United States Patent 8,216,786 (GENETIC POLYMORPHISMS ASSOCIATED WITH CARDIOVASCULAR DISEASES, METHODS OF DETECTION AND USES THEREOF) - sequence listing, part 2

SEQ ID NO: 1022 - DNA, 106206 bp, Homo sapiens
gccaaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagctttgccttggtggctggggcttgattgggaaggaggggattaccagcttactgggtgcccatgctgatgtctaagtggtgaccgcagcagtacccgggaaccccaacagttggttgtcttgtcttccagggtgcaggtcactgagtgacttccccagggtgcacagcgagtaacagatcaggacccaaacttgggcagtctgggctgggagcccacaccccactcaccagttctgctgcctcaggtcaggccagggcagtgctgctgcagagctagaaggccctgcagctacagctgcttcattccctgcattagtgcctggttactgggtacctcctgagtggctgtccccgttccagaacttgcatacactgagcgggctacagagctagaaggccctgcagctacagctgcttcattccctgcattagcgagcagttattgggtacctcctgcatgcctggtcccattccagacaggggcctctggcctggctgagttcacagcccagtctggggacagctgggtatgaggtgcttacggcacagtgtccagggcagctgggtgtgcagggactgggggctcccggaagattttttggaggaagtaacagctacgatgggatgggaacagtggaccctaagcaggccaagggtgcgtagggacggtggtacccagatgcccaagtcttccaggcaatacctggctcaggcccagccccaatccatccccttactttctgccatggagttccagcaggtcactctccctggcacaccttccaggctggatttttaatgaaacagactcagggaggtaggggctggcagggaccctagaatccttgtgatttttcttagcaccttatgtcagggaaacctaaactgaggtcagcacttgggcccactgacagtgactgactgggggagaaggtcctgcagcccccttcccctgggtgtgttctggggacctgtggtttgctggcggaaacaagtgatgaggctggttagcggatgtgggaggctgtgaccccagggggccatagggtgcggtggaactgcaggccctgcagatgacggcagccagctgcttccaggaaccaggtgtccaaggccacctctgcaggggtttcctcttcagcctgcctggggtgagaggtcagtgcaccacagccgaggctggagcacagggagcttctgttgttctgatctatctctggaaaaccagccattcctcctccctgcagtcagaattctttgccctgtctgacctgaacttgcttagggagtcatgccactccccactgtggccatagtttctcttcctgtaaaattttattattttagttttttgtttttgagatgtagtctcaccctgtcgcccaggctggagtgcaatgccgtgatctccgctcactgccacctccgcctctctagttcaagcgattttcctgcctcagcctcccgagtagctgggattccaggcgcccgccaccacgcctggctaattttttgtatttttagtagagacgggattttatcatgttggccaggctggtctcgaactcctgacctcaggtgatctgcccaccttggcctcccaaagtgctgggattacaggcatgagccactgtgcctggccccttcctgtaaaatttttaaatggagaattgggtgcgagatgtggtttccagcctggtgcctggggtgctgagctagtgagtggtgcagtccaggacacctttgctttatgtcacttacacggtcacctggagccggctcaagtggctaaagcatcctggggcccagagccaggtgataggtccctctggccaactggacagttgaggcctgtggttacccgaagcccagctggggccctggtccagcctcgcctcccagactctgcacctgctagcacagctgtccacgtctgtgtgagctgctctaggccgagggcctcagtttcaagagtgtgttggggtgggatggggcaggccgtggtcctccagcatgaagaaggagccatgaggagttcccatgacctcccgagacttgccataagtgttctagtccacatataagggtagggttgggattaccatttactgaccacatctgtgaggtgccgagctgggtgcttgacatcatttgcttggagaagcagctgctagtagacccattttacaggtgagagaaccaagtctcacagaggcctgggttcaagtcccacctctgccactaactggcatgtgaccctatctatccttcactgctctgagcctagaccctggcccctgcctggctccctgccaggctccctgccacccctcacgacctctgatggtcgttgtgggggtctcttgcctggctcccagggctagggttagggctctggaggtgctttcactcaaccaagggggccacagcactggggagtgaaactgccccgcctcaccctgcgttgccctctgggtctgtgagggtgggctggcaggaggcctaggccttgccctaggggcagtcctgcttcctcattttatagatagggaaactgaggctttgggaggactcactgacatacctaccttcaagatgagttcaggtgggctcagttctggggcttgggaaaagggccccagtggctttgggaagcacccccagcccagggtgaaacatgcttcttctcttcctgtggttccatccgaaggattgtggtgagccccgtgccttcagttaataaagatttgtattgtgaaaagattttttcttttttttttgggacacagtctcactctgtcgcccaggctagagtggattggcgtgatctcggctcaatgcaaatctccagggttcaatcgattctcctgcctcaccctcccatgtagctgggattacagctgcctgccaaatttttgtatttttagtggaaccggggtttcaccatgttggccaggctggtcttgaactcctgacctcaactgatccgcccaccttggcctcccaagtgctgggattacaggcgcgagccacggcgcccagccttgaaaagatgtttttagaaccagaagaaacctcggttcccactgatccttctgggccacgttgtgcggagctcccctgctggttggggctcagcgcagccccagggaggtgcttcctgcacctcaggatgggcgagggtgggcattgggggagagggggacctgggacctgcggcttagttccctgaggcaggcagggcttattggggccatttcatagaaaggcagattgaagctcagcagggaagaggcttttgagggtgatccaggcgctggagggatggcctaggacaccagggtcacaccaggaacatgggagggccgtgcttgtctctagacgaggggaatgggggaagggccacaacctctgtttctgtgacccagcagcatcaagcccctcgctgggcacctcgcacacaccccctgccttatctctgcctgcacgccctgttccctccacctagactgcctgctgagggggcagtgccaggaggttgcctgtccttggggaagaggggcagtgaccctgtgaagatgcttgacagacaacccccaccacctcagaagtgtgtgtgagtggtgaacccttttaagccatcttccagccattctcactggagggagatttgatgggtacagagcagacccctacctgtctaccctccttcggacccctaggaagcttcgcaggccttccaggctgccagacagctgccctggcgttgccgtctgcttcttccctggccccactctgaggggctcagagctgaggcagaatccctttttcattcatttcctgcagaataaaacaacatacagaaaagtgaataaaacataaatgcacaacctaacacactgttaggaagtgaacgatctgcaaccaccatcaggaaatagttttgccagcacccaagtgccctcccctcacagtgtcacttccggcctctctgccctggcttatgtgagtcttgtgttcttgtttttctaaaaagtcttcagcacccaattatgcaggcattgcagtattttcctgtttctgtgctttatccccttgaatcatacagatgcaaattctggcagctggcttctttggctcgttattatgtctgtgagatttattcatgttgctgtgcgtagtatagtttgtgcatgttcattgctaaaaacttccattgtttggctgtatcgtagttcacagattcatttcactgtcagtcaagcttgtccaatgcatgcagcccaggatgcctttgaatgtggcccaacacaaatttgtaaactttcttaaaacattataaagatttttgtttgcgatttttttttttagctcatcagctatagttagtggtagtgtattttatgcgtgacccgagacagttcttccggtatggtccatggaagccaaaagattggacatgcctgctgtagatggacagttggtttgtttctagtttggggtaactacacacaatgctgctagcaacagttttgtccatgtctctgatgcacgtgtgttttttgcaaatggtgcacaaatttttctagggtttgtactcaggagtctgactcctgggttctagggtatgaagatctttctaaatattgttctagtttacgtgcccaccagcagtaaaacagaattcccttgccttcccatccttggcagacatttcacttttgccagtctggtggggtgtatagttatggccttaatttgcatttagctaattaccaaggagattgagcatatttttatgtttttattaaccattttgattttgtctcctgtgaagtgtctatcatcttttgcccattttttaacttgttgtctttttctttttcttttctttttttttttttctgagacagggtctcactctgttgccctggctggagtgcagtggtgcaatctcagctcactgcagccttgagtcaggctcaggtgattctctcacctcagcctcccaagtagctgggaccacaggcccacaccaccaagcccagctaattttttgtatttttaagtagagacgggtttcatcatgttatgcaggctgctctcaaactcttgagctcaagcgatctgctggcctcagcctcccaaagttgggattataggcgtgagctaccagattttttcttattaatctaataattctttgtatagtcttgatattatccataatgtgtattgcaaatatcttctctaactctggcttgactgtttatggtgtcctttttttttggggggggttttttgagacaaggtcttgctctgtcacccaggctggagtgttatggcacaatcttggcttattgcagcctcaattcctaggcttaaacagtcctcccacctcagcctcctgagtagccggaactacagtcacgcacttccatgtccagataattttttttttttttttagagataggatcttactatgccccagctggtctcaaactcctagactcaatgagcctcccatcttgacctcccaaagtgctgggagtacaggcatgagccactgtgcatgccagttcttatttttaatgcagttgaattgatcagtgttttcattttggttagtgctttttgtggcttaagaaattctttccaggctgggtacagtggctcacacctgtaatgccagcactttgggggcagaggcaggaggattacttgagctcaggagtttgagaccaacctggacaacatggcgaaacaccatctctacaaaaaatacaaaaattagctggacatggtggtgcgtgcctgtagtcccagctactcaggtggctggggtgagaggattgcttgagcccagaaggtcaaggctgcagtgagctgtgattgtgccactgcacttcagcctgtgagacagagtgagaccctatctcaaaaaaaaccaaaaaaaaaaaaaaaaaaaagaaaaccactgaaattatttccactccaaggtcatgaagatagtctcttagattatattctgaaatccttataaatgtaaatttcatatttaggcctttaattcacctagatttggttttttgcatatggtgtgaggtaaggattcactttcatttttttctctccatagggttacacacctgtcctatcattgtttgtaatctaactttctgcgcccatctgcaatgccacctctgtcatatgtccacatatgacatatgtagatctgttgttggattctttcctctgttccattagtctgtctgttcttgtgccaatatcaagctgtcttcattattatcaattatgtattgagatctgataaagtaagtcttttccaccttatttttcttctttgagagtgtcttgactattctggctctttgtattttcatgtaaggtttttctcccatataagttttaaaatcagcttgtcaattccaacaacaatgatgcacttgatagtttgggaatttattatagctatcaatcagttttgggaaaattgacgtctttacaatattgagttttctgattcatgaacatggtttacctctctttccatttgggtcttctttaaggtttaccaataggattttatatttttgtccattgtggtcttgcttatcttaagtttgatttgtaaatattttatgtttcttttagtctattgtaaattgtgtatttttaatttcatttttttttttgttaatagcatataaaacacaccttgtcttttaactggagcattttgtccattgtgtatttaatgtaattaaatctaccatcttattttatgctacatattgtctcacttgtgtttgtgttttcttcctcccttttctctccttttccccttctttgagattgagcaacttaaaacaaatcatttcatttccccccttctcctagttagaaagttaaacactctctattcttactgaagtctagagttaactaataaatacttttatcctcctcctggacaacataaggacctcaggtgactttcattggtctccctcattacttgatattattgttgtatatatctaattctaactcaatgtattttaaaactctcacctaagaccgtatttgtttttttgtttttttttttttggaggcagagtctctgtcacccaggctggagtgcagtggcgccatcttggctcattgcaacctccatctcctgggttcaagcaattcttgtgcctcagcctcctgagtagctggaattacaggtgcctgccaccagacccagctaatttcttgtatttttagtagagacagtgttctgccatgttgtccatgttgatctcttaactcctgagctcaggcaatcctcccgccttggcctcccaaattgctaggattacaggcaagagccaccacgcctggacctttttacttttttgtagttggaaaaggaaggaatattttaatagctttaaaattgttttattatgataaaattttcatattataaagtttatcattttaattattttaaagtgtacagttctgtggctttgcgaatattcatattattgttcagtcatcaccaccatccatctccagaactttttcatcaccccaagcttaaactctgtacccattaaacactaaatccccattcctccagccctttgcaaccaccattctacctcctgtctctctgaatttgactactctagacacctcatacaagtggaatcatacatttatctttttgtgattgggttatttcacatagcatgtcttcagtgttcatccatgttgtagcatgcgtcagaatttcctttcttttggccaggcatcgtggtttatgggtttatgcctgtaatcccagcactttgggaggctgagtttggatttgggaagattgcttgagcctaggagtttgagaccagccctggcaacatagtgagatcccgtctctacaaaaaataacaaaaattagccaggcatgttggcacgtgctggtagtcccagctacttgggaggctgaggcaggaggatcccttgagcctaggaggtcaaggctgcagtgagccatggttgcaacactgcactgcagcctgggcgacagagaccctgactccaaaaaaaaaaaaaaaaaaaaaaaaaaggcacaaaaccccaataaatagaatttccttctctgcataatgctgctatgaacatggtacaaatagctgttttcatttctttggggtatatatccagaagtggaattgctggattatgtggtaattatgtttaattttttgaggaaccactctacggttttccacagcagccacaccattttacattcccgtcagcgatgcacaaagggttccaatttctccgcatctttgccaacacttattttctttttttcctcttcttcctccttctccccccttgaaactttttgttttcttctcgtttttgtagagaacagggtctccttatgttgtccagtcaagtctgccaactcctgggctcaggctatcctcctgtttctgcctccctaagtgctgggattttaggctgaagccactgcgcccaactccctgcttcttcaactgccatcctaatgaatgttaagtggtatcccacagtggttttgatttgcgtttccctagtgattaactatgggaagcagaagtgaatgagacagaattgtgatcttgtcagaaaaatcgtcttggaaaagccaacgtccaacagaaatggttagaacaggggtcgctggcttccatccagacagtatccctgacccttgttggggcaatgtcacagaggctcctgctgagcagggaggtctggattccacactcttctgccactgcccagctctggacctaagctttctatgggtgtcaagaggacaagcagccgtgcccatttgtctcgctgcttgtttttttgggtgtcagatgcgccagcaggagggacagtgtgcgggaaggtgctggtctgaggctggtcctgccaaagccccgcaggctcactccctggtcgtgcggaggtggctggtgctcgctggtctcctcagcacccgcaggccgggcccgggggccaggcagttgtcctctgtggagccttatcggggcccacaggccctgctgccttgaccccacccgggccccaaaactcggcctggggactgcacaaggcggggctacgcggggcagggcccgtctgctgggggagtgcgctgggcggcggcgggagggcagggtccctgggctccgacagcccctccggcggaggtcaatcacaatgaaaccgtgtccagcggacccggcaggggctcgccgcagtctacctggccaccgtgaagccatgacctggcgcccgaagctgccggccggggtgtactccgcgcgggaccctgggcctccgcaggccccggcggggtcgccccgaggcgggcctggcgagtccaatcgccctgcccgcaggggacccgcccctcatgggtcccgccaatcgcagggtacgttgctcggcagtgctgcgcggcttggcctatgggacggcgcgttgttgggctgcagcgccgcaggccgcacccaggtcgggcggtgggggcgagcggaggggctgaggggcggagaggcctggcgggccgctgctgcgggccaggggacgggggcggagccggagccggagccgacgggcggtggccgcactgggaccccggaatcccgcgcgctgcccacgattcgcttctgaggtgaggctagctagcgggggcggcgggggcccggttcgggctgaggcggcggcgggggcgcggggaactgggccgcggttgcggcgggcgggggccgcggggcctgcggcggcccgggcagcctcgggggcggggaggccgctgcggcgccgagggcgtcttggaggggtccccgcggggccttcggcctgggccgagccggggagcgagggcgccgcagatctttcatcgggataggaccccggggactaggcttttcccgggccgctcgttcctggccggcttgtgggctgcaggggtgggggcggaggaggacgaccctggctggacgctggtcagcatcctgcttgtgagaccggttccgcggtccgcagcgctggtggctgcaaggtttgtgtacggacgcatctgtcggctctcgtatttaaaaacgacggcttctgccaaaagagaaaagccatatctgccgacggacgctcgagagataatcgtggaactttatcagcgatggggctgttggtcacctttgccctccctctcttttcttttttcttaatcttttattttcgttttttgggagatgtcagagggcctttccctgttaggatgacttttatctttgctcttgtaatggctcaagatagttgggaggtaatttgcattcactttatgcatacccaccttgaaaaacgtattttggttcgcctgaaactgttgttggtttgagcataatttatgtttagaaagacaaaaagcaattgtcatatctccaaagaccaaagacatagctgatagctgtatgcattactggtaagttaaagaaagattttttgtgtgaaaaattgactgagatcttaatggggataggaaatagaatgctgataggtcgactgtgtctatgagtagaggcgcctagtgaaaacaagcttggagtggatgagtaggagttcaacaggcaccagagagaggagggcatttcaggcagagggtgtgaattgtatgaaagtgagtttgtaaactttggagccttgaatggacaaaggcccgcgatgataccttttttttttgagacggagtctcgctctgtcgccaggctggagtacagtggcgcgatctccagtcactgcaatctccgcctcccaggttcaagcaattctcctacctcagcctcccgagtagctgggactacaggcgcgcgccaccacgcccagctaatttttgtatttttagtagagacggggtttcaccatgttggccaggatggtctcagtctcttgacctcgtgatccgtccgcctaggcctccaaaagtgctgggattacaggcgtgagccaccgcgcctggcctacgttaaaattttaatatactcctttgattttgacagtggagaaaactagaatagtaaagttgtcttttcaggaagtggatgatttgggcagtcaaaactgcttttcagagtttcgatgtggtttacaatggtatggacagctggtatgatttgttagttttctacttgtggtgtctttaggttttaaagtttcggagagtcgctgagtgatgtgagtctaaactctagccagtccccgaattgtgagatagttttccttctaaaatatacttcgtacaagctggtcatttttccccttaattcttttgatgttatctgatatactgagaaggttttgtttggtgttcagttttgtgttactgattttgccataaaaactgtttatttacatgatttttagtttttagttcttatagtctttgaattgaataagaaaagtaaatactgaaatgctttgaaagataacaaaatatttacttattgcttgaaacttagagttagattgactgcccttcctttctttccttccatgtttacctcttaacatatacacatatgtagagagaatagtataaaccccttttctcaaccagtttcaacagtcaatcttgcttcatcatatccccgcagtcctagatatcctttaaccgttaaatagttcaatatgtatatcttaaagacttaaacaaaaggtaaacatgagtaccactatcacagaaaatgaataattccttaatactttcaaatatccagccagtgttaaaattgtcagaattctcattttttttcttaacaatttcaatcgatccacatgctatctatacagtgtgactcattttaattgatagtttcccctccatatttagttttctcttgtaatttatttatggatgaaacctggtagtttgtcatgtggagttatgcacagtctcaattttactctgtggcatagtttcacagaatttactgaaaactggtggttagatctaaaggtatgatcagattcagctttacttttgtcaagcaaacttcttaggtaagtaggcagaaatgattagtagtctttgttcgcagcccttgattgtcagtgcctacagtcatttcagcaagcattgaatatattgatatttgaattctataacttcttttattaaatagaatatttttataaagataatttttcatgcctccactatttggttatcttgaggtatctcttacagaaaagggaggataaatgcttaattcttctccattatttactaggtttcacataatgaattgtttcgctaatatccttcaaaagtagccaatgaagctgggcatgctaggatgggcctgtaatcgtagctgctcctgaggctaagatggtacgaacctgtgagcctgggaggtcgaggctacagtgagccatgatcacttcactgcactactctgtctctttaaaaaaaaaaaaaaaaaaaagccgagcgtggtggctcacacctgtaatcccagcactttgggaggccgaggcgggcggatcatgaggtcaggagatcgagaccatcctggctaacatggtgaaatcccgtctctactaaaaacgcaaaaaattagctgggcgtggtggcggatgcctgtagtcccagctactcgggaggctgaggcaggagaatggcgtgaacccgggaggcggagcttgcagtgagtggagatcgctccgttgcactgtagcctgggcgacacggagcgagactccgtctcaaaaaaacaaaaacaaaaacaaaaaacaagctaggtgcggtcgctcacaatcccggcactttgggaggctgaggcaggtggatcgcctgaggtcaggagtttgagaccagcctggacaacagtgaaacctcatctctactaaaaatacaaaaattagctgggcatggtggtgcatgcctgtaatccccactactagggaggctgaggcaggagaatcgcttgaacccaggaggcggaggtcgcagtgccattgcactccattctgggcaacaaaagcgaaactccgtctcaaaaaaaaaaaggaagtaagactaggattctactcaaccttctcatttttatatacctgtatctacttttcttctaagccaaacattttggttctacttgctcactgtttcaacccacaccgtacacatttcagtctcagaacaagatgaacacgtgaacctcgaaaatttgagacaggtctcggttaacttagaaagtttattttgctagtgttgagaatgtgtgcctgtgacacagcctccagaagtcctgattgacatgtgcccaaggtggttgggcacagcttggttttatacattttaaggagacatgagacatcaatcaatatatgctagaagtacattggttcagtccagaacggcggggacagcttgaagcagggagggagcttccaggtcacaagtaggtgagagacaaatggttgccttcttttgagtttctgataagcctttcctaaggaggcaaccagatatgcatctatctcagtgagcaaagggatgactttgaatagagtgggaggcaaggctgggcatggtggctcacgtctgtaatcccagcactttgggaggccgaggcaggtggatcacctgagatcaggagttcgaggccagcctggccagcatgatgaaaccctgtctctactaaaaatacaaaaattagtcaggcttggtggtggatgcctgtaatcccaggtactcaagaggctgaggcgggagaatcacttgaacccaggaggcggaggttacagtgagttgagatcgtgccattgcattccagcctgggacagagtgagactccgtctcaaaaaaaaaaaaaaataggaatcttaacatagcataatattaaactttaatagagttgtttaattgttaatgcttattctggcctttctacattgaggaaccttgagtttaaaggaatgaggggaagcacatttaatacagtttgccttttgagcttaatttttctagaagtacctttttaaacagttgttataactaatgtgtaacactgtttttgataactgtcagcttaaacatgttgagcatatatttatttaattaatttattttttttgagacagactcttgctctgtcacctaggcgggaatatagtgatgtgatcatagtttgccgcagccttgaactcctgggcttaagccattctcccacctctgactctgaagtagctaagactgcaggttcatgccaacaggcttggctaatttttttttttttttgagataaggtttcaaaagcctgagctgtgttgctcaggctggtcttgaattcctggtctcaagtgatcctcctgtctcagcctctgaatatgctaggataacaggcatgagtcactgcacctgacctgtttccaggtttttactgttataagcagtgctccaattaatattacatctccatattgggcacttatgaggtacatctataaatacattctcagaaatgaaattgctatgtcaaagaataattgcacttttcatttgcatagacatttccaaattaccctcctggccccaattaatattcttacatttccatctttgggcacctatgaagtatatctatagatacattctcagaagtgagattgccatgtcaaagagtaattacacttttactttccgtagatgtttccagattatcctcctaagaagttacgttggtttatactcctaccaactgtgtattttctccacataattaagtatggacactaaagtaacaatagtccctatcttacatggttattgtgaggattaaatgaagtaaatgccaaaaggtacctactaagctgtcagcaaatgacttatattattaatataattattgtttttttctgaactttattaccagaaatattataaacctagacagtgcttcatgaggttgggaaagagggttcatacaattgatctgagcaatatatgcctccaaaatactgttatctgtattagaacagacgagctctgcatctaggccttgggcccagggagtctggcatctggggctgacgttaggggacagagtccacaggtatatctcaaatttgctggaaagggcatgcctcaggaatggggcgcagtagatgtaactacatgtgtgcctctgcagcctggaatggcagctgtggctgtttgcatggggaggagaaagtcatcatttgggagggacctttagaatatcccatcccaaacacttctctccttctcttactctgaagggcttaatttaaatttgctttgtggattaacgtattgagaatgatttagggagttccttacctaaaaaatgttttccctcatctgcacactgtcgcttgaaatttatttcacaggagagggagccgtaaccataggcagtgtggtattatgaaaggagtactggctcttcactatgggtttactgtggtttgctgagggtagttgagtgggtgagaaagtcacttagctgccccaagcctcacttttctccatcggaaaattaagtagccatgtaatacatgaaagagagaatgttgtgaaaacactttgagaatgcaaaggccaagtgaaaacatatgtccgtacaaaagcttgtgtgtgaatgttcagagcagcattatgtttaacagacaaaaagtgaaacaccccagatgtccatcagctaatgagtggatcaacaaaatgtggtctgttcatacgatggaatagtagttggcaatagaaaggattgaagcactcatacctggtacaacatggatgaactctgaaaacatgctaagtggaagaagccagacacaagagaccatgtgcttcatgattttacttatgtgaaatgtcttcaataggcaaatctttttgttttttgttttttgtgagactgaatctcactctcttgcccaggctggagtgcagtggtgcgatcttggctcactgcaacctccacctcccaagttcaagcgattctcctgcctcagcctcctgagtagctgggaacaggtgtgtgccaccatgcccggctgatttttttttctgagacggtgtcttgctctgtcgcccaggctggagtgcagtggcacgatcttggctcactgcaagctctgcctcccgggttcacgccattctcctgcctcagcctcctgagtagctgggactacaggcgcctgccaccatgcccggctaattttttgtatttttagtagagatggggtttcaccgtgttagccaggatggtctcaatctcctgacctcatgatccgcccgcctcggcctcccaaagtgctgggattacaggcgtgagccaccgcgcctggccacgcccggctaatttttatatttgtagtagagatggggtttcaccacgttgcccaggctggtcttgaactcctgacctcaagtgacccacccgcctcggcctcccaaagtgctgggattacaggtgtgagccactgtacctgacccccagtaggcaaatctatacaggcagaaggtagatttggggttgactggggctccagctggggagaatggagtgggaatgaggaatgactgctaatgtgtatggggtttctttttgggtgttgaaaatgttataacgttagattgtgatgattagttacacaactctgaatacactaaaactctgtatacttcatttagagacagtcttgctctattgttcaggttggggaacagtggtataatcatagctgactgtaacctggaactcctgggctcaagtaatcctccccacctcagcctccggaatagctaggactactggtgcataccaccacagctggctaatttttaaaaatgttgccactcaagatgtgtggccctggatcaaaatggtgaaattctctgaactaatttttctcatctgcagaaataggagtaataataataacagtcatatctaactggaggtgtgaggctgtggtaagcaaacttacaatgcttacagtatgtgaggattctgtcagtgtgctttctttccttcttttccagaacatagaggatggaggagcaggccttaagagggaaagacacagaagatgcaatagagagccttgtagctcttttttgtctgtctctccctctctctcaaaataaagcctatgtagaggtatttttttgtctgatacagctgcatgtgtttgcagtttagtaggaactttgtggttaaaccatgctttctaagattttcttaaaaggccaaccttgttgccagatgataccattaatcaagttattcaagttattgtcacatagggcttcaggcaggaaggaaggttaggaatggtctttagtctcatagaatgaactcccttttggtctgagtgtctccttcagtaggaagggatgtgatgttaattgaccagtctttaggggggaaatagatgacccccaccatccggatactcagtttttattcttttttttttttgagatggagtttcgctcttgttgcccaggctggagcgcaatggctcgatctcggctcaccgcaacctccgcctcccaggttcaagcaattctacttcagcctcccgagtagctgagattacaggcatgcatcactacgcccggctaatttttgtatttttagtagagacggggtttccccatgttgaggctggtctcgaactcctgacctcaggtgatctgcccgcctcagcctcccaaagtgctgggattacaggcatgagccacagcacccggcctcttttctttctttctttctttctttctttctttctttctttctttctttctttctttctttcctttctttcctttcctttctttcctttctttcctttctttctttctttctctttctttctttccttccttccttccttccttcttttcttttcttttcttttcttttcttttttttcttttcttttctttctttttttttttttttgaaagagagtctcgctctttcgcccaggctggagtacagtggtgcgatcttggctcactgcaacctccgcctcccgggttcaagcgattcttgtgccccagcgtactgagtagctgggattacaggtgcacagcaccacacccggctgatttttgtgtgtttttgtagagatggggtttcgcagatactccatttcagtttttttctgagcaacgtctccagggactgaagcacacatactttgacaacagaatcaccagcaatgtcactgacctagggtgtctgcagcattcagtgtcttctattttctgtactaggtgttttctgtactgtttgtaaagcaggaaatatctttttttttttttttttttggagacagagtcttgctctgtcacccaggctgaagtgcagcggtgcgatcttggctctcactgcagccttgacctcgtgggcccgagcagtcctcccacccagcttcctgagcagctgggcctgcagacccaccccaccacacccagctaactaaaaaaattttttttttagtagagccaaggccttgctatgttgcccaggcaggcctgaaggtgcttttaaactcagataagcaggacatttgtagctgtggaaatagctgtaatctaaccatcagagttgttttaaggatacaaattacatatagtgtttaaagcataatgaatgtacaggttgctagattgggttttactctgttctttctgtaactttttagaagttggtcacttactttttttttttttttttttgagacaggttctcactgtgttgcccaggctggagtgcagtggcacgatcttggctccctgcaacctctgtctcccaggttcaagcaattctcccacctcagcctccccagtacctgggattataggcgcccaccacacccagctaatttttataattttagtagagataagggtttcaccatgttggccaggctggtctcaaacatctgacctcaggtgatctgcccacctcagcctcccaaagtgctgggattacaggtgtgagccaccggcgtctttttctagtataagtgtttaaggctatatagctctctagaagcatctctttagtgaagccaatagtttccaactgtaatatttttgttagtaatgtatatttaaattttcattatgatttcttttttggcccataaattattttaaaatgtacctttaaatttctaaatatatggtttgaagaaactcttctgttattatgttgtttttttttctttcagactgagttttgctctcgtcacccaggctggagtgcaatggtgcaatcacggctcaccgcaaccttcgcctcccaggttcaagcgattctcctccctcagtctcccaagtagctgggattacaggtgcccgccaccacgcctggctggtttttgtatttttaatagagacagggtttcaccacattggccagggtggtcttgaactcctgacctcaggtgatccacctgcctcggcctccaaaagtgctgggattaaaggcgtgagcgaccgcgtctggccgttattatgttttaattgcattgcacccggagaaatggcttgtgtgctgctgattccctggaatttgttgtgattttctttattgccagatatgacatgaatgtttataaacattccttgtattctaaagaatatgggctgggtgcagtggctcatgcctgtaatcccagcactttaggaggctgaggtgggcggatcacctgagatcaggagtttgagaccagcttggccgacatggtgaaaccccatctgtactaaaaatacaacaaaattagcccagtgtggtggcacacgcctgtaataccagctactcaggaggctgaggcaggagcattgcttgaacctaggaggcgtaggctgcagtgagccaagatcatgccactgcattccagtctgggcgacagaatgagactccatcttaagaaagcaagcaagcaagcaagaaagaaagaatatgtatttaatttgtgtgagaaagggaggtgcaaggttctgtatatctctaatgatctaactttttgcttgcattgctcatatttcctatttactgttactgacttgagcaatgtggtagattattatggtaatctcattatggtagatttgtcagtttctctgtgagttctagcaatttttggttcatatatgttgacagtattttattaggtgtgaataaccttatacttttcatcttcctgttgagctgtacttaggtttatggccttttccattccgaataaatgcttttattttcttggtcttcattgtctgatattaatataattactccagctttgttttgtttggtgtttgcctggtatttgtatttttgtccatttattttcagactgtctgtgttctgtttcatgggtatattagttttttgtggctcctgtaacaagttaccacatacgtggtgctttaaaacagcagaaattattctctcatagttctggaggccagaagtttgaaaacaatatcactggaccaaaatcaaggtgtcactagggctgtgcattcttcctctggaggtcgtatgggagaatctgttcctcgcctcttccagcttctcatggctgccacattccttggctgtggctgcatcactccaatctttgtgacccaggtcagattggtttcttgtcttctgtgtggttaaatctcccccacctcgattttataaggatactggtgattacattcagggcccacccaggtaatccaggataatttcacaatcccaaaatacttaattatatctgtagtctttgccatataaagtaatatttacaggttccaggcattattcagacctgttaacttggggaccgttactcagcttactaaaagagtgtctcttataagttacctgtaatttctgtcttttaactggcataatttagtacatttatgttatgattcagataaatttgtactttctttatcatcttaggttttgtattctgtttgtcttttctccccatgcttgcctttttaaacaactgggagttgtttgtttttctttatattcttccatcttttggtttggaaatgacatactcttaatattcttttagtgattacccttgaaattttgctatgcatatttaacgaagtctaaaactaatattctgtcgccctcctagatacagcaaaggcatgaaagttctttaattccaattattcaactctcaagttacatgctgctgttgttcagtgttttagtccagactttttttttttctttttaaagagacacagtcttgctctgacactcagactggagtgcacaagtttttttcttttcttttttttgagacaggttctcactctgttgcccaggctggagtgcagtggcgcgatcacagctcactgcagccttgacctcctgagctttagtgatcctcccacttcagcccccaagtagctgggactacaggcacatgccgccatgaccagctattttttgtatttttttgttgaaacagggttttgccatgttgtgtaggctagtctcaaactctgggactcgagatctgcctgcctcagtctcccagagtgctaggattacaggcgtgcaccaccattgggcatggtggtgcatgcctgtagtcccagctactcggaaattatttcacacaagttcttttttaaaaaaaaaaaaaaaaatagagacgagtcttactattatgttgcccaggctggtcttgaattcctgggctcaagtatcctcccacctcagccttccaaagtgctaggattacaggcatgagccaccactcccaaccttcacctaagttcttgaaagataattttgcttgatatagaaatccagattgacagttatttcttttcagcattttggagttatcctactgctctctacttttgttgtttctgttggcaagtttggcagtagtcggtttgttattcccttgtaggtgatctgtctttttttcttctggcttctgttagaattttcttttctttattttggccttggctattctgcatattcattacaatgtgtgtaaggtatggatttatctttatttattttgcttggtttttgtagattcatgtctttcagctctgggaagttgtcagccattttcttttggaatatttactgttccctatttattatttctgcatgttactcaagtaaatggttactagagttttttttttttttttttttttcctgagacggggtcttgctccgttgctcaggctggagtgctgtggcatgaactctgctcactgcaacctccacctcctgggttcaagtgattctctcgtctcagcctccaagtagctgggactacaggcgtgcaccaccatatctggctaatttttgtatttttaatagagatggggtttcaccacgttggccaggctggtctcaaactcctgacctcaggtgatctgcccaccttggcctcccgaagtgctggaattacaggtgtgagccaccacacccagccaacgttcttattctgttattttttattttttattttttttgagatggagtcttgctttgtcgcccaggctggagtgcagtggcggcatctcagctcactgcaacctccacctcctgggttcaagcaattcttctgcctcagcctcctgagtagctgggactacaggctcatgccaccacgcctggctaattttttgtatttttagtagagacagggtttcaccatgttagccaggctggtcttgaactcctgacctcatgatctgcctgtctcagcctcccaaagtgctaagattacagacgtgagccaccacacccggccagggcaattttttcaaagctgtgttttaattcgcaaattcctctttgtatctaagctgttactcattttttgacctaaaaattcaatttaaatttcttttattctaaaagttagcaggtgtggtggtgctcctgcagtctcagagtcccagctactcaagaggctgaagttagaggatcgcttgagcccaggagtttgagaccagtgtgggtaaatcgaaaccctgtctctacataaaatacaaaaattagccggacatgatggggtgcacttgtggtctgagctactcaggaggctgaggtgggaggatcacttgagctcaggaggtggaggttgcagtgagctgagattgtgccactgcactccagcctgggtgacagaatgagaccctgtctcaaaaagaaaatctgagtggtagggattttcaagtatttgccttagttgaggtctccaaatggaaatagtgattgggcactagtttaaaatgtacaaaaggtgtattcagtgtgaggttggttccaaagtgcacggtttgacagcccagggagtgagtgaggtgtgttggtgtgttttccatgatacaggggaactgactccagtatggccagtatacgagactttggtaaaatcattactttgttctggaactctattttagcatctgtaaaatgacttctaaagttccttctggggcagaaaatacatgcttctaaggttctgtctcattgctttttttttattttagtaatttaataagcatttatttaagatctgctgcattcagagcattgtgttaggaatattggaagtaaagcattgtaatagctcttgccttcagtaagcttgcagtctggcagttggattaaaaaaatgaccatacgaagccgtgataacagcctctaggagggaactctactatgtggtggagatatgtgtccccctgcaaataccaagaaagacagttaattagtgtccattacagaatgttcttctggtgtcctttttaaagagattcagtcagtctttaaagatgatgctattgctgctactgctaataataatagtgatagctaccacttactgtttactatgtaccttgtgctaaacacttgacataagttaactcgtttaatcttaaaccaaggaagtagataatgattctcattttacagatgaagaaactgaaatagacagagatgaagaaatgtgcctaaggttacgcggtttagtgaactgggatcagaacctgggttctctggccttagactataaaccatagataggaattgagcacatttattaatcagcattgcaaggctggtggaattttgataaacacccaaaccagattcttttctgcactagtgataccagacagattttggaaatataaacaggatagggtgcattaaagttcactcacatttgttcagttaaacagatggttggcttatctttagttgcttcactcagtcatttccaaaaccacacccaaggccaggcagtggctcatgcctgtatttctagcagtttgggaagctgaggtcagaggatcacttgaaaccaggagtttgagaccagccttggccacgtagtgagaccatggctcaacaaacaaagaataataaacatatttactattatgggacgtctatgtgccagacattgtgctagacattttacatttattatttctaattgccccaacaacctgggaacatatcaccgagtgtattttattacaaatgtggaaactgaagtacagaagacaataagcctatgaagtgatcgtagggcgttgctggtacaaagtcaaaacctgcatcattgggccctgcgcctctatgtctgtggggagaagggattgttgatgatgtgatagctggaaaacataccattcatcaaaataaatcccaggtggattaaaaagaaatgtttaaaattatagaggcactgtggagaaaaagcaaaataaaatgtttatcagagataacgccttaacattttcttggaacattttattagatgtgtgcctgggaaggaatgataactttctttttaaaaccagaagaaatcacaaaggaaaaggtttgtcaacctaaatatgcaaaatgttaaaatattttcttattgaaaaataaaattatagaagatagtagtctgagaatgacaaatatgataaaagggtcaatacctgtactatttttttcagatgtgtagaaataaatacatcaagatctcaacagatatgtgtacaaaggaaatcataggccatgggaaattttaaatgtaaataagcatataaaaaaattcatgctcacatactgagagagatgccaaataaagtagacatttctacactccagccttggcaaccgtgagaccctgtctcaaaaaagcaaaaccaaagcagacatttcccatctaccaaaacagagaaattttagtgatagcctctgcttccttttcggagtatgtaagccaaaaggaaatgaaactttttatttaatcctcacccattttggaggttttctttactgtaaggtttcctttccagtgtcaggcttaaccttcaagcagttaccactttagacacattgtttgctgccatttcattcagcagctgcgttattcataagatcactttataatgacatacttttccatcttactgttttataattattaaatggttcccctgatattgctccattttttttttttttcaggagaaacattctcaggttagtactgttaatccctccttacgtgtttaattagattatagagtgttggttttttccttccttataaaatcttacgtagagttttctatactgatgtgtctggtcaacctgtgcttcctgacttagctgagtcttcctgcagtctttatggggtttcataaagtgagcaggtaccatgctcacttagttataacttccctgaggtctagaaatctccttttcttcttttcttattgtcctacctctgggagttgtttgtgtgagctttagtctccaaatcgagtcatctagaggcagacatactagctacgtttgctttatcaactttgggaattgacgtgattttggaaacataagaccttcttaattcagagatacaaaacccaatttgatatgcagattgtccatttgcagtctggaatttccttgtgagtggcgaacttgtgagtgaaatttggagtgttttagtttgttgctgtactccaagggtctcttcagtcggacgtcagttgtgattgaatgaagcaaagcaaaggtttttcttagtcatatgcctctagaaacaaaacttagattagcgttgttagtccaaaatgttagatctggaaatgtatttgttcttccatatgtattaattgagagactattacgtgacagctctgtgaatacagtagtgaatgagacagaccagtttcttgtcctcttgggagttttattatactaggggagatagtttatttctgacagtaatactaagagttaacacttaagtacttcctatttgtcaggcacttattctaagcattttacatgcattaacctgttgttaaactcatatttcaaatgtggaaacttccaccagggaagttaagaaatcttgccaaaattacagagtcagtaagtggctgagctggagtttgaactcaagcagtctagctccagagtctgtgccctgatagtgatggtaagtactttgaagggtaagaaaacacaaaaagtccagggtgatttgagagagctgggagtggggactattctaaatagggtgggcagggaagcaaacttcaaaatttccagttgaaatttgacctgcagcctaactgataaggactaaggcattcaaagtagctggaataaattctttgttctaggcagagaggacagcaagtacaaagactctgaggcaggaaggggctgggagtgtttgaggacagaagggagactagtgtgtctgggaaatggtgagcaagggagcgtgggggctgggggccaaaatgggaaggcccctgcatattggggtcaagagtgcagattttattctagggactgtgggaagccattgaactcttggccccaagtggtccttggcctcccaaagtgctgggattacaggcatgagctaccactcccaaattaagtagggtgcgacatttaaatatattaatacctttatggagaatgaattattaagagtttatgagtttagatacagagagacaagactagagattaagagtcttattttgaataagttaggtttgagtagactttaaatattcaaacagatgttttgttggcatttggacatacaagtttggcctcagggaagagtttagggctagagataaaaatttggggcccattagtgtatataaatcagtggttctcaactgtgagtgcacatttgactcacctttaaaaatgctcatgcccaagctccattcctagagattcagattctgtgggtctgggtttgggtctagccatggtttgttttaaatctatctaggtggctctaatgtatgacgagggctgagaaccactggtggaggtggtatttagagccaaggatgggcctggatcagtgtgatcctttaaggcaaacttgtccaacctgttgcccacatgtggcccaggacagctttgaatgcagcctaacacaaattcgtaaactttcttaaaacattatgagatttaagttcatcaactatcattagtgttagtgtattttatgtgtggcccgagacaattcttcttccagtgtggcccagggaagccaaaagattggacacccctggcttaaggcaatggtatagctagggaagacaagcagctcagggtactggggcagcccagcaggtagaagttggatagaagaggtagaacagcaagggagactcacagcagtagctggagaggttggaggaaaaccagaaactgatgtctgaaaactggaagaggacagtgactcctgaaagtgggagcagctgtgccagatgctgctgagagctggtaaagtgaatgcgctcagaaggaattgaaactagcttcactgaatgggtctcagaggttcaaaccagggttttaggagctgtagattcaaatcctacccctgacattagttttctatttaaaattaaacaggatgctcttttcttagcctctttttatctttgcttattaaccaaaatgtaactgaactgtctcaatgcttaaagaaaggagatgataaacagacagccttattcccctctcccattcccaaacaaaagccagttcttacctggagttttggctctagctttctctctgcctggagtgcctttctggatatatggccacctggcctagtgctctcaccacctgtttgtctgtgagtccttccttagctgtccccttctctgggagctttcctttgctcttcctacttaatgatgtgactcacctccccaccccctggactcccagttccctacccatagcacttgtcgccttctaacagactgtgtgatttacttatttatcatgtttattgcctggcttccctgcaggaatgtaagaaatctttgttttgttcattgatgtcccctgagaatgtggattgctgagcaatgcctggtctatagcagcctcacagttagtgcttggtagatatttggtgactgagtgctgactccatgaaaatgattgtcatcctttgactctgctccagttgcatttgaaaagttgcatgggatctgccacttctctccatgacccaactatagagacttctggagtgtggcttctcccctctacctcagtactgtcatgcctattgaatttttttgagacagagcttcactctgtcacccaggctagagtgcagtgggatggtcatggcccactacagcctctactaggctcaagtgatcctctcacctcagactcctaagtagctgggactacaggtgcatgccaccacgcccagctaatttttaattttttttttttttttttttggtagagctagggttctgccatattgcccaggctagtctcaaactctgggctgaagcaatctgcccacctctgcctcccaaggtgctgggattacagttgtgagccactgtacaaggctttacttggaatttttagacttcagaaattatttgaatgttaatataggaaagtggtagtaataattagaagcaaattatatatatgagaaacagtatttaatgtattttggagaccaagtgttatgacagggatcagaaattttcagttgtcactgacagtaaaaatcattgcaagaagcaatttggtgctgtggaaagttcataggcttggaagccaggatacttggttcttaggtttgtccagtaatcttagccaccctacagtgagtgtctgctgtctgccaaacactctaaatgctttccagacagcatttttgattttactgtatcactcatggttgccattactacaccttgtttttttttgttttgttttgttgttttgttttctaagagatagggtctcactgtgttgcccaggctggtctcaaactcctgggctgaagagatcctcctgcctcagcctcccaagtagctgtgagtacagtcatgagccactgtgcctggctactataccctgtttatagatggaaaaactgagtcccagagaaaagataagaaagaaaagattctattctgatatgaacagaatcattttggagtggagaccatgtggggcacatttaacccctatacactgtcaactagagagtttggttaacttactgtctctaccttagggtaagacacaatctccgaggacctacattttatgacctgtgagatcaggataaggctatcctgctaaaacacttaaataacagaatttatggccgggcgtggtggctcacgcctttaatcctagcactttgggaggccgaggtgggcagatttcctgagttcaggagttcgagaacagcctgggcgatacggtgaaaccccatctctactaaaatacaaaaaattagctgggcgtggtggcgtgtgcccgtagtcccagctgttcgggaggctgaggcaggagaattgcttgaacccgggaggcggaggttgcagtgagccaagatcgtgcgtgccattgctccaccctgggtgacagagcgagactccgcctcaaaaaacaaaacaaaacaaaacaaaaaacaggatttatattgtaaaatataaaactttaaacaaatgttttgtatcattatgctgctgaaaatacaatgttccaacagtgtcctctgttcattttatactcacagtgatgcttattattttatttattagaatgtatctgagatgccaagttcaggagatttttggagtcctgctctgtgtgcccttctgccaggtggccctatgcttataatcactcttaggtgtttacacttccttcctttttcttgtcagggtccctggctccctctggagtctactctccaggaggtggggggcgctgatgtcagcagggaaggggggcttattgctctcagtgatgcttattattttattcacgttcttaatggtttgagtttttggttttttaagagatggggtcttgctttgttgcctggctggatttgaactcctggaccccattgtgcctcacttgttttatttttcaaattttattattttgtaaatttcccttttataaattaatctttaaaaatgtgtgtgtgtatatctatgaacaaataaaggatctcctggtcatctctgtccccatccacccagctccctgttcctccttacaagtaaatcaccattgtaagttgtatattcttcctgcatttctttatgcaaatagaaggaaatgtgaatgtttttcttattctcttccttctccccacaaaagatgccatacatacactattttctcttgttttttttttcctgcctgacagtatttccttgtttttgtgaagactagaccatctaaaattttgtgtactcataattacttgatagcataaagactttcaagtctccatcagctgacacaattaattttcaatgaacatacctttggcaagtcttcttaggcttatttttgtgatttttaaatgcttcctgcctagctctaaaaaggaaaacctggcaccatcctcagaagtttcagagttaatgaagtatctcatgtctcagcctttgcgtgtacagaataaatacgtttttctcagttcacttacccattgtggtgttctcagtttatgagcccttgctataattttcaaagctttcttttatcatttgtctttcagataaaacaactgcttcacaactaggaacttttagttgttgattattaaattctgtcaaaactgcctgtttgttttttgtggtcagtattttaatctcccttatctacaatcctgccaaacttccctaccttccccctgctccagaaaaataaaatccaactcaaaccttacttagcaaaccaccctcacagagtgaaattcagaaaaaaaattttgtttcaataaaaagattttgaaagatttcatcacttcaacaaaactatagttaaaaaattaaaatattatattaattgaaggacagtaacagtataatgagggagcaaaaatagagaaagtagctgacattgccagaagataagtcaaattctgctttttcccacatgtaattgttcaggacatgtggctcagaatatgtgaattagtatagtaactacagcagagtctctctgggttgtgttatttgctcaattgcgagatagcatacttataaaattatttctagattcactcctgaaatcttaactgcagtctgctttgtggaatttcttcttggaagaacttgtttaagagtatgctgattgatatttgttcatgggccatctgaagattctggatgttattttattttattttttgaggcagtctccctctgttccccaggctggagtgcagtagcacaatctcggcttactgcacccttcgccttccgggttcaagcaattctcctgcctcagcctctggaatagctgggactacaggcacgcaccatcacacccagctaattttttgtgtgtgtgtatttttagtacagacggggtttcaccatgttggccaggctggtctcaaagtcctgacctcaggtgatctgtccgccttggcctcccagagtgctgggattacaggcgtcagcctctgtgcctggcctggaggttattttaaatcgttttttttttttgggatgaaaacaaattttgttaaaattagtaatacagaatgattttgtgttcttttatcattcattcatttaccaaatatttattgaggcctgttctgtgctaaatggtggggagatggtgctgaactacacagaagagccccagtatgcctgctagctcttcccgtgtttacattttgattttctgtgctgcaatacagtagatgagcttggcattgagagtgagtagtcttggatttaggttttgagccggccatttatttattgtgagacctctgaagcttaaaactctgagccagcacacctgtaatcccaatactttgggaagccaaggtgggtggattgcttgagcccaggagttcaagaccagcctgggaaacttggtgaaaccccatctctacaaaaaatataataattatctgggcatggtggcacgctcctgtagtcccaagctacttgggaggctgagatgggaggatcacttgagcccgggggcagaggttgcagtgagccaacatcacgccactgcacttcagcctggatgacagagcaagacccagtctgaaaaagaaagaaagaaggaaaacccacaaaaacactgagtcagtcttgatctgcacatggaggaatcttgcagggtggttggaattaacgagtgtgtgtgagaacattgttctctgcagtggtctttatagggtctttagacaattcgtggtcacttttctggatcccttgcattttctagctgcattttcctcaactgggtttgggaaaaattaggtctggagtttgggatggggagctgtttttactttacaggtgaggtaactccatacgtgttgaagttttataggagtatgagtggaaccaacctctgatttttggctcagtactgacccttggactggagagtcctgttgtcagcaacaagaacacagtttaatgagaagcaattaagagtgcggtctccaaaccatagtcttaatttcagattcttgcttctccacttactgcctactaaaccttaagcaagtaactggaatatctctcataacataccataggattaattaatgctgtagttaaaagaaaaacaacaccagctatgtaattgtataaaagacttaataaaatgtggatgatttaggctgggaagccgttaactaaccattcatcataaaagggaggaagcaagaggacccacttgagtaggctgggacaaattgctgtggttcagttttactttttgcttttgtttctaattggagctgttttgagacatcctgattgtcagagagaatgtggattagagggaggaggaggagctctggagtcaggcagcccgagttcagactccagcaaccccattactggctgcttaactgtgttgtgccttatctgcagaaaaaatgagttaaaacacacatagtgagcagtgataactgtagctgtgattatttgaaaggggccttttgagcagctgcttctgcaagaggacatccggagacacaggaatagaaatgatccgatcagagtaattaaaggcttttaactgagctctgaggtcccaaacagggcacactccgtcagcctaaagctgtgaagaagaaccttcaacataaggtgggtgttctcttttagggtggtggagaactgtgtcattaggctagtactgtaagcagtggggggttagagcttaactacggttgtgtttgggagatagcgccagatgttgggctccctcctgccagtagattacagggatttcctttgcattggctggtgctgcagccttccagtattgcaggtttccaagtgtttgtaatgaatttctggccagggcgtccatgtctcttggtgctggccagggtgtgtgctgacggctgcactgttcccagccctctgcctggatttagtcttcagtgtcggagcccccaagtctgtttacaatcttgttactctttccagcgaactctccaccttctgtttcactgcgtatttcctgacgatgcagtttcattttggatgcagacctcttggagccctttgtcccagggaagttagatgtcccttgtggcaaataccctccttcgggaataaacagtctcatttgagcccctgctatgtatgacacactcccccagggcccttgtacaaacatgagttagaaatgtattgtccctgtatttcacaggcccacagaccagtgatggagcaagtatgtacccagataatttatccgcatatgatttggtcctgtttgaaagtggccatgggagaggtgggaatggtgtatgttgacacacaggagtccaggtgccaggcttggggcgtggggaaccttcatagagcgggaagcattcgagttggatattgagaatgagtgggggctgaaaggtttagaatagagagaatagttaaattaggtcattaaaaatatgtggaacacctgctgggtgccaggtactgcatgtgaaatcagacgacggttgactgcgctcactctgctgtgttttctgtgctactccctaaagctcagtagatgtttattcaccaggtgactgctgccttccccaagccacctggcagtcacgttttacctctgaaatcatctcagtgaagctttcctgacagcccctctctatgagtttcctagagctgctgtaacaaagtgccacagaccaggggcttaaacaacagtaatgtgtcatctcacagttctggaggctagaagtctaagatcagggtgtgggcagggctggttcctcccgaggctgtgagggagaatgggccccatcctagctcggtagtcggcagtccttggcgtttcttggcttgaggaagcactgcgtccacctctgccttcatctacacttagttctccctgtgcgtgtctctttgtccgcattttccgttttataaggacataagtcattttggattaggtctgccttgtggaccccatcttaactaattacatctgtagcgaccctatttccaaataagggcatattctgaggaactgggggttagggcttcaacatgtgaattttggggagtggacacagtccaactcataatatcctctctcagttctttctacctcccactcatggacactttccccctgctgatatactgtaagtggagttctgtcatgcactgagagaattttgtttgttatctcctgctcttcgtatttttcagtctctggtgccttgcatgtaaggtggaaggtgtctccagtgcaaatttattatgcgccaggagttagtagaaataagggaagatactgcagagatcacctctcttcttggtctcctattgacaattccaaaggctctctggagtcgggtgccaggtggccaaggacattaccaggggataccactttcattatctcctttttcccacggagcagtaattcattattagctgacaatcaaagagcattagaaatctgacaagatcctttgggtcctctagcaggcattttacacggaggctttctttaatggctctcttcttcctagtttcagccgtaagttttcatgttccagctttagggattcaaaagtaaatcatgtgaatgctgggaatagttacccttagcaaagatgtctgtgccagaagggagatgccaataaataattgaatctgtccaaaagtttcagaattccctcattatatatttgagagaagcaaaaatttgtctggtatctgacctgaggtttagttacacattaataaagatggatcatcccagggctgcagtacttctgctaagaaagaatattccagcataacctttgttatttccgagtcagtaaataatgtactaggtagagtggtgttttctgggacattagaaaagagacgttatttggactaaatagtgctgttcagtcaggattttcttcaatgccatttagcaaaccaactgtccttagtctgtccagctagcaagaatttgtataatgcaacagagagtgctgttcagtcaggattttcttcaatgccatttagcaaaccaactgtccttagtctgtccagctagcaagaatttgtataatgcaacagagtactttacagttttcacactttaaatgtcacaggaggggttcttcactaggcttctggaacctagtctagcaaaattagaggaaaggccctaaggagatttatctctgttaagagaaaaagttaacattttcaggctaaatagttgaatctactgaagataacaaataatgtctactatttcaaccctccaaagattgaagagtgttaggattgtcatttgtgtttttttgtggggtagttgaataaaattgggcagctaaaattttcagttccatgtgcctcctaaacaaaaaacaaagtaagtagtttgtgaattgactgtagacaaaatagaaactatgctgcatgctgttttttttgtaaacagatgacattttctttctttttttttttttttgagctggagtctcgctctgtcacccaggttggagtgcagtggcatgatcttggctcactgcaatctgtgcctgccgggttcatgccattctcctgtctcagcctcccgagtagctgggactacaggtgcgcgccaccacacccggctaatttttttttgtatttttagtagagatggggtttcaccgtgttagccaggatggtctcgatctcctcacctcgtgatccaccctcctcggcctcccaaagtgctgtgattacaggcgtgagccaccgtgcctggccaacagatgacattttctaaccaggcacatgccatccaatttacctgtcgatcataccattgtataaagcagcagaactgaaggggaaatatgattgttaaacacactgaattgcttttatgtcatttgagatagttggtgtaagtgtcttgactttttatatttggaaacattaaataaaaacataaattttttaaaaagggatgttaagatagctgttcatcctgatcttagtagtatcagtctgaaaaagcatgctgaaatatcttcatctgaaggccggcagagaccagctcatgtaaggtctggaggtgctttcttctgagagcaagaagaatcacggagcgtttcaaacacatacaaaatagacagcacggtgtgatgagtcctgctctaaccttcatccagtgtcagtggttagctcatggctagtcttatgtaacttcatttccccttgcccccatataagttttaggcacatttcagatgtcattttatccagaaacatttctgtatctaatataatcctagtaatactacacctaaaatgtaaaactaatttcttaataccatcaaaatctagctagtgttcaaatttctagttgtctcaaatgtcacttttagatttttattttacagtttgtttcaatcaggatcctactaaggtccacatattagttctcagattttaagcagaggagtgagtgacatgatctgacttacattaaaactctctatggccaagttttagagaatggattgttgtgggggttgttaagagactggaagtagagaaaccaattaggaggccgttgagtgtccaggaagtgagtgatgacaacttggatttgagtgacatctgggggatgggagatgtggaggaagcagatgtcacttgggcaggccatacttatttgtcacggttcatccagatttttgttttctgttgtctgtgtttatttgaaaatattgttcccaaagatttcattaatttagctatcaatatattgttgatggtgaaatcttaaaatgtattacataagtaaaatcaaagcaacattatagaatattgagatagagaaacattcatccatactttaatcaacttactcaaatttattccagcttatttgccattatatcattttgccagtgtataattatggcattacataatagaataagaaatatagtttgccacttaatatgttttatactcttttatctgtattatgctaaagagtctctgtagttacatgatattgtattgagcagattttaatgtttatgttacatttatttatttgagtcagggtcttgctctgtcacccatgctggagtgtagtggtgccatcatggctctctgcagccttgacctcccaggtcgagtgatcctctctcctcggactcctgagtagctgagactacaggcgtgtgccatcactcctggctaatttttttgattttttttgttgagatgcagtctttactatgtaagctagacagcttggaactcctgggctcaagtgatcttcccacatcagcttctcaaagtgctgggattacaggcatgagccaccacgcctgacctgttcctacttttaaaattattttattttaaattagtttaaatttattctaagatactatgaaaaatgttccagaagttagttttttgcatgtttttccctttctctctctttttttaactttttgattaaataatattattattattttttaagacggagtcttactctgttgttcaggctggagtgcagcggcatgactcagctcactgcaaactttgcctcccaggttgaagtaattcttgtgcctcagcctcctgagtagctgagattacaggtgcgtgcccccacgccccgctaatttttgcatttttattagaaacagggtgtcaccatgttgcccaggctggtttcaatctcctgagctcaggcatccacttgcctcggcctcccaaagtgccaggattacagacatgtgccactgtacccagcaaataataacttctctgtagagattttacttgaaaactaagttgatgaaacctgcagtcataattgataaaaatgaaggacaggtttgtactgcaaagtagaattatgcttaatcttgattactgggctcagaatgtgtatactttcattttgatttacatttatagacttccttattgaaggaatggagcatgtatatacctggcctgcagtgtttatcttatcccattcacacagcaatttgtaactaggggaaagtaatacctgccttatcttaaatatgatggttttacaaagattcctgtctttcactgtcttctgggaaccaggaaatagctatagttacctctaaaatataccctcatatccttttttaccgatgaaaatggcttataattgggactcataatgattttctttggtcttttattgtttttgaaacacgaagcagaacatttttattattggctcagaatgttcagctttaattacatctaatgaggaaatattgccagataactcttattgttttgttctttggtcattcttttggaaggtttacaataaatagattgggtaaccagaataaattaaacaatttaaaggatataaatagagaagaataagtttcagagattccacttaggctgggctcttgcctgtaatcccagcactgtggaagtctgaggcaggaggatcacttgaacctaggagtttgagaccagcccgggcaacatagtgagacctcatctctaccaaagaactaaaaaaaaaatagccaggtgtggtgatgtgggcctgtagtctcagctatgcaggaggctgaggcagtgggatggcttgagagcccacaagttccaggctgtagtgagctatgattgcaccactgcattccagcctgggtggcagaataaggctctgtctcaaaaacaaagagaaaaaagattccactgaggtcattagttcgtttattctatgttgatgtttagtcccccaattgttttcatgttttgcctttaagttctcgaagtagtggctgggggcggtggctaacgcctataatcccagcactttgagaggcctaggcgggcggatcacctgaggtcaggagttcgagaccagcctggccaacatggtgaaacgccgtctctactaaaaatacaaaaattacccgggtgtggtggcacgtgcctgtaatcaaagctactcgggaggctgaggcaggagaatcacttgaacctgggaggcggaggtttcagtgagccgagatcatgccactgcactccagaatgagcgacagagtgagactgtctcaaaaaaaaaaaaaaagaaagaaatactgccactttaagcatatttttatcttatctttacatttagaacagaaatatcaaattgatctttttcttaaaaaaaaacactaatttcttcaactgattctttggttattggttccacaataaaaatatcttttttgcataataaactctactttataggcttgttatccaaagtgcggttcaagttcagcagcattggtatcacttgggaattgatgagacatgcagaatttcaggccccactccagacctaatgaatcttaatttgtgtattaattcaattcccaggtggttcatatgcacatttgaaagctaacagggcgtggtggctcatgcctgtgatcccagcactttggaaggccaaggtgagaggattgcttgaggccaggagtttgagaccagcctctgcaactcagggatacccccatctctacaaaatttttaaaaaattcgccgggcatggcggtgcacgctgatagtcccagctgcttgggaggcttaggtggaaggatcacttgagcctgggaggttgaggttgcagtgagctgtgactgggccactgccctccagcctcggtggcagaacaagaccctgttcccctccccccgagaaaagaatgtaatgtcagtagccatattcacagaattttaaatttgagccatcttggcatgttaggttattaacaaactgagcatcttgacctcaaattgctggtacctgccattgttcttttaaccagaaaggagctgttagggaggaacatttaccattttgtgagttatgtgtgagtggcttctcttctgttgatctgtttgtgggatcctttgcaaaaccactgctggtaccttatgggaaaaaaaatcagaaatcaaatttcttttggaataaactgtgctgttcttagcagatcttgtctgtgtggaacaaatcatgtctgtaaagaatcacgtggtcaaaagtttaatatttagttctttttggatttgtcagaggacttaattgctttgttagattgttgtcttgttctcctctttggaacaatggctaggacaaaacacagcattggttagtgggagggtgggaggtggttgatcagccatgtgcctctgaggccacaaagaagcctcacaggtcatggtttccactgtcagttggtcattacatcctcctgttgaagattgtgtttaccaagctcatgtgctcatcatgaaacactgttagacattgatttgaaaacaataatttcttttattttgattctgtaggaacctagaaagattgtacaatgaatggtgattctcgtgctgcggtggtgacctcaccacccccgaccacagcccctcacaaggagaggtacttcgaccgagtagatgagaacaacccagagtacttgagggagaggaacatggcaccagaccttcgccaggacttcaacatgatggagcaaaagaagagggtgtccatgattctgcaaagccctgtgagaagagaagtcttttctctgaccagatgtcatctttccttttctaatacttcaggtcttatgccctgttgtatgagtggcatagttcattgatcttatcacaggaaatcagtgccttgagtatacgtatatggttgttgaaagaattcagttcagttcatgttatcagacatcataaatgaaaaatcttcagtgtcgtaaaggataggaagtgttaatttctcctttttactcttgtgacttttctagagggtccttatatattggggcaatttttaaattacaattaaaaaaatacctagcttaggctgggtgcgtcggctcaagcttgtaatcccagcactttgggaggccgaggtgggtggatcacttgaggtcagaagttcgagaccaggctggccatcacggtgaaaccctgtctccattaaaaatacaaaaattggccaggcgcggtggctcacgcctgtaatcccagcactttgggaggccaacatgggtggatcacgaggtcaggagatcgagaccatcctggctaacacggtgaaaacccatctctactaaaaatacaaaaaaaaattagccaggcgtagtggcgggcgcctgtagtcccagcaactcgggaggctgaggcaggagaatggcgtgaacccgggaggcggagcttgcagtaagccgagatcatgccactgcacttcagcctgggtgacatagagagactccgtcccaaaaaaaaaaaaaattagccgggcatagtggcgcatgcctgtaatcccagctactcgggcggctgaggcaggagaatcacttgaaaccgggaggcggaggttgcagtgagcggagattgtgctactgcactccagcctgggcaacagagcgagactctgtctcaaaaaaaaaaaaaaaaaaccctagctcagtctcctgggtgtatggtcagccttaacagtacctgctaattgattgatacctttagttagagtcagcattttgagccacagtcatggccaactgagtgttttccagattgcacctttaatcaggtcgttgtatctgcgtagttttctcatgttgctgctgctgcctttgtgtgtgcatcatccttttttgtcccttcttcttctgatttgttcttactgtgccccttcataccaggggagtgtcatttggcagaagtttattgattttcttaaaaaaaacaaaagatgttgattgtctcttatgtgctgtttaaggaactgggcatttagcagtaaactagacatacaaggcctttagtagattttgtttagttgttgttactgagttataacttacataaagtacacaaatcttaagtatatagcttggtgaattttgacataaatgttgcttctgtaactacccagatcaagtcttggactttacattctagtcgaaggaaataaacaataaagaacaagcaggagggcaatgcagaaagcagtaggatgattagattaagtgtgactgtggtcagaaaggctgttctcaggagggaaggtttaatctgaactcaatgacaggaaggagccagtctttcaagaatcaagagggggccgggtgtgggtgcttggctgggcatggtggcccatgcctgtaatcccagcactttgggaggccaaggcagtggatcacttgagcccaggagttcgagaccagcctggggaatccgcatctctaccaaaaatataaaaattagctaggtgtggtggcatgccccggcaatcccagctactcaggaggctgaggtgggaggatcactcaagctgaggctgcagtgagttgtgatcgtgccagtgcactccagcctgggtgacagagtgagaccctgtctccaaaaaaaaaggagacgtgttcccagctgaggaaccagctaacatgaaattcctaggatagggatgggcttgatgagcccacagaggcagaaggcagccagtgtggttcggcctgggagtggcagagtgaggttggagagagaggagggagcagatcctggaaggctgtgtatgctgagattgagagtttccattgcattctgtgtgtggcagaatcattggagggctgcagacagggaaaggacaaacggtattttaaagaaaattattctgggtttggtttagagagaaaattggctggggcaagagaaaaagctgttgtccaaatgagagatcatggctgcttgggccaaggtggcgtagtagaggtaggaagaagtagatttgtatggctttcattttgaaggtagtgtgaataggacttgctgatggatggggtggaagaagtgaaagggaaaaaaagaatcaggatagcaccgagacttttggcttgagcagtttacttacgtaaaaacaacaagaagctaagtaaaaatgactcgggatagttgagtcatttttgagttgaaactgatagcacctagtgtgtgccaggcattgttctaggcactggggatgcagagataagagagtaaagttcctgcccacaggttgtttagaacacagtaagcatcaaggctgggcgcggtggctcatacctgtagtcccagtgctttgggaggctgagataggaggatcacttgagtttaggagtttgaggctgcagtgagctatgattgcaccactgcactccagcctggggcttgaggttttgccagatggtttggtagagttggagatgttagcaagaaagggattacaatgtaatcattacaatggatctaagccagtgagggagttcagaacaggggaggtgagccaaggtgagaaggtgttagggtgatgaatggatggaagaaagtgtgagctggatgctaggagggggtggttgcagggcacatacttggctttgggattgaagagagacatggttactaggaatgagcaggtgtagtgctgaccatggacgtgggagcctgagatgggttggatgacagggtctttggaggagaggaggtccgaaagctgagaggtatgagggtcccaaactgagggtatggatgttgaaccagcaagagttatgatcaaagtagcacacacaaggtccttaggctagtgacagctggctggagccaaacgttaagatccagattggtggctccaggccctcactcaggactaagctcagctctgtgccacgtgtcctttctgcacttacaggtcgtctgaaatgctctttatgcatagggctcctgtactgtggttttcttctttttgtgtcttccttaccaagctttaagtttctggatggcaaggaccatattatttatcagtatgtatatccttagtgtctaaaacagcgcctggtacttagtagtgtgtgtcgaattgagctttccctagatctgtatgtggatttgaaaaccattgaaatagatcctttgaattttcagactgagggctcctgaaggcaaggagcttgtttaatttagcttttgctttccctgtgaccagcactgtctgtgatgttcaggagatgccatctgtatctcttactctctctcttttttttttgagatggagtctcactctgtcgcccaggctggagtgcagtggcgtgatctcggctcactgtagcctccacctcccgagttcaaatgattctcctgcctcagcctcctgagtagctgggattacaagcgtgcaccaccatacccagctcgctgcaacctcctcctactggcttcaagtgattctcctgcctcagcctcccaagtagctaggattacaggcacaagcttccatgcccagctaacttttgtatttttagtagagatgaggttttaccatgttggccaggctggtctcgaactcctgacctcaagtgatccgcctcccttggcctcccaaagtgctggaagttacaggtggaagccactgcgcctgccctatctttatttgcacatatctccctttctctctcattgcattgtgctttgatgacaaagatggctaaataatcaccatgttttgtttttttcctttgtttatttcttgcttgcagtcagagtacctctcagcttttcccttcctcacggatgactacaaaatatgatctgcaacattatttgccatggtttggtaaatagggggtcctcagagggctcttgacagacattctattctacccttaattaacagcaatacatctgtctgttgtgtgcttcccccaagtgataggtactcttagactgtcccttggcaatctcctgcaatatgttttcagctcaagcagtgacaaactagaagtaaatttgatgtggattaacatccagtgaacttaaattttcataccggatatcatttataattgtttgacaagatatttctttctttcttttttttttttttttttttttttttttttgagacggagtctcgctctatctcccaagctggagtgcagtggcgggatctcagctcactgcaagctccgcctcccgggttcacaccattgtcctgcctcagcctcccgagtagctgggactacaggcgcccaccaccacgcctggcttattttttgtatttttagtagagacggggtttcaccatgttagccaggatggtctcgatctcctgacctcgtgatccgcccgcctcggcctcccaaagtgctgggattacaggcgtgagccaccatgcctggccgatatttatttctttgcagggtatgtgaaaaaattattttagtgcaggttgggaatataaattatctgtattgttataatagtgattttctattaaaatcaccatcaatccaattgcacttttttttgcctgatttagtattatttgataaaggatggatggttagggttttttccacatttaaaagtaatttgaaaagtattttgaagaaagtactgcaaaggataaagtagaatatgaaaaattactaataatcctatcactaaaaggattacaatgaacattttgatgtatttactttttttttttttttttttttttgagacaaagtcttgctctgttgcccaggctggagtgcaatggcccaatctcggctcactgcaacctctgcctcctgggttcaagcaattctcctttctcagcctcccaagtagctgggattacaggcgcccaccaccacgcctggctaattttttacatttttagtagagatggggtttcaccatgttggccaggctggtctcgaactcctgacctcaggtgatccacctgccttcgcctcctaaagtgctgggattccaggcatgagccactgtgcccagccaatgtatttacttttaatctttttctatgtttaggtatgtatttgctgtaataaggactggttatactgcttgataacattgtcactcaaacatatatcaagagcaattttatgccatttaagtttttttagcttttcatgttgaatgcatgcgtagaattcccagtgtatttgatcagtcctctgttgattgaaacgtaggatgtttttcccttttatcaataatactggaatgaacatacaaatgaatcagtctttgagcacttccttgaatgtttccttaaaatagattcctaagagtagaattcctgttcagagttttaagcttttattgtattaaattactttctagaaaagaatgtaccagtttatattctcagcagtaatgtgtgagaatatccgtttgcctttccagcactggatgaaaacaaaaattggtctatgtgatagctacttctgaccccctgcccaaggaacagaaaataaatggtatctcagtgttttaatattttttattaggctttctgtgaagaattggaatcaatgatacaggagcaatttaagaaggggaagaaccccacaggcctattggcattacagcagattgcagattttatgaccacgaatgtaccaaatgtctacccagcagctccgcaaggagggatggctgccttaaacatgagtgagtagttcctgatttttaatatatgttctgtagttttcaggtaaaatttcctgaagattgctcatgtgaaataagtgggcatttaactgtataacataacagagttgagtattttgaaaattaatgtgttttcgttagtcatagtaaaagataggctggaattctgaaatcatcttgaatgttgcagactcctcttttcttagccagtgagactttatttccgaggcagatgactttttatgtgtcttcccagcccctatgtagattaaaataaactaatagaaataatgctgtggagtagcacatcagttttgcctggccagcatttcttacctagcattcttcactgctgtgtcccaactagtgagaaagagaaattctaaaagaaaagccagaggaaaagtactggatgggtgaatgtgagcaaagaatggtcagctgtgcaagaatgcagctttgccatggcaattgagtttgcaaatgttaacatgacaaagcatcaactaatctgagccactgcatattgtaccttggattagtctctgatgggtctggttggatagtcaaatctgattgcccgaaataaggtactggtttctgttagatctgctgacatttgctatttacctgtctgctctgtggtattcttagaagttgaatagcattcaacagatctgatatatattgtaattaatgtctacagaatattaagagtcacatttaatccatagctcaaacctccatcctgaaatcacatggccaccactaggaaagttttcatgtggattccgtttttttttgttgttgttgtttttgagacggcgtcttgctctgtctcccaggctggagtgcagtggcatgatctcagctccctgcaaactaccacctcccaggttcaagctgttctcctgcctcagcctcctgaatagctgagattacaggcacacaccaccacacctggctaatttttgttatttttagtagagacggatttcgccatgttggccatgctggtctcaaactcctgaccacaagtgatccactcgcctcagcctccctaagtgctgggattacgaacatgagccaccacacctggcccatttcgtctgtattaattagcaagaatgttctgtcaggagaaacttcccttcagttcttttggttacctggtgatacagtttgtgtaggaaaggcaggatccctttccgaaataataagttggtttccaatcatccttcagtgatgaacaattagttttttttttttttagtattatttgaatttatgatttaaacatagtcagtgtgtttcacatcattgcagttattatccggatttgttgagaactttccttctgaatggatgttgaactttgtgaaatgcttcttttctttctgttaaaatgatcccttagtctttcttctttagtttgttatggtgaattatgtttttttgtttgtttgtttgttttgtgtatttatttatttagagataagttcttgctctttcacccatgctggagtacagtggcacgatcacagctcactacaaccttgaactcctaggcttaagggatcctccatgccttccatgcctggctaatttttctcttttctttttttttttgagatggagtcttgctctgtcgcctgggctgcagtgcagtggcgtgatcttggctcactgtaagctccgcctcctgggttcacgccattctcctgcctcagcctcccaagtagctgggagtataggcgcccaccaccacgtctggctaattttttgtatttttggtatagacagggtttcaccttgttagccaggatggtctcgatctcctgaccttgtgatcctcccgcctcggcctcccaaagtgctgggattacaggcgtgagccaccgcgcccagcccatattggttgtttctatctcctttcttttgttaagtctggctagaggtttatcttattttattatttgtattttatttttaaacttctcagagattcaacttttgctttaatcagaaagccttaaaaacacttttcttctctaatgtatacgtttaatgctgtaaatttccttttaagcttgctttactgcacgccacaaatttggctatctttttgttattgatttctaacttaattgtgtaagtattggaaaacagtcattatgaaattgtctttgaagttttcaagactttattgtctaatgtggaagataaatatctcagaaccattagtatttgatttacatttgataagaaatgttaatatttgaggctttttggtaagtctcgctttgttgccttggctattcacagctgctatcataagcactacagcctcaaactcatggcttcaagtgatcctcctgccttagccttctgagtaactaggactacaggcgtataccactgcacctggctgagttttgtttttctttatttcaggtcttggtatggtgactcctgtgaacgatcttagaggatctgattctattgcgtatgacaaaggagagaagttattacggtgtaaattggcagcgttttatagactagcagatctctttgggtggtctcagcttatctacaatcatatcacagtgagtattaaatgggctagtaactgaacgataaatgaaatattttgtgtctggcaccacctctttccatttaggagaagagggaagcaggctgagcttcagtaagtcttggaatacctcttctgattcctgactacagagtgtaataacctgagaatcagccagtttgggttaaaagttacaggaacagcagttcttgaaaatttctttcttgcgtgctaacctaataaaacaactaagtgtttaccagattatatgcagtttctaaaattatttttatgcttaaaaacctaagaatgatgatgttttctttcttagtctgaccaaagccttccgtctctcaaacttatttcttcagctactctagttttaactatttttcaacattattaggatctcttttccttcattctgggtatctgctttctctggaccaagcgctgttctaactgtggttgtgtcagtggacaacatgagtccttcccttgtggacagtcacttcttcatcccaatccattagcctattcttcactccctattttgtccatcttgtatttcatagtccctcatttcagcaatactctgccaatcctgtactctccctcccagcttctgagtagcgaaatcctgctgtggaagtcctcccaccagagcccattacctttctccatagattcagaacccaaatctcaaatgggccaatgacttagcctggcaaccataactcatctctcttacaaccttactaatatttaagccttctctactatctttgagactcctgacctccttcttccaccaaatgacctcatcatgtcacagaaaaaatgggtacccttactgacatttgtagccattctgtactcttgaccacctgttataatgtcttgccttctgcctgtggccagactttgctcacctggcttggaattccacccttcctgccttcttttttttttttgagacagagacttgctctgttgcccaggctggagtgcagtggtgcaatctcggctcactgcaagctccgcctcccgggttcacgccattctcctgcctcagcctcccgagtagctgggactacaggcgcccgccaccacgcctggctaatttttttgtatttttagtagagacggggtttcaccgtgttagccaggatggtctcgatctcctgaccttgtgatccgcccgccttggcctcccaaagtgctgggattacaggcgtgagccaccctgcccggccccttcctgccttgttagattcacagtgcattgccagggttcttctgttccttcactcttttgtagagatagcttcttcctttgaactgcttccttcctttggttttgaaacttgttccagtcttctgtttttttcatgtaatttcttttaaaggatattttaaattgttaatacagtgcctgctttttgtatcaagtgtaccttatgcagatgtctaaagaaaaagtaattccaccaatacttccatctctcttgaggcaagcagtgtgtgcgctgttcacgttgctgaaatgtttcctccatactcacacacacatgggtttttctgcacatggactcataaccagcggtgcttcgttaagctccattctggactcagaggaatgctaagcctcttgaggtgacggtctggagctcaccttgtgattagtgtgttgtgcctctgggacttgatattggtctctgccagagagactgagttgccttctatccatctgttcttgtttccgcttaaatgaacttttcaaaatgtaagccttaccatgtcatgctcctgtgtgcggcacggtcactctgtgtagaatgtcatcgctgctttattcccctgtagcagttacccccattcattctgtatgtttagctgttgctgtccctctctgcccacaggaatataaattccacagggagagcgtctgttgtggtccctgctgtggccccaggacccgtggcaaagagtaggcatgcagtaaacttaggtgaaaaactgaatgaaacccccggctgaactgaaattacctcagtgaaattgtgaacaagagctcgctgggaccttttgacatttgattggtgggtccagttagcctagcacaaatgccagctcccttcctggtgcctgcagggaaattgctggcctctgtcatctaattatacttgacagaatgctgtggtggagattagtgctaagtggttgcctgaagatcagtgcggtgaaaatgttacagctgtgattggaaacgtaaccctaactgtgataacagcttcaccttcttcgcaggttttaaagtgctgtttgcctagtcctattttgaatgctgattaaataagtttgaattggttaaattgcttgttttctcctcctttaattgtttaagaattggcaaaattaaaaaagtgttttctgtaaattatctccttggggcttaataccgagtaaaaagaaatgcaagttacctaaaatgtttcctatgtcttataaactagaactagagaatctttaaggaagaaaggttttggtttattttgttttactattatggcatccatttcttatttactatctaggtatggtatagacgcttaacagaaaagcaaatacagtgtcaacaaaaagtgacagcaggtcattctgccctttctttgaaagggggtcatagggattttctgctaaagggatttaaaattgctaacaggtgttagaagattggagatgattgtctgaaatagatctttaagattgcattggatttggagaagtgtttgtgggggctggggggagggggacaagacggggtggcccagttagcacagtggactgggcttcctctctcggtggcacttagctgatggcttggcctgcccattctgatgtcagtggaatgctgtcaaggctttgcacctgcagaacctggcaggtgcttgttcaactccattctggattccagagaatgctaagcctctgaggtgatggtctggacccacctttgtgaccagtgccctgtgcttcagggacgtgatagtggtctcctctggaggtactgaattgggtactgcattggtctgcaacaggagagtctcattcttcatacacagagaaggggcagtacatgtgtgggaagagacacagggagagcagggctggtctgacggggagggacaactgcagaggaaactgacttcaaaatatccttctctatttttacttgatgtttgtaattttgcactttctcctttttgctttagattcagagaattgaatgttttaagcctctaaaattaaagtatgtattaatagatctgttagttaagcttacagttggaaataaatcttaaaataagtaaaagaaggaaacattattaattacagcgttattattattattattatttttgagacagggtctcactctgttacccaggctggagtgcagtggtggaatctcggctcactgcaacctctgccgcctcggttcaagtgatcctcctgcctcagcctcccaagtagcaggaacaggcatgtgccaccatgcgcaggtgtgcaccaccatgccactagctgattttagtatttttagtagagatggggtttcaccatgctggccagcctgggctcaaactcctggcctcaagcgatccgcctgcctcggcctcccaaagtgctgggattacaggtgtgagccactgtgcccggcccagcattatttgtaataatgaaattattattattattattattattattattattttaggcagagtctcactctgtggcccaggctggagtgcagtggcatgatctcggctcactcaacctctaccttccgagttcaggcaattctgctgcctcagcctcccaagtagcagggattacaggcacctgccaccacacacagctaatttttttgtatttttactagagatggggtttcaccatgttggccaggctggttttgaactcctgacctcaagtgatccgcccacctcagcctcccaaagtgctagggttataggtgtgagccactgcacccagccaataatgaaaaattttaagagtccttaagtattcagcagtagataggaaatggctcagttattcaatatcaatttgagcaaatgttgtatactatgaaaaacaattacaaagatcatgtagaacaagtgaaatatgaaaaatgaaaggtatcagaaatgagaaaatatgaaatatatactgtttacagctatatgaaatatgtacatatatatatggagagagagagagagacaaaagagaaatgactaacaaaaatggttgtgtaatactttttaaatgtggaacctgacagcatgcttctaaaatttagatggaagagcggaaggccaagaatagctaagacactcctgaagaacagctaggcaaggagatttttcctaccagatgtcaaacttaatataaagtggtaattaatatagtgtcctttgggcaaaggaagatgcagagggatcagtagggccaaattgcatgcattgaaacagacatgctgtagtcggcattgcagctcagcggggtgggggatggacttggcaatgatggctgctgggatgcttgggtagaaaagtcacaagtggaaataattatatgagacttctatactatacataatcacaaagcaatcccagtgaattaaagattaaatgtgaaatgcaatactttaacaattttaggactaatataggtgaaaatcactggccttgaacctctggcctaaggagagatgtcttatgacacaaaaatcacttatcgtaaaagaaaagatggataaatttgtctacatttaaagtagacaaactttttccttattaaaagataccataggccaggcgtggtggcttatgcctgtaatcccagcattttgggaggctgaggtgggtggatcacctgacgtcaggagttcgagaccagcctgaccaacatgatgaaacccatctctaccaaaaaatacaaaaaatttggccaggcatggtggtgtgcctgtagtcccagttgctggggaggctgagacaggagaattgcttgaaccctagaggcagaggttgcagtgagctgagattgtgccactgcactccagcctgggtggcagagtgagaccctgtctcagaaaaaaggtaaaagataccataaagacagtaataataaaagccgcaacctggaaggtttgtcccacatgtagccaatagaaattaatatctggagctgggtgcagtggctcacgcctgtaatctctgcactttgggagaccaaggtgggcacatcccttgaggccaggagtttgagaccagtgtggccaacatgtgaaactccgtctctgctaaaaatgcaaaattagccaggcgtggtggcgcgcacctgtaatcccagctactgggaggctgagacaggaatcacttgaacttgggaggtgaaggttgcagtgagctgaaattgtgccactgcactccagcctgggcgacagagtgagactccgtctcaaaaaaaaaaaaaaagaaataatatctggaatagataactgtcagtaagaaaaagacaaaccagtataaaatggacaaaaggcaagaaaggaatttcacagaaggggaaataagaatgccttataaaaatatgaaaagttactgaaatcatttggtcaccaggaaattataaattcatatcacaatgaaatgtcattttatagacatcagatttcttttgttgttgttgtttgagacagagtctcaccctgtcacccaggctagagtcagtggcacgatctctgctcactgcaagctctgcctcccaggttcacgccattctcctgcctcaacctcccgagtagctgggagtacagtcgcccgccaccacacccggctaattttttttgtatttttagtagagacagggtttcaccattttagccaggatggtctccatctcctgaccttgtgatccgcccttctcgccctcccaaagtgctgggattacaggcatgagccaccatgcctggccactagaattattgtatttcttaagctaattgatagatacatggatgtttgatttattattatacttacattgtcttatatcttgtaaatacccttgtatgtgtgtttttaaaataaaggcttttaaaggaagcaaaacaaaaatctgaaacttaatcttttctaattttcatccttaattttcttcattccaaccagtatatacacagatcccttgttttatgttttgttttgactgagcttagcaattagacaactgcttacttttgtgttaaatagtttaacaagtcaggatgggctggatgcagtgactcccacctgtaatcccaacacttttggaggccaaggcaggaggatcacttgagctcaaaagtttgggaccagcttgggcaacatagtgaaaccctgtctctattttaaaaaaaaaaaaaaaggtcagcatgctttttaagataaaggaggctgggcacggtggctcatgcctctaatcccagcatttttggaggccagaaaaagtgggtgcatcacttgaggccaggagtttgagaccagcctggctgacgtggtgaaaccccgtctctactaaaaatacagaaattagctgggcatggtgtgcctgtaatcccagctactcagaggctgaggcaggagaatcgcttgaacccgggaggcaaaggttgtagtgagctgagatcgtgcccctgcactccagcctgggtgacagagtgagctttgtctcaaaaaaagaaaaaaaaaagataaaggagctgacttaaggaaatagaaagcaaggctgactcagcattgcaaagaagtgggtcatagggatttatagagactgggtgttgtagttcactatccatgtaaatgacccctagcaatgatttagtgttgctgctcccactaccactaatgatggtaataatgggtagatgccgtttattgcgagctttattgtagacacaggctcttccatccccacttagtcatgaggaaaacaggagctcagggtgcccagaacaccatagccagttcttggcagagctaggatttgaacttaagtgttatctgactttggattttgtgctcttaaccctgttatgctctacagagacaatcaggtgagtttagcctacagatcatataaggggagacaggatagatttagatgtctgaaaattaaattgtagaagggggttagaatttgttctgtgttatatactagaggcagtggtgacaaacacaggaaaacagatttcttctcagtgctagaaagaacgttttaatccttaagtctctccagcatctgtttatgacagtgcttcagcgcccatgacacggtgggctctcagcgagtaggtggtcatttctttcctgaatgaataaatgagggaggctggggtaagcatcctcatcactgaaactaaaacaagcagaccctgggtatgcttctgtttgggccactacagaagaaatcactatgtggcttaggaagctggactaaacaccttaagtccttttcaacaaacactcagctccaactgtccgaccctagttaggattctgggttccttaacccattagtaaatgtatttgaacttaatctttaggaagccttttgagcctatactaaaatcattataaaaactagaatgaatatttttgagggcaggtctcttcttttttactgctgtattcctagtgtctagcatatgcttgatgcatagtgtaaaccaaatctgcattgaattaattactgtgggagaaaaacatactgtggaagaggcaaaccaatgaaggcaatgaggatgtggtgttgtagagacttaagaaatggattatggtgggcacagtggctcacacctgtaagcctagcattttgagaggctgaggcgggaggattgcttgagttcaggagttcaagaccagcctgggcaacttagtgagaccccatctctaccaaaataaaaaataaaaaaatagccaggcttaatgacttgtgcctgtagtcccagctactcaggaggctgagatgtgtggatcacttgagtcaggaggttgaggctgcagtgagcatgattgcgccactgcattacagcctgggtaacagagtgagaccccatctcaaaaacaaaaataaaaaacaaaaaaaaaaacagatcaagtagtaagggtacaagttggttttaattatttttttattttttatttattttatttatttttttgagacagggtcttgtctgtcacccaggctagagtgcagtggcacgatcatgactgactgcaacctctgcctcctgggttccaagtgattctcgtgcctcagccacctgagtgtctgggactacaggtgcctgccaccacaggtggccaagttgtctattttattttatttttttagtagagacggggttttgccatgttgaccaggctggtcccaaactcctgacctcaagtgatccacccatcttcgcctcccaaagtgctgggattacaggcttgagccacagtgcccagcctaggtgttaagtatttttaaaaattcattttgtcagtgcctactgcagcaaggaaaaaaaaaaaaggacattctgtttgactttttaaaagtaagttttggccaggcacagtggctcatgcctgtaatcccagcactttgagaggccaaggaaggcagatccagttgagcccaggagtttttgagaccagcctggccagcatggcgaaaccctgtctctatacaaaatacaataattagctggtcacagtattgtgcgcttgtagtcccagctacttgggaggctgaggtgggaggatcatttgagcctgggaggcagaagttgcagtgagccatgatcacgccactgcactccagcctgggcaacagagtgagaccctgtctcaaaaaaaaaaaaagaataatgtaagttttggttttcattattatatccctgaggagtgacacctttttgcctttgacactagtagccaccagaaagtgtgacagagtaacccagcagtaatttattgacctgtcagaaggctagtgtggaactgttttttccctctataaagtcagttatcatgaacgtgagcaagaagcacttcatatatgtgataaattagtacagtagaataatggaaagcttccagtaccccttggcttcgtgacaggcattgtgcatggacgcttccctgcatagctcactcagtgttctgaacaaacccgtgaatttgtagcctgaaagagatgcaaataatttcacttggatctttgagctaattcagtcattttccccacagaccagagtgaactccgagcaggaacacttcctcattgtcccttttgggcttctttacagtgaagtgactgcatccagtttggtaagaatgtccttctctttggcagcttgtatgtgcaggtcatgttaggtcattcaacatcttcagatcagctaaatatgtaaaacccaagaaacaagaaagagcctatgttttatgtggtgtgttcagttagagaaaaacctttgagagaagttacaaatattgtaatcttgagtttgaatagtttctagttagggtaatttgaagtcctcttgggctggggtgcagtggctcatgcctgtaattccagtacttaagttcgagaccagcctggccaacatggcggtaccccaactctacaaaaaaataccaaaattagctgggcatggtggtgggaggattgtttgaacctgggaggtggaggccgaggtcgcaccactgcactccagcctgggcgacagagccagaccctatcaaaaaaaaaaaaaaaaagaaaagaaaaaatgaagtcctcttggtattttacatttttatttttttattttcaggttaagatcaatctacaaggagatatagtagatcgtggaagcactaatctgggagtgaatcaggccggcttcaccttacactctgcaatttatgctgcacgcccggacgtgaagtgcgtcgtgcacattcacaccccagcaggggctgcggtgagtggctgccctggtagcatctcaaggtctaaagctgctgagtgaaaggcactgcacgtttcctctgaattgcccttgttgtttatagtcagtaaaactaattttgttgaatataaaaaaaaaggtgtaccactaagtttgactttcttaaaataattttttttccttttaaggggtccatatatcccatttaatttggaaaaacatgtaataagtctgaaaatgcctattagatttaacaattggccgggcatggtggctcatgcctgtaatcacactacttcgggatgctgaggcgggaggattgctgagcccaggagttggagaccagcctgggcaacatagtgagaccccgtctgtacaaaaaaaattaaaaaattaaccagtgtggtgcgtgcctgtacttccagctacttgggaggctgaggtgggaagattttgagccaaggatgttgaggtttcagtgagctatggttgtgcctctgaactctagcctgggtgacagagtaagaccttgtctcaaaaaaataaaataacagtaaacaaaacaaagtcatagagaattgagggagaggtaagatttcagggtgttgaagactgtggggacgtgcaaaatgacatcagtaagcaggcatctcgttcgagaagaatgggaaaagaaggagagggcaagctggggtggtgggtggagggtgctgtgggctcggggaagggtgtttggggtgtgggagacttgaacgtgaggacagtctgtggggacgagctggggaaagggagaggttgaggcctagaaaccaacctgtccagctccccgcagccaaccagcaggacccaggctggattgtgacggggaagaagaaaaggagcggctgggagaggagacacaggcagtgcaggctgttacgaggcttagcttccaagctgctcaggaaccctcctcctcagctgtgcaccaagccttaccccttctggtgtgaatgggccaccctgacaaagccccagacccctccgtatgaaagtgcacgtgcaggctatctgctcaatgtcatgtgaaagcacagtacttgagaagtatgctttttatcaccaattttatataaggacttttggggtttattgtacaacagatgaccttattgattcagtaatgctgtattttttttttttttttgagacggagtctcgctctgtcatccaggctggagtgcaatggcgcgatcgcggctcactgcaagctctgcctcccgggttcacgccattctcctgcctcagcctcccaagtagctgggactacaggtgcccgccacctcgcatggctaattttttgtatttttagtagaggctgggtttcaccgtgttagccagaatggtcttgatcgcctgacctcgtgatccgcccgcttcggcctcccaaagtgctgggattacaggtgtgagccactgcacccggcccagtaatgctgtattttaattgatcttggttttttttttggagatggagtcttgctgtgtcacgcaggctgaagtgcagtggcgcactctcaactcactgcaacctctgcccctcgggttcaagcagttctcttgactcagcctcccaagtagctgggactacaggtgcacaccaccattcccggctaatttttgtatttttagtcaagatggggtttcatcatgttggcctggctggtctcgaactcctgacctcaagtgatctgcccaccttggcctcccaaagtgctgggattacaggcatgagccaccacgtccgacctgatattgatgttttaatgtcatgtgtgttggattatttggatgaacattacctctggtttgtttcactctgaacatatggttcttatgtcaacatcgtggttttattagatacatcattgtgtgaatgatgtgattttttttttcctgaaagaatgcatgtcactccagccactaaaatgtttatggattttaaagaactattaaaggtacctttgacagtatggttatgaacagctatcacgtaacgtgtttttgtttgtttttctgagacaggatctcaccctgtctcccaggctggagtgcagtggcacgatcttggctcactgcaacttgcatctcctgggttcaaacgattctcccacctcagcctcctgagtaggtgggactacaggtgcacgccactgcacctggctaatgtttttattttttggtagagacggggtttcaccatgttgaccaggctggtctcgaactcctggcttcaagtgatctgcccaccttggctcccaaatgactgggtttatgggcatgagccactgtgcccagcctctttttaaaattatcaaaataattttgcttggtaaggaaatttcttcttgtatgagagctgatactttggaaggagttaaatgtggtattgtctttttaggttaacttttctctatggaattgataaagatagtttttgaatctttgaagcctgttactttagggtcataatgttgctgtctataggtcttgtctttagaagaccttcaaaaatggcatattctgaggccactctggggaattttaggaaacttaaggactctatgaacacttagatttttctctttgagagtcaattttacttaaatacatgtagagaaattatataagaaattatatataaattgtatatatataattacattatatatatacaaacttgtataaatttgctttcacctaatttttaggtgtttcaatgttatctacaacctaagataaaaagtacagaaaaactttagagcacttggaaaacctcctccttttttttttttttttttttttttaggagatgagggtctcatatgttgcccaggctggctttgaattcctgggttcaggattcctcctgcctcagcctctagagtagcctcttgactacaggtgcatgccatcacatctggctaatttaaaaatattatttgtagaggcgggggtctcactttgttgcccaggctgacgtcgaacttccaggctcaagtgatccacctgccttagcctcttgagtgttgggattacaggtgtgagccaccatacctgatgggaagccttcttttgaaatgcactgagtcctcagaggagtctgtggtctgctccttgcactagatgcagtgctcattgtataattaaatccaggtttacatagcacttatatcagtgggaaaaagtctagaaagatgtggattttcttttgaggctctcccagtttaggggtagttttgtttttaagtgtgaattgttagcactggaaaccaagtttgtcttaagttcatagattgattttcaagaagaggacaaaaacatttcccttcccattttatttctgtgaggaaagcatttaccatatcatcagtcattgtgtaaccccaggttttccttcttcatggcgaccatttggtctctaggtctctgcaatgaaatgtggcctcttgccaatctccccggaggcgctttcccttggagaagtggcttatcatgactaccatggcattctggttgatgaagaggaaaaagttttgattcagaaaaatctggggcctaaaagcaaggtcagtaggcatctaatctggtatttaaattacagcagaaagaagaataaagcaaaggaccagtcttcctgcccagctccacagagcattcatgcttcccctcaggttcttattctccggaaccatgggctcgtgtcagttggagagagcgttgaggaggccttctattacatccataaccttgtggttgcctgtgagatccaggtaggggacagccattccagtcactctgcagtttatttagatgtgtctggggttcacatagatttttttttgatacttatcgagtaggagaggagtctttgagcaatctctttgccaaagataagctcatggatttgggacttgatcaggacaaatgctgtttcactgattgaagttggcaaaggattactgggcttttcatttctaatttttaaattttcaaatatgtcagtcactaccatttatggagtactggtgtgtataggcctggcatcaggtgcttagtgtgtgtcatcgcatatgtgatgtcacgtgacccccacagtactctttgaaaaagcaggtatacagaagtagagactcagagacttgcctgcagcttacagctgtgagttcccctccgctccgtcagccgttagttcacgttctcccctctgcttcttgacttatgtctgtggcgtagtgaagtcccaagtcctttgtaggatcctgaaaggtgctgtgttttctcatttctctgccaactttggtgcccaatatttttgtcatgctaaagaaatacttctgaaagtaactttgtgatcagtctgtcactatccattctacattttttattcttacactctagagatttggtttcttttgaaacctacatttttattcaagtcatctgaccctcttgatctcagtaaggaactcaagccatgctgtgtgtgttttggaaaaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctggtaagaatggtgccaccacttgatgataaaccttttgttctaaaagcatcagtgttggtgttcttacagcaagtgcgattgctgtcttttatgcagtatctgaataccttcaccttcaaagtcatgaagaagcactagggttgtttaacttctgaggtaaattacaataaaatgtagaggtgaaggattcctggtattgttttattttttaaagataaccttgtgtttggactcagtggggacaagagcacagagaatgcgtaggcagctggatgaccagctgtgtcagctcagtccccaccatcccacaagcaagcgagagaggtggcacttttgaaatcggtcagtcaggtatttaggcttttgtcttaacagcaaatcctggctgtctggggcctgatgactgtgttccatgggtatccactccctgtccacagcgtgggagcccctcagctgcttattgcagggacacagagcccggcatggtccagaaggcgggcttatggggcctgcagcacacagggaaagtgagcccacactgtgataggagggcagacacacaggatgtgttctgtgttacagggttgccgtgaagaatttcattcttttgcaaggactggagagaaaattttatgtggaaggtagcccttggaaatgacctcaaagaataggtaggatcttagcctgcgtttgaaagcctggaaaaaaacaggatgacaggatgaagaggccacagcacagctgcagacaatgggagtggggagatgggaacatgcaacgtacggtgcacctttcaggttcatcttgactttaccaggatcattaaatactcagttcttagagctgtattagaacactgcccttggggtctcagtcccgcagccacatcatcagacacagggctctggaacagatcccttccatgctgcacatcagacctcttagatgggggtcacgatggtccgtcctaacgccacatgacctcaagtggtgtagatgtgaggacatgtcagtgtggggaaagaaggcctcagaggggccagtatccttgtatgctgccagccagtactggacaagtgggcacgttccagcctaagacaggcgtggcccttggaccagatcacagatgagatgggtggcttcaggaagcagggtggcttcaggaggcaggaagtttaactttcctgaaggtttggaataaaaagtattcataggtctgattcaggctatgttaaatgttcttactgaaattctttgcacttgggatgaatattgtccgctagaaaggaggaactgagggttttctgcctgggcgcgatagtcagtcagtggagtagactcaatcagtgacacagggacgaacagagaaggcagagtctagcgtaactttttgagttcatataatcagtgaggttgattgcattaattgactgtctactgttgagtcatgaacaggacacagttcttgccctcaggagtttatgacctaataagagagatggacaaacgattcccaaatgagccctgcccctgtgatctgtgcagtcataggcatgatgagagcttgcaggcagaggtgggtgccgattggtcaaggaggtaggaagaggagcaaaagctcatgaagaaggctgaagaagcagttagagttgggtggccagccagggtagtgaagctgcagggactcatagatggagaaagcttgagagtggggcagccatggcccaggtgtgcgtcaggagccaggtcatccagcatggctgtgcaaggtaaggagggctgaggttggcccagtcacacagcccctgcctcctggtaaatacggcgacattttgctgctcttctacttacagtcagtgtgagggaggagagaggggggtcagaatgcacagcagccaccaaagactgtgctgaaagcacatcctagaaggcggagagggggaagtcaaaatcaggtagaaactctgatttggtagggaaggaagataaggatgaatgattaataagtaaaacattcattacaaaaagcatgatgaatgtttactcagtgtccttaatgtgtacagattgttttaatattagaaggccatatagtttataagaaataaactagacagcaatcactaatcatagtccatgttttaatttagcatcggggttggcatatatgttgtttgctaataactgagtagagaatagttgccaatttccacactataatatatgttgcagccgagcacagtggctcactcctgtgatcccagcacttcaggaggctgaggtgggagaccaggagcttaagaccagcctgggcaacatagcgagattcctctccacaaaaaataaaaaaatttcaaaaagagagataatatttcatttgaacttctacagttagaaaaaaaatgctaaattgtcccccccccaaaaaaaatcaagatataatttcagtttctcaaagaaggaacaaatccatatatattttctctttctttttttttttggagagacaggatgtcatcatgttgcctaggctggtgttgaactcctgggctgaagcagtcctcccacctcagcctcccaaagtgctaggattatgggtgtaaactaccacgcctgacccaaatccatgtttttaactacaagccagatagtagttctgaggtctgagtattacttctggttttggtttaacagcatttaaaggggaagaataaagaaaaatccatatggtttcaggataaaatgatgttgatgagtcctgggtggtttattctgaagttgtggagattactgagttctggctctttaagcaaaaggaaacttgaattaataagaactgtgtttttctgcagatagtctttatggcagagtcattctcttttattattcctcaacaaagcatgctcagaaatgggaaaactgccagtacacacatttaccttatctttctgaggacaattatgaaaataaaacccaaaacaactccattcatgattgttattacctttttaaaaaaatgtaggccggtcacgatggctgatgcctgtcatcccagcactttgggaggccaaggcaggtggatcacctgaagtcaggagttcaagaccagcctggccaacatggtgaaaccccttctctacaaaaattagccaggtgtggtggagggtgcctgtaatcccagctactcgggaggctgaggtagaagaagcacttgaacccgggaggcagaggttgcagtgagccaaggtcgagccacagcacttcagcctgggtgacagagcaagactccatctcaaaaaaataaaaggaggccgggcgtggtggctcatatctataatcccagcactttgggaggctgaggcaggtgggtcatgaggtcaggagattgagaccgtcctggctaatacagtgaaactccgtctctactaaaaatgcaaaaaattagccgggtgtggtggcacgtgcctgtggtcccagctattcaggaggctgaggcaggagaatagtgtgaacctgggaggcggaggttgcagtgagccaagatggcgccactgcactccagcctgggcaatggagtgagactctgtctcaaaaaaaaaaaattaaattaaaaaaataaaaaaaatattgaaagagtgattagtaatgaagatggcccccaaaaaagagcagtacccagaggggagagagaattctgaattgagaggactgtttctagagtaccacagccagcagggcacaggccactgaagtgtcttgtatgtctgaccctgtgcagtccctccaagtcctgattctcttgtgatgtattgtgaaggtgctgtgagtgacttggttcaggtgcgaatctgttaggttgttgagcagacagctcttcagcatcccccgtattacctctctgtgctgggcaacaaatcactacaggcctggtggcttcgaacagcagccatttatttcctagcttctgtggggcaggagtccaggcacagcgaactcaacctagggtctcataaaggctgcattcagggtgttggctagggctgggttctcatcaggagacttgactcagaggatccacatccaggctcttctagactggggacagaattccttttcttagggctgaagcattcttggcagctttacttcttcagagccagcagtagagacagagactcttataagataggtgctaaactcttctgtgatacagcccatcatcaccttttgtgaattccgctacttagaagcaagtcagagatctcacctgtgctcaaggtgggaggggattacaggagctgggggcctggggccactgtgaagtctgtctgtcacacttaccaagtgtggccaggagagatgcagaggacaccgtccatgcccttagagatgctgtctgtgggaggactctgcagatgagttggtccagtagaggcatgaagtaagtggggctgtcttttaccacagagcacatggtcatgaggcagagctggaggtgaatttgaatgttgttgtattcagacgtaaagtaattttgctgagaaccagttgtcatgaggtatacttacttaccttacttacctaaagattatcacagtatttaaactgtaacttaagaggtaaaagtctattaagtatgttgatgaatataacctgcacagtggctggcagcaagtaaaccctgtttgggtgttcaactttaattttttgttgaaatatgtaagcaggagagtgcacctaccgcaagtgttcagtttgttcatttttaaaaactgaaccccctgtataaccagcagtcaataagagcaacggtagcagcacctcagaacacccccagcacctccttcagttcacttgtcccatcccaggggtgacaactgtcctgtctcccaggacaaccaaaacaaaggttgttttgcatcttctgcacttttaatgaatggtattacatggtgtatgttctttgcaggttggtctctttcactcagcgttgccttcaggagagtcatccacgtggttggtttagagcacattgtgtcactataagccttcttatgaagacactagactatccatctcctatatggatggacttttgggttgtttccaattgtggtttacgaggagtagggttgctgtccacattttagtacctggtttttggtgaacacatttgcttctgtggggtgtaaaattaggagtggaattactgagtcatagggtatgcatgtgttcaacttttgtggatgtttccacatgattttccaaagtgaaaccctgttttgagatctggaatattgactgtctttcactctccttggaccctagggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaaggtgtggacgaacattacacacgatcacgtgaaacccttgctgcagtctctctcgtccggtgtctgcgtgccaagctgtattaccaactgcttggtctgtgcctaccttactgttcatagttagatgacgtagagcaagttgggtagctggggcttcggaggctttgggaatccagcctttctgacccaggtgtaaagcgaaccttccttattcactttcttgtagtctgaacctaagtccactgaatgcattactaaaattcggataatactatctgcttgaaactgcttaagatgtaatgtaactccgcagtagttccagtatatctccgtatatagcaaaaatatacaataatttacatgtattaacctacaaataggagctcttcttatttaattcaaattatattcagggactcttaatacttcatgcacaaaaagacacttcagtcctaaacctgtattttagtgttgtgaactccagtggtttcaagtcactaaagtttcttaagtcttcagtgttttcttaagcagttttcccttgtggctccctggcgtgttctctgctgactcttgtcccctgcccttagtgttattcccctgctttctatcccaaagcctccgaatgcacacccccagctgccctctgcatggactgttgcatgtgagtagacggccatagtggcgagtcaccttctgactcctgttgggtgcggcatgacccaagtgcagcgcaggccatctgcaggcaccagcgacagacgctgcaaggggtgcttcgtttcagcgttaatgccgctcaagttatcgtttgtcctgagaggtgctcccatgtcgtggtgctgagacctcctctgaagatgggtctttattcctcctgtaacctacctctaacagtccacccagctctgctttaaactgtatgtagaagaggcccatttccagaagcccctggaatggaggagacaggggctgaagcagactcatctgtgcatgactagttcattaggagttcagttgaaattagattagatgctcctaaaaccatgggcaaccaaatacataaagtggggctttcttttccccttgtaacagtgttttactttatagatttatttaaagaaaaaaagttttatcttccccaggtggtcctggtgttttcctgacgcagttggtgagaagcctccgtgctcctgagcggccgcgtcacctgggcagggaccctgtgtggccatggggctctgagcatgggagtgcgtctctcctcttctttcctgccctccttgtcttctttccccccttcttcctgtctccccttttctttcatttgtttattttttacttgtttcacttgttaaaggaagtgggcgttataaaacaaaaaaaaaaaaccccaaaacacctttctgcggctgatgtgaagcacagtgctgaattgccatgaggaagttttccaaagcgtttaggcagcagcgcgagctttatttaccattagcttgcaaaacaactaagtcactttaggcctagtagtcaatgtgtacatccaaggggaggccttgctccgcatttatatttgtttcttactgttctggagtgacagagtccatgcagtgctcccaggttggtatcttttcatttataatgattgctgttactttttcaaatgtgttcaagtttctgaggttgctgtttgaaatgctttgactaaaaattatttttaataaaacgctggagttgtttttatctgagaagataaccatcagtgagtacccagagctccatgcccattccacactctcctcgcagtggctcagcatttgctggttttgttgctttttttaaagtcgtatggtttatggctatcttattgcctctcgaaagtattctgaaaggcataacatttgctctcgaagatgggcttgttttaatgttcagtgcctactcatgccttagaatttgattaaaaatctcagatttgattggagatccaaaaaaaaattatgggtggaaggctcagcatgctgacgagatgcactgatactaaaacagcctttaaatattaaggactcatgaagcgcttcaagtttgtttgggatatttttgtagcactcaaaaatattaagttatataaaatattcgacatcaccaaactcttcttccaggtagctaccgtgtaagtgtccatacagtaatgttcttgggttgaaagttacgcagacagtgcattctgatgctgtcatttactttaatgcaaaactttggtgatgcccactcttgcctcacggtgcaggctcctccctaaccctgggtagcagcatcacattgcttttcatgaccctgtcatctcatgcttccagttggctttggtgttggatgattttcagagcagtgaaccaatggtctctgaggggcctcccctgctggtcccagggttatggggctcagctctgtcgtcagcctaccttatgacccagattcagctgggctttccagatggtggttttccatcagtcatgactttgacttccagcattaactggtctttatgtggctgcatcctgctcccatggcgactctgctgagtgacccagattagatgtggtcattggttcagtcctctctgtgatgttcagtgcatgaccagatgtgagataaactgaatagattggatgctatgtcacttattgttgtcataattctgacttttcaactgttcttgatattacagtggactaaagaggatggacatagaacttccacctctgctgtccctaacctgtttgttccattgaacactaacccaaaagaggtccaggagatgaggaacaaggtgcgtcctgcgtcggcactcagcgggggcttgggtgtgggattggaagggatgccagctgctttggggggagcgggtgcttgcttctagcagagggcatctgctgttgttgccactgttgcagtgaagccatctcttcacaccgctgctgttctaccaccagtgtgaagtatgagcagcagacattttttgggccctattgattcttgaactgatgtttgctcacgatgtttgctcaccggtcagaattggaagctgcaaaacctgttcttagcaagagcagactgctgtccctttcagggttcgttcaaagacttgtgagtggcatttggtgtatcagagcaggagccctgccagtgctcacatcactagacgatggacatgcagcgagtgtttcccccaagttaatgacagtgagagataggtgtcctgcccaagcatctggaagatgtggggagctgggaatagtctccatccctgcagacccacgccccactaagcaggcatggcggtcactcagaacacatggggccatcctgcctgcgtggggcagtgggagagctgaaatgtagcttccatgtggctggggcccaagtgcacaagcagcagggctcccaggcagcatggctgctcaggactgttgatgtgtgcctctccttcccaccctcagatccgagagcagaatttacaggacattaagacggctggccctcagtcccaggttttgtgtggtgtagtgatggacaggagcctcgtccaggtgagagcccagagtgtctctgactttagtgggtggtggctgtgtgaccgcctgctccaaagttattctgaaattgagagagtgactttatgaggtaagtattctaggcaaccagttacctttgttaaaaccttcatgatgagaaacggttcaggcacttttcgttgagttctagaaggagcgagcatgctgagggctgtgtccacccctctggtcatgccccttgtaatgcatgcatatgtgagggtggcacatacaccaccagctttggggctcagattcggcccgggttcagcagcgttctgtgtaaggcgctaggagagggtgggtttagggactcttgttctggtacatattgctgtctgcaacaaagtgctgcttgggttgcagaggggtgggtgcctgtaagtgtggtgcacatttacacacatttctacaaaatgactctaccttgtggcacattgaagataattgtgtaagtagttatctctgaaaactaatatgccacctaatgctttaacacctgactctgcaggggtagacgattgttggatttgtccagccgtggtcctggtttcgtgttcagtgtctgcacgtcctgccatcatcactgccacacttactgttgacagctgtccctgctgcatgctcttagccagctccatcctgtgctctcagctgatatttcacaggctgggcctggtgtgctctggtgactcagtttactgtttcaggatgcacctctctctgactgtacggaaactatcgaagggctcgagcttacagagcagacctttagtcccgctaaatctctctcttttagaaaggtactcactgccctgtcctcactacctgtctatgcgccttgctcccctcccctcccccctccccgtctcctctcttcaggcattgtcttagttactgaagtagcttcaaatggatctttaacctgtttgtgagattgtacagaaggttctgttctacctacttgattctttaattaaaacatttgctatgaggtgtgataacaatttccagcattcgaagttgttactgagaaatggccagtctgagcaacgtggtgcatttctgcagttccgcacgggactttggtcagtgcgtgttttgggtttcagaatttgccttttccatgactctgactgcagacagcctcttctgggcagtctgttgctgttggcagcggccactcccgagtgcccttccaccctcgctggttcaactttgactgtaaatgtcatgaatgtagccactagaggtcatatcattgaaagatgtcatttcagaggaatgggaattcagacagtctttgtcagcccttgataaaatgtatttatttgtacctcaaaaaaaaaaaaaaaaaccctaaataacatttttaaatgccacagaggagaaagacttaggagagtctgaaacccctcactgtgattccctctgtgtgcgggcatctagtatgtggagtaggtggaagatctgtctgaacccacccacgtagaaggaaatcctccctaagaatctaggctgctagtgtgcaggagttggtgccacgcagaaaggggctgaccgcatggttgaagagtcttagctgagaggtatgtttatattcttgtcaaaggaaatttccagaactgtctctttcacttgtcacaccttcattgagatgcatgtgtcactttagtggtgttccagttcccacatagaagcaggtttatagcaaagattctgtattcctgtctgtaatccctgctaataacattattttgcatatttacttattaattccacaggtcctgtttttccctgtgcttagagcatccttccagctgccattcttggaagagcttctcagagcaggggagaaagatgactctgcctgttgcttgtttttcatcttttggcactttgttgcggtcttgtcagttattctttctctcaggtgtgtgagggctgtgcaggccatgagcccagctggcctcctgtgtagagcccacgtgagggcagcactgaggaccttgttagggctctccagaaagcagcctgggtcgccgtgttcaaccaccagttacagctttgtgtgctctgtcccagtgatattcagatgtgggtgtgtgtcactgtcacctgggggcttcctgaacgatagaggtagggtccgtaccttctgaacaccatgctcactgcgagtgctgcatccaggtgtcattagcagagaataccactgtacgctgaccccagaggaagagagcttgaccacctggacagaaatccttgttccacctttgtgttttctctacctccttatatctgaagtttacttttgcacccttgatctttatcccactctggctaaaatatccctctttttggtgagaatgtgctttggctccatgggagtcctttactgggcaattgttccacttcctttcatgtgaacctcaaagcacagacagtcttgctccttttggaacatggagctgcatgttgagaagttgagtttttccttgaccaagcaaggacgactgtgtcccacacactcccctccccagtgaggcgagtgcgtggatgcctgcttcccatctgagaacctgaagaatgggtatttgggacttagggagctggggcttttctggaaaggactttcctttgccttccatttctccctcactggtgatggccattcccacagtgcaagtgttgccttctgatagaagaaggaacagtaatcacagttcaaacaggagttcgcagcccagccgaaggctgtgttgactttgttttgggcagcataacatgtaacctgaaatacatatatatatatatatattttttttttttttttgagacagggtctcactctgttgtccaggctggagtgtggtcgggctgtcttggcccactgcaacctccgcctcccgggctcaagcagtcctccctcctcccatctcagcctcctgagtagctgggactacaggtgcacatcaccacacctggctaaatttttgtatttttttgtagagactgggttccgccacgttgcccaggctggtctcaaactcctgagctcaagcagtccacctgactcagcctcccaaaatgctgggattatagggtgtgagccaccgcgcctggcataacctgaaataattttggctgccctctggattcaattgcaagtgaaatgaaggattagagatgaagatgtgagtctacactgcaagctattcagcccagggaaggactcttgtgttcccatgtgcacctcaccaggggctgtgttctccaacacccttcatgctgtgtggtagaaatgcagaggggcagtaagctcaccccttggactctctcagtgacctgtgttgagcacctaacctgtgcatggtccagcactgggaatgccagtccagatccaagttggccctgctcgtagatgaaaatctgatggtcagagaggtcagccgctagtgcaggttgcacagcctcgggtggagctcttgttccacccaggttgcctcagtcaagtatggaaagttactgggcctgtgttttgctttagaggcttgtcaagtgacagggaggtgaggggagtggcaggaggggaagctaggcacatcttggtttcttgtctgggttgtccatgagtggcgtatgtttctctgcatctcagtcattgctctgtgtcctttcttgcagaggaatgtgattctctgttcccataactggtcttgacagcagcttaacccttagctgtggtctgtggaggagggagctctccaccactggggacctgctgcgctgtgcctcgggcttcagctgtctcagtatgagagagccccgcttgtcctttggggcatcaaaattgggaacaagggttttgatgtctctgtgccaatggatttttatttgtatttttatttttattttgagacagcatcttactctggcccatgctggagtgcagtagtgcaatcacagctcactgcagcctcgacctctcaggccaaaagaatcctcccacctcagcctcctcagcagctgggactacaggtgcatgccaccatgcttggctaatttttaaattttttgtagagacaaggtctcactatgttgcccaggctggtctcgaactcctgggctcaagcaatccttctgccttggcctcccaaagtgctgggattataagcatgagctgtggtgcctggctgatagtttattctttgtttgtttgtttgttttgtttgagacggagtcttgctctgttgcccaggttggagtgcagtggcgcaatctcggctcacctcaacctccgcctcccacgttcaggtgattcctttgcctcagcttcccgagtacctgggattacagatgcccactaccacgcctggttaattttttttgtatttttagtagagacaggttttcgctgtgttggccagggtggtcttgaactcctgacctcaggtgatccacccgcctcagcttcccaaagtgctgggattacaggtgtgagccaccatgcctggcctgatagttgattcttgatatttgattcctttactaattttaaccacttgatttaaatgaacttaagcatttctcttgtatcaccttctcatttcattggcagtgatatcaggatgcaggtgcagccagccaaactgctgttgctgggataccatctctagagtgccatcatgtgagggctcttagcagtggccagcccagcagctcctccttcagatagtgaggcaggcctctggtcagggaaagacttggctcgggccacagcgctaagacatggcagacaggactcagcttcctgtcttggtgaggcagggcaacttcttaacgaaaagccaatgggcctcgagtcagacctggttcagaagagggttccctttgacttgttgactgtcgagagtctccaggctcccgggcaaaggttgcctgttccagcagcccatctgtccctctcggagctctgtgtcactggtcagcactgggtacgcagcatgctaggtggtaacccctcagcccatcccagtcagtccaagttcccctgtctctgcttgaggagcggtcggcctgtgtgagttgaatttcccgagtcagcccagctaggacgctctccatctctggtgttcactccgcactgagagcagcactgaaggaccaggcctggcatccaaagaattgtggtttctcctgtttctatttggttttggaagctgtcagtcatgtgcatgtgtgtaagtgctggataactgtcttagaagtgagctccagggtagccgggcgtggtggcgggcgcctgtagtcccagctactcgggaggctgaggcaggagaatggagtgaacctgggaggtggagcttgcagcgagccgagattgcgccactacactccagcctgggtgacagtgcgagactccgtctcaaaaaaaaaaaaaaagaagtgagctccagggaattaggggacattttcctgcccctgacccaatcaggctgcactgtgggcacagcgctgtgctggggcaggtggctgtgagtggaccgcaccccctgatgcccacccagcccactgtgctggcctgcaggctccacctcctgctttaagattggtgtggtctgtgagccgccttggtgcttcgctttcttctttttttctttggtacaaattttcagagttttccaaattcctcagctaaacactggtgtcttggggcatgttgtcatctcggaatgttttgggataagctccaggaactagttacaaactaaccacagtcaaaagaacagaacttacctgtgctcttagaatatgagcaaagctctgagcatgccttacgctgagtgctgtacctcgtgacagtttctgatgtcatgaggaaaacttactgacttttaaacagtaacaggaaagggcctcttccccttctgctccacagtgaggagtgggcaccctccctgaggtgctctgtgctcttgggtctgcattgggcttttgcttctgaaacctggaaggctctgtaggatttcttttgtggttaatatctgttcatcgtggcactgacctgtgtttccattatataccactgaaggctgcagctcagcctaggcctcgggcccatggcagtgcagtctcaggggtctctgctcctggaaagcctcctgcccccgccctgcctgcagcctgcctgggaggagggagagtccccatcgggccgggctcctgcagaccagatgtgcctttcatccacagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaaggtgagtgcttgtggtcctgggcacggccactccagaaggtgaaagtgctctgggagcttctttgtggtccaggtgctggctgtgggtggtgataagaatagtcacatgcatcaaagacaaaccagaactttatccagtactcatttccaacctagtcactcaggccagaatggaagaaattgctggccgggcacagtggttcatgcctttaatccagcactttgggaggccaaggagggcggatgacctgaggtcgggagttcgagaccaacctgaccaacatggagaaaccccatctctaccaaaaatacaaaattaggctgggcatggtggctcacgcctataatcccagcactttgggaggccgaggcgggcggatcacgaggtcaggagatcgagaccatcctggctaatacgatgaaacgccgtctctaggaaaatagaaaaaaaattagccggatgtggtggcaggcacctgtagtcccagctacttgggaggctgaggcaggagaatggcgtgaacgtggaaggcagggctttcagtgagccgagattgcaccacggcactccagcctgggcgacagagtgagactctgtctcaaaataaatacataaatacatacaaatacaaaattagccaggtgtagtggcgcatgcctgtaatcccagctactcgggaaggctgagtcaggagaatcgcttgaacccggggggcggaggttgcggtgagccgagatcgtgccattgcactctagcctgggcatctcaaaaaaaaagaaattgcaaagttaggcacacttgtgagtggccctggctaggagggagacgtgtgtaaatgacgatgtggaggactagtggtggccactcacaagagtctgcgcgccatactaagacacaccggggcccctctgccaaaacgaggctgaccccgaagatgtcctgccgtggtcccatccagcagctgtgatgagaggagacagcaggaccgaggggcaacccacagaactctgggctggagggcattggtccttctcccagggaggtttctgtccacatggagtgaccagacattcacaaaagaattcactaatttggatcagttagtgggaaagccagcatgcatattattattattattattattattattattattattattattattatttttgagatgaagtcttgctctgtcgccaggctggagtgcagtggcacgatctcagctcactgcaatctccgcctcctgggttcaagcaattctcctgcctcagcctcccgagtagctgggactacaggcatgcaccaccatgcccagctaatttttgtatttttagtagagatggggtttcaccatgttggccaggacggtctcaatgtcttgaactcgtgatccgcccgccttggcctcccaaagtgctgtcattacaggtgtgagccactgcgcccggccctgaatattatttttaagagacttttgtctctctctctcttttttttaaattaattatactttaagttttgggatacatgtacagaacgtgcaggtttgttacataggtatacacgtgccgtggtggtggcacatgtatgggtggcacccatcatctacattaggtatttctcctgatgctatccttcccctagccccacacccctgacaggccctggtgtgtgatgtccccttccctgtgtccatgtgttctaattgttcaatccccacttatgagtgagaacatgcagtgtttggttttctgttcctgtgttagtttgctgagaatgatggtttccagcttcatccatatccctgcaaaggacatgaactcatccttttttatgattgcatagtattccatggtgtatatgtgccacattttctttgtccagtctatcattgctgggcatttgagttgtttccaactctttcgtattgtgcatagtggtgcagtacacatatgtgtgcatgtgtctttatcatagaatgtttataatcctttggttatatacccagtaacgggattgctgggtcaaatggtatttctggttttagattcttgaggaatcgccacactgccttccacaatggttgaactaatttacactcccaccaacagtgtaaaagtgttcctatttctccacatcctctccagcttctgttgtttcctcgctttttaatgatcgccactgtaactggtgtgagatggtatctcattgtggttttgatttgcatttctctaatgaccagtgatgatgagcttttttttcatgtttgttggctacataaatgtcttcttttgagaagtgtctgtttatatccttcgtctgctttttgatggcattgtttttttcttgtaaacttgtttaagttccttgtagatcgtggatatgagccctttgtcagatggatagattgcaaaaattttctcccattctgtagattcccttttcattctgatgatagtttcttctggtgtgcagaagctctttagtttaattagatcccatttgtcagttttggcttttgttgccattgcttttggtgttttagtcatgaagtctttgcccatgcctatgtcctgaatggtattgcctaggttttcttctaggatttttatggttttaggtcttatgtttaacccctcttgagttaatttttgtatgaggtgtaaggaaggggtccagtttcagttttatgcatatggctatccagttttcctaacaccatttattaaatagggaatccttttcccattccttgtttttgtccagtttgtcaaagatcagatggttgtagatgtctggcattatttctgaggcctctgttctgttccgttggtctctatatctgttttggtaccagtaccgtgctgttttggttactgtagccttgtagtatagtttgaagtcaggtagtgtgatgcctacagctttgttctttttgcttaggattgtcttggccatacgggctcttttttggttccatatgaaatttgaagtagttttttctaattctgtgaagaaagtcagtggtagcttgatgggcatagcattgaatctataaattactttgggcagtatggccgttttcacaatactgattctttgtatccatgagcatggaatgtttttctatttgtttgtgtcctatttcgctgagcagtggtttgtagttctcctcgaagaggtctttcacatcccttgtaagttgtattcccaggtattttattctctttgtagcaattgtgaatgggagttcactcatgatttgactctttgtcaattattggtgtgtaggaatgcttgtgatttttgcagttgattttgtatcttgagactttgctgaagttgcttatcagcttaaggagattttgggctgagatgatggggttttccaaatatacaatcatgtcatctgaaaacagagacaatttgacttcctctcttcctatttgaatacactatatttttttctcttgcctgattgccgtggccagaacttctaatagtatgttgaatacgagtggtgagagagggcatccttgtcttgtgccagttttcaaagggaatgcttccagcctttgcccattcagtatgatattggctgtgggtttgtcataaatagctcttattattttgagatacattccatcaatacctagtttattgagagtttttagcatgaaggggtgttgaattttattgaaggctttttctgcgtctattgagataatcatgtggtttttgtcattggttctatttatacgatggattacgtttattgatttgcatatggtttttttgttatttggtttttttttttttctttcctgagacggagtctccctctgtcacccaagctagagtgcagtggtgcaatcttggttcactgcaacctccacctcctgtgttcaagcctcagcctcctgagtacttgagactacagacacacgccaccacacccggttaatttttgtatttttattagaggcggggtttcaccatgttggccaggatggtctcgatctcctgaccttgtgatccacctgcctcagcctcccaaactactgggattacaggtgtgagccaccgcacctggttgatttgcatatgttgaaccagccttgcatcccagggatgaagccaacttgatcgtggtggataagctttttgatgtgctgctggattcggtttgccagtatttcattgaggatttttgcattgatgttcatcagggatattggcctgaaattttctttttttgttgtgtctctgccaggttttggtatcaggatgatgctggcctcatacaatgagttagggaggagtccctctttttctattgtttgtaatagtttcagatggaatggtacctaccagctcctttctgtacctctggtagaatctggctgtgaatccgtctggtcctgggctttttttggttggtaggctatttattactacctcaatatcagagcttgttactggtctattcaggggtttgacttcctcctggtttagtcttgggagggtgtatgtatccaggaatttatccatttcttctagattttctagtttatttgcgtagaagtgttcatagtattctctgatggtagttcgtatttctgtgggatcagtggtgatctcccctttatcattttttattgtgtctatttgattcttctctcttttcttttttattagtctggctaaatggtctatctattttatcaatctttaaaaaaaaccagctcctggattcattgatttttttttgaaggcttttttgtgtctctctccttcagttctgcactcgtcttagttatttcttgtcttctgctagcttttgaatttgtttgctctttcttctctaattcttttaattatgatgttaggatgtctattttagatctttccctctttctcctgtgggcatttagtgctataaatttccctctaaacactgctttagctgtgtcccagagattctggtacgctttgtctttgttctcattgttttcaaagaacttatttatttctgcgtgaattttgttatttacccagtagtcatttaggagtaggctattcagtttccatgtagttacgcagttttgagtgagtttcttaatcctgagttctaatttaattgcactgtggtctgagagactgtttgttatgatttccattctcttgctgaggagtgttttacttccaattaggtggtcaattttagaataagtgcgatgtggtgctgagaagaatgtatattctgttgatttggggtggagagttctgtagatgtctgttaggtccgcatggtccagagctgagttcaagtcctgaatatctttgttaattttctgtctcgttgatctaatattgaaagtgggatgttaaaatttctcactattattgtgtgggagtctgagtctgtttgtaggtctctaagaacttgctttatgaatctgggtgctcctgtattgggtgcttgtatatttaagatagttagttcttgttgttgcattgatccctttaccattatgtaatgccctgctttgtctttttaaatttttgttggcttaaagtctgttttattagagactaggattgcaactcctgcttttttttttttttgcttttcttttgcttggtaaatattcttctatccctttattttgagccagtgcatatcttcgcatgtgagacaggtctcctgaatacagcacagtgacaggtcttgactctttatccagtttgccagtctgtgtcttttaattggggcattttgcccatttacatttaaggttaatattgctatgtgtgaatttgatcctgtcattatgatgctggctggttattttgcctgttaactgatgcagtttcttcatagtgtcgatggtctttacaatttggtatgtttttgcagtgggtggaactggtttttgctctccatatttagtgcttgcttcaggtgctattgtaaggcaggcctggtggtgagaaaatctctcagcatttgcttgtctgtaaaggagtttatttctccttcacttacgaagcttagtttggctggatatgaaattctgggctgaaaattcttttttttttgagacggagtcttgctctgtcacccaggctggagtgcagtggcgtgatctcggctcactgcaagctccgcctccagggttcacaccattctcctgcctcagcctccccagcagctgggactacaggtgcacgccagcatgcccagctaatttttttgtatttttagtagagatggggtttcaccatgttagccaggatggtctcgatctcttgtcctcatgatctgcccgcctcagcctcccaaagtgctgggattacaggcgtgagccactgcacccggccgaaaattcttttctttaagaatgttgaatattggcccccactctcttctggcttgtagggtttctgcagagagatctgctgttagtctgatgggcttccctttgtgggtaacccaacctttctctctggctgcccttaacattttttccttcatttcaaccttggtgaatctgatgattatgtgtcttggggttgctcttcttgaggagtatctctgtggtgtttctgtatttcgtgaatttgaatgttggcctgtcttgctaggttggggaagttctcctggataatatcctgaagagtgttttccaccttggtttcattctgcctgtcactttcaggcacaccaatcaaatgtagctttggtcttttcacatagtcccatatttcttggaggctttgttcattccttttcattcttttttcttttaatctttacactttatttcattaagttgatcttcaatctctgatatatcctttcttctgcttgattgatttggctattgatgcttgtgtatgcctcacgaagttctcatgctgtgtttttcagctccatcagatcatttatgttcttctctacactggttattctagttggcaattcctctaatcttttttcaaggttcttagcctccttgcattgggttagaacatgctcctttagctcagaggagtttgttattacccaccttctgaagtctacttctgtcagttcatcaaactcattctctgtccagttttgttcccttgctggtgaggagttgtgatcctttggaggagaagaggcattctggtttttggaaatttcagcctttttgcactggtttttcctcgtctttgtggatttatctacgtttggtccttgatgttggtgaccttcagatggcgttttcatgtggatgtcctttttgttgatgttgatgctatccctttctgtttgttagttttccttctaacagacaggctcctctgctgcaggtctgttggagtttgctggaggtcgactccaggccctgtttgcctgggtatcaccagcagaggctgcagaacagcaaagatcgctgcctgttccttcctctggaagtttcgtcccagaggggcacctgccagatgccagctggagctctcctatatgaggtgtctgttgacccctgccgggaggtgtctcccagtcaggaggcacaggggtcagggacccacttgagttggctgtctgtccctcagcagagcttgagtgctgtgctgggagatccaccgctctcttcagagccagcaggtagtaacttcagtctgctgaagttgtgcccacagccaacccttcccccaggtgctctgtcccagggagatgggacttttatctataagcccctgactggggctgctgcctttctttcagagatgccccgcccagggaggaggaatctagagaggcagtctggctacagtggctttgcatagctgcggtgggctctgcccagtgtgaacttcctggcagctttgtttacactgtgaggggaaaatggcctactcaagcctcagtaatggtggatgcccctccccccaccaagctccagcatcccaggtcgacttcagactgctgtgctggcagcaagaatttcaagccagtggatcttagcttgctgggctccatgggggtgggatctgctgagcaagaccacttggctccctggcttcagccccctttccaggggtgtgaagggttctgtcttgctggcattccaggcgccactggggtatcagaaaaaactcctgcagctagctcagtgtctgccgaaacggctgcccagttttgtgcttgaaacccagggtcctggtgtcatgggcagccaagggaatttcctggtctgtggattgcgaagaccgtgggaaaagcgtagtatttgagctggaatgcactgtttctcaagccacagtccctcatggcttcccttggctagatgagggagttccccgactccttgcacttcctgggtgaggcaacaccccaccctgctttggctcgccctccgtgggctgcacccactgtctaaccagtcccagggagatgagccaggtacctcagttggaaatgcagaaatcatccaccttctgcgttgatctcactgggagctgcagatcggagctgttcctattcggccatgttgcctgtcaccctgacatttgtctctttacgaacacagtatttctgtctgttgaagcttcaccggggagagacctcctttactcagtttgattcattaacactcagcattgctgagcagtcattgtgccgggcacatgcccagtgctattgtgcgtacatctcatctcattctcaaagtaaccctgagagataggtcattttcccccggctggagcagaggaatagggagctcagacagggcggctcgcgagaacgaggttgtgcgtggccgagccctgatttggacagaagcgcactgccttcctcactgagtctttggtcacagcagtcagccccggcctctgtgcagggggacgctctgaacgtccttactgtgcttgtgtgtagggcttggggtttctgacagaaattctctttctccataaaccttgagggtttcctgtgcaggtgtggtcacaggccggagggtgaaaatgctgactgccctggcatgtgcccaggtcccatcaggaatggctggtgcagcctgtacttctcttggtagcccgctgacaaaggcggtcttgtttttgtcaaagatggggcagtcttaaaatgaatacaaataagcggctcaagtttgagaccctcacggagcaggtggtttcaaatgtcaggctttgaaaaggaaatgttgagaactaatgagagaagcaggtctccaaagcctattccttgagggcttttgggcatcagctgcttttcccccaagctccctgctgccagctctcttgtccactaggctctgagcagccttggtgctggcaccaagaagaaccaggggcacagggacccctgccaggaggctcccgccagcatcctcagggccgtaagctccaactcaggtttttactgaaacctcagtgtgcttctcagtcctccggggtcagccttgctggagccaccttgttgtgtgggactgactgttgctctcctgggccgtcgtcatcctgggagctaggcactcctcctaagaggacctcttcaccggtttttgtctcgttctagaccagccactgcattacgtagttgtgactgaaatttgagttgctgaattgtttttcagtgtcacaccgctatttactattcaggccgccacacacaccaggccctgctgctggttgtctccctccagtgaagctttgtctgagccattgctgtaattacctgccttagagcgagaactggaggtagtcagcttgagctgtgggtcatgtggcctcctcctagtttctgtgcacatgtacacagacatgtgtctgccctttggagtctcctgggatctgagtaacctggattgtttttaaaaacaagtcaaacaagatatgtggagtttccccccgatgtgtgaggctccttcagcagggctgtgatggcagctgagtggatggggacaggctctggccgtgctctgtgatcacagagctgtcagcaggagaacccacaggaggtctgatctggcccttggcatgggctgaggggagaatgtgccacaggtaaaatgcaggctggctgccagaggtcagcaccttttcccggttgaggctgtatgctcactcagctaggtggtatggcggcctttttatggacacctggcttctggaaggtagctgccaacgtggtacttggggaggcgagccagctgttagggtgggagcagaggccctgggagctcagaaggatgatgatagctgctggttcaaaatacggacctgctgatcctaagctattaatcttaaacttctgaaataaagacagagatggaaggagttagaatagtgctggtccatattttccccgaaatgagaagtagacttggaatccttttctatatccaggatcctagttcctgcattttttcctctggttcttattagcatttttcactttaaaaagtaaaaatacgtattacagttgccaagtttaaattattgggataaaatgccctaccacagaattaaaaccaaaataatgctcatgtgatgtcccttaaggtggtgagtgggttcaggaccctcagccacctgctcagcagggagaaggcagggagggaggggtccctactcgcacaggacagcgggggacaggccagggcataccattcgagtccatcacagaagtggctctggcagactctctttggaataagaatagaaataagttttgtatctgaagttggttaagtttctctgaaattcgcatcagtcaacacccaggtcacagcttcctttatcctctcttggagaggatcagggaaagggttgagagagccctgccttctcagagggcggccgagcgggctgccccatctgccatggaggcaggtacaggctcatggcgtggcgtccacagctcctaccatatccttcttgcttctctgcagagaatctggacgaggctagagaacagaaagaaaagagtcctccagaccagcctgcggtcccccacccgcctcccagcactcccatcaagctggaggaaggtgagctctgggtggcagcggccgccactgtgggagggtgcacggctcgtgcgcgctgtggcggaatgtggcgggagtcgtgttaacagcaacacggaagtgtgtgcttgcatcagcgccaggacgtgacacctttctcctcctatattgcttctgtcctgggtaactccaggcaaaacagatttgtatgtgagctgtgaccaggtaggaaggccggcctcgggggtcggaacccaccatggttgctggtgtccacgttgcccattgctcgcacactcctcgtgccgtgttgtcatgcagatgccaccttcggaggtgccctccgctgtgtgagccacacgccggctgcctctcagccaccgtgtgtctgtggtgtgtgatcccgggtgtctgtccctcggtctcgtacatccatgtctctcgtgaagcccgtggccctgcctttcttcttctgtaacctgatggctgtgactgaatgcatagattctctccttgtgcttttttctccctgtggctgcgtcacaagcaggagacggatgcgctagagagtacctgttaccctagtaagtaccgtgctgcctccgctctccaccggtgccctgcgctttgcctcattctcctgcttctttgttgtttattaagttttgttttctgtttatttaaaataaaaacagaagccccccttttttgtacccagtcccttggaggccttcctggaagtggttcagtcacctgagtgctgtgctgccttcagcggcagcgggtacctccacgcacctaggtgccatggagcactctgggcctcaggagttcctacctccagcctttgagggtctctttggattgcttggtgggagggttttgccacactggatcagatgtaagtgcagcctcggttcagacagggtggggttctgccacctgccgtgtggggtcagattgccttggacctttgctgaagctggtccaaaggaggtgggcagaggagcggatattggaccctcgtaaagcagtgtgatgttcactcagatgatggcagctctccagagcgagtgccctggggcagcctccgtcctagcatcagccacaccatgcccagcagagcgggccccatctcctcagggggagcggcgcctgtgtgcccatagccctttcccggttctcatgaagcgtggcctggaattagcctggggcagctggcagggtgggggtgcttccagcttcccaaaggtaaagcactgagagtttggggcctgggcctcctgtgctgctcctaaccactcagctgactcccctggccctgatgtgtggcttgatttttaaacactaaacagcttgtggtgcctaacctgtcagttgctggtaactttgtaggccgtttacgaatggacagagcgggtgcccgggtaagtgcaaggaaggcgcccccaggctgtgtcctcagggccgctgtgctccttcacagatggccactcctgatgctgggtggagtttttgcccccactccttgccttacaggccatctctttccttttaattaacttccagcctaaacggctttgttcttttggatgttgacgtcacacaacgtgctgtgggagttatgcacgattttctactggctgttttgggggagaccaggtgttgtagacccaaatttagacttaatttcagtactactagtacatgcccttagggtgacagggcagacttctcgtcacataatgaaagcgggacgtcgctcctttagtcgtcctcagcttgtgctgcagtctgtctttccggcggggggacccaggcctgggacggagtctggtgttgtcagcacactgcccaccagaaggagctaaaaactaccccgagactgagtctgtattttatgatattagctccatccagccgtacagtagagtagaccatattttaagtttcttgtcttggtaaaaatctgtagagtaaaataaaatggcagtttcgtgtgtggggctcccccatctcaagctgccctttgagatctgggcaggaacccttaatcccatctctcacctcacccactagaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcacgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggctgctttttgctttcttctttccagaccccacagtagagcacttttcacttatttgggggaggcttcaggggactgttctcaccttaactcagccagaaagatgccctagttgtgatcaaaggtaactcgaggtggagggtagccctggggcccctcgacatcaccgtcattgatggagcctgaaccgtgtgctcctcggcagatgctgttgttgttacttccctccaagaggctggaaaagggctcagagctgctgagcaggaaccggagggtgacccatttcaggaggtgccggtaccagcctgactaggtacaggcaagcttgtgtgggcccaacaggcccttggtagagctggtgccagatgtgggctcagatcctgggcatgatgggccgagccacctcggatcccactgattggccagccgagcgagaaccaggctgctgcatggcactgaccgccgcttccagcttcctctgagccgcagggcctgctacgcgggcaagcgtgctgcctctcttctgtgtcgttttgttgccaaggcagaatgaaaagtccttaaccgtggactcttcctttatcccctcctttaccccacatatgcaatgacttttaattttcacttttgtagtttaatcctttgtattacaacatgaaatatagttgcatatatggacaccgacttgggaggacaggtcctgaatgtcctttctccagtgtaacatgttttactcacaaataaaattctttcagcaagttccttgtctaaatctgggaagcagttttatattttaatttctttgttcccatgtttgtctcgtgctgaaaagagacctcctaatgttcatgtcttgataaaatgtcacctgcagccacgcgtgcggcaggacgtgccacccagcactcctggtgtccctctccacgggaactcagggtgtccagggaactgctggcctgtccttgtccccatggtcccagtctcactgtcactgtgtgctcatgtttgatggggagggctctgtgctggggacatcctgccagggtgcggggcacactgccagataccacctggccagggctgaccccagccttggaggagcctgcctgagtgagtccccaggctgccactgtgcagagggggaaactgagggtctcaaagagccttggacccttccggtcagtggagccattcattcagctccagctgcctttcctggtgtgggtagaagcacggctatatatggcgaaaggcacttggtataaaacaaacaggtgctttatttcatcatcagaaacctggtgcatagtttaaaaaacaaacagaagccctgacagccttggagtgctgcagctcggagtcactgaaggagtaagtaagtctggaggagctgcctgagcttcctgcttaggggccggcccccacccacagggtctccctggactggcggggggtgggggtcaggcagtgggcaggggcctgacctaggctcccactctgcctggtgcccacagcctgggcacagtggctcagctactcagccttgagcgtctgtgccgggtaactcagcttctgcaggaggaagaaggggagcaaaaagagcccggaccacgtggtgaagcaggcctgggccccggccagccagtacactgcggagagacggtggcgtcacccagtccccgagggggctggcacttgggaggcgagggcaggtgcttggcccccagcctgccccagcaccatcccgcgccctcacctgaagcggccaccaggggccccgcggccctggccagagcacctaggctgcgcagtgtacccatgaccgtgcccttctgccctggtgagcctgtgggaagaggcacagtcaggcaccactgcccttctcccgctcaggtggcttcggccgagggaagggggctcaccatagccagcgaccacggaggacaggcagggcaccacaacggcggcggctggtgggagacatcgaggaggtgcccgtcagcccaggggagggtgcatcacccagcccctgctgcccatcggatcccctgccagggcagggccactcaccaaaggagtagagcagcagccccaggcccagcacgggcagagaacgtccccagccgatgaggaggaaggcgggcaccagcagcaggagggcctgcaggtgggcacggcagcctcagcacagcccgtgccctgcaggactcaggggactgcctgccacccgctttggagggagccccctacccgcttcacggcagcaacttccccgccagggtggatccgccgggcataggcaccctggatggtggccatggtgaggccgatgaggaaaaacatcttcccctgctgtaggctgggagcgggtgtgttagtgcagggcacccggggcagggccacccagggcagggccagggcgagagtggctgccaaggcttcctggggatgggggttgcttccctgaagcaggggcgttatttcagggagacagcaggccgtcgccagatggggacccacctactgaactggaagcgctggtgtgtgaggaagctcagcgtgtactccaggcccgagaacaggaagaggtagaggaagtagactaggcccaggcggcgcaggctgctgagccctggggagaggtggcgcgtgctgagaaggcgaccacagcagggaagggcgccgcccggggaagcccaggggagagcaggctccacgcttgggttggtcgagtccttactgtctccagagggtgggtcctggccacgagcgacagccgagaagcgcagcagggccagggggctgagcagatcagccgcatcacggaaccccagggcgatagagggcgcctgtggggatggcattggagagcctgcaggagcggctgctggcctggcaacccacggactgtggcctcaagggtcccaacaccaagagagcggcccagcctccctggcatctggggctggcacacaggggcactttacatcgctatggaatcaagcctccagcccctaggcctgtgggtcccagaccacagccctacccgtttctccaggggcagcgtctctggcaggaagcagaagatgaacagcaggtcggaggctgcgaagagcagggcaaaccagggtgccatttccaggggcagggaggctccgagcatagggcccagggtgaagcccagtgagaaggccaccccaatgaccgcctagggaaaagaccacccgagctgcacagggagacccaggcccagaagtcaccaccaggaccccaaaggcccagcctgtgcacttaccatgccttgactgcgggccagaggcgagcccaggtcagcaacgatggccgtggagaggctgacgttccctttgctgatgcccccaatcagcctggaggccaggaaggccgcaaagctccgagaggtggcccagactgcatatgaggtggccacacccatctgcccaggggcaggggccaagaggcaggggcggtcgcttaaggccaggagtggctcagagtagggcttggcaacccagacaacacccctcaaccctgccctatttcgaagcatctgagggccacttgcgttctcagtgccttcctaggggccaggagcagctccttgaaagcctggctctggaacaggagccactggtcccccgagaaccccctccaggatgcgatgagggccaaccagtggccatgaggggcccacagccacctccctctccccacctaaccccatggggctactggctgggtgggaggaggcttccccatgggcacccaggcccaggaacataccaggcacagcagcatcaccgggcgcctccccaagcagtcagaggtggccccagtgagtggcgcacacagaaactgcaggacagagaatgccgagccaatgagacctgagagacagatgtcaccatcatggggctgcctggcaccatgagctgtggtcttggggccctcaaggccaatgtccagccccgtcctgagggtccagtcatgctgggccctacactcacaggccatggcccttgagccgagggggccccaatggagagatgaggaaggatctgaacgtgacacgcggaggcaagggatcatgcccagaagccaggacatgtgggcaagggcaccagacatgccagcccagggagtgggaaggcaaggaccgagaattggggaggggcctgggctggaccacgtccaccaaacataggaccgtagagagcccgccaagggcacagagccagccatacctccgaacaggacactgttgtacctcttctccactggcatcccgatggcggtggcaaaccagtccaccccgccctgccaggagccatagagggggtcctaggggatgaggaatcacgataagggctggggaggtctgatgggcctggggggcagggggcactgtgggccgcagggcaaggactcacgtgggcacggccgtggctctccaacagcccgggcagcaggggcagcagcagcgtgaaggccaggaggtccagcaggaggccgagaaagacaacggtgaccacgcggcgctccggcggctgctggtggatgggtgggcgcggggtgcagcctccaccccctccccatcccatggtgggctgctctgacctggcctgggtggggtgcggcgggtcgggttagcggggaagccgagtcctccggggcctggcatacccccacacccgacagccggcgagcaccctaaaggggctgatggcaggggctctggcctacggacgcaggggccgttctggcctgcgcgatgcccccgccccgaacccaggcagcaggaaacgcaggcttcggggattgcacaaaaaatagccgcaaaggcaacggtcctgagagaccagggtgagcacatcgcggacctggccccaccccaccccacggccgcgcctcccacgccctcgtaacagcgagagaaaacttgaagccgcggggaacccggatcccgatcccgatcccgatcccgatcccaaccccaaccccagccccggcccgcgccccgcgattccggcccctggcccggactcggtctccctggcgggggccatggggtgcacaccggacgcaggagcacccccaaccccgcgcgcctcccactccgccatcccgcgtgcgtcccggtcccgcccccaccccgcgcgcccccggtcccgccccccaccctgcgcgtccccggtcccgtcccccaccctgcgcgccctctaacccccacgccgcgcgcctcccaccgcccccaccccgcgcgcccctggtccagccccacaccccgcgcgccccctactcccctaccctgcgcacctctcacccgccccacccccgcgtaccccgggtcccgtctcctcccccaccccgcgcgtcccctgtcccacccccaacccgagcgccccctacgccccccaccccgggcgcccccggtcccgccccgcacctgccgcggctgcgcgctcgggacggacggtcgcacagacgcggaacagggcaccaggcacgccgccaggggcgggacggccacgcccggccacgccacgccccggaagtgacgtacatctctgcacgttctcttccggccggagtcagtggcggggttctcgccggtcctgcgggtcgctgcttggctgtgggttagcagcaccctgagcggagcggaagagctgcccgccgccgcgtaaccccgaggccgagactcctggcctggcctccttgggcccacgacgcctgccccgcggagcggacccatgggcctgaggtttgtgtgcggggcctcaggcgagcgctggcgcagcctgtcccccatcgtctgcgccctgcgggcctggccctccccgtggaaggaccgcgggcttcggggccccacgctggggggctgactcctgccacacacacagcggtggccgcgggcctggggcggcagcacagccattctgctcgggctgcgtgagctgaccccgctctctgtgcacctacttttgctgcgtttggtgctgagcctgaagtcccaggacaggcggctgagggggaaagatggtgtgaattgggtgggcagagacaactgaaagccacaggacccggttggcacctttttggccgcctgcgcctttgcctgcagccccgctccctgggtcacccgaaggaggagctggcgctctttccgggcgcagaagcacccgacccacgctggaggaaacggtccctctgggcaggagaagctttgggcctggctggagcacactcacggaaccacgccaacgcctggcctgtagccagctcccacctcccctcccaccttctaaaatgcttgcggatctcacgtggccgaccctaaccagatacacatggggaaaggaatcaggtggcacacataccgcctttactccatagagaacttccaattgtgggtaagaacaaagccccacctcttcctaatagatgcagttttccacctgcagccaaaaagacaacctgttattagcttttttcccagaggacaggcatctctatgaaactgccattgcaaaatttgccgacagtgagataaccagctccattttgcttctaacctccatgccctccttgtttactgctgcacgcaggttgaactgtgggaggaacttagtttaaaacaaagatgataacagccctttcccaaaggaaacctttcctggggattagcctgcttttgtgggaccaacagattagccacaagattagaaactacggttgaagagtcacgcagcgggaggctacaggattctgaccctccccaaactgctcctggcgataacatcaccatcgtaaagcctaagatcagcacttggtgggtcacctggcaccacccaggctcatctgatgttgtggcacccaggaactgactcagtgcgaaaacagcttcgactccctgtgatttcatctctgacctgaccaatgggtacttctgactcactggctgccccccacccaccagcttatctttaaaaactccaaaccccagatgctcagggagaccgagtaataataaaactccagtctcccacacagctagctctgcgtgaattaccttttctctgttgcaaatgccctttcttgataaattggctgtctaggtaacagggaaggtgaacccactgggcagttacacttttatccacccttccagctggatcacgcgccctcttcaatgacatgacacgcagctagagtgtatgagcttgctgccggcaccttccgtcctggatcgcatagcaaggcctcaatggacagccaggtgcctggtccggtcccacttttttttctgtcctgttctcgtttcctctttgcttggccaaagagggttgggccagggtcctgagtgcaaaggcttggcttggtgaattaaagtggcagtagccgtgtggcagagaaaatttgtagatgggtgaaatcctgggcctacacagtgacaaagtgtatatagacagccagcctagttggtggatgtgacaaccccagactcttctagatttgtggatccgtgcacctgccagacctgtctctgagccatctggggaggctgggtaagatttcccccgtcagggcctgagcctcatctccaagctgctggcttcagcccagctgccaccagcgctgtctctgtcttgcgctttccagagagagactgactcattttgagctccaggcctaccaggcagcccaaccgcggcagtaactgcctctcacactgaggatggctcatgctctggtccagccatggcttgaacacctcccaacaagaacaaagccagactcattctccctagcatcttcttccttgctcaaagatcccacaccccgttagaagctggaactgggtccttgtcaccttcctcacctccccagtcgtagtctggttaatccttacatctcaccacggtcaccgtggctagatgtgacctccgcgatgcttcaggcacgtaccagggcagcctgggcagggctggtcactgtgatctcatgaggtgtgaacttgaccccggccttctttcctgggatgccggctaaggacacaagttcagtgtttgccctggcttgtagcccagcgggggctccgtcatcccctggggaatgcctcggcctgcaagaccgcataccgcattggaacagggaaaccacctacttcagcacctccctcagcaaggtggcaggtcccaacaagccttgcaccacgaggaagtggcagtggcattcgggatatggctccctggccagcttgtgaagttcaaggggctcgttacttcttacagctcacagtccctcccgggtccagcacacctgagggctgacctccctcttgattagtgcaggggaaaagcactttaaaaagctgtgtcatgcgtaacttgcacatcttctgattctgacctgaaactgcatcccaggtcggcacagacgcaacccagtctcctcccacctccgagagtgcagtgtcctgaatggagaaccccagcacccagaagcatccactgaaggacgtaagtaggacaaggccaactgtggctgttccagcagagggactgtgggtgatgtttcccttctctgatttctaaaatatctgcaaacttgtttcatttataattgaaaatataatttgcataacaacagtaaattctacacatgaaggcaaacgtccgtggttgacagaaattacactggccagaatccccagtccccatgaggcttgtccagacgcagtgaaccagtcgcagctgataacacacagaccattcccgatcccagaggtgcatttcaggattcattctatttcatcaggtgacgttttaacagaaacaaaaccgcaggcagcgggtggggggagctggaggttggaatcacaccaacattatagcattattactctaaaaaaaattacttttttggctgggtgctgtggctcacacctataattggggggccaaggcaggtggattacctgaggtcgggaattcgagaccagcctgaccaacatggagaaaccccgtctctactaaaaatacaaaattagctgggcgtggtggcacatgtctgtaatcccagctactcgggaggctgaggcaggagaatcgcttgaacccaggaggtggaggttgtgccattgcactccagcctgggcaacaagagcaaaactccgtctcaaaaaaaaaaatttttttttaagcgacacagtcttgcactgtggccgaggctggagtgcagtggctcaatcacggctcactgtaaccttggactcagctcaagcagtcctcctgcttcagcctcccgagtagttgggactacaggtgcgtgccaccacacttggctaatttttatgtttttttggtagagacggggtcttcctgtgttgcccaggctggtctcgaactcctgggctgaagcaatcttcctgccttggcctcccagagggttggaattgcagatgtgaggtaatgtccagttccttgccttatttataaaatgtaatttattttttgaactttttcctcttcagagccttccattcgccttcctgtgtagccaggctgttaaaaagctgctttactttccgctttctttccgcatccctaaaagaaacaaaaggcaaatgcccatttttggattagttcttggagagcatcttgccctctctctcccacatcagaaccacattagccaccgtggccacgttcagttcaaacagggggaagtgaacctgcctggctccaacccccagccagagccaaggctgtgggatgccaggtgcccggtgctctgcccagggccacacagcaccaaagctgagtgacaccacaatcgtgtcgcacacacacgtccccctcaccgttccatgatttctgagagttgcatcctcgccaggaactgattgtccttgcggatttctcgaacggcccctttaaattcacgcttgtgtttgtggatcagcctcttcctttcctgttcctccttactactgccttgttttcttccaaactcgaggctacaaccagaaagccactgttaaggaagcaagagtctgtccccacctctcagccagagcctgcttgggagtgtggcttcactccgtagtcatctgctcaactgcagaactggcagacgccccccgtcagctcccactgagcccacagccctggcctcccagggagatgctgccagcacccacactttgaccagccggggtgtgaaaagcttcagtgggacaggcttgctcttctcacaggtcagcggccggcagagctgcttctggctttccatttcggtcagtgtgctctgacacagctcctgaaaaacacgaaatccccgactctgcgatgactcacctgctgcgtgccctgagctccacgcacgggttctgtggtgtcaaggcagcgtgaggacagtgctgcgagctccctgcagcaggatggtgcccttgctgtgcgcctaccggtgggcgggggggtaagccaaggctgtggctgctcaagtcctggcacagccggaacgaagtaaagccactgtcttcttgaagagggagggccgtgggctggcccctgagagcactctctgaaaggaggggacttggggagttggaggtcaccatagcctgtgctcctcacagccagaaacgtcaacagaacccctctttcccagacaaacttggcacgaaaggccgtgagccacttgcttcgtgagaaggctcacaggagaacccctttc

SEQ ID NO: 1023 - DNA, 65124 bp, Homo sapiens
gattttggttgtcactcacttctggcttttctacaaaggacttgtgataatggctccaaatatctgtgacggtatgaggtaagtctcacaaagagtccaatttcaaaactgatcagagaaataaatgaatgcctaggacaagctttacaccatgtaggagagttggatgttctgagtctcgtctcagtgcagaccagcagtgacttttatctccgttccctcatcatttagcatagcatgaaatacagagaagatcagtaaacatctgctaagtaaataacccaggagagaaaactgaaaactttatacacaggaagatgttacataaaacaaaaagaaacagtaccactgtgggttcttgactgctagcaggcatgttacgaagggggatgtcacatccaagaaagtgttgtctatttaaaatggaatactccaaggcttggacatcaatgctgaaaggtgagaaaaatgcccagaatcctataaaaagttcataaaatctcgctgtagcttcatcctttctctatttcctgattccatcatgccctctcttcactgtcaagcttcttggaaggttcattcctgcagccacccctgcctccttgtcagttccctaccatgccactcatctcctgattccagtgctctttcccttatcaggagactttcacatctaattcctggttaccctggtcttgaatataaatgcaaatctttaaaagccatcaaaacctgtgtatatcttttctagccatttaaactaaaaaccaagcattctcaccaagaaaaaaatcaacaacaaagtaaataccttgaagctctccaaaggaggcccatctctcttccaattataatggctagtgtgacatctgcgtaaggttcttcagtagatgaagccgatcagctgcctcttaaaagctcgatgaacccccaccccaaatccccagttattttcgtaagttctctgtattctgtcttgacactgtctctcatcctaatttcactggtgtgggtttttgtgtgtgtgttaaccctagcctagtccactgttatccctatttctaacatctccacaccctaatgcaccttacacatcacgcctctcctcattcataagcctcagccattcctcaagaaccaaattaagttcaaacctctctacaaacttctgagctccacattcatgataatccatctttctagctctttctaccactccctcttatagcaaatatatggccttttatgccagagaacctggactcttgtctctgcctcttacaagtcatgtaaccttgggtaacttgcttaatttctgtaccttaccttcctcatctgtaaaatctgtaacttttatatacagatttgctataatgattaattaggttaatagatatgaagggcttaataagatgcctgatgtatatagcaagcatccagtaaataataactcattattaattatgtactccagaaaaattcagtaacaatctgttcccacacaaatgacacttcgttgccatggtacttttacatggctgtttccttgttcctagttcaaataatgctatttattcttcaggacccatttcaaacaacatttcctccaagatagagttcacatatgaactaaaagtcagtcttacatcggagcaatttgtttgcatttgtgggaattcttttttttcttcttcttctttaaaaaaagaacaggttcattgaaatatattccacatgccataaaagtcactcattttatgtgtacaaaccaatgatttttagtaaatttatagagttgtacagccatcatatacgtatgtacataaataaatagttattttcttacgccctatttaacttactctcccagttctaaaatctacttacctgattttatttttttatactttaagttttagggtacatgtgcacaatgtgcaggttagttacatatgtatacatgtgccatgctggtgtgctgcacccattaactcatcatttagcattaggtatatctcctaaagctatcccttcccccttcccccaccccacaacagtccccagagtgtgatgttcccctcctgtgtccatgtgttctcattgttcaattcccacctatgagtgagaatatgcggtgtttggttttttgtttttgcgatagtttactgagaatgatgatttccagtttcatccatgtccctacaaaggacacgaactcatcattttttatggctgcatagtattccgtggtgtatatgtgccacattttcttaatccagtctatcattgttggacatttgggttggttccaagtctttgctattgtgaatagtgctgcaataaacatacgtgtgcatgtgtctttatagcagcatgatttatagtcctttgggtatatacccagtaataagatggctgggtcaaatggtatttctagttctagatccctgaggaatcgccacactgacttccacaagggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttattttgagaagtgtctgttcatgtccttcacccactttttgatggggtttttttttcttataaatttgtttgagttcatcgtagattctggatattagccctttgtcagatgagtaggttgcgaaaattttctcccattttgtaggttgcctgttcattctgttggtagtttcttttgctgtgcagaagctcttcagtttaattagatcccatttgtcaattttggcttttgttgccattgctttattgcttttggtgttttagacgtgaagtccttgcccatgcctatgtcctgaatggtaatgcctaggtattcttctagggtttttatggttttacgtctaacgtttaagtctttaatccatctggaattgatttttgtataaggtgtaaggaagggatccagtttcagctttctacatatggctagccagttttcctggcacgatttattaaatagggaatcctttccccattgcttgtttttctcaggtttgtcaaagatcagagagttgtagatatgcgacattatttctgagggctctgttctgttccattgatctatatctctgtttagtaccagtaccatgctgttttggttactgtagccttgtagtatagtttgaagtcaggtagcatgatgcctccagctttgttcttttggcttagaattgacttggtgatgtgggctcctttttggttccatatgaactttaaagtagttttttccaattctgtgaagaaagtcattggtagcttgatggggatggcattgagtctataaattcccttgggcagtatggccattttcacgatattgattcttcctacccttgagcatggaatgttcttccatttgtttgtatcctcttttatttcattcagcagtggtttgtagttctccttgaagaggtccttcacatcccttgtaagttggattcctaggtattttattgtctttgaagcaactgtgaatgggagttcactcatgatttggctctctgtttgtctgttcttggtgtataagaatgcttgtgatttttgtacattgattttgtatcctgagacttgctgaagttgcttatcagcttaaggagattttgggctgagacaatggggttttctagatatacagtcatgtcatctgcaaacagggacaatttgacttcctcttttcctaattgaataccctttatttccttctcctgcctaattgccctggccagaacttccaacactatgttgaataggagtggtgagagagggcatccgtcttgtgccacttttcaaaggggatgcttccagtttttgcccattcagtatgatattggctgtgggtttgtcatagatagctcttattattttgagatacgtcccatcaatacctaatttattgacagtttttagcatgaagggttgttgaattttgtcgaaggccttttctgcatctattgagataatcatgtggtttttgtctttggttctgtttatatgctggactacattttttgatttgtgtatattgaatcagccttgcatcccagggatgaagcccacttgatcatggtggataagctttttgatgtgctgctggattcggtttgccagtattttattgaggatttttgcatcaatgctcatcaaggatattggtctaaaattctcttttttggttgagtctctgcctggctttggtatcaggatgatgctggcctcataaaatgagttacggagggttccctctttttctattgattggagtagtttcagaaggaatggtaccagttcctccttgtacctctggttgaattcggctgtgaatccatctggtcctggactcttttttgttggtaagctattgattattgccacaatttcagagcctgttattcgtctattcagagagtcaatttcttcctggtttagtcttgggagggtgtatgtgtcgaggaatttatacatttcttccagattttctagtttatttgcatagaggtgtttgtagtattctctgatggtagtttgtatttctgtaggatcggtggtgatatcccctttatcattttttattgcgtctatttgattcttctctcttttcttctttattagtcttgctagcggtctatcaattttgttgatcctttcaaaaagcagctcctggattcattaattctttgaagggttttttgtgtctctatttccttcagttctgctctgattttagttatttcttgccttctgctagcttttgaatgtgtttgctcttgcttttctagttcttttaattgtgatggtagggtgtcaattttggatcttccctgctttctcttgtgggcattgagtgctataaatttccctctacacactgctttgaatgtgtcccagagattctgttatgttgtgtctttgttctcattggtttcaaagaacttcttaacccaggaatacagtgaactgataagacagagccctgtcgcagaggcacaatccagtggagaagggaatgctaaccctcctgggtcaccatactcaggactcaggaaccatgtcttcctcaggtttgcattctgagaaagttctcctgcagaaacctatgcttactacatgcttgattatatttaagtaaatttgccatttttaatttaatgaaaattcaaaacatgtaagtcatttcaacatatggtatgttgctaaataaaaacctttattttaaaaataggttttaattattaataatttatattactttcctgatccacaatgtggtctagcacagaggtgttagccattgcatgaaagataggaactgagcccctcttctctcttcagaaacttggaagcaagaaacaaaagtcagacattcatgtctttactcatctacacaaatttcatattttacctttttaaaatagctttacttatatatactctacatactatacagttcacccatttaaagaattaagtttatcctaaagctgcttccttacgtattttaaatttggcctaaaagtttctcagcatgtagtgaactgtaacctaactggatgctgaaaagactgaaacctactcttgtgccaatcacagagtttcagcatatctaaggtggtcagttgttcaaactgtgttcaaataaggcaaatgccaaattataaccaattctatttctgtacctcatttttgtcttctttacatcactttcctttttctgcccataaatctttttcaaccacgaggcagtgctggagtctctctgaacctattgcagttcagtggctgcccgatttgcacatcactctttgctcaattaagcactgttaaatttaatttgactaggtttgtcttttaacaaagatgtacagttcaatgttttttgtatgttttcaaacatacaaaagttgtgtaatgatcaccataatcaaatgtacaattttttatcatcgtccaattagcagacactaccattccctcctacccctccactctcagcctaggcaatcaaaattctctacagttatgtcactcctgaatatttcatataaatgaaatcatataatatgtcttcttctgtgactggcttctttcaattagcacaaggttttcaaggcacttccatgtgtaacatgtactttattcccttttattgccaaacaatatcctatggtatggagatatcacattttatctattcatcagttgatagatatttgacttatttctgctttggggctattatgaataatgctgctatgaattttcacgtctacatttttgtgtggacatatgttttcatttctaatgagtatatacctaggaatggaattgctgagccatatggtaactctatctatgcttagcattttgaagaattgccactgttttccaaaatggctgcactattttatattcccaccaacaatatatgagggatccaatttctccacattctggacaacacttgttactatctgactttttgattatagctatcctagtaggcctaaaatcataactaattgttcctttgagttgcattttcctgctggctaataatgttgagtttttttatgtgtttgtctaccttctttagagaaatgtatattaagatcctttgaccatttttaatggtgtttttattatctttgtgtgtgctttattatctttatatgttctatacacaagtccttatcaggtatataatttgcaaatatctttgcacattcttggctttttcttttcactttcttgatacccttggaagtatagatgctgttaatattgatgaaatcaaattaatttacctactttttcttgtatttcttatgcttttggagttgtatctaagatggctttgcataacccaaggtaacaaaggtttactcctacgttttctatttagttttataatttttctcttaagcttgggtctatgatccattttgacttaatttttacatgtggtattataaggagtccaacttcattcttctgcatgcagatatccaattattccagtaccatttgtaataaagattactcattctgcattttttcaacccttttcaaaatctagtggctcataaatgtaagggtttagtttgtggacacaattctgttccattgatctttctatctattgctatgccagtaccacattgtcttgtttattgtaattttgcagtaaattttgaaattggtaagtttgttctttttcagaattgtcttgactattctgggcccctcgcactgctacatgtttttaggataactccattcatttctgcaataaaagcttgctgggttttgatagagattttgtttaacctgtagatcatttgaagattaatgccattgtaacgatattaaatctttcaatccaagaacatggaatgtcattccatttatttaggtctaccttatttcaacaattctttttgtttgttttcagactacaagttttagatccttttgttaaatttatttcttagggttttttttgttttgttttgttttgttggttggttggtttgttttgagatggagtctcactctgtcacccaggctggagtgcagtggcacaatctcagctcacagcaacctctacctcctgggttcaagcgattcttctgcctcagcctcctcctcctgagtagctggaactacaggcatgcaccaccacgcctggctttttttttttttttttcttttgcatttttagtagagacagggtttcacgatgttggccagcctggtctcgaatccctgaccttgtgattcacccacctcggcctcccaaagtgctgagattacaggagtgagccactacaccaggtcatttcttagtatttttactcttttgatctatagtaagtaaaattgtttttatctttgaatttttaaatttttaacacagttcaaatcagtgtgtctgatttcatctccttctctaacaaaccagggtgccagaactgcttcagtttctctgccttctctttgtctatgatgactaatgtatgaaggtatctgctgcatcaaactttaaacttcacattatccttatttctcttgaccttgacagatctggcatcttttcacctggctgtaagcagaaagtccttgatctccttaactttttgaggcatggcagcatgtgaggcagggagaggacacagacccacacagcaagtggtgagaagccaacagtggaattgttttcttaattccatttgttgattgtttattgctagtgtatagaaatacaactgatttttgtatattgatcttgtattctaaaaacttgctcaacttgtttcttagttctaatagttaattaattgattccttagggctttttaatacaagatcatgtcatctacaaatagaaattgttttactttctttctaatctggatgccatttatctttttttcttgtccaattgccctcactagaacctttagtacaaagttaaatagaaatgggaagactagacattttgtcttgttcctgatcttagacataaaaacgttgtcttccgttattatgtgtgatattagttaagtttttcataaataaacttcacagtttgaggaagttcctattcctagtttgttgagtgttagcatgaaaaagtgttgaattttgtccaatagtttttaaaaatttttttagacaatcatgtaggctttgtccattttttacttctttaaatttatttttattgatacacaatagatgtacactttttaggtacatgcaataatttaatgcccctcactataaattcggagctgcctcctcgccgatgattccagcgcctgacagccaggaccccaggcagcagcgagtgacaggactttttaggtacatgcaataatttaatgcattcatataaagatcaaatcagtgcaattggcatatccatcaccttaaatatttgtcttttcttcatgctagaaacattcaagttattttctcctagctactctgaaatatacaatagattactgtaaactacagtcaccctactcacctatctaacattaattgatttttggtaaactaatctaatcttgctttctggcatcaacctcacttgaccatggtgtatagtccctttcatatgttattggattcaatttgcctacattttgttgagaatttttatctatactcttaagaaatattgatctgtagtctcgtgatgtctttatctggttttgttatcagggtgatactggcctcatagcatgagttgggagatcatccttactcttctattttttggaagagtttgtgaagaattgatattatttcttctttaaatatttattgggtttttaaaatacatttttaaaatgcaacttgggtagcatgtccaataggaacaaatgagtgtccacccttgaatttcataaccctggaattaatccatgtaatctatgatccacaactgtattaccaaagttcgagttactcataggaaagagaaagaagttctctaattcgtccttaaaagttttccaagttcagaaaaaaaaaatgttgaagaacacgaatctccgcaggaaatgatactcctgtacccccagctcgctctccctcacgacccctcgctaggcggggttcgggaccaggtgaacgctgatctgatagttgacacgggacgactgtggcatcatccttgctgccgtcaatatcccgagagggaggaggttgggccgggagggtctcccggggcggggcggaggaggagggaatgcaaaacagagcctcgtccccggaacccaagaagcagcaacgcccctcactataaattcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcgggtgagtccgcgcggaccgccaggcatgcttgggggacttcaagggcggggtgctaagtttcatgtcacggtgtcctaactgctggctctatactgggaagctctcggggaccaaggaaagagcgaccgtagttctggtcagcgcctgcccctggagctggccacactttcccaaatcaggtgaggggcttctggaatgggagggaacaaggtaggtttgtttgccacgtgcctcgaaattctcaatccattttaaccaaactcttccgagtgcaaggaagaaatctacagaaataagatgcaattcaataaactttcttcctgaggcttttagttaactcttgtattttagccatcatctgagcgggaagccggtatgactctgcaaggcgttcgtttaaaagttgtgctacttttgaggtgaagttaagagtgtctccatccacgccctctgcttcccagtcaatgtccctgcactgctcacgtccctttagctctctccctgcaaaccatagcggtgggtcctagacacgggacatcgctccaaccttggccaaactctcccaccctcagggttcccagatgtcctttgaataatcaaactgaggaaggagaagcaagatgtctccacaccccaatccctacagccttagccaatgcatgtgtgtaactgagacagaattttagcaaaaggtctcctgcttccaggactaaacagagcctctggcaggccactgcccgacacccaactccatcctccaattttcttaaatgtccaggtaaacatctccatagtgccagcctgctatagtctcccgaagacctcagcaattcttccccaaagcgtctccttctgcaccgtttttttctttgggcaaccatttgtgacctggctattgagcccacctgggcctcttctctttgtttgctgatagcctcgttaagtattaaaaacctactcccccccttcaggagccctcttttaatgaaagtttgggtactgggatcagatttgggacttggctacatttatttcctgtgtcattctgagaagagaaagtaatagaggcaagaaatttggcaccctattgatctattttattactttgttgagcaacttgtgcttcccgctgaagatgctgcatcccaacatgattctcttattattagttaccacctgagggttttggatctccaggtgtttatttcacatagcatatgctttaacccccttataagtcttctctaaggaagaaactgccatacttcccttgtcttctccggtgtttccctagctataaaggccccacctgcataacctgtcctcaggctgtgatgtattcccgggtgccctggtaccttctccttcctctccaccacccttcctgacagtgcaggggcaggaaagcatggggagaagggaaatggagactcccacttaacttgctgtgtgatagtaagagcattatttcacaactctgaacctcaagtctctgcccataaggttccctccagtgatataattccttaatttcttttgttttggttattgctttaaaataaaagtctaagcttaaggctaggttatagaaactgcccatcataattgctaggtctcaacatttgcttaagttttgtgattcttagtttcaagtctgttacccactctctctccccgccaccttttttccccctgacttcattgttctttgttcccatcctgaggccttgatttctggttctgctcttctttgaccttaaactgaatcaactcttccatcatccaactcagaataaaattggttttcttccaccggttccactgatgccaatggaagacttgtcttccttgcgatttgcaaaatgtctttcagtcacaggtgctgcggcaatgctgctgtcccacagcattctaagcttcagtctttctctctcttatcgtgggtcagtattcagaaaagggcagatttgtgggttgttcaggtttctcacttttctttttcttctttctagtttgggatcagagttgtgtgagtatttgtgtatataattttgttttggttttttgttcctgctgctacttacgactgctgttattatttcaattatgactaattaatactaatgactaattttcccctatgctagagggaaaataaggaagaaaagtttactctgctacttacccaaagcccaggtaaaatgcttagctgagaaggaatttaaaactcatagtttaaatgcatgatgcatgtctgctgtcattttatctgtgctgccacagtgtcctttcaagcagataactgagagttgctgtattttgctttcgaatttgttacagggacaaaaatagtgacccctcacatttaggtgttttggctgcttaatgcgagctcctgccctctagccgcatgcttattagtttacctagccctttttctggtcagtcatgactggagaatgccaaagagtctcccaagtaggctaccaaattaagaattgtgtttagaagtttgaagtcagtccaagtgttgtaaagattaaaacgttgttttgaagatatgctgtgtcaataaacaaatatggagccagagcaacacaatgtgaccaagtgtccaagcccagcttaggaacacttttctcccatgttatctagcaaactgacaaatcagctttccaacacgtgatgattggaaaatgctattagtttccttcaaaattctcctaatgtttctttttcaaaattgcctaagatcattggattatgtggtttgtgtttcttttcactgtagctgcttgttaaagcagtatactcaatctctgataagcaacagtaaatttgatcgatttgtatcctaaatttagctatcactttacattttgttttattcataatatgaactttagcttctaaaaatcaactttttaatagcttaatatataaagccatcttaaatcaaggaatatctatagggacttaaggtaatattcaactaaattggcaagtgactaccattatcctattaaagctctaaaatgcaatatttcaatcacagaaaaaaaatcttataatttaaagaactataaattgccagatgtttccctagttattacgttagtgacaaattagacaactggaaatagaaaacagagtatatgtttggaacagtcataaaaggactagtgactattgctgctagctgtggttgtattaacattaaaatatttgctatgggatttttcttcttatcaaagcagatgctcagatgaggaaaaactttcttgcatatgaaaatcaaaattgtcttccaaaatatttaagtaacaaaaaattcattatgtagtataaatgctgtatgattacattattcttatagttaatttagaagggtttgaatttgtttttgttttgtttgtgtttgtttcttcgataggtgcattctctaactgtcttaagtagaaacaaatgtctagaatctctcagtgattatcagtctccttcctattaccaagaatgtttttattgtgttgttaatctcacatgtaatttttttaacatttaaaagtttggaaaatgggtaaaaaatgagtgtgccttgtttcctattattacaatgtgccttcctatttcaagtcccaattctagatttccttaaaacttaaaatcatagaattaataatctttcagtttaagtcaacttttgtgtgatttcttgtccacttatacacacatagatgccttcatcttcaccaaataatgtagaaattttatttagttcaatggatttaagtactctgtatgcttaagtacaaaataagaatattgagaaatacacatatgattgtgtaccttttttttttttttttttgagacagagtcttgctctgttgcccaggctggcgtgcagtggcatgatctcggctcactgcaacctctgcctcccaggttcaaatgattttcctgcctcagcctccttagtagctgggattacaggtgcatgccgccacgcccagctaatttttgtatttttagtagagaagaggttcgccatgttggccaggctggtctcaaacttctgacctcaagtgatctccctgcctcggcctcccaaagtgctgggattacagacatgagccacctcacctggcctgattttgtacttttaaagagaatttgttgttgctaatttgctaagtttatttagatattttctgattctatattagtcaaagctcctcttatctactttggaaaatgaagaattatgtctataaaatatatcaacaacagctgcaggtacttacagaggaaatactgtggatctgagtgatattaggccctgaggatacaagccaaagtataaaaatggtctttgccgtagagagatagtagtcaagctaagcacatattttggcatgggtctctaatagcctaatgctagtagggtgggaagccatttaaaaatggcccctccttctgtcctgcctttcagaccagatggtgtgtctaaagtggtcacactgtttggttctggccacttctgtaataaccactgctcctttcccctcctcgtgagattataactcctttgacagtatggatggcacctaacgcatccttgttttcttttactaaatgttccacggagtcacttgcttgcctgtttgttgcttatttgtttgtttttggctaaaactacagaaaatgttaaatacattttcagacctttatattttaaaaaagaaatgttaagaaataaataatttttctaatctcatttagatacactgtcctattacacacaatgacaaatttgatgcttttgtcttgctaattgaagagctaagcatgaatacagtttttcagtctacagcagcaatgacaagggtaaagtggagaaaagagtaaggaaagaaaaaattaaaaagaataaaaggttgaaatatcaaatcggtggttcttaagatgacagaggcaggtgagacaagaatactggaatcacccagggggcatatgaaatctgtacatttcatccacaccttcttttctccccctgtcctcattccccctgttgagacacattgtattacaaattaggaggaaaccatctaaaattatctcacgtatcccagttcccatattagcatcatgagtatcacctgagagtttgttggaactgcagaatctcagaccctgtccagacccattgattgcataagaatctgcattttagcaaaatcctcaggtgattcaaatgcacattaagggaaaagaaacacagtgtaccgtacctgtggcttgtttagaataattatgaagaggtgttttcttggctcttaactaacgtttttaataaagctaatatttattgagtacataaatgtgccaaacacaacgttcagtctttctttaaattttttttatttaatcctcacaacaaccctgtgagatagtttctgttttatccttattttatagattgggataccaagtaataatgagataagtagtttacccaaaagctgtaactgatacagtcgagatgtaaacataagaattctaatttcattgcctgttctcttagctgttacctacagtgtctgctctatactgggctacctactttttaaggccaactaattatttgaaaatttatttaaagttttaatttgagatcaaaatctgtttccctcataaattttttttaaaaaaagcaaacaagatctattccattttgatctaatgttttcctgtcaccttacctttaagtgcaataatgggaaattctagaaattccttctttaactgtttgaaaaaataccaaaactatgacagcctgtccaaatccactaaaatatatttttatatgcatgctttttgtatatcaattatacttcaataaagctttttaaaaaaatagtagatgacatacttttaaaaattaactttggagcccaggtatggtggctcagacctgtaatcccagcactttgggaggatcacttgaggccaggagtttgagaccagctgaggcaacaaactgagacccccatctctacaaaaaataaaaaattgccagagcatggtggcgcacaccatgtagtagttgggacctgtagtcccaactactcaggagactgagttgggaggattgcttgagtctgggaggtgaaggctgcagtgagccatgatcacaccactgcactccagcctgagcaacagagaaagaccctgtctcgaataataataataataataacaacttttgatatctctattttttcccataaaaatccaaaattttctgtttactttttggtgctctcatgctataaagtaaattctcccttggattggacaagttattttctgttttctacatacacatagactgttcagcattccaactcaaattacatattactttttcagcttttaatataaatgcttatttactacaagcatggtttacaaaaatgtagtaaaatatagttactaaccagtcaatgctcaagccagtgactccccaaatgattcagtccctgagctgtttcacccagtgcaggtagattctctgacagccatcagttggatctgtccgaatatctcctgttttgacaggggcttattgatgttggtcaaaagacaggtgtgtatgggttccctgggatcatgtttgaggggaaacctgtgccaacaggactgagcagccactttttcaatggtattgagaaaatttgtaggagataaaatttcaccagctccttgaatctagaactgtagatattcaggtagcactgacattacaacatctaatttgtaagttatgggttagggcaaaatcaatccagggctgccatcatgacaagtagtggaagtttgaaagaaggagaaatacccaaaagatatcttacacatagcaggcagagtttcttagtactaataaaaaataaagtaccagtgatcaccctctatagcccctaagagtcccctggtttcactaagccccaatatttgtggctgtggctgaatgcaatctgcacaaggttttctttttaacagttggaaaaaatctcatagcatagcatttttttctttttaacagttggaaaaattctcgtagcatagcatttttttctagtaaatttcatatacttaacaactttatcagcacatatattttccttcacacttacaatttcatcaacacatatactttactttttgactcaaattcttcttgccatcaattcaaatgctcctgcccttagaatgagaattttccattaacccagctttaataatctaactctcccattcaaatgatgtcacttcatataaaacacattttatcatgatgtctcccagccctcagttacacagttaattgctgccactttatcatgaatgaaaaagatgtgattcttgggtaatgatttcttgagtatgtcctggtctattatctactgagttaccagagtggatttttgagagaacacacagttattcctattccttttaatttccattaacttaagccatatgatagaacattacagttgttatatattttgtataaatataaaatgtaatatataatttatatattttaaaatatttagtggcaagtaaagatagtagtaagtgaaaaaatcactgtataacatatgaatcgtaagtgtgatcccatgtatgtgtatacctggtagatgcttgtcaaggtgccattaaggtcttgggttattggcatcttaatgaaattcatttaattatgttaggattgatttgttagtaaaatcacttacatgttttttaaatgcatgcatatctgtggagccaataagaaaaattaggaacaatatacaacaaatcttaagagcttttgaggatgattttttttctttctttcttttgtatgtacctacaaaattttctataatggatctctattgattttatattttttactttctatttgtcttggaatttctattactttatttataattcactctagattttaggtactagacaactactattaactctctggagaatggtactataaatctgaccctttctgtcatttttttttcctgtggtacactagtgtctcacaaagagtccacagaattcacacggtcatgatattttatagaagaaatcattttatgggaactttcttttgttaatagatccttccaatgctaacattattctgtataacagtgctaaagttggtatgcctaaatgctaaacttggtatgctaaagttggtttaaaaattaacctatatacaatcttcttgaataactcttcaactttaaataaatttcttatttaaaaaatcctcctatatataattaaaaatactgatgaatttgactacataaaaataaatgcttatacagtaaaaagtaccataaacaaagttatcatctaaacaagaaacctgggaaagctatttgccagccattacatgtaaaatttaagtttccttaacataacatgagctctttaatgtgagaaacaataaacaacctaattgaaacatgagcaaaagccatggctgagaaaactcgtagaagaattactatggaaacaataagaaaatgaaaagaagttcaacctcattcataattaacgaaatgcaagtcaaaacaaagatataccttttacttatcagataaagaaaaaatgatttgataaaacccagattcttggtattataaattggtataaccttaacggaggacattttatgaatatctatcaaaaacttagcatatacaaacaatttggttcaacagtctgttagaatttattatatagatacattcatataagtacaaaagtgcatatatgtaaatattattattgggacatttttgtagcagccaaaaggaaaactgaaaaaaaagattaaggctcattaatagcagactggttaaataaactatgtgtgagtacaatgaatgaaatattgtacagccatcaaaatgaatgaggtagatttatatatgctgatgtaggaaatctgctagccatcataagtaaaataaatgaaacaaagaagaaaatactatgatgtacaaaaagaaaaaactatagatatacatatttatatgcatgtgtatgcattttttatgaatatacatatttatatgcatgtgtatacaagtcctagaaggagacataggtaactattagtagtacctctgggaagtaaatgcagagaaaagtaatagagggtaaggatatgtttacttttattttacatccttctgtaacttgacatttatacgacgcgttagcattacttctgggaaaaagaaaaacagaaaaggtaatcttttaaaaaggtattttttaaattatggtacaataaaatgtgcataagctttatactaagtaatagaatcatttaagtttagctgtagattcacaagtaaaaatccaatctattttcatattcttacatttatagacatttcttacatgtctatagaaagaaatggctaggaatgagactgcactattttaccctaaaacgttctttttctctttgcctaatgtatatctacaagggcattggggaagatgttgaccacaggcaggaagatgatgagatcctgtgcccaccacttaatgcagtctagctctatataaggaaaaatatgttcttgatgtgaaccagatggtttcactcccttcaaaaacactcttaagatgcagtgtggaagcttactctgtaaattaaaaaataaaaacctgactatattcagtggaatgcgttaatcatttttttctttttaggtttgatatttgacaaattgatctaaaatggctgggtttttatctgaataactcactgatgccatcccagaaagtcggcaccaggtaaatgccttacatctacagcagtgggtctgtcagcagttttctttaatgtgtcagcagtggggagagcgcaaaaacccacacacaccattatcttgtgaaagaagtagaggaagcagaaaataatgaaatcccagtgttaccacatcccctccaatatacagattaagagcgtttgtatttatatggttttaaacataaataacatcagaattactaagctatttccattcatgtactgataatgaatcatgtgagaaagtcctttggcaaggactccacatggccacaggtgattcctttgagcagtgttcttcctgtatagggcttaagaggaccagaagggaaatgattgtactctcttgtcagctacttcctgggcgatttgggttctttgataccccagtgctcactttcggaagtgttaagaccataaaccttaacagttgaccttctcaccttcagaaaacccaaatgtctcggagtttcattctcacaaacttccaccttcctccaatgatgagatataggaaaaaagacaatgtgaaattggagatggaggtgccctcttagcctctttacaggcatgagtcacatggcagggcattaaactctctcacaacctgttgtggagctcagcagggttagccaggactgttttgtctatctaactcttcttacatgggcctatgtgatatttttcataacaagagtccgggatttacctaactaataagatttccccacgcccctccttacaaaaactcagttcaaagaacaagccctcagcttctcctagtcccctccagggaaaatgaagagtagcttgtcctattctgaatatgttgtgctcccattttatcaaagtagaggatagatacgtaggtgctgggtgggtagataaatattagagggatgcttcttctttgctgtaacagattggcaagtaggaatcattttctggaaggtactccacagtggtggtgttagaaaactatttagaatgcctttaatcttggagataaaaatagtaacactttacagagttctgtcaatggatatctttagggatgttttgttttgggaggttttttttctgattttgtttttttcaggtatagcgaagcttgggaatctggactgtgcagattttctgcaaaaatccagctctggaaagagtgtattaagatgcatatcctaggatgacacaaagacagtatgctttattttacatcttaaaagtattgaacagaaggagttttgtccatgatatcccatcagcccactagcaggaaaagcaggacacttacccagggggttcctgctggaaatgattcttggaatcagccttccttctactctatttgggaagtctttggtttctaacattcacacatttgtagcaaagcttccaaaataactatgatgttttgcttaggaataacaaaacatggaagaaaacattctgtgaaattttaaactttttcaaacctttaagtttcagatgaataagcaaaacatacttaagtctaagaagctattttttgtttgtcaaagaactgatgttataccagttctaatattaattagcaactttgccctggttttcctgtaaaataatctccaaggccctatctcaatctgtgggcagtatactgaaatacaaaaagtgttcacaaaaggaccttctgaactttgcaatctccctttaaaacttttaccaacttaaaactacagaactctgatctcttattgatttaaactagtgatatgtaaacagcacttcagagcttgtttcacaggaccaaaaaatttatgctgaaatctactcatgacaaatgggaaaaccctgattagcacatttaaatgaataaataaagaaccgtattcaatggcttaaaatttatagacctgcatcatccattatggtagccatttactatatgtggctatttacatttaaatataaacgtattaaaattaaactaaaaattcagcccctctgttgcattacccccatctcaagtgctcagtagacacatgtggttagtggacaacacagatttagaacatttctatcataggaagtactactggacagtactgctgtaaacacacttattaataatgcagcagactttcttggccacttggtaagaaagttttctgctcttttaaacttatttgggaagtttttaatacttttgaaattatgatttcctcagtgttagattatctgatatacagctctcacagaccattttttgtttttcctgtttgtttgcatattaaaatatataggattcaatgtttcacgtgcttttctaaagttgcagttcttgatttcttaaaattgtgaaaagaagtacccacagttatattaagaactaaaatatatggctgttggcttggttaccaacattgctgacagctccaagtaagcaaaagtaaaaaagatgtaggatcatttttaaaggccaatattttcttccttactcattaccttctgtaaaattctgtaagattttctttagttttccagtaatgataaacatttcaccattgcatagacataattaattgattttttaagcagttggagagccaaacaaaataaggggtagaatacttcttattttattttttaataaaaatgtacatattagaagcctttatttttatttaaattgtatgtcactgataaggtttggatatttgcccctccaaatctcatgttgaaatgtgatcccctgtgttggaggtggggcctggtgggaggtgtttggatcctgcaggcggatctctcatgaatggcttggtgccctccccatgttaatgaaagagttcttgctctgaaactgtgacacctcccccctctctctcttgctcctgctctcgccatgtgacatgctggttccctatcaccttctgccatgattgtaagcatcctgtggcctcaccagaagcagaagctaacaccatgcttccttgtaagcctgcagaaccaggagtcagttaaagctcttttctttataaattacccagtttcaggtattcctttatagcaacacaagaatagaccaacacagtcacggataacagtagtttttcatttttcatcaatataatgatcctgctgtattcttaaagttcttaatcactatttgtcactaatacgataacattaataaaatttgagtctcagttactttccagtcacttatacctagcagttcaataacatttagttcctggactaatgatcatgtgttatataaggcaaaaaattaaaaacaaatttgtctttgagtcatcaaagcatcaagggtttgaaatagctatataactagctgtgaaaaagggatataaatatccagctgatatttcctttacacatttaatagtatcatttttcaatgaaagcataaataaaataagtttggaaccagtttggaatttttaaatattaatcgcagaatcttactaacagaaaacaaaagcaagataaatgctagtcatttgtgcctgagtttttttttcaataaacagaaatgaagcttgctttaggaaacatgtgtactccaaataacctactattcacacaattctcagtaacattctttctttgcttaaataatacagccagatgtgcttagcacataactctatagaaaataataatttaaattagatttaaatagagatagatagacagacagacagatagacagatatttttgagacaaagtctcactttgtcctctaggctagagtgtagtggcatgatcatagctcactgcagccttaaactcctgggctcaagccatcctcctatctcatcctcccaagtatctaggactacaggcacatgcactatgcccagctaattatttttttaattttttgtagagatgtcgtcttgctacattgcctaggttgctcatgaacccccagcctcaagtgatcctcctgcctcagcctcccaaaatgctaagattacaggcatgaaccactgcacccaaccaatattaatatttttaacaattgaaagagctcaaagaaataggttttaaatttagaggccctgttttgctgacaggaaaggcttttagctggaatcaagagtgctgttgtcttttcccttcaattagtcattccttttaagacttttaagatttaaatgtatgagtcattttttaaatcccagaaagatctagtatatctcataaatgtaataatacagtgcagacctggtggaaaataattatttatctgaaactgggcctcagtgcctttcctgaatctaaacaaatgttcatctcacccagagaactgggacaacaggaacaaggtattgcaagtccaaaatccaatccaaagcagcgttcttcctccccacctctaggcaaggccaaaatacttctgcacacagtatagacaccagaaaaaaacagagccactgtagatgaaaccagtcagggggtaagagctgtcttttgatctagagcttgcacctttgctcctcagtaatactcccaggtcaaaaaggaaaaataagatgggcagttggctgcctcctggtccctccagcctggtcagtgaacagagtgggaagataaaacagctaagtatcttccttaacaatgcaaagcaagaaatccagtctgctttgggaaagtgaaagcaatgcaaattcagattattaatcataagagcatctcatgtgatatacaaaattattgtatagcagtaatgggtcagccgtattttattcaacactgaaccattaatgaatgctagctagtcttcctttcacttacagaatgtttatctatacatgactaaacaaagaaggagcgctggaaatgatcctgtgaaaaatactggctcacaatgtatcagctgagtttggggcaactgaggtagtaggaggcgccccctggacttctgctggaatttagatttaaatagatggatgaattagacaaaacatactctctgaaagagtgagaaatacaatattcaccaattaagtgaaggaaaaatctacactatgaataaaacaataaatgtggatacatttgaaaatttgaatttcaaaccccttaagataatgtgacaaatacaacaggcctaatttaacatcttaaagagatctgtgtgacctattttgcagttttattttcttaggacaatgcttcagtatctttaactttcatatttaatcattttttttcttttttggtttctatggtatcaccatccatcaatccatattggttggagggggggaatatatatatatatatatgtatgtctcccaagagaaagtaattctgcaatcttcctcagcaattcagtctaacaattaagaacccttaagctaaatagaaaaattcatttcacaggcaagttttactcaatatgtataattagttttagttaactttattaatgaaatgtcgcaaatcaattaggtttgcaataatcagatgccgaggacccaagaggaaccattcctctcacaagaggggaaggtgatacacaatttagttgggaagcaaatgtaattagatttgatcaattgagtattcctgtcctgatgtggagtcagtcacatacccaagcctgagaatatatttgaaaagaggtagaaaaaaacccagtatgacttagaaaatgtccttgtggtcctattggccacaactggcagccaaaaagggctttgaagccacaggtagacaggttttgttcagacagggctatgttttagatttctctttcaaatctgaatggttttacgtagggcaatatataaactttcctatttgtcacagattctagcactctttaatgccttatactgggtgtttcacacagttatttaactgcccaaatcccaatggcacttcagtttgcaactatcatgacctagaagttagttattgaacagttatgaggtaacttaaagtttcttccctttgcctctagaataagaatatcaaagaaatgtcatgatgataggaatactactgaaagaggatattaaacactaggtattcctacttagggctacagtttgcagcagattctattgtgtttcagtcaataagtgtttttggacacctacatgccagacactattctcagcattgagcacaaagtcgtgagcaaggtagacaaaaatgcttggcctcataaaacttacattccagtgcataaagatgagaacaatcacgtaaaatttataatatgttggatggcatggaaaatggaaataaagtggaagggaggcttcaggttaaaaagagtgtttagggaaggtcttcttaggaagaaggaggaagctatgtggacatctgggagaagatcgctccaggcagagggtagagcaaatgcaaattccttgaggcagcaatgtgctggcatggtcaaggcacagcgagtatgccagggtcttcagaaaccacagagaagagtggataacaaaagtgaaatcaagtattgaagagtatgaactgacaggaactagagacatatttagaatggatgccagaacaggagaaatgggtgggattttaaaagctaaatgatttaaagacttaaaatgctctgaagtgtagtgaaatgttccccaaactgcagattttcccaggaaaccaggtgcataatttagtcatcgatgactggttctgtggcaatgactctagtaattagacccctgcattttatgtcagttccttctggatactcagctacattatttggtgcttttggtatacttcaaatatgcattgcctatcactgacctgtaatcctgtgtctctgggcctgaaaatataacttttcatgtagtagagaattagggctgtgcaacattgccactagattatttttaatgaaagctttgcccttttagataaatacagcaatgtattcaaacaagtcctagggataccactgagtgcaaaatgtcatgtactagttattccatttaaattattttatcttcaagtctaataagaaaattctaaataaaattatatatttgggattgtgtgtgtatcatccatccacatgtaagtaggaataaaattatttaatggaaaatttcaaataggctaactctaaaaatgtacagataatctggatgagagaaaactatcctcactttgtgttatttttcaatggtagcattttctcataatccccatgcttttttcatgtcctgctattctttaagatttcctaatgaggattagggaataggcatatttaacaatctgtgttcgcaggttgaaaacaagaaaatgaagactaatagtttctctcctgttaatttgattttctacagctcctctcctaccagcttaggcagaggacttagttactatttccaatagatgggagccaaggaaaagacaagcatctgtgatgtcatgtctcccccaaacgggtagctgcctcaccagcctccattagagacatcccccagagtaagaaataagaaataatcatgagtagaatgagaaaaaaatgcagcttcctttatctgagaaaaacaatagtagctcaatgctgtggcctaaagggctttgaaaataatgcaatttctgataaaaataaatgccattattcttgcttattgtcactgttttagtcaaataagattttagcaagcatatttcaaattgttctaaatctaagtaaattggtaattaaatgctatcattagaaagtattttaatatcagaaaaattggaccataagaaagttagtttacccttgtattcatatatacatgtgctttgtgctaaaaattgttatcatttagtgagaacctgtgactatattaattaatttaatttaatcttcatatttctctgaccgttagagagtttgtgacttggataactttcaaacaactagtaccctgatggaaatccagaattttgttaacccagatcacagctgcatacttaaatgctatgcaacagtggcacttacccccaaaccgtatcctatggaaatgcctttttagcaaattaaactgaattgtgttcagagatccacaggtctaagcaacattagggaaggggtaaagtagtcctcagcaaggcccttttcagagcactccaccagtgcccttgtcctcctgggcagagctcctcagctatactccctttcctagtctaccctatcccacaacggaaccatacttctctcatggaagccctggtctcacagaactaaaaaggaggctcctagaaatggggttgtgttgagttgacagagatgtgtggctctttaaactgaaatataatccaaagagaacaagatctagtagaatttcaggtcctaagcctggttaaatttcaggtcctaaggctggttaatagtacaaatacagttatttatttataactagtgcaaatacagttatttatttataactatacaggaatttatttcccagtaccttctatattactaacatcccataaaaccagccatgtaaggaactagaacattttgagaatatgcaatacataaccttaaacaagaagttttcattcctaattaaaaaaaataagctagttcatcacaacttccttcaaatccttctgccactgatttctctcctgaaaagagatattatacggcattttagagaaaacaaacatctctaagtcacaaggagtggaataatcaaagttgcattttaagcaagattatggttttttctttgagttctctgaatttgaatagtttcttaaccttagttttttaactgctctgaaaatggtttctgtccctggtggactcttgtttcaatgcagttattttgtctggtagagtcacagagttaagctgtcattcagatcagaaaaaataaaagagagagatgaattaatctcaatggcacagtctccttattcaaaaaataaaaataaaaataaatctcaagtccaacaatgaatcatctttgagactctcccaagtgatctagttttaagggcaaaaactttggggaaactgttgggggagcaactggtgcccagtactgtttcacacacgtggtttttcttatctattgctcacacacttagacataactggaattattgcctttgtattgttgttgccattttataaaggaagacaaaaaagatcagacaaaataatagtgaacatctattaattggacacttactggtgtcaggcactgtgtcatgcactgtgtcaggcactgtattttcttatttaatccaacaaaaaaaaataggctaaattatcttattggctcaattttctttacagaaactgagcctaaatttcccaaatggctaaccaatgccagggccagcaactcaaatttgggagtaattccgacacctaggttccaaccatttttctcccagaaataacccaccaaattcaccagagtctaagatcttactgttactgtttaattaactgctacaattgcagcattttaaaaaaatataaatgagcactgtgctagtatttaattatagctttatactgatactgggtacaagtataagctaacaccattttgaattatagtagaagagtcaggagctctgagaggaatgttcaggatagaataaagcagatattttaatgtctcatttcagtgaggaaaattgttaattcatatgccaccagccatcggcagaaatgtaacaggaaatgaagaaaaacttaattactttaaatacagtggtctgtagtacaaattattgtgccgtgaattagtttccttctgctgtagaattgatcattttgattatgtagccaagcagtgtaagacattactaaaattattcttgaatcctacctttgagatctatataaaacactaggcaatttgcctgcaaatacatagaaaacaatttttaaaaggattgggatgagttattttcccctctgttaaatattagcctttgaaatgaacccagctgatctgccaaataacacttggaaattgttgtgttttaataaagtgacagactgagagggaagccacactagacgtccttatgcttttagaggccttacagggcaggaacattatgcaataatgccttttaaaagaagtgagcttcctagtattacaccttgcctggcaacaaatgtagccacttactgaaatgcaggcgtaattagaatctatgaaaatctagcatcagaatcccaaacctctatgcaatactcagtaaattacagcttttatgtctgtaatattttcaaccattctacttaaatatgtgaatacatgagtgtggagttctttaggaggcctgctgcatatgctagggaaaggtttcatcatttctaatcaggatggctctgtaaatgggatgcctcatgttcaggtttctggaaggctcagagcctgggcttctactggcagagggtagacccaaatggactactctagtgaaaatctccaggtgaacatggaacgcagtgaaaacctggggtatccaacttgcagtataggccaccagcaagtgtcacctctattataactttaaccaggcaagctcagtctcatgcattagtttataaaattgcaacagagccttctaagactgaaaggacattagtttttaaacctatatattatgacctaattaaatgaaattttattttaaagccctcataaaagtagtaaaattggtgttttaaataaaccaaatgggaattcaaccactttaatttttcttttgttccaataggaaaataaatgctttaaaatttgaagttgaaacatgggttttaaatatattgagataaaaactattttgcataggcattttgaagaaaataaattttgttctcgtgatttgtgattggccattgatttccgtgtttaagattatgaaggtgtgctcagctgtctactagaaataacaggggagactcagtcttgtttcaaatggaagggctcctattcggttttctccttcatttcttaaagtgttgtgatttttttattccctggtgttatgtcttgagattttaaatcttaaaacatgcaattaggtattgaagttgaaagctggaagtctcagccagctagtaatggttttttaaaataggtaatacagacctctagtggttgaacagtttgaaagcctctgcaagaaaaggaaattgcgcagaaagtgcctgcattttaaggggaaaagttagttaaaattattcagatgataaaattcacatatttcataggaaaaaaaaagccagaatgggcttcaagggaaggtggcacacttcccatccttttagatgttcctcaattcctctaaataagcaaaaactctctggccaaagtcacagtaagaagtctggatctgtattatttttctctaaaagatcttgtgaacagagctgctagatctctgtattatatgaaacatatatttttgtacacagttttgcctcactggggctttgcttcctttgtactccagaggctccccatgaaaacaatctgcagccacctcaacttgcctgtgctgttctcaggttctgtccatggggagccacacttcagtgagctcagcgattggatggctttttagtctacatgagagggaaactccatgtgcctctagactagtgcttctcaaactctaatgaacacccaagtcatctggggaatctgcttgaaatgcagattctatctcggtctggggtggggcctgaggctgtcttgttcgtaaactcccagttgatgctaacgctgcccatccagggccacccagagcagcaagccggttctatgacagctctctttattttttagttacatattttgtttttactcatttcttctttgtttgctcttttactttaataacttctgttaaatttttaatatttggatctgtaaaacatttaaagttctctttcacttcactatgtacaagtatctctgggaatctgttattgaagttttgagaagttgatctcacattttaaaaatagattcagtgtcatctctttatcttgaaaagttcatggtagttgtgagcatctctctaaccacttgaagctattgggttagaggtagctacaattaaatatctgattagccatattgggagagtgggtgaaaacaggttttgtgcatgtggtagatgtgtaggaagctaaggacccaaaaaacaaccacatcataaaatcaagcagaaacacacacacaccacacacacacacagaggctcaaagcataagtgtcaacagatcagaagaaaacatgggagaatgtattttttcataccaaattattaaaattccatcatctaaataacttcctatcatagcatgttgtcgacctcatttttcaaatccataattttagaacttatgtcgtggggtagtctaaaagcctcttgcaaacttttaacatctagtttcaaatcaaaaataatatattaacaagctgtagcatagagggagtacataaattatcatcattgccctgcatgaatagtaattcacaggtttggctcacacacaacttagatgaaataattaactatgtacagtacttaacagtataaaagtaattaatctagctgcctcgtaccggtttggcctaaataaacatgcaataaaaaagccataggattttattatttttttactcacgttactactttagtgtgttggaattttaatatgtcagaagaaagatatctttgcattaaaaaatcattttcttttcaaatgttaatgtactgattataactaagtgaattccatatatttataattgtgggcagatgttctcaattaatagttttattcattctacttcacagtttagtgaaaaggattattttaaattaaggtgtaaataagaacaaatgagatttttattactacaaatcacacagaatttgttggtggtgctataatcctgtgtaggtatagctttggcaaaacatttcagataagcttgttttttgccccatgggttctgggacgaggtgagttgtctgtttgtcctataaggttcagaaaggtaaaagggcaaggtcattaattggctagagggcaacaaagaaggtagttatccctgtgtggtcaagaaaaagtggctcaggttatcttgctcgggagagaaaatgttcattcagctccagtccttttggtaaaagcccactctcagtgtatgagtgttcctttgcctaatcatgtagactataacatgttttcccctatatgactccatcgattaatcattgcagtattatccccacttcataaatgggcaaagaggaggatgaagccgagtagttcttccaaaatcaagtagcatgtaagatgtaggagcaaaactcaaatccagagacttctgcttccagccaagatggaataacagggactagatttacctccccacctaaaacaattttaaaaactggacatacatatgaaacaatggttttcaagagagtggacatcagataacaaagggcagtgatccctggaggataggaaacaaatgacctgggattgtcccagcccactgcctggagggagtttgcaggcatgatacagggatggtacacccaggcagaactcgaggtcctctctgagttaaggacacagagctgggagtccagagaggccaaggaggctagagttcagagtaccagagagttgagagctgcacagagaacccagagatctgcaaatggtaccccttgtgcttcagtgcatgtgggcaaataatcacccaaacgtattagagagaacaagccccagaggtcatcaagagctagaaaatagttgctatttccaccagccacagtggaaagtctcataattcatggagcatcaggtagcatactcagtaggttcttgcctcaggaatgggaaaaatttagccctagactaattgctgctctggtaccacctaagaaaccgtaaaagtcagactcaaaagaattaaattatttgcaagtaactcaactgcttttcagaaaacaactggagaaattttgtaggaatacaaaagcatccaatatccaacaaagtaaaattcacaatgtttagcatccattataaaatcaccaggcatgcgaagaagctggaaagtacaacccataaaaagaaaaaaatgaatagaaacagacccagtcagtaatgacacagatgataggattattacactattacattaaatggttattatgactatttcatatgttcaaaatgcttgatggaagtttgaacatattaaatgaagacatgggagatataaaaaagactgaaattgaacttctagagatgaaaactacaatgtctgagatgaaaacttaaactgagacttcagatgctaagactacatttgtttcacatccccacaacattcttccctggacgctgagtttcctcccagcagctgaatacttcatgcttcatcctttcttaatgctgaactctcagaaaaagtccttcattctaagaagaggcgggagggtgccactctgtagcccctttctcatctcactctggtccctgctggcctggaacagattccactcccttcatgcactgatactccactctagactgagcctcttcatgaggtagccatcaagccatccgcagtcatcaacatggcaccttctgagtcagttacaagagtttgcatcatcagaccaccattttccgtctctgttttctgacttaccccaaaactctagttaaaactcatgaaatattatctcttcacatgaaatacaattaatatggaagtcagcatttttgcatctcccaacgcttcacatccaaggagctgtgtatgaaatcatgaactatgttcttccagccaaccaagcaattaaccaaagtatacatgtccatgttgtccttgtacagagtttgaaatatgctcatgagaattaaactatttttcagtaaatctgaaaaatcaacttgcttgtccaggaagttttattagggatagaatcccaaacaatgaatgtgctagccaagtgttactattaatcagaaatactccatattcatccaggattaatcctgtgtaactccctcagtcagtgtagcaatgtgttctcttcctgcactttttttatgtgtgtgtattcccaaatctgcagtgaatgtatttaggaaatacattagtatcaaaaggacaaatgtagccttaaaacataaatgtacagataatttcctatttgtagcaaagttcacttcagaaacacttgataagaactattcaaaaataaatattttcagtatttatttaaaatattttaaaatgtaaactcctcaccagtcatctagccagggccactgagtgtggctctatgaaatagcttcagtccctttcactactgatgaccttttgaacacaagataatatttgtcgagtaaatgtcaaaatagtataagaatacccaaatcatggattctatgctgtattcactcacatagagacttcactttggagcacttcagagcagcaacagctctaagagatgtaacagtatgctttccaggatagaagaacgaaaagggaaaaataagttgctagcaagaacaatgaggggtaggggtgaagttcaggctgccattctgaaagcttcctcagactgagtcaggcacatctcacgaagtgcagactatgcaagctggctgtgtgagatcaagggtagacagttgactcatcctgtcacatctctgtgttttaccgtaacctccaactattcagccatgaatcgctgcatgtggaatggaagggggaatgtctaacaaacagagacatacttcaagtcttcagtctagttaaaacattggaatgagggtctgcaacatctttctggggcttggagtctcgtctcagttctaaaatgagatggttggcctggatcctaagtttcaaattggcagcctttttaactaaatctaatctagaagagttctgttaggttccacagtgttgggttttaaaatatatatatatattagttgaaaacattttaaaataggatctttcacatgaaatttgaaattttaagtttatattttaaagttagctgttttcccccacctcattacaattggcacagttgactatagctgagaagtgaccccgtggcccccctccaagaaagggggagggccctccattcaccaccatgtccacttcacctatttctcccagcctatatatgtatttgaatatgtgaaccctggaatgcataatgtctagggaccataacaacaatagaatgctatgaatctctgacttacaaggactctcttatgaatctctgacttacaaggactctcttatgaatctctgacttacaaggaaaacaaaagactgtagagaatagtagttcaaccacattttaggttaaaatagactttacttggataacctgacaaccaaaacatctttgataatatagtaattgtgtatgtttaccagacaaagggtatacatgtatattcttgtatttctcttaagaagaaaatcaataaatttgacccatgaatttctttctatagcagacatttttgtgacttcctgactcacaggagatacagctaccctccaaacctaaatcaaaagtccgtaagttgcagaatgactttttatgtaaagagaacatactagtttctgataagatataaagaaaccatgtaatttatctagggaatgactctaagctgatcattgacttatttacacaactatagctactggaatagactgattccaaaaatatattttctctgaattagaatctttttcatatcaaaatatccaaaattattagcatattatgttattctcacaaagtcctaatgaacttcacaaatctgcctgctctattctgagtacaaaaaatatttagcctaatttgtttttccattattttatatagtaataaagtaataccaaaaatgttattgccagaaacaatacagtgttgtataattattagaaagtgaactcatgaaattctattaaaaaacaacaattaccacatgttaagtcagataattcacagaagagacttatatgaatactaggggagctgtaggcaacaaaatttttctctgaatcctgcattttgaaggaagtttctgtcatttaattagttgaggtttgattcaccaaccaaaggtctatagtgtgatatattttcttcctccaacataaagttaacttaaagtcatttgtactttatgtgtttattctttcacttcttccccaaaagtaattctttaaattgctttatgggattaataacaaattatatcattatatatttttgtattattagggcttctaacttcattataatcaatttattggccatatataataatgcaacaaattacatctgtaaagtaaaattttatgacgcaatttacttagtatatgtataagtctcattctgctgcccaggctggagtgcagtggcgcgatcttggctcactgcaaccttcgcctcctcctgggttcaagcgattctcctgcctcagactcccaagtagctgggattacaggcatccgccaccatgcccagctaatttttgtatttttattagagacggggtttcaccatgttggccaggctggtctcaaactcttgacctcaaatgatccacccgcctcagcctcccaaagtgctgggattacatgcatgagccaccacacccggccggagacaggttctccctgacctgtgagactgcaaaggtggtgtttcctatgagtccagccagataatagactctgctaacattaattaaattaatattcctttttaagattctaggtgctgaatatatatctcttggtctataaattagcttcgcacttcagctatttagcaaacttgttttttattgtatctagtgtattcatactgaatgggtataatatactgtcttttgaaaaagttattttgtacacataatcttaaaacactcttccaagggcaaggtagaggcttcataatattatttccatttgtcagatcaatgaaggtttaatgatttgtccaagatctcaatttctagagaagcgaagaagaatcccccaattctagttctaagtttcttttttcccttgctaaatcctgcagtctactgatttttttttttttagacggagtctcgctctgttgcccaggctggagtgcaatggcatgatctcagctcactgcaacttccacctcctgggttcaagtgattctcctacatcagcctcccgagtagatgggattacaggtgcatgccaccatgcctggctaatttttgtatttttagtagagacggggtttcaccatgctggccaggctggtctcgagctcctgaccttgtgatccgcccaccttggcctcccaaagtgctgggattacaggcgtgagccaacatgcctggcctgcagtcaactgatttatgttcatcaccttcttaagttaaattgctcttttactcattgcctttggttttgtgtgttaagattcagcatcagcattcatgatatcttttcactcttaattctgagtgtttccgtccgtttttttaatttttgtactttatgggctttttcttcatttacccccaattatgcgggaaaggctgtgtgcctcttttgaaagctctgatgttctcaatgaagagaccttttaaatgaccttgtttgtcccccaccgagttgcatatcacaacttcaaatgtctcactaaaatgttacccatttggcatcagtatacagaaaaggctgcactctgagataagaaagaacagtggtgttttcatagtaagagaatagagttcttaatgggaaaggggagagtataatttccactgatttagctggtctttcaaactttatgatgcttttctccttgaactagcctataagaaatttgtagggaaaataccacaggaatcaaattttgggcatagatgtctattaatattgctccttacaaagctttttcccagaattgtttctccttgcctacaaaaactactccatgcctttattagtcagaaaagcagttttgtagagaaggcaagtaacagagaatcaagctaagtaagtgaaactctgtaattgtcaaacttccagaaagtaacatttgtaactaagtatggtatctttgtcctctctctttctctcttctctccacttggtttctaatgaaagccttgattacatgttatatttaatgtactgttccacaaagaagaaaaggcctaatgtgaatgcaagctgaatttacacttaaatattgcagtcagttcagaccggaaggatacagatcgatgccctctgatcctgtcagattccccgaagtgtctatggcagtgataccacaagagggcagggtttgacttccggactaggtggcttcctcccttcagtgcagaccttggggccacgacaacagccatcaatctcttgaaaccctaatgatgaatctgagctcaaattccctcttcagccttatctgtgcagaatcctgaagttatgaaaaatgcttacagaaggtaatttctagaatgatctaacacagcagatatttagtaaactccctgtttgagagctcctactaagcacccaacacagctttagactttggtcacccaataggattttatcttttgtgagggatctgtagttttccccggaagatataatgcatgaaataaaagcctccaataaaattcagtatacagttaatttatttcataaaaggtgagagatataaattatcaaaggttaaaacaaaaagtaggaaccagagcagggtttttcagtagcaactctattgacattttggattagataattttttggtgtgggagactgtcccacgcattgtaaaatggttagcagtatcacttgtctgcctgctagatgctagtaataccccccacacctccctctcccacattgggaaaatcaaaaatgtctcgagacattgccaaatatccctggagtacaaaatcagtctaattgagaggcactagactggagtataaagagatgaccatgccaaaaagtaaaaataataataatagagccttgaaacattacttacagaatgtcaaaaacgtaaggacctgctctctattcctgtttcttaacctgagcaatgggaataatgatgccttccctcataggtctcttgtagaaatgaaagcaattaatgcaacacttggcacatagtaagcatccaatgaataataagtgatcagtgttactattgctaatattaagccactattataagtcctttctgttaatcagcagaaacaaaaagaagtataaaataatggtacattaaatgaacttaaacacttgtatgtcattttgtgctaaagttatgaagctgaaaagattgaattgacattttccccattgatagaaatcatctcaaaaatgctccatcttccttgtgaaagccaaaggccagcagtttccacatacccagcatctgataagtagttaatgatccagaaataaactgttaggtgcttcagggaatttctgtgtatagagaagttccatgtaaatatttctccgagaggtggatggagaatgataattcacttttaccctctgaatttgatttataagcttcacctatctggcaggagataagaaccaaagttaactgaggagaaaaaaaataaatgatttcaagtgaccatgatcttcagctggaaccagttgaaactgcaaagcaactgggctgaagaagttcagccaaaattatttgtttataaaaactagagagtgttagatatttctatcacattggcttatttgaaatttctgctggctcaaatgaaattgtattcttctatttcctactgcggggttccttccctaaccacaattgcttttggattggagacttgtaactttgagaacaagagcctcagcttagctagctggaagaaccagaggagagttttaatatctcctgaagaaagaaaagcactaacacggttattatagttcaggacaagtggagtcaaagttgacagtttctgacttgaacagttttgttgctggtaataaaagcagaagtcacgtgctgaacgtgaaggtgagcagaggagaacttgcgatggcaaagttaaaaacaagaggagatgatggtcttggtgtggcacaggatgttaaaaaaattctcctgtccttaaggagttactgctatttgagtaatgtgccacttccctacatagccttctatgcagaaatgctatatttccacttcacaacccagaacgtgcattttattttacatttagaggaggaacaaacaaccagaaggcaaaaactggtgcattattttttgcaattctcttggaaagagttcgtttttaacttctgctcagacagcacacaactactgggaatatattttaatttcaaatctgatgtgtgacatctggtaactcatttattgctaatgaagttttcacaggaagcagcagtcaccagtagctcatcttatttttcagttggcaaagtgttgtttaccttttattggcctggcatcggtgtctcttatcacaggatatttaattagaaaacgcaagtagcctaacatagaaaagaaatggagtggtagataatagtagatagaatggtctaaatatttttattacagtgatgtaatatcactgtaatttatgtttaaaaattatgtaatactcaaaaggaattctcagagctggcgaaacagtctggtccaagcagcctctcagcagtgcctttcagcctcccctctctgagtctttccaccccttgctggtactttagtttcttccacttctagcaccacgtgtagtttcccaatttctcttacccaaatttgctcgcagggaaaaaaataaattaaattagccatttacaccacagtgtgaacttaataacaccaacaaaagttccaaagctctagggtctcatagcacctccagatccatgatctcattcggtgtttccaacaatgttttgcaccaaactggacacatgcttgctacttcatcatcctcatcgtgaacattattattattatcatcattttccagatgaagaaaatgaatcacaagtcaactgacagtccaaaggctccacagctcagaggaggtaaatcatgtgcttaattcagaacttttggctcccatcactatgctcttcccactgtcttaactctggttgtcacctgagccattgtgtttcttctcaggtagatcttagttcttcctgagaaggtatgaaggtgggtattccaccctacctgaattataggaatttcagatatctgtgagcagctgcaaaggggattttactagatgacatcctgctgggcacactttacgccagtcctgaatgtgtaatagaaatctgcagtttaatgagtaagtttctcatattcagtttttgatgcttcataaatgttaaatgaaaacattttagctgagggtacttttgttgtttgttggattggttttgcctgttcatcaggattatcagcatttaagccagagttgcaaattaagttgcctacagggcagtgcttttcaaatattagtgtgtatcagaattacctggagggctcattaaaaacagcttgccgaaccccacccacagagtttctgattcagtaggtctgtggtggggccagagatttacatctctaacaaatttctgggtgatgctgatgctgttgtttcagggaccacactttcagaaccattgctagaggggccaactaggggacgtctgtgagtaaaagcacctacactgtgcttccagtacagcagccagccccagtgtgatgagcacttgaaatgtcgctagtgtaactgaggtgtcctggaagcatacattataccctgggttttgaagacatggtacaaaaaatgtaaaatatcttaataattttatatggattacatgttgaaatgacaatagtttggatatattggattaaatattttatcaaaattaattttacctgttcctttttacatgtcaaatgtttttaatagaaaaattacaattatatatgtgtctcactttctatttcttttggacagcactgaactaaagaaccagaaaatagaggggtgtattagtgaactacagaaaattcaagtcccaaaagctgtaaatactctgaggaccaaagaaaatatatacgttgttcagatttgccctgaggggtcagtttgtacccaaacatttgctgccacaagtagtaaatgtagaagcaatccaatatctactattttacttttctttcagggttaatcaagtgccttgttataattcttcaaactaaaaacattattataataatgaaaaatatttctgctgaacttccgaataaaaaaatttagtaatattttgaaagtctgagctttatttaattcattttacttacccttgtattatagaacaattatatttttaaaaatgcttttatgtcttccaaagaactttttatttttagcagtccatgaaatagaggtgagaacaggtgttggtattctcattctaaatatcttgtaatatttaaaggaaaccaaagtgaaagattaaattgccatgtaagattgtgttgccggttactggcagagcagactctttgccaggacagcagtccagtgctttctcttccaggctgttctgctcttcctcaatttttacagcatttttatgttaatcaatcaataaataaaaagtaaagaactataatgcatacaaaactgtgatggaagaaaaggaaactatgtgataaaatcaaataaatatgacccttatagctttagttttcttagaacagaggccctttaacttcagaatgttgaaaccttctcttgaagttctcttataatactctgccctcacctctgtgtttttatctgggcaattagaccacattaactaattgctaaactttaaaaagttgtattttcttacaaagaatctgagaatagggttgattttctatgttattttaacagtatcacattgcgcccccctcttcacaggaccatgtaatcttgactctctaacttcatggcaagcttttaattttgattttcaaccatgttccaaactgtactctttgacttggtagtgtcaataaataacgtaagggatgtctgacaggcttacagcctttggccataaatggaatgaaacaaagtagtccagatagggctcaaactcataacattgacctcgttagtctagaaccacaaccagctatccaaatgtgcctgggaaatatttctttgagtaatagttaattttttaaaagaaagaaaaaaacctgtgactatgataatcttatgttgagtttctttattcatcttgagtaaacagtaaatttttttcactttgttgtttcaatacaaagagttcttgtgtttaatatagaatattattaaattagtgtgggattaaaaatatttagatagctgatttaacaatatgtgatagcattaatcaactgccttgttataattcttgaaattgttattactctacttgtcaagcaattttgcccttctcgtcaaatgatgcatacctgttcaatggaaggattataaaagttcatgcttcggaaaattttttttttttttttttttttttttttgagacggagtctcgctctgtcgcccaggctggagtgcagtggcgggatctcggctcactgcaagctctgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccggaaaatttttttaagagtataaccaactccccgaggatacaggggtccagggaagctaaatgactgcttcaaggtcacccagccagtgagtgggaaagctaaaattagaacctcagtccgctcccacattttccaccaatttgcaggctatcgttaaagaatatttcttctgcaatcagaacattgagcaatttggaaaaacgtgtacagtatatcgaatattctagcttcatttaaaatttatggttatgtggcttgtataatgttaaaagctttaatctaaaatgaattgccatgtggccaataaccccaacataatactcataatgcatataaattctctaatattatcataatttcttaagggtacaaattaattagtacctcttttcctgcccaataactttcctcacaccccttaaaatggaatttgaaatgagataaacagttgctgctgctgaattaaagtttcaaagaaataaaagtgaggtggcttcatatacaaaatctgtagtttttttcacaaattggatgaagcaattgttattgactaagcccatattggtgctgcccttttctctgttgaaaagaaaagcttgtgagtagtctccaagagccatattattaaaaatgatgtttcctccccatgatggctgagatactaatccattgaaatgtggcgataattcttgtgagaaaattctatgagtctataagtttgaagaatttagaagtgtaagaggacaggggttcatttacttacaggccttcttccaagttaggttttattttccttttctcctagtctctggagtctcctctctccagacaccctggaaagccattcatggcctttcatatttaacataagagtatttaatactaacactaacatgtcgaaggaagatgtttaaagcatgtgaattagacttgatcatatatgtttcattggcacctgtttctctactttttggaataaaataaaaacgacaaaaacagctaagaattttggatagtgatgtgggtgggagggattggggcattcatcacaactgagttgtttaatttatagtaagtgggaacttttagagttgagagaagtttaattgtagtttagagtttcattattagacagtagtcttaaacaattcccaagaagctaaaatgtgggattaacattttactttcattgtaattcatatcctaaatataaatgttaatataaattataaagtttctgaatttcctttcataaaactgggttctttgggttcttagttattttggatgaaacaaggggagggctagttggaaatgatggaacatttaaccactgtcaccacagttagtcacaattggtacatgcagaattaataaagcagcttgccttgtttttatttcttgtgaggtcagatgacagtggatgatattgacttgggaagatggccagaagccactatttaccatgtacatatatcagagagccatttattaagtttgaggagattggatcttaagtacttaattagaatgacattaataattttaataaaatgttttgcattgagagaactattcactcagaaatagcaggggtgaacaaaatcatctccaaagaaatcatttaacatgaagttagtctaggattaccaaccaagagcatggcattctcccatgtatctgacttaaaagcaatacttgtctcttgccccatggtgccaggtggtctgccatgcttccctcttcgtggctgccaggattcccggtatagaggcaaatacaacctgtaaaggctcaaacgcttcatcaaaagccatgactataatccaaagctattaggtttaagcaacttatttggaaattatcaccttcaaataacatgtagggcaacctcagtagagatgaaatggacgaagcaggcatggaaactgcccttcctgccttaaatacagaatgccagatcacagctctgaataaaagttaagaccacattgggccagatcaggactaacactagatacacagctgagataaagttccagtgactttggcagtgtgaaagtcaggaccagtaggcacatatactgaaggcaatttaagctgtgtttcctgattaaagccagggactgaaaaatcactacctattcatgatgaaagactagaaaacttctgaagaccagacagagtttcagagtggtatagttactaatctactaaatactgcaaatatatagtatctgcaaatatatatataaggttgaaaactaagctcagaaatgagcattaaaaacttttccagatcaagggagtgctgtacccccaagctgaggtttcataggctaccatcatccaggcactcagtcttcccaagcaagttaattcccaccaaaaatgaacacagtcaaagattacaaaacctaagcagaagtccattatcaagaaacagtgtccacaagtgcaataaatataatttatacctgaggaactataaatagtaaagcaattgggtaggggctcttaacagacagatattcaaaatgttaaggaaaataaaagaagaagtagacttcgtaaaataggaacagagggctaagaaataagaacaagtagatctgaaaaagaaacgagtaaaaagcctagaaatattagtgccaatttctatgggtcaatgatttcacaagtgaatagctaacagttatttcctgtggccttacttggcagagagaggtgggggaagcaacataggagcagaaacagttcctttctaagtctgacttataaaataggaacaataaagacaacagtttattgaacaggatggtttattgagctgtccagcactataagcaaatggcttacaaacattttcctactctttttgatgcttgagagagatactttgatagaagattattccaaaatataattacttggtcatttagttctctctttattatcataggaaactatggggaatttttttttctttagattgcaaactagttttaaaaagagcttgtaatgaacaatttaattagattggttttggcttgcctaaaagcttaagaaggtattaatattctaatcaaaagtcttgggaaagcattcttagaataaaaaaaggaaagaaaatcttcattcttatgctttaagaaccaggaaagctgtcaaaggatataaggtaactcttacaaaagcaattgtaaaataaacgtggtttggccacaatgagccaacacctatgtttgccacagacttagattcccacctcactcatggcaaatttattcagctgcttaagattattttttactcatacttcgaaagaacaacagcctggaatttttagacttttaatggcaatggaaggaacttacctatgataaacatttttctttactctcacgctttcttaacccatggctgttctgagtcaatgtttgccttgcattcaaaaaataatagtaaagattcaagtaaaacatattcattaagcactatttgaaagatataccaagtgctttaacattatctcactttattcctacaaagatcatgtgcaataaatatcactgttcatgtttcctacagatgaaaaaaaactgagggtcatgttcagagaaattggatgacttacccagagccacacagatttgtacgtggcaaaggaggattccatttcaagtctttcaaccccaaattcatcttcctttctctaaggggaaatggtgctatggaattcatgtaagccacagagcttggataaaaggaatagtaagaccaaaaataggaaaagtaggaagaggtggatcctcctatgtttttaatcagggttctatctacctgtaactcttctgggaaaagaagcaggatgtgactgaaacatagctgctttctagatctcacaaatctggcttttctagtcaatcacatctctctctccttcggcttctcaccaaaccagcatccgttcagcttcaaagaaaaaagagccctactgtttcccactcatttatcatcaatctaaagtaactgccaatcacaaaagtcccatctttatttctttccttagaaacaaatttctctagggaagcttatcagtagcagaagtgcagactgggaaatggcctatgtcaccctcccatctagaaatgcccagtgcacatccagatcccacacccccaagagcgttgtgcaatatctgttaatttatgagagctgtttcccatagatgatgctgcaggcattagtaaggagggcaaagttcaagtgatgacaccatctctactccacctggctggtttccaggtgccatctcctgatccctctccccacccccactgccctctcaccatccttcccccaaaccccacactccccaccaatctgggtcagtgataaacacagagtattccacatgcctctgatatgatgtaacattcgacacactaaagataatactgcctttaaggctcctgtccccctggctagacttaaactgtgtagaggaggagaactgtgactttattccccttgcatcctggacacccacacatggtaggtgttcagtgaatatgtgatgagttggtgaatacccactgaatgtgctatttgcattgctacttccttgtgcttccttccactgtttctatcgcctaaaattcttctccctttttcctccaccctcgagtaggaaaaaatttgtttctttattgggcagggagttctggtcattatacatttatgtaaaatgttcttctaattggcatattccatgctatgtccagattctttcaagcgaattctcattaaggtaataatacctcaccgaagtttccagggatgatcccctagctgttcaaagctaccttttatatattaaataccagtcaatatgaatcaatggtaactgaaaaaaaggctgatagcttgtgaaggagttggagtacaaaactatgcctataaattgatcctcacaaaggcagactttttcccacagaaattgtattatgaatgctagttatagtttgagactagttaataaaattctactcactccaaacataggattaatggaacccacatgagttgtgtgctgtcaaagtcgagtcaagaggagagagaaggagaagaaaatttcctccctgttctcatagctcagggcacccaagggattctagagcgtaaagtgtactcccttctattttttactgcccttattcccaagctgaaccaaatatttacctctgccctcattttcagttatggagttcactcaggcccttttcaaccttcgaggttccttaacctttacattattaattctttttctaagcaaaatccagctgatctctactagatggttaaaaggatagtaaataggtaaattaatccacattaagccacaaatgactgctagccctaaccctttaatgactaattaatttttaataaagaatatgtgtctatataaatgaatttatacttctaagttggcataagttcagaaaaaatagtaagatgaactggaaaatctacaaggtatagggaaatcctctgggtgaggaagaactagtcatacctccctaaaagcctagccctagtttctgttacattatttcttcttttcatcttctgttttctaaaccacaagtttctaaaagcaccaaggaattttctacctgtttatttcgttttgtttttgtttctgtttttttgtccaaggtgaggcccaagttgacactgagtattctctgtgaaactctgcaaggagcaacatgtgatttcacagaaattagtctcgatacactatattcatggctgtaagttctatgctgctcacccattcatttgtccattcagtcactcattcatgagacatttatcatctgcctcctggaacataccagggcctacaccagaaaacaaggaaacaagtaaacactagtaaactttaaacaggctctccccacaagcaactgacagaccagtggagaagacagatatgtcaacagatgattacaataaagtttcaaggccgggtgcggtggctcacgcctgtaattccaacattttgggaggccaaggcgggtggatcacccgaagtcaggagttcaagagcagcctggccaacatggcaaaaccccgtctctactaaaaataaaaaaattagctgggcatgatggtacacactggtagtcccagctactagggaagctgaggcatgagaatcacttgaacctgggaggtagagatcgcagtgagccaagatcgcaccactgcactccagcctgggcaatacagtgacactctgtctcagaaaaaaaaaaaaaaagtgtcaaacctacatccaaaatgtcaaagtgctcaaaaaagttgggaaggcttcaccaaagatgtgacatttagggtagataacacctgtttgtggatactaatgtcctggtgagtcaaagaagaaaaggatgtacattatataagctggatgcaaaaaggaacaataatgaggacatgcaaccaaaaacttacatagggagaacaactttacttactcagggaaggcaaagagaccacttaagaactccttcacatgtgttatgtcttaaaagctgactactggagttgtatcccttgcacagcatccctttgcaccaaagtgaacactactctaagaacatgtgttcagctctcctgaatgccaagcacaaccatgcttggcatggcagtggtgtcttatttctgctcctctttttccccagggcatgccattgcaagagaatgctcagccatgttcatctggggacctgctcctggtagagcaataggatctgtgtgcccagcaccactgcccacctagctgtcctggcctgtgcccaatgctgaccttcacctcagagtgtggctgtaccacattcggtgatgtcactctcactgaaccttcagcctccttcctgggacttcctgatggactgttatccagggcagaatgtgttgattttctaaatcacataaatgaatagcttgactgttgattatgtagaaaatcagagcaaatatttgcatggctttgtgcagcccattcttgagcatctgattctccccagaattctaaaaaacctgctgctttctcaagccctcagtaaagacatgctttcttgataatcctagccaaacctattcatttgacatctttgttacacaaatggttaaccacagagttaacttcagaaatggctggcaggtatgaaggttagaagattcatgcacttttgctagactgaattggaagttaaagagtaagtagttactgactgcagaggcctggaaaaccatggaaaaaatcctattcctcaaagtcgagccctacctcctacgcctcttaaatcaattgccacagtgaccaatttgtcagtcacctaaaggcagctatcctgaccacttaagggagaatacttataatctttatacctaagtaaagattgtgagaggaaagaaatggtttaaagaatatgaatgtgtcacacttctgaggttaatgataaatgaattggtcctgcttacctcaggaaaaactttcaagtctttctgaaaaactaatttaattcagtagtattttctaagatttaggttatgtttttaatcaatttggaaaccaagatttacttatagaaaaaaaggaaaaggacctagataggtttattcacatagaatcccaatttcacttctctggatgataccattttctacaaaagcaattatgttctaaaatttaagtgtgctttcttaggctttatcagttcacagtgtttccttaagaaatatgatccagtattttttcctaagactaaagttgagttactacgtttatgactgagaaatgaatgtttgttagtttgtttgtttacaataagaattttttctttaccattttatttttattttccccaggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaaccctcccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttccactgccaaaacaatgcccgtaagatggcttatttgtataatggtgttactaaagtcacatataaaagttaaactacttgtaaaggtgctgcactggtcccaagtagtagtgtcttcctagtatattagtttgatttaatatctgagaagtgtatatagtttgtggtaaaaagattatatatcataaagtatgccttcctgtttaaaaaaagtatatattctacacatatatgtatatgtatatctatatctctaaactgctgttaattgattaaaatctggcaaagttatatttactttaaaataaaataattttattgcaatgtatttatcttcattacttaaaatagatgctaatttattttaaaataagactaccttgaatgagtatgaatatatttttatttaaattttgatacaactgatagtttaatactattggttatagattttttatcctgacattgaaaagttaaagaaaaaacattttgttctactgcatgtcatggaataaacacatcgttttgaatttttcagtttttcacataacaaagaaaaaaattaactcttgctataatgctagaataatacattattttacaagtaatttaataacagaatttttctaattgtatacattatcattgtaggaaagttagaagatatagaataacataaaaataaaagtcatgtttagcttccccggtcaaaaatcattattttaacatttgggaactttattttctacttttttcattcattatacacacatatatgtgtcaatcctgatactgaagtcatgatgtgtatagtactttgtatacagatctttcacttaatgtcatagcatagtagtttcctacccaattaaatatttttctaaaacattttaatatttgtataatactacaaaatatggacatacgctgatatagttaactagtcaccaaattggaaaattgagctttttctgatttttttagtatcataaattacactgagatgagcattcaagtatgtgaatctgagaaatttcccatactcctagaagtggtgcaactgaaatacacgtatgaacattttttaatagtctaactacctgttatcaaatatttcccagaaaacataacaatttacaataccaccaactaggtatgaatatatatcaccataacctcagaatggggtatttactaaattttttttttttcagacagggtctcactctgtcccccaggctggagtgcagtggtgtgatctcggctcactgcaacctcccactgctagattcaggcaatcctcccacctcagcctcctgaatagctgggactacaggcctgctccaccactcttggctaatattttttacttttttacagagatggaggtctcactatactccctaagctggtctcaaaactcctggcctcaagtgttcttcccaccttggcctcctaaaatgctggaattacaggcatgagccaccacacccagcctaaatttaagcagaaaagaaagatttaccgtaaggatccagctgccacatgcaagggccaggatgcaactgtgcctgaaaattgtacttttaacatttctgctcccatcggacagttgcttcattcttctatttaaaggatttcagtgcttctgaagttcatacagggcagaccgaagtgctcattctggtcaaataaactgtggccaaagggttggagttatgcgtaaaataattgatggttgctgtgggcaagggggtgtcatctcagagagaggccttggccactgggcagaatttccacaaagcagactatattaccttcacattcccaaatataaagtttttgtgaacaaatatggttccatatgccttataatatttatattatttttatattatttttaatttcattaatgtaatgccagccactcaccccaaaggtcttctactattttcacaaaggatcacctcaaaaaaataaattttaccttatcccaagtgatagcataaatatcctatataaaatccctccaggcctccaggtcagctttataactgttttttttttttttcagtagttgaggattttttgtgtgtgtttgtttttgttgttgttttgttctgttctgttctgttctgttttgttttgttttgttttttgagacagagtctcgttctgttgcccagtctggagtgcagtagtgtgatctcagtccactgcaacctccgcctcccaggttcaagcgattttcctgcctcagcctcccaagtaactgggattacaggcacgcatcaccacacctggctaattttgtatttttagtagagatgggttttcactaggttggccaggctggtcttaaactcctgacttcaggtgatctgcccgcctcagcctcccaaaatgctgggattacaggtgtgagccaccatgccctactcaatagtcattttaatccaagtgattgtaagcattttaaacttgctgaactatttcataggttatagttggcaagatttctgatagataattgtatttagatatcccctatatcatgtatttattaatggtgttaataacatgttccattcatcaaattatattgggattttaccccatctcacttgtgaaatagatgttactaaccttgatgattattctttctttttcagtgagatcaacataatcttggagttgagaccctacttaccaaaatgttaggataggatgccattatgtattcttcatgaaaatatttacaggttaggtagactccttatttttggtacatttaaaaaatacatacagaaaagaatatttaccatagagatctaggtgcccaacagaatgcaaaagctacatttatattgaaatatatatttcaatatacacccatttacacccatttctgaggtgtaaatttcaatatacacaatattaaaatttacctcattctaagcttttggggaaaaaaaggctagtcatttctaatgctggctctttctcattgtggaaattcatctttttggacatcagttacatcatttttcaagtatggtgagttggcttggtgaaagaaggcttttatattttatattttattttattttattttatttttgagatggagtttcactcttgttgcccaggctggagtgcaatggcatgatctaggctcactgcaacctccacctcctgggttcaagcaattctcctgcttcagcctcccatgtagctgggattacaggtgcctgccaccacacccagctaactttttgtatttttagtagagagggtttcatcatattggccaggctggtctcgaactcctgacctcaggtgatccatctgcctcggcctcccaaagtgccgggattataggcgtgagccaccgcgcccagcgtgaaggcttctatttagttaataattcactcattcatggatttaataagtgttgtattgtttccctactctgtgctgggtaacaagtgctgtgtaacatatagcagcttagcatgtaggataaacttgttgctcagctgctgtgagcagtgtgaaggagagccaagtgagaagcagcttgattgcaaatcacagaaaggctctcagagttttgataccacaggtttttcagtttcataactctgtatactggtgcatttttttccaacaatatgtgccaatctaggaagcccaagaagagaaaatagattgaagcaggtcacaaaagtgtgaatgaagaaaacaagtttcaaggaatttcggatacttggtatgaagagtgagatatctgagggtaaagaaagtaaatcaagagtaagagagatacagagagactgagtggacaggaggctggaagcagtcacacactgcccccaaggccagggttcagacctcacaggagagatacatacagtcagggccccaggaccatgttggatccactggacccagaccaaccagaggaagagggaacccaaatattagggtgggaagcaagtcataaacagtagacagaatggtatggggcaagcccttaaccatatggattttatatagttcaggctgtatgactgtatattggagctaatcagagagtcaaattttccaaattcaaaatcttgactgagtcagttaacatatgacatctgtaactatatccagtcttgtctacttgtgtagtgaacactcatggaaccatctgaacagtgtccattctcccctcatcgcaggaatagttctgccccactcagggacagcaccacctcagaatgaaccattttcctacctaactccatccccaggccacagttaattggtccaggcttgaagtggaccaatcacagtttttcatgaggatttttcaaacaggcgctgatgaagagctggccccagtgttggcatttctgagacgtaagctcaacaccagccacatctctcaccacgtggaagaagctagtctgcaacagagtgaagtaaacagaaaaggcaagagagccctgaaggtgcttgagtccttgattctacctgcgtcttatgtccagctaaatccctgcccactcctctctaatcaagggaccagaatacagtgatctatagctaagatctgcaagtgtttcttcccgcttatgatcaataagaatttcccttttgtagtgtccagcacatcatccattggccacccagcagaagtgataccgtctacatcccaaaacttattggtccctatcttaataaggggtcacaagtgctaccccacttccatatgtctccttgtgagatggtaacagccaggacattcaatagtgtgtgttaagggggaagaggtgtggagatatagacgtaccaatagtgagagggggctgaggctactacactatctactattgcaaattattgtaaactgaagtctctccctgagatggcacaggggtaaaatacacttctgttgcatgagcaattataaaaaatatgatttagaccatgaaatcataagcagagagaggaaattagtgctcctcaccacttgagggcccaaatgcatggcttgcatgttgcctgggctctctttacttgacagtgacctgggagttctctgggtatcatagagccagtgagcacagcatccaaacctgccgaaatccaatggaaaaggccttcatttaccaagctaacacaacttacatgagaaattatataactgaagttgaaaagatgcatttcagcaatcaggaagagccagaattagaaatcagactgttttttttttccagaagctgagaataagagaagttagctttagtaatatttaattctaaatcattcctatactaggaagctttgtataataatcctttaagagtttaaagaccatgagatttacccttcaagcagtgtaataggaaaatatttatctatatgcacaagagacgtaaatttgatgaaaaaatgatgttaattttaaaactattaaaagccagtttgctattatgattattttgcttcaagtatccaaatgatgatgagccaaatatgcccctgagcccagttcttgattcattccacgtcctataaagattctttagaaaaattgaacaagatgagaaatagggatcctggctcaacctcccagtgagttgggatttatctcatggaactttttcccaagcttgatgaagttctgctgtgccatatggacatgtacagttgctaaatgataattttccaaaaataagcttcaattctccaaaatggcagatagaaagcagctggtgttactcaacagagataagcctcctagagctcaccacagagaggagagcatcatgtctgcagatgccacagcagatctgctgagaatcagccagcgccatgtgacacaagaacccacagatgcggattcgtcctgactggtggctttcttctggccattgctgttacagagaagtttctaagcagtactcaatgcacacaaaactaagtagaggctatataggcaattcttcaaataagcaatcattattctcagtaattcttgtagtaagtggatggtaggaggaaaaaaaaaatacctttccactgatgatatcacctttatagctatttcttgagtctccctatcttttccaccttcttcaagaaatagtcccctattacaatttgcatgcccactcttgctgcagaatttgtataggggctcaactctcattattgccaactatatgatttggaccatggatgtgagaagacttcagcaaatcaatccatcacattcctctggctgcaatgagttgggcacataacctaaatgaacacaattatggtgaatttcctggttttgccaggagctatcagacaaaaagcttgttctttcccactctatagtggatgtgaggagttgttgtagccatttgtcactccaaaggagaggtggtgtttccagaagttgtcacagtgtgtacttataccataagtatggagccaacatagtgaaagactggacaaagaatggaaatgaatcaagtccttatgacatcattggagagttgactttttgtgctagaaatttgcactgtcctccagatctccctatcttaagcagttggggatgggttttctgtcaaaattatccacgagaatttaatcttctgcaaaattattatagttatcatttattgagttctgattataggacaggcatagaattctctgcttatatgcattatattatttaatcctcacaacacccagtcatgctatttctgttattatcctatgagacaaaaaaaaaaaacacagattttacataatcagtccaatgtaacatgactggtaaatgttggtgttgacatttgaaatcaggcattctgactccagaatctgtgctcttatttgctaagctatgttgctttcctctgctcctcacctctcccctgaccccccaaaaatggcattacaaaatatgagtcatgtaggtactttccaatatattatccaagcctatttattcaaaatcaatacagtaatattttactttgtctgaaaccgatctcactggatttcaagatagaattttaatagtctttgtccttgaaaattgggctcactaatggaaagcactaattgaccttaaaaagcataacactggattttacatttattgtaatgtgattttggatgagcttatattgggtctagcaaataaacaggctacaactgttaactgtcatagtaattagttaaatgctctggtcctttctgcagccaggaatttagatagcacttactaaatgggaggggaaaggaaattcctaaatttattttcatatcaaagttttaacttcttacagcctaacagaatgatgttctttaaaatatatatgttttaaagaaactacattatattctgagaaaaatttccttttaaggtgtgcagtacaggtttggcaacagattttggtgaagaatagaactggaataattaaaagtatgacttatttcaactgtgcacagagacccagaggataaagatgttatgatcataccatgagtcctaaggacagttgtagcagcatcattgaaaactacctcaacatggatgctatttaagaccttgagaggtaaggagagagttgcaacagaaaagataaaatatgcttactgcttcaccttttgcttctggctgcagaacaagtagaaaggagcaattacacccaaaacgttaaaaaaaaaaaaaaagcaattaggctaaaggctgaggaaatgatcataacatgatggaagttccagcagccaagatgaatcagaaagtagctatgtagcctatcatgataggaaagctgggcatagacatagatcagtgttttccaaccaagtgtgggccaggagtggtggctcacgcctgtaatcccagctactcatgaggctgaggcaggagaatcacttgaacctgttagatggaggttgcagttagccaagactgtgccactgcactccagcctgggcgacagaccaagactcagtctcaaaaaaaaaaaaaaaaaaaaaaaaaccccaaaaatggaaaaccaaccaagtgtgattggccaaatccccaggggacatttggccatgtctggaatcacttttggttgtcgcaacttgaaagaggagagtgccactggcacttagtaggtagaggccagggatgctgccaaacatcctgcaatgcacagaacagtcccacacaacaaagaactatctggtacaaaatatcaattgtgccaaggctgaggtccctggggtagatgaggaagggaagagcaccatgtgaatgctgcagtaaattgtgctaaataatgaagtgccagtctcccagttcttataacctctaaagtgtctctccctctctctttttcctgtgctcacactcactttctcagattgcattacatgtgaacttcatccaaatgacctaattcatggggaaattgtgttaaaaaaaattgggggggcaggcagtgtcatttctggggctaagtagacaagtctattaagcttctgcaaaaaaaaaaaaaaaaagtttattcactcattaacgttaggaacaaaggcagctggtagcatgggataaacctaaagggttataacccacttccatgggagacaaaatgaaggtgtgggttccagtgggaaactaatcctcagagaagacactaagtgcagaaataaaacatgtaagcatgtggtgctgctggctgctccaccaggacactctacagtatcttagcatttgctatgagtctgatgaaaatttttattgaacaaaatcaaaggtgtattttatttttactctaaatatttccataggggatttgagtggctttcaatgaaaagcacattaaaacagggtaatataaaagaaaccagacagatgaatcacaaaaaggaagaagcaaaaccattgactgtacagacaaaaaggtgttgtgacagataagaatattgggttcacaacttcttgcagccaggttgaaaaggcatcactaaaactccagttctttttatcaaaacaagtgcagaacaggtccccatatggagcagtcttttcgacattgaattcctaaggaaatttctcacgttggactgtggatagagacatagagtcacagagggatcgtttgtaagcatcattttttatttcagcctgattcttagttggttgttctcggaatgttcttcttaaaacccaagagcatgacaccaattcaatgaagcttggtgatgtaagggtatccagcactgtgagataagagtcacccaatggtgtacttgacaggcacagcaatgtccttatgatgtcaatggggacctctgggtccactgaaaccttagataagataggcttagactccctgaaacagtgcaagatctccagaaatttccacagaagcctgaggagcttatgtgttcgtggtctcctttagtttttgccatctgcttttccagttcagtttagagattatgatctcactactccacactgtaagatgccatattattccatggctgtaagatgccgtattccatgtgaaacagctccaattacacacacacacacacacacacacactcaacagcacactaacatgctatgtcattagggattacctttgattcaaaaagtcctttgtcccttggaacatttctcctctggactccatgcagtcccagacttcactccatctcacagatcattcccttccttctctgcatcctttccttttttatcaccaactcccttgaagaagtaaatccactttgtatttcctcacccctagcaccctagccattcgtctcattaactactcccttctgaatgtcacacatcctttctttcctgcaaagtttcctcttctcccacaaacagactttcaggatattttcttagagaaattccaggccacactatgcagataatgaattcttcacctcgtcactatcaatccaatggttctcaaatagtagtacccagtgctaatggtgggaagcaaaaaattcctcaaggaatgaagtgtcttcatattttgatttattaagaatccttgctccatcaaaccccatgttttcctgcctatctgatgcatcacctcctgctgcttctatttgacagggacgacccaatggttcacgtgtggcagggcccctgtgccctgtgtgagcattcaccctgaaggcatgctcatggggctcatccaatggatgtttttaagtccaacaaccttctcaacttttttcttatcaaattcaattaacacatcactggacttagtttttatgttctc

SEQ ID NO: 1024 - DNA, 95390 bp, Homo sapiens
agaggaagcaatgttaaatatgcttaatatggtttaatcctctcaaagactttgtaaggtatcaatgaaacttgcacatgtgtgtcagttaggttttagtacaggaaacagataagtttcaggtatttcaagtaaatagggatttaaaacagggaataaaatgcttactaaatctttgggaaggctagagagagaggctctaggctgggaattcagaaatgtttccataacactgtagaactgacttattagagaaagatgacctttgcttcaatcagaaaagtggggacttcagaagtcactataaaatttattgacttcaaaaacacaccattgtagccacaattaagagatcagggagccactactgctcacacccctacagcctctcaaaccctagaacttggatgctggaacccatcacagaaaactcatatttccacaatctcacttattagcagaaaacaatggaagcagcaggaagatgacctccacttgacttttgcttccaaatctcaacaagtgcacctaattggatgaaacttatttacatttggaagtttaatggcacaggaatctgggaaaatttagtttttagctttccagctgctgtagtatagaaatacacagaatggaaaagtgcaaatggttgccagttggccatatccaccatactgagattcaaaggttttagaaatttcttatccaaggtcacagaacttgtgagtgctagagcaacaaacttgaattcaaagattttggccacttgcccagtgctctttccactacatcagtctacagcactgattactctctgaagacatttgccaaaggagacatattttcaaatcttgtgctaattatatttttcactgaagcattaattcaggcatctgtgaacattgttaccttttagtcttatgtcaaacctagttcttcttccaaactcagacttaatcttattttacagtaattacagttaaaccaacactgctagggtttaatacctttgagtatttttctcagcaggcttgctgcttaatccatttaatgtcagaacaacacaaaccttcttattaaaatgggggaaaggacgttattagagactgcattagtggtcttttcttctttggggtaaaacctaccaatatggcaatatttgcaccttatctttattttgttttctgctgaccacatacagaaaaacattaaaaaaggaaagatttcagatgttaaatccccttgaattctaattacacataaaagtagaatgaaagctctctgaagcaaatattcctagatttgtactttaatattaaaataaaaaatatgaactatgcaaatatttggacaaaatgaaaaaatataatgcctcagtaatattcatattcaattaaatcatcactttcatttcaaatgcactttaaagtaatttggggaacatattttaaaatgtacatacaatgacctaagtacaaagattcctaacatataccttaagagaaaaatagaaattactacctaacacttctgattagacttaagcaacaatactatgttaaaattaaagaggtgattaaattcatataaataaaaggtacatatcatgattgtagttagaagagatttgattgcactctttaaacaaggagataattattgttcaaaagttgttagatcaagtggatctagtagttttgtgctaagagcatatagaaaagaatataataaagaaacaatgtatgtggttgttaaggatcaaataaagacgttatgtgagtcttgtgtaggttagattacatcagtatcacagattatttatctccacatattcattagatacagaatgttaactttataagagttggcaaatttttaaatcaaaaggaactattgtattcagcacacaaagcagtgaaggctgtgattaacctcaagagaagtttggggtgcttactagagaaaacaattgatcctgagatttttctgaacatttctatttgtcattggaatccgtcttttgtaaaagactgttttcactcctgaaagtcattatgtactctctctgtgtacacacacacacacacacacacacacacatacacacacccctctatatataatatacacacatataaatgttgaggggtatattagagagatcacacaataaggctttttcctttgctttttacataggaaactaaaataataagttcaatttaacttctaaattcattcagattagaaagaaaaataattaaaaattgtgatagtattttttttgttgaaggatcttttacattaaagtcagcagtattatttggtaagtgggctacagagtagaacttaaaaaatatatccctatctcagttatcccacatttttagtatcttataagaaatgaccaggccgggcatggtggctcatgcctgtaatccctgtgctttgcggggccaaggcaggtggatcacctgaggtcaggagttcgagaccagcctgaccaatatggtgaaactccaattctactaaaattacaaaaattacctgggtgtggtggcatgcacctgtagtcccagctacgtggaaggctgaggctggagaatcgcgtgaacccgggaggtggaggttgcagtgagccgagatcgcgccactgcactccagccttagtgacagactgagactccatctcaaaaaacaaaacaaaacagaaaaacaaacaaacaaaaagaaatgaccaaagaccataagttgtaaactacagaagttgaagttacctttataatgattttatatatatgtaattatatatattatttaatatatgtatgtttgtgtgtgtgtacttgctttttaaacagacttatgttggacatatatttcaatgtcaaagacagtgcttttcattattctttaggtaaaataatgaggtgtacatgactctagtaagagctaattggaaaattataatgtttgacactcctttactgttttgttttcttattttttgactattaattaaaaggatgtgtagaaaacatgaaaaattaagtattaatttcatggtgacagatatttaccatctattttttctgagcataacatatagtaatatagaactcagaaattactggcttaaatcaatgctattgtttattaccaaattaaccattattattctagtcatctactgaggagtatagtttccaaataaaacttaaattgccacttagagacttgaccctaaagatgtaatgacataaagtgctcagttttgagaagtatatttcactttgtgtactgatggattttcctcatcttgttgagcagatactaaaaggtaagaaaagggctattaagttacagctattaagtactatttattattattgaaaaaaatatcatctttaggttgactgataatgacatttcttttagaaggattgagtgtttgtgtgcctaaaaaccacgacctacttcataactggctaataccttcagtatgaacaaactttttaagaataaactgctgtatgtgaggctacttcttttattaatatttcatgtagggcatgtttataaatatttgagaaaattctatcagaatgtcaaccttttttatatcctaaaataggcaaatactaattaaaacaaaatggtctgggggattgaattaccctctactgacctccatttttctcatcttgttaatgcagttcttactgaaattaacatttgtctgaactgttcaagagtaactaaaaaaaaccaaagtttgcattttatatcattcatttactttacatatacaatcaaagcactctaacaggttacagattggtgtttttactcatataggtgtatgtcaactttcttttataggggagatttgcttcaaagaattatacaaaaaactggcataaatatgaccactcacaaaatgtgtttaaataagtaaataatatggaaaaatacaacacaaatatgtaatgaatatttgaaaaccctggtttctgaagagtttagatagggattgtttacattataatctacttggtatttctttaaataccaatgtatcccaaaataattattcgattcacatgcttttctctgaaacatatttgctttatgtaatttatttaaaggctcagataaccagaatgaattcaacctaacgcaaggattaaaagaatgtaagagatctgtccaagatctgggaatacatcgaatccttcctactcattttcatcagaagccctcgcctctgtgaagacagatgggagctccatctacattcaggcaggaaggccactcaactaaagtttaaagttttacaaggaaaattcctacagcttgctttaggagggaagggtggagaacattctgttttacaggacactccaccctcagctatatccccttgattaattatgtaaccagatctccttcatcaacttaccgattaggtaatggcaggtatttctgatgcttggtatggggtctgagtgaggagggtcctaaaaatattacttatgcagctgttttgcatagcattaaagtgaaaagctttaacttgcagtacaagttaacatttgttccagacttttttttttaaactattattttagcatgtaagccttatagacataaatcctgtctactgatacattataaagtctcagaaaagtcagtgattatatacaggaaagtagataaaggagaaatttcaaatgcataagaacaagcaaaaaggtattcgtaaggtattagaaactattagcattttagtataaataactggtgaatacagcaaaatgaataatttgtggttagtataaatcagctaaattcttgtaatgcacaactaactacacatattcttcagcccacggaggccatacaatggagatttgggattctaactttgttttcaaaatggagaagtgcagaaactttgaatcttttaaaatttatcttccatctgtttcctgtaatatcaagatttagagcaaggtctaaagctttatcttacgtaaaagctgggtgcctaatatgtatctgtcctgacctcccatggaaacaattatcaggcttcagatattttgtctctcaattttttaacttgaaagtacatggctatttatttttgcacttattttttgtttttattgtgcaatttttcaacatatggcaaagttgaaagaataccacaaatgtttgtatacctttcataattgtgtatatgtgtatgtgtgtgtatatatatatgtatatatgtatatatatatatgtatatatgtgtatatatatatatgtgtgtatatatatatatatatatatacatatatatatatgaatgttgcagcatgcatttcctgagaataaggatcttctctttattctagaggtatatacctctacaggtgatagaggtatataaccacaatacctctatcacctgtaaaatcccgattccaggacacaacatagataaattaaataaaaatttttgtagtggagccaaggatccgtaatttttacagttctcaagtgactacaatatgcaacaaatgttgagaaccactgtccacacattaattaaatttgttaaatattttcagtaaagaatacattttgtttcttaatatgaataagaatgatagccttttaaagtttagcaaatctaaattatatattttaggtcagcattttacaataatttacatttccttaagctgttcttatcaagttaataattttctttgttaaataaatgtattttatcttaatttcagtttcttctatatcatgatttaaaatgcagaaagtatgtattatgtagttttcaaatatatttatctccaaagttaaatggattttagtaaaaatgatatttatacatatatattttaataaaatgtttaataaattagacatgaatcttagcatgtgaaacataaaacttttttataactttccccataatcaaacttcaaattcgtaagaattaaaagtccggaaagaaagaaatcgaaatccaaacttactgcatgttaacattttaataatgtactttcatgtgttaaaaacctaaatgtttcttgcaacaaagcattatccataagtgaataaaaataattttgactaataacaaattattcctatcttgtagtttctttgtcagaattaagattagcattatctattaattacttctctgtggcttctatgacattgttgtatccaagcaagtaaagaagacattaagcatttagaaacagcccttagatgtctatgtctgttcttcagtgttaggagtaaaagcaagcaatgtgtaaactgattatttttaataaatgaatcagaacagttcaaagtcagataagttatacattttagactggggcagaagtcacaagacccagattctaggctatgattagcagggcacttgatctctctgggcctgaagtttctcacctgttaaatgaaggatttagttatgccaaaggtcccaaactttctcagttcacagcattcctagtgtctcagtaattttttcatggtgttgcaagctaaaagaaacacctaacagttccatttattaaacagttaaacccaaacttatgtttgtctatcctaacaacttagtagctatttaaaaaataatatacattaacattttttattcttaatgggatgtgcacatctgttgggcacttcataacttctcaaacttaggaataaacttggaaaccgctaccctcattcctgttctacagtaattttcccatagtccttgtgttttattacagcaatttacaaaaacacagcctcacaaagatacgatgtcaaaaggaatgaagtacaatttaatgtgtagaagttctgaactacctcaagatagtggtttgcacggtgtccaactgatgtcactgtgttggccttgaaaatttaaaatatcccatgatagtgcccctgtgagtttgttgtggtgctcctggggtgcctcagtacatagtttaggaagcatggactaccctctgtaaaatacttcatatagctacaatgtgtgttgtaaactgtaaaagacaattctgagggcctgaagtaaggagctgcagaattgaagaggagattaaaaagtgatacatgttcagtctgcatgaaattccccttcctccccaggtcacctataaaatgcctacctatgcctacctataaaatgcctacctatgcctcaaaactcagctcaagctccctcagggaggttaccaagttacccttaccaagttaaatccacctattatacattctcacagtattcatttcacagtacttgtcccagttgtaattatacattcatttgtgtaactatctggttaattcttgtctctctcattagaatgtaagctctaagaggaaagaacatgtctgatatcactactgtaacccacagtgtctggtatattataggggctaaaatcttgcttagtgaaatgaactgtgatagaataggtttagcattcattttgattattttcctttattcaagaacagctgatatttataatagcattcctaaaacatttttctcatactatttcgcaggagaaagaaacccatacacatacagctgcatctgaaacctcagaaactaagctcaacccaattgattaaaaggatgttctttggataaggtaatcaaatgttcaccgactcttatagccaaattaattattatgagataaaaatcacgtaactacaaaaaaaaaaactgctcacaaaaaagtttttaaatcttagcagatggacacaaaccatactttgagaaccatgttccacagtgccaatacaggaagtttctagataatggcagctcattttttaaaaatggcactacactatactgtattcacatgccagcaaaactgttaaggtaagttcatgtcactattaaaataaaatgaattctgggaattttgttgatattcaattttaatcttaattatgcaaagatctgttacttaactaagactatgtaacataatatagcatatgacttctggataatgaaaataatcctaaacttaaccataaaaaaataagggtatgaaagtcaaaataaggtagaaaatgactgcaccaaatagccaacaaccttaaaaagggtaggatttttttaaatcactaaattaagattggttcattgcatttagtacatctcttttatgaagaggagttataagctacagaatcaataaattatgttttgatataaatttttcacccttaaagttcctagctaggaggaaattattcttttacacttacacgttttagatagaatggctataagtaagcacagataaatgaagaaatgaaagagaagggaaaaatagagatggttgattctgcctctgcaattgctaattcataaacatcaaactttcccagtgtacactgtcttctttgggaatttgctccatctttttccttaaactgaaaggtggcttactgaggctatcactttcctaaaggtctccccaatactgcctaattattttctcttatcacaggatacagggtggatgtccatctacttccttgttgtcacttcccagatcactttcactttatgctcttctaaaattaaaacaaagatcatcgaccacaaaacacaattgttcttttgtagctcatgctagaataccctctttgttacatctccttcatttttctgatccaaaatttagtagcctactatatctcacccactgtccttctttcctccagctatggtagagaactgctcctccaactttatgtacatttgaatcacctgggagttcctgtgaacttcgggttctgatttaataaggacacccaaagagtctgcatttcctgtaactctcaaaagaagctgtggagtactctgaatagcaaagcactgtaagtgctgtttctgttagtatctaatctattagtcctaatctcccatttatgctttggcactcattccctcctgctttcggtatcttaatatctatcattccttcactcttccctcaggttccctacatagtttatctctaccccctctaagccgctcagtatcgcccattaaagaactaaaccaaaactagaaaaccctcatttaacccttcactccccctacatacaatctgatgtgtctctcatccacagctaaacttggaagaaaaattgcctgcttgaggatgccattttgttatcttcagctcaatcctgtacccacttcaatgttatttgcaggcccattaccccaacactgcattcacgaaagtcatcagtgactacacattgagaaaacaagaatgacattttcagttctcaactaatttgaatttctcaacagtattcaatattgttaattactcccaatatttttccacatggtcctccatgacacaatacataatagtccccttattatctatattcctgtctattgtaaagacttcccccgcacaccaaaaaaggtcaaggaaactcctagccttcaagtctcaactcaaatctggccttctgaagccttcccaactaggaaaatatacagtcccattggttgtctaccagttgtctaccagttaattgtaattcttagccacaagttagctgacccaccgtctctcaaacaggtgaagttaagctcaatatttggcatatcttgatatactttgtacagtctagctacaataagtttgcctatgcacgaagatggctaccggcgggggggggcgtccttacgtcctacgtcatcacgtgccgggatgagggtggggccctcaaggaagacggaatggaatccagatgggcgggggcaagcaggacggggcggggctacgcgggatctgggcggggcggggccggtgaggggtcgggggtgctcctgctattcagccggtgcgcgcggcggcgggaggcagtggctggggagtcccgtcgacgctctgttccgagagcgtgccccggaccgccagctcagaacaggggcagccgtgtagccgaacggaagctgggagcagccgggactggtggcccgcgcccgagctccgcaggcgggaagcaccctggatttaggaagtcccgggagcagcgcggcggcacctccctcacccaaggggccgcggcgacggtcacggggcgcggcgccaccgtgagcgacccaggccaggattctaaatagacggcccaggctcctcctccgcccgggccgcctcacctgcgggcattgccgcgccgcctccgccggtgtagacggcacctgcgccgccttgctcgcgggtctccgcccctcgcccaccctcactgcgccaggcccaggcagctcacctgtactggcgcgggctgcggaagcctgcgtgagccgaggcgttgaggcgcggcgcccacgccactgtcccgagaggacgcaggtggagcgggcgcggcttcgcggaacccggcgccggccgccgcagtggtcccagcctacaccgggttccggggacccggccgccagtgcccggggagtagccgccgccgtcggctgggcaccatgaacagcagcagcgccaacatcacctacgccagtcgcaagcggcggaagccggtgcagaaaacgtgagtgtcccgagcgcgtcctcatcgcgggggctgggcgctcaggcacgcgggtgcgggaggcagccccaccccgcccccaaatccctgcgatcctgggattaggtccattcccggcactgcccgtggaatcgaggtttggaggccggctgggagacagaggacttggattctcccgttttcaatgattgcattttaaaaattgtcctcccacccatcctcttcccccgcaccagtgcatacacaccctctcacatttgcaactttgttctttctgatttggtcctgatttgttgacagctctgatctgccttgggctaatggattagttagtataaacctgtcttgaaatctccttccacttttcatatccgcatgggttaggttagaggacggtcttaattctcattcttcgtagagtttggtaaggcgagatgttttaaagagctaaacacatgctgacttttacgaaggggctgagtgcctctaaaggtactttttggtccccaccaactggctttgtgttgcgctcatatttacttatttggcagcaattttgtagcgctcatcgtgaccatatcggtaaagtggatagaagtggtagcaggtgggagtggatgcaacggacaggatacggtggaggatttgtattcttcagacatctttttcggaagcttgcttatcacttttggggtggctttagggtctgtaaaataaaagatttagaactgcatttgagagaggttttcattcttaacatctacctctaattcttttccccttcaaagttttcttctagttgagtgagtacaaacttgcttttgtcgttgtcggttgattttggtggaatatttgtgtgagatggccaattttttgtgtgtgtcagaaaaaactatccgtgctcaaaacatttcctgttgtgaggtggttgtattcatgtgtttattccaatttttttatttctagatctctgagttactttacctacatgtgtttcaagttttcgtaaacaattttaagaactcttaaacgtcttctcagaccaaatcagaagtgtgcattttgcttagactccaactatcactaatgggaaccagaaaaataacactttaagatttacatttaaaaccagttattggtttaaagtttcattctaaaattttagtttcctttcagaatttcagttatcatagttcttcagaagtatacttatgaattggcattaacagaggataataatctataaatagactgatgaaaatttggaagttttatggtacagtgtgtcttaagggaatattgtcaaaccagcagttttctaccttggcagtttgagacatcggttattaatacttttaattttgtagaatggtttcttatattaaagtatgtttgtcttatttgacattgtcattgatggttaaagttgggaggcatcccaaatgtctgttctatgtgtttattaatataataatacacttagcatcatatataataggggtgtcatgggttttatgtgtatggtgagaaaacatgaagatctccctgatgtgtttttaagatactgggtttcagttagggtgttatcaaaggacctggatggctttgtaaacaaaaacaaatgccataattttgtattcattacacagtttaacatttatggattttggttattttgcgtaaaatgtactttttattagattatcctaatattatacttacttagtttttaatatacttgtattaatttcttataatataacaaaagtattttttccattcacccacattttgttagcatagatgtttatcagatctctgctgagcaccgtatattgcttctaatcatacagatgccttaaatattaccagcttgctctgtaagaataggctagtgctggcattttcattatcaagtgaaagtgtttatataaattatttttacctgaatgaaaaattgttaactttataatgcagttaatcaaagtttattttagaaatgaagtcattaaacctagtattaaatttgagttttaaaattaaactaccagtttgtggcctaatgagccccaaaacatgccaacattggggaaaatagatcttgttttgagctgaaaatgctatccagacctacttaactttgacctcttaaatgagagccattttattttatttacagataaaatatgctgtagcattattataggactgtttaaaaagacagccaattaaatataaattttatggaatataagtattccataaaattttggagtaaagtaggtgacaattgtaacctgaagctctttcaatcttgagttgaatttattaagaaaaatcaaccccccctagtggcggctctcacattgaaaattatctttattagtaggaaatacattttaaatgtgttcaatttaatcccactgaagtatctccaacatagtagactctcaataaatatttcctttctttttggagtaatgaaggttgggaaattaaaggctctgaagcaactttacgtccaattcatgttcctaccttcaagaagaaaatatcaaagataactttcattatagaatctactataactttgcttagactgttgccccatacttagtgaccctactcagaaaaagagaacaaatcctgtgtttattttattctctttggaaatgaaagtgtttatttattttgtctcatgaagatagtcaaaaaggccattatataattaaatagaatgtttttccctagtgataattttgtatatatttttgtatttttaaggttttaatcataaagaaaaagttgtaatggatttcagcttacctgtacatagaaagttagcactgaatgttggcaaataataggtgttgagaaaaggggatctacactttaaaatgataccagctgtagtggtgattaagccattatgaagtgtcagaactggaagtcacttctgagccttagctgatctttctttaaaatgcatactgataaaaacttttacttttattaacatattaataatataaaagcattgtcttgctattctttttaaatgtcatgaatttcatatatgtaatactgaattgtattacttacataatactcattaaatgttttctataaatttatggtgccatttttaaaatagcatctaaaataaaagaatgggtcttttcatttacacaattatttctccatcatttttctttccaatagctttagatagcatatacatagtagttatggacacttgcttattagaactatgaaatgaagtaagtgaaagtgtttagttataggtaacattaaatggcaaaaagaggaaacaggtataaattgaaagcactggatctaaactaaaaaatgaggtctagtttcttcactgttacagatctgggcaagtttcttgaccaataaagcacgacagtcagcacctgtactgctactctcacaactaaaacagaacaaaaaaaaaatatatatatatatataaactgtgaagactgctaaagatacaaatgaaacagaaacgtaaattctattcttttagcttacattatcacagaacaatcaattcgcccgtgaaacagtaagaggcagtatacgattatgttctcaattacggctacggctgaaatgtgctacttcactggtgaataaatttacatagtacgtgcttactcatgtatttaattaagacagttacttagaaataaataccatacaaatcttttacaacagtacctttctacttttatgcttcttttaaaattgatattttgctagtggcttaatatgacaaaagatgactgtttattagcacttattctgatacaagcttgcccagttctttacatcattttcttcatttttataatagtactaaagaaaggtagtattatttaagtttatagatagggaactgagattcaaattcagagttgctcagataatgagaaagagtttggatattggatcccaggtctttttgcttcaaagcttgtgttcttactgacttgtgttcgtactgtccaggtgaacagattcagtgatgcatacagtacagccatatcctagggattttcactgtttcttctcagatagtgttatggctgaaataaattatttgtcatttcccatacataatttgtacttgctcatccccatacttgtgtttttacgtcctttcctcttagagtcttttctcctgtcttattgatttgctacccacctcccttcctctttaaaacattgtttttaaaggctgcataatactctgttgtactaatattctataatttttttaactgtttttcttttgggaggaaattttattcccaaccatttaatactttaatatttcagagaatacccttgggacgtgtaaattttaatgcaaatttatttttttaggaaaaaattcctgtaagggaattttgggatagaaaagtatgtgttgttttaaggttgaaccaaatcgtacactccaagagatagtatcaaattaagaaaaatttactaattacattccatcatcaatctggggatgtgactatatctttgcatttttgcttaaaaaatattattgtcaatttcataggcaaaagtgtggttggtaattaaagttatatgttgggatcatggttatgtataggagaagcacttgtatttgcagattttctacttagggtgtcctttacgtattcatttgttttgtcttacatttttcagtcatcttttagtttgttctttttacttctttctattgaaatattgttttaaaatgtattcctattaaataatactggcagattttaaaagtcaattatatatgtggcacatcttaagtatagcatgtgaggccttatcttttgatgtcttactgtggtagttagggattttagtgctgtcttgtctcactttaacctttttcaccttcctgcatcctcccaatatattttatcacaattttggattatatacacattagtgttgtattatttttgactgtatattgtttactgtttagctaagtaatatactgtgattatatttgccttcctgttctatgctattattgatttcttttctaccatcttcctgtttattagcatctgggtttagctgtcacttaggttcatcggagacagagtttgtgtttctggctcctgcttttcttgttttggtgtggttttctggaagagaagggtagttgcagaaagctagatattctgccgtcacagaaacagaagtgtcttgcctgtatttaagacccgatttagatgccacatctccatgaactcttttgcagcacctgtgttactgagcaatatattatgcttgattttgccatgttataaaatatatttcctcctagtaggaaaaagaatgtctttaaagataggactattatttgtctttgaaactaccagagcttcccagtacagtaccatgcacttagtacatatttgagatgtactaatttaacaattaactaccacttaaaatttttttggtaatgttttagtgattctggtaaggcagatacattttatgcgggttcgagggggaataaaaatgtgtgtttgcgtagaagaagggggaggggaaacaatgagttttccaggattatggaactagtagtggtttctaggccatatttcattttcctgatcttccctgctaatgtcttgtgctagaaactatgctgtttatatctcatcatctctcctcaggtatagcaaacaaaagggaaaggaaagaactcatcacaattatagggcagcagcaggagggtggcagaagacttctgactcattaaaagtggcttccagccagaattctcagaagtttttgtagatgtttttgactcatatagggaaataaaatatccagctgtgttcagcctgacaatgaagttggggtctatttgtgctatgtgtcacctccattacattaagcacatagtttatgattgtaaatatttgaaatttatattcagagataaatacggatgcactgaagctgggggaaggaaatgaagaatgaatggggttaagagttgggctttattgggtgtaggtagtatggtagggggattttattgaggaatacttcagatttcctagctgttagatggagagtagcaccatagtgctgagaagcgggtgcccaactccaggggaatgttgaatggaagggcacagggtcaggtacagggactggaaataaagataaacaagttatgggtaagtagaccaacgcagtaagagtagattaaatcaccccgaggaaaaatccgatagagcaaactcagtactgtgagaggcaatctcttgttaaaaaacgtcactttgatctcataggattactgaaaccatatctttgcatgtcattttgaggttttataatgaatattatataaaacagttatatttatgagtaaacttggttaattttttcagctttgcttcaaacactggctacaaatgatgaacctcatagacttttttgatggagatgttaaaaaggctttcaagatagcattcagactggcattgggcatactgttgggcctgttaccaccagcagttaaagcttgcagggcttctaaacagaagcatggcatgcagtcagctggagtcttgatttcataacaattttacagattgggacaagatttttgaggtaaaggtttcaaaaaataataagttactcctttgcctgaccaacatcatacggtctatttcaggagatgtttgaactccagagctcccaaatccaatcttacagggatgtttatttatatttcaaacaggcttttccttaaataatggttagcagtgtcctttcttaaagattcgaagacaatacaaaagtaaaaatattagcgtaatccaagtcaagtgcagttaatgtaagattactctatttttaattgttctgtatatcttcaagatgtatggatagatattaaatattttaacaaaatctgtacatttctcacaaaatcagtgaaaaagtgggtcaaatgcattacctttgttagctttaacaatctgacattttaaaagcttcaaatccagtacatctgaattgttaagttctgagggtacttcttagccctgaccttaattcctctgtgtatttgactttcttcctctgtgtatttgactttcttctatgacctccaaaatattctaccctggtttttttccgtctatcatttcttctctgtgtctatgcctcttccatagccctatacctaaatgttggtattactgaggtctatcctcaagccacttttttccttttctggtacagctctcattaggaaatgtagttgttcttctgagctacaaatcgcagaaccatttgcaacctctcctcactcaatggtttcctcttccttacttcctatagtgagttagtttagttcagtgaacatttgagtctggcttaaatctctcttcaagccagtcctttcttaacctcactgtcactgcctttggtcaggttgtgatcattccttttcttggcacttttggtcagcaaacattaattgagaatccactctattatgctgggcattaaggatacaaaaatgatttaagcttacatagaaataagggtgttaggcaaacaagtataagcaattatgttacttgacaatggaaatttgctctcatgttaaatattttgtaagacacatagtaatgcattagaaatgtagacaattttgcattatgaaaagcaagcctcagaatctagtgtgaggctgaatattgcaaagagccagcacaagacaggcagcagtaccacatggagggatacctttatgttactattagttctccctgtgtcatagcatgttgccttgtttcagcgtttgtgtcactctcttctctccagtgtttcataatcattactggaaagccaccaagagtgcaggactggattgtgtacacactttctatttctgtgaagttgtttgtatggaatattccttaatggaatcattatattagacatttgtataagaagtcaaatggggcagagttgctaatccattgtgaggtaggtcagggaggacttcatgaaagtgatctacttgagcggggacttgaaaccaatgggacataacaaggaggttgtatgaaagcactaaaccacatgttgtaactgtaagtaatttcttagctctggggtagaatagacaaaagcggcttcaatagaagaaatgaagccagaggggtaaatgaagctagaaagatcatgaaggattttgtgtgctaagctaaggaacatggacagttcagagctactgaaggagtttaatcagaggagtgacacagtcagatttatgttttagaaagaagttcctggcatcccggaatcctaacttcagcgaaccctgccctgctttctgtatactctatcaccagagtcagcttggtgaaacacaggctgatcttgtaaatctcagctcaacacttaagaacagatgcctaagtccgatttctatcgttactttgctgtctcctctatcttgaacatttttgcatcagacacccacatagctcacttcattttactcatgtctgtcctgaaacatcacatcagagagaccttcctaggctgtccaaaccagcatcacgtctgtcaccccttagtttcttaccttgctttatttttcttcttagcactcaccgccctaaaagttatatgtttatttgtttatttctccatcctccacctaggatgtaagctccatgacaacaggagcttttgtatattttgtttacctgtaagtgttctgtgctgggcacttgataggtgttcagcatttgttgaaagaatgtggccccaaccatccttcttcttttctctctttcaccctgtgcctctcccttcatgtgggggaattcttacagttcactaatccttagttatgcctcttcatgaaatcctgtccctcactcaagatccatctcagataccaccttttctgtaaaatcttttttcaagcagttgctgcttctgcttagctcccataacactttttgaatagttaggagaaaagtgtttacctgggctgtacaggatgtgatggatataaataaatacttgtcagcaagttattaattaaccagtagagaattacacaatgaggtagacaagcattataggtaaagtttgaaattcagttggttaagtggagaagtgaagtaattaggtgtgacttgaaatttgtttataaatgcaatatgattaggggaaaatagctaggggaaccatcaccaatttctattatatacacagttgtacagacaacctggagaaggtatctgttgatacatacataaacacacacacacacacacacacacacacacatcattttaccgatgtattaccttttttgtagaagtatttacttttcatcttctttctgcctaaagtattacttctccacatacatcactgaaaagaaattatctagaaatgttttgattgggtcatattaatagcactatgcccaggccaatttctactttacaaaagctgatataattccatttgaattgtcaaaaatgtctttgttgtaagaaaacgctagataattactcttctggctaacaggaaggtatagaggtataaggtataaattactttagtttcccagttcagcgtgggtatctgatgatttttaaattcactttaagtgattaatgtctgctgtgaaatcctggctggggtctttgtgtgaagttattcaacttttcttttctgaactcatgttcctctttgacccataagtgtctttattctcaggtgaaaatcatgctaaattgtttagggttccgttgaactttctaattgagacacaagctacgaaagctaataattaagtataattattgtctacatgtaaaagcaaaagttgctggtaatcaccattaacctctaatatttgccaacaagaaatgtaaatagcaaaagtcaaatttattcttcttttaatatttgaggaccacattagatggctggaggaccatctgcaggtgtcagaggggctttgggacattatctctaatgagttgaaagtaaataaatacagaaagctggtgatatgaagataaatactttatttagggttgtccttgtttattgacaacgtcaatgatgctgagatgcttcctgtggaagatagcaaaggaagtatgattttcatataatttatcacaaatttctctttttaattttccaccaaacaatggctaatgcatttgagaggggaaaaaaatcccagtagatctgttaattgggaatcactgtgctacaaatgcttgaagtataagcaaacattttcctatgatgagttcataagctttttaatgaaatattcggaagaatttaacccattccctgtttttcttaagatgtgaaaggaagattttagaaagacttacgtaaactttaagtagactttaaaagtttgttgtgttagagaaatatttgaggagatgttataatgcaatagaaatttttgctttatattttttaaaggattttttatggtattttgtttgtttttcagagtaaagccaatcccagctgaaggaatcaagtcaaatccttccaagcggcatagagaccgacttaatacagagttggaccgtttggctagcctgctgcctttcccacaagatgttattaataagttggacaaactttcagttcttaggctcagcgtcagttacctgagagccaagagcttctttgatggtaagacagaagggtttaatttgtctacaataacgtataaaaaatacttgtactagatatagctgtttctgtgttaataactacaaaaattagccgtatttggaaaatttattgctgtatagtaaaatttcagtggcaaagccagatttataagtcttaaaatcaattttccagttttattcacccaacagatgcagccactgaaatgatgcatggtatcattctttgaaaatcatatatttagaagttacactcaaattgattatgtcaaattccagtttcccttctacttcaatatttaaaagtcttttttaaaaaaaaagaaaagataaaacaccatcttgctggattttctgtgttttcatagacatgtcattttatttatccctccaaacttacgtatatttctaatctttttttttttttttgaggcagacttttgctcttgttgcccaggctcgagtgcaatgacacgatcttggctcactgcaacctctgactcccgggttcaagcgattctcctgcttcagcctcccaagtagctgggattataggcgcccaccaccacgcccagctaattttttgtatttttattagagatggggtttcactatattggccaggctgctctcaaactcctgacctcaggtgatctgcccgtctcagcctcccaaagtgctgggattacaggcatgagccactgcgcctggcctatttctaatattttacattaattgtataccgactgcaagaaatataattaaaacatgtttttcactagaaagaacatttgattgtaagagtcaatagaatttgatttcattctctattgtgtcactgaaaactgtttgtcattaaccaaaccaggtagcatccccgtatctcagttttctcagcagtaaaggttggggttttgagctaggcagctggatgatatttgttacctttaaattgcaatggaagtttttgtttgcaaatgatgtttcagtgtattttctcatgtaaaattaatttttgatttatcttttatctgtctataaggcagaaatagattttttaaggaaatggtctttttaaaatatcatataattttactaaccatagcaagttaatgataaaatctcagtgggctatgtcagtcaatgcttctcatacattaatgtgcttacaaatcacatagggatcttgttaagatgcagattcttgttcagtagctttaggtgtgtccctagattttgcatgtctaacaagctccgagatgatgctgatcctgctggtctaggtcactaggaagtgcctagacaacacgtttatggatatttgactggtaatttgtgtttagaatattgcaacagttaatttccctttagatttatgtttacataatctgatgtgtttcgtctgagcatctttttattgatttgcttgcttgctctcccgtctttcttttggacaaaagctatttagtttaacagttgtggtctgggcaatatacagatttgaggatagtgatttcaggaaagattatatatttcaaagtttcatagtacacaaattttctctgacctatataaaaagtgtttgaattttcagttgcctctataccaaacccttcatcttgggagaagagttacgcagtattcagtgatggtctgtaagtatgtgtgtattagctatagtcatttagctgacatagttggaactagaactcaggtttctagattccttatattgtttttcctgaccaaataatacctacttttttctgggaaccttcgcataggaaagcactgaggattttttcctagacctgtggttcttaaaagtgtagtatccagacaggcagcatcagcatcacctgggaacttgctagaaatgcaaattattgggtccaaccctagacctgtggaatctaaggtggtgggacctttggtgatagggctagatgcatattgaagtttaggagccactgctgtagattgtaacttcaggcctcctcccagcgtcacggaatgctgtcctgatccctagcatttactcacatgctgtgcttagtgcttgaccatgtggtggcagattctgtgatgtgtaagacgtggttgccacccttagagattctggagtctagaagccaaggaggcattattctctgactctgataaagctttattgacttgagtcattttacctttccatttcttgttcctttgtaatggggaatcaaattatatatgttaaaaagaaaaaaaaagtataggtttttcctctgtttagaagtagtacatatgtgtgtatctagacagatacatataaatgtgtgtgaaacacacatatataaacagatatatttctatatttaatgtctacattatgtgtgtatgtgtgttcatgtatgtatacacacagacacatacatgattagataagtgtcctattattcagtgcttcaagtaaaggagatctcacagtctatcttataaagcatgtcatagtttaacacagggttcatcacggaattgttaaaaacttttttctcagctcttcattaatgagtttgtctgttttttattctggttcagtgtatttgacagtaggatcttattacctatttgcatgattccttcatcaactacattatcattatctttaacgttagattcttttcaaactgcattgtgcataagaattacctagaaagctttttaaaatgcaaatttggaggcatgcccctgctgataacaaggaagttctgtgtaaaacccaagaatcagtattttaacaagcatgttacggagtctgaggcagtgatttagcctagccttgattatgccctgaacaagttaatttttgtttctttgccttcagaatgacaaatgcaaacatacaaaatttaaagaagtctatgaatatttttgcttgtgttatagtggtgtacattcagcctaagcagtttcttagattgtttgatacagaaacatacagttagatggaaaatgaaaataataaggttttttttttaatccccaaatttcctccagactaccagtggtctggaaaggcaatgcaacatttcagagcacacagagaatgaaattataagggtgacccttatgaactgaaaaaatggtagatgcaaacgaagagatttgaaacatgctaacaatgattaggatttttgtgtgcagttggacccactcttccactattagggaaacagtatagcgaagcgaagggaagctcaaagtgaataacaggatgcaaacagggggtgtgtaaattcctgcggaaagaacaatataaacgagtaatcatacaatcttgttagaaaggaaactcaagttttactgtaacaatagatatttttccaagaaaatacatctatttattgcaagtttaaataatccaacttggatggatcttcttaaagtttggaaccatgactatactgctgctgctgtctgaaaagcaacactataaagttttaagtactacattaatatttatccatttctaattaattaaaacatattgaaatataactttaaaatacttgaacaaggcttagcaatttttcagttataaagtcgaaaatagtttctttgacatgatttaagcattacatttaaatatattatctctgagatggagggtattttaaaaatttaaataacaatggttacaatcaataatagtttattaatagagactaggatttgggtggttacaatctaatctttgaaactggttgatgtgaagagaaaggattgtttcctcctatatcatgtctctcaaaattgttaaacagtgtacactgggcttgttgatcaatctaatcagcattgtaatgtttcattcctaatttcagcatatctttaatacaatttttaatgagatttccttactattttttgaaatgcccattattatgtaaatattttgttcaaattattctgtttttatacagctgccccaaaattgagaattcgggaatgactacttttgttttctgtttacatacaaacacctaatgagcctgacaaaatggagcttagggatccgagtttctgatttcaaagtcttgcatttgcagctgtcatagggaatagtagtattctagttatttttaaaacaaggtaatgttagggaaaatctaagtcttgaatcattatacatgcttaaaataatcaccattttataaaatgtagaattatttacatgttaaaatattttcattcattaagcctaaaaatgctgtgggaagagaggataatagttatattatgtgatgatctaacatttatttgaccccattgtttatcatggatctttcttgactttattttaaattaaaaattacaagtgctctgttcttggtcttccttttgcagatgctttaacagttcattcccagttcattaggttttccaaagagagctattgtgtttattcatcttcagcttgtgcatttctctgaatttcagttgttttggtatctctctagatcagaacattattcttgaaaaacaagtatacgtacatgtgtatatgcaaagaacaagcttgaacaagcagtaaaaatgaagtaatgcacttctaagtgttgatgttttataaaatctaatagatttgtatgtctgctttttcattcatgagaattctataatttcatctgctttgttgtaattttaaaatttctgtgtgtcaagtaatttaccaaagtttcagtatgatagtatcatagcaaatgttatttcttaattctaggactatccaaagtaggtttgtttgcataacagtttagcacatttgaaatcaccaaataaagtatttgttgaatttgatttacccatggcattatccatcttaaatggtgatttaactgttatcttttttcctaattcacattttaaaacatgaaactctaattacaatattcatgataactttcatagctaaaactatataaacctaggttcttttaaaattttaatttatggaacccctgcagatttaaacatgaataaatacaaagaatagtagcgcattcttattgaatgaatatacaaatcctggctctcatatttaatattgtgacctctttggttcaggaatttaatctctcttttcctcagatatcccaatttacagtataagatttattagattatatgaataaattaatatgatagaactttatataggatacttttatctctgcttttgtttgctttgacaactattttgaagaacacagtgacaaatatctgagattcaaacaatctaaactcattgtatcatatattatgtattttgctgctttcctgtctcttttaaatttactgatttaatggatttctctttgatcattacctagtcttgcatggttctagaatccttgcttatttggccatgaacaggtcattagtcatcattttttttctttttagggagactaccgtgggctaacattaaaatcaccaactttcagcaattttccttttttagaaaattttcaaatacagacatttaaaaatctgtagttaagtcttaagatatttcgtgagggtttgtgatctggttaatggaaatgtacaccttcatgttatagtgttttataaaacatattcatatataatattaattatattaaaatctgaagaaatttttatttggtaatatttgtatattatttttaaatcttgctcttacagccttttgacttttcaatcaatgaattttaatgagtaactcaaattcgtttatttgcttatggctggagatttagattttagagtcattttatcgtcagaataacattttaagccattaaagtgaataaaatattccagggggagaacatgtagaataagaggaaaagtaccaaagataagatgttttaaggatgagcaggggtagtaaaaagtgaaatctgtggagtatgaaagtatgctaaggtgatagagttgacttaagatactttcatttgatgtgttcttaaattggagagccagagagaaaactgtacatgaaagtgaaaactgaaatgaaatgaaagtgtaaactgaaatgaaatgaaagtgtaaactgaaatgcaatgaaagtgtgtacagaaaaataataacactagagaaggtgatttctgttccttgtttgtccatagaggccaaaaagccattcagttgttagcagtgggagattaagagggagacaaatgtctgggctctgtggctcatgcctgtaatcccagcattttgagaagccaaagcaggaggactgcttgaaagcaggagttcgagaccagccaggacaacgtagtgagacctcgtctccatacaaaataaaaaattagctgggcttggtggtgtacttctgtatcccagttattcgtgacactgaggtgggaagatatcttgagcccaggatgtcaaggctgcattgagccatgatcgtgccactgaacttcaggagtgagactgtttcacacacacacaaaagacggagacaagtagtctgatgggattggttgacataaagaaccttaatgaattgtacctactgaattcttcatgtattttctagcctgaaattttctcatacaattgtcatatttacagagcattctgttgtcagctggatttttttttatcgtgtctaatttctgtgttatggagacatttcatctctttatctcagcatggtagagggaggttgtgttttgtgattaaagcactgacagcaggagctgtggatgctagttcagttaacgaatcttgtgttttttgatagactttaacctcactgttccacagggtcttcatcttctcagcatgtttgataaagatgcttgcttgccctgatatattaggtttgtagtaaattctaaaaatgagagatctgtgaaaaatttttataattaaaattgttactgttatggaaatcatagttatttcctgcagaatcctgatatttcacttgttttagtggagaattttgtttttttttttttttttgaatatgcataagggcctttacggacctggtattaatatcaattgagaatccctttgtttaattaatttcatattttttatttagagatggaaatttgttaataaactgtttttccccttttgatataatacataataatttacttacatatactgttttcttttatcgaaagtggcacatattccaaatctggacacttggaaaagtgtgatagcttgctttggtgaggatagaaattttgggcattgtatgctacttgctttattgggatacatgtcaaattttctgttattgcgctatgtcttaagataggtgcttcagcttttgtgtttgtaaaattgttattatttcccgaagaagttcacaataataactgtgctgaacagcatggaatgataattttaagaagtatgagggaattcaatccagaacatacgtgagttatttcctaaatcctgaggttctaagtctctgtttctcaaagaatggcacctcattctcagcatcactggggaacttgttacctatgcaaactgtaaagccctatcctagacctactgaatcagaaattctagaggtgtggctaagcattgtattttaagccttccaggtgattctaatgtctgtgaaagcttaaggatcactgccctcattgagtatttacattatgttacttaaaatgcaatttaaatactactcttgtatatatgaaaagctaagtgcaactcattccccactgaaaaggtcaattaactgctcttgttccattaatgcagagatttgtcatatagttatagaggaattgtataaaactgagtgcgtaccaatgagtaactggaagaatgttaaacatctttggaagtcagtttttatgtaagagtttggatagaacaaacttttaaggactaccctgccaaagtagtaaaggggatggtaaatattatgaaattaattgaatttatagcagcagttagggactaaaaggggatatgctttccctggcaagatcatctttctgtttaaatgcaaactatagtaacaaaatacaaaatatagtttaccactattcggtattcctcatgaatttttttttccttgaccaattcaaagcatgtgatatgaagagatgtggcatttagggagtaggggaaatctgagcttagatgtctaaggaaggaaagtaccgtattaggaaacatggatatggttaaatgcatgtgggaataaaacttgagtcatctgtggtatgaccatttgataatgctgtgatgtatttgcactctaaattccatcatttgttagattaaattcttatttgtattgtacgactccttcatagatctttcaatgaggaaatagtggaaatattttggtggtttactatcttaacattctactgaatgttcagagtctgattctcacactttggaaagtggtacatatcctcactgatggggaagattttaacaaatgcccattacggtacagcagatacttcccagctggtgacctattttcagatactacattttgtttctgtggactgtcataaatttaattccagtggtgtaatatttaaagtgtcgttatgcatataatttatgtaacaatttacagttttgaagtatagttgacccttgaacaatgcattaataacatgaacagccgattaatgtgtcttttgtatatgtattatatactgtattcttaaagtaggccagagaaaagaaaatgttattaagaaaatcataaggaagagaaaatatatttactgttcattaagtggagtggatcatcatacaggtcttcatcctcattgtcttcatgttgagtaggctgaggaagggttggtcttgctggcttgggagtggcagaggcatgtaagtggacttgcatagttcaaacccatgttgttcaagggtcagctgtactttcaaatgtgtcatatagttaccatagtaatcctattagatactaattactgctttccacttaaagatgataaaaatactcagttacctccttaggggcactttaattgtaagtttctcatcatggtttgagggtgtataaagtcagcatagacttcgttacctctgtccttgattgtcagtgattgattccaggcattaccctggtattgtacatgttattttaatcctcacaagaatttgtctcaagaggtagcattgtcctcatttaaagatgaggaaactaaaggtcaaaggtagttagcaaagtgggcggtggctaataatagctcacacactgaggtctggctacctgagtttttgtctaagctctgccacttaaatctctatgactctgaacattttctcaatctccttaagtctcacctttctaatatattgaaataacagtgtcagtctcatagaactattatgaagattaaataggatataatacgtggaaagtgctaggtgtacagtgtgtgcccaatatcacatatgagtactaagtaaggtcactccaatggtaggaagcagctcttgtgacagtgtctcatgtcactttcttactcattgttttctttctaatcagcacaagcaatatatacatgaaaatgagtagtattgatagagcctctagtaatttactaagttagaggtagtaggcatgagagcaagaaatagaagaaaaacttcatgcaggggtagacattacatagtttaggctgaaaggccatgacataaaatgtttcctgaaaaagcacagcagtgtttttttaaatgattttaaaagtccacccttctcagactcatctttgcacaatatttacttcaattatttaccagtgattaaccttaaacacaagagcaacagaaatatttgcatatttgtttttggtagaaacctccagtgatcattccgccaaatgaacttgtcacttttcctacttatgtagtagttacacatattatctatcatccttccaacatttggaattataagcattgttgtttagaaagaatttgttctttttattttttctctacttcaagttcctgtaatactttaattaaaccctattctggtacttagtatttttgacattgttttctagttatttccatagcttatatcccctacttaaagacagggtctgactcaagtgtctaattacattggctaatactcccagtacaagcccaagaacaaattataaattactctaagatgaatggtctctttcattgcttagtcatcttctcagtgatcaagtagttatctcttaatatttatgtttttctactgccagtgactctaggtggaactaatatcaattgtgttgattaaatattaattttaagagattccaaacaataatttagatatataaagtctgacactgttattgtccgtttttaggcttatttcataatgtaagggtttggctttgttgttttctttttaaaagcaagtgttactgatgcttcataccagagcttttagaaaagtaacagaatatagttgactctgacgttgtatggttttagtgcattcaagcaaatgtggccattagtaagcaagcaacaacataacttaccgaatagaaagggagaaaaggccattctctcttctgccattctctctgtgtacagattaaacatttcctttggtcttgatgaactgttaggtcagtttacctcaaactgttttttggcctaaggaaatctgttctctggccttttgaagttacattcagagaccgtgcttttggctgtttcttgcaaagagatatgttttaacttctgcaaaggccagaatggcatgagattctggtgtgacacattcactgatgatttaccagaaaatacactgcaaatatgaaagactgcagacaggttttatatgtggaactctgctcagactgagagaaagtctagttattagtaaatctctagttttttcagagctggattattttgtcacataaaaatatagtgagataaatgttaagaggactgccagagtcagttttatttaatggtttctcttattcaaatatcacaggttaaaagaaggtcagaaagtggcaagtatctaaaagattatgctttataaccaagcaatccataagctctgagaaatatttctactaattacagctactgtttgttgaacagtattgatccactatgtgtcagaaactttacatatattctcattactcttcacaacagccctgcaagatgtgctttaaaatttttttttttaattaccacctcacatattaggagacaggctcaaataactcccacttttagtaaatgtcagaggtaaggtttgagcccaattctgtcagttaccaatatccacatgcttttaagtgagataatatttgaaagtgcttggcaaaatgtttaagtggtagctgttattatttctattcagctgcgcttcctcccagactataaatacatacataccacacacatacacacacacacacacacacacacagtgaggaaaaaaaagaagagatagcattataacatgacacctccaatagtaagcatcctatcatgccatcagactttccttcacatatataatccacaagcagttaaaagctataccggaaaagccactttacaagatgtaatacctaggagtaaatataaagatacctgtgcacatcttttttgtagacaactttaaaacattctagcaggacaaaatatagacttgaacaaatggaaagaaatgtatgttcttggatagaatgattcaagattataaagacattaattctccatgagttaatttataaatttaacatgaacctattaaatagtcacagtaattaacagtttttacccaaatgctggacaagaagattccaaacatcagaaatccatctctcaataaggtgtatagttgctttttttctcctcaccaccaccagttccctaatatttcaataaatacataaaaatgttggattcatttttataggttacattatggagaactttagtctcctaagaaaggaggtaggagtggagaggagtgtttgtaacagtgttgtgcagttctttgaaactcctaagttttgtgacaaaattatatcgtgaactcatcaaaaattatttttaacaatctgtcagctgacaacttgactaaacccttcagttttgttactagcatagaataaggagctacccactggcaacaggattacttacctagtatttattatttaccttgttttagccaaatactaaaaataccagtggatgccagtatttcaaattgtctttgtttggtgttcagaagttttctattatagctctttactcttgcttacttttaaaatcattgtttttcctttttttccatagttgcattaaaatcctcccctactgaaagaaacggaggccaggataactgtagagcagcaaatttcagagaaggcctgaacttacaagaaggagaattcttattacaggtaaattttagtaaatatagtttcttacactaaggacagttgtaaatggaaaatgaattaataagtcttttagtaattccctgtttacttaggatttgctcaatgttttttgccactttcatctgaactgcgatagtgaatgatgcttaatacatgaaaaactggaattatagtcatgcaccatataatgatgtttcagttaacaacagaccacatatgcgacagtggtcccgtaagattataccatattttttactgtaatttttctagtttagatacaaaaatgcttaccatgtgttaaaattgcctacagtattcagtatagtaacatgctgtacaggtctgtagccttggagcaataagttatactgtatagcgtaagtgtatggtagactataccatctaggtttgtgtaagtacactctatgatgtttgcatgatgatgaaaatcacctaaccacatatttctttgaatgtgtccctgttaagtaatgcatgactgtatatgaagtagattagttagaagaccggtcaaccccttctgttgtattaatatttcttcaaacagcaagaactcctagagtattttagaggttctaatttaagatgttgaatttatatatatttttatggaatgtatctctattaaaattgttaaatgcatttcttaaatagtttaaaatagttcttaacccaaatttcattttgccaatatgttataacttacattttattttagcaactgtttgtgacttattaacatactaaagattttctcaacaactccaatccctatttttatgcttcagaatttagtttctaatttgtctatgaaagcattttgcatctttttttactcttttttttagaattgatgccatgattgattctcacttaaaattctcagatacttattttgttgaaaaaagatagaataaagatgtgtgccatgtgtgctgtcaccgctatgtgatcattatcagtttcacccactgaactgactagaaaaacttcaccattgttacaaaaagtaaccctaagtttcggtaactccactagttcattcagtggatggtgatgtgcctaataatataacatttttattacaattgtgtaatcacattcaaagtcctgttagcaaaaattaacttatgttaaacaaagtaaatctattaaagcatgagtcctcccctagccccaactgaggatcttcatgtatatgtaaacccaaacataaagactccttattcaggtcataggaaagcattttaataattgctatttaagatgattaaacacacctcttgggttttctactaagggcctaatgaaatcccgtatttcaggtgaaatagacagatatgtactgattgacgtaacacttggcaagttggtttaaattatgggccatttttatttttttcccaaaacatttaggcaaattgtgtacataccctatgtcagggaaacagaataacaataatatgaatgcaaagctgtaaagctataattatatggaatatatatattttaaattatctgcaaattggtaacccttaagaagttaaaataaacttacctgtttatattgaataccatttgtagattgctcttttaataggaagactcacattctctatgattttcttaggattgtgcttatatgttatctttttatgaagaagatgactaaaaacattatagatatgtggaaatggctgtttgattataacaattgcataatgacatctgactttatattgcaaccgacggttatcagccaattaccactacagtgtgaaaggtgttaccagaggttctgtataccatatggcctaaaacttttgaggagaaatattttcctttgcttaacaaaggcatatgaagaaaatgttacaaaaatttttattaaaggccaggtgcggtggctcacgcctgtgatcccagcactttgggaggccaaggcgggcagatcacgaggtcaggagttcaagaccagcctggccaacatagggaaaccccatctctactaaaaatacaaaaaattagctgggtgtggtggcgggtgcctgtaatcctagatacccaggaggctgaggcccgagaatcgcttgaagccaggaggcagtagttgcagtgagcagagatcacaccactgcactccagcccgggtgacaatgcgagactccatctgaaaaaaaaaaaaaatttattaaaagtttaagacatctttctaggttagcttcaatttattactattttacaaggaataaaaatgaaacaatgtgaataactgtgtctttatttacttcacatgtttatttcataagtttaaaatatatctcttgctatttaatactgtattgttaaaatcttgcagctttgtttttcagtgacaggagttgaaattttatataacagtattgcagtttctctgaaataataagtgagcttaacaaaattttcagataggttgagtgaatctttgtgactaaaagaatgatgatctcttttatttaattagcatattaattccttctgttaatttattgagagaaatcaatacaagtaataaccttgggtctcctggtacttgagatcatttgagatatataaaaattgatgtgcatctatcgtttctagatttttatttctgataataacatttgtctaaagagatttgataactgtacttaaattatccttctgtcttctggcatgtacaccaatgagtttattggaatgtgactaaatttgtttcactgtttgaaaaagtatgatgttctacaaaataatatgaatgtgatcaatggataatcttccctagaagcagatattttcaggatgaatcagtgcaatgacggatatatagtgttactgccaagagaatttaagaatatccaattttgaatgtgttagtcattaactattcaagttcttatgggtagaatcaccattgtttatcctaagagaattgccaggtattacatatcatatttgcagtcaaaaacctgagagcctgcttgtggttaaagggacatggatggagccggaggccattatccttagcaagctaccacaggaacagaaaaaccaaataccacatgttctcccttataagtgagagctaaatgatgagaacacatggacacacagaggggaacaacacacactggggccgtttagaggctgcagggtgggaggagggagagaggatcaggaaaaataactgataagtactaggcttaatacctgggtgatgaaataatctgtacaacaaaccctcatgacacaagtttacctatgtaacaaacctgcacttgtaccactgaacttaaaagtaaaaaaatagaacaaaacagtcagaaccatgcaccaatttgggatcgataacacataaaggcagcatatcatgttatttaagtgagtacgctttggagccagactgaatttatctcctggatcagccattttctggctatgtgaccttgggcaagttacttttaaaggtatagtccttgacctcagtttcttctattgtaaaactggaacatggcacttacctcattgggtttttgggagaagaaaccactcaaatacataaaaacatttagaaaaaggaatactaaataatagttgttatctttgtagtcaagttcttagaagtataatatagatcaagaatcttgaaggtggaaagtaattggagtggaaagagagacagtcactgtatttcatttatttcatctgataatgaagatatcgactggactatatgtgagcagcataagcactagggcaaagacttgttaactcttaaatcccagtacttagcatacatatctcctcttgggtatgtaatagtttattacgtgttgaataaatgaatcactattatttatatagctctttatagttctcaaagcatggtgatataaatctttatttgctcatttctacaaccatataacattgtaccttattacactgagtgctggctctgtgccaagcattgagttaggtgggatatcgtcattatatctacctgatgaagtgccagtttttgaaataacactgaagcctaaaaagcagtaaatagcttaaccaaagccacacagctagtaatagacagagacaggagtccagaccaaatctgtctgactacacagtacaattcttaaactaaaccatactgtgtttctccttacatgaaaaacagggtgttagaagacattagctgtgatcacatagtaaagaatagatcaagtaccaaattgaactcaaggagaaaatagtgagggcttgtagaattaaaatatatgataataataaagtgatctatgatactattgttatccaagaggagaataaaggtattagttgatattggacttgaattatccagtaataggaaaagaaactataacatccaaactaaagagtatgggctaataaaaaataatggacccaaagtaggcaaaacagagagaaaaagaaacattatacatgtgaatgtgctgtgaacaaatagaaataacacatataaaatgataaatttaggtatgtgttcataatgacattaaattttagtggactaaattcactgtatgcttgctttacatgtgtattatagtttaattacatgtatattttatatatatagtgttttcctgtaaaagtcttaaaatgttctgtgacttaaaatgttagcatcagtgcttgaaatgtctttgtacaagaagagttttctattaatgttcccagtttaagaatctaatcaacatctttgcctcctgtttccctctaaaaaaaagcagtgtgatagactatagtgaatgatgtctagtttgttttttaaaaaatatatacaatatatttaaaagagaaaatctgaaacatgaagaagatgaattccatattctaccaaagttattctgattgagcattaaatttagccatttttccatagacaaatcaaaaggtatgaatagatatttcttagtccaggagtgtatgttttggctgtgtttgtgaaatgtgacaattttaactattttgaagagaagaattttcagagataaaagtaataacctttatctgatggtcaatattaagtcatattactaattttagaacttcctttccttgtaggctctgaatggctttgtattagttgtcactacagatgctttggtcttttatgcttcttctactatacaagattatctagggtttcagcaggtaagtatatattatttatatcatttatattattatatcatttactttttatatatatttaggacacagttggccatttgtatgtataaagtatcaatatatgctgtagaatacagtatgtatttgtagctaataattttttctaatattaataatttactgcactataattcctttaaacctttatgtgattcatggttactgtgtttcttctttcgcttatcaagaatcttatatataagaaactttcaggcacgtagggtctaggggagaagatacaaaattatttgctatcaaataacttatggatagcagaggatatatgacaactatgaaatgaatgagatgctgttaaaaagtacaagtaaaatcctatgatttatacctttaattctgatttatttggattatggaagttaccctaaatcaaatggtatgtaagctgacctaaataatgtgtaacaggtgggtggtcaagaaaacataggaatattgaagtactgtaagcattagactggaagtcattgaaggaaacagacgtgtctgacttgtttgatgttattgaatgaacagtgaatagatggaattataaatatttgatatattggaagggcaagaacatcttttatggtttgagaacagattgtaacatttgaatgcttgctattctcatatatctggttctcaaattgtactgtgcacaagaatcacctgaagaccttgataaaacttggtcatccctgtgagccccattgtcagatattctgaatcagtagttcacagtggggcccatgaatttgcatttctattaagctcacaaggctgctggtcttaataacagttatatagactagagcttcaactatattatatacccagtggaaaccactgaagggttttgttacagggggtgtgtatatttcaacttgtgtttcagatgcaacttttggaaattgtgtaatggttggcatcaagatgatttaatactagaagattaggttcctaggaagatttaagtgtagatgactaaagtagtggtatctagctactactgctaccacaaagtctaaactcctgatttcttgcattctaaagaaaatacattaatgtccatagaaaagcctgtttgaagcctaatgtattatataactgtcttaatcaggatttgatattgtgatttatattagtaagaaaatcagagagattagccattttccaatccatttttttctcgcatatacacatggatttttttcctaaaagaatattcatatctgacgcaagtggtagattaagacaccatttttaaaactgcaagttatgactcgctcatgggtatgcagtcgagacagtggatcactatcaaactgttttttagttgtttaggatagaataaaataatatagaatacacagtgttatctcatgtaataatggtaagtgttttgtgaaacttttccatgtgtttatgtctgtgcacacacctgtgacagatggaaatgtattttttatcataacttgcagttaaaaaaaaaggaaaactctggtttaagcactaaggactcagcaccgtagtaaatggtgagaggcaagagaaggaaagtgggtttaatatggtaaaggcacaatcccttgctcttgtggagtctacttggagtgaaaattttatatgaagaaaattttagagaacagtgaaggaaatacataaagaataccattaagcttagagaagtcaaagaggcctggggtggttaggaaaagctgcatggaagagataagaatctaaaaactaacaaatgaatatggaacataaacagattttaatatgttgcatttaaggaatggggatgtgacttatttgagcaagagcattcatgttgggaactgatgacaagtaacttttggcttatctgttgtagtgccagtctctttagctttttctaccttaggttctatcttaggtgactagggaattttaggaatcattcaattcgtattcatcaccactagcaagcacccactaatctaaataggctttaaaattaatttagccatattttttaatcagtccttttgttgtattccttgtatcttttttctttagtctgatgtcatacatcagagtgtatatgaacttatccataccgaagaccgagctgaatttcagcgtcagctacactgggcattaaatccttctcagtgtacagagtctggacaaggaattgaaggtaagaattgatggtacaaaaaatagtgttggtagtttttaaatatgagtctgtgaaaggaggctgggaacctgtagggtcatagaactccatgatagggaagtagtggaaagatgtaaagtctgcaatcataggccacagctaggtcacaaagagcctgatgagctaaggaatattttggcaaatgagagccatttaatgagtttcaggcaacagagtattgccatagtcagtaatgtattttataaaaataagtagtaccttcatgaaagatggaaggaaggtacaaggttgatacctgagtgcatgtaaattattgtgtttaaaatgcaccaaagaaaaaagtaagctagcatatgcaagtataaaaatgcttttctcaatgcaaaaaatgtttttggaaatttgttaaagtgttaagaaaacaaaaatgcattagaaaatatgaaaattgttgacagtgatagctcaataaaaatttaaaaaattatgcaagttctatctgataaaagtgatatttaataaacttttagtttcttgtcattagctcttttgaaaatgatttttttgtattcagaacacagactccagtttagaaactaatacaaattttacctattcaagtgcttaattttacagcaaaatggaaagtaaattttgttttgcctttatttctacagaagccactggtctcccccagacagtagtctgttataacccagaccagattcctccagaaaactctcctttaatggagaggtgcttcatatgtcgtctaaggtgtctgctggataattcatctggttttctggtaaggtacaaaattttatgatactggcttttactattgttacaataaaagcttgaggcaaatttaatttagcaaaatataattcagcagagaactattcccaaatcaggcaaccctcagaaccagagagcttcagagagctcacttaaaaacatgggctggagcatttatgaacagaaaatgcaagtgaggtacagaaatggcttgattgattacagcttgggatttgccttatttgaagatgatctgattagttggccacctgtgactgactgagactcagctatttggttacaaaagtttaattctactgttaggctttccgttagcttatatagtaaatgaagttgcaattccttggtaaggacttaaggagcagaggcatcttcagcccaaatttagtttaacattaagttatagaaaaaacaagccaattttctttggttatctttgatttcagctttaaaaatctgctaccaaataatttgataaaggaaagtaacattttaaagtaattatttctgattttgactatcttctataactcagaaaactgttctttaggatatagtaacaaaaattgagtgaaataacacgaagccttgtattttgactattttaggatttttaaggtatgagagaattatgtagcccttttttaataggaggatgcttaccatcttgggattgaatgcctgctagacagagaaattatggcctttccatatgtctcaaataactgccacatagaaaaacgattgtatattcatgattgtggaatcatcatttgataggagatgctgttttcttgttacaaagtctgaacacctgcataggagttgactgtagggaacagcttaggattcctcagagtggacttgtctgttatctcattgtatccttagctcatgttaccaagtacaggagaagaaaatacaaagtatattgtatattctttttgtgaataacaaggaatttgaaacagataatcaaatcttaaattaacattaccaagcaatgatttttgtttatgtgtttatttctgaagaggattttgctgacccagaattagaattatgctttgagacagttttcccagtgttattgctcatgaacaattagtatgtagagtcatgtcctgcataatgatgctttggtcaataacagaccatgtatatgatggtagtcccatgagatcataatggagccgaaaaatccctatcacttaatgatgtcatagcattgctcacatgttgatggtgatgctgatggaagcaaacctgtgttgccagtcatataaaaagtatagcacatacaattatatatgatacataatacttgaaaataaaacaataataaatcactatgtatttactattaatcattattttactttatttttaaatgtattatacttttaattattttattttaatcattattttagaataaggttaactgtaaaacaggctcaggcaggtccttcaggaaatattccaaaagaaggcattgttatcacaggagatgacagctccatgcatgttattgcccccgcagaccttccagtgggacaagatgtagaggtggaagataggatcattaatgatcctcaccctgtacagacctaagctaatgtgtgggtttgtgtcttagtttttaacaaaaaaagtttaaaaagtaaaaaaattaaaaattaaaaaatagaagaaagcttatagaataaggatataaagaaagaaaatgtttttgtatggctgtacactgtgtttaagtgttattacagaagagtcaaaagttaaaaatgcaaaagtttatgaagtaaaaatgttacagtaaactgtgctgggattacaggcataagccactgcacctggccaaaaggaaaatattttttataaattcagcgtagcctaagtgtatagtgtttataaactctatagtagtgtacggtaatgtctcaggccttcacattcactcaccactcactcactgactaaaccaaagcaactttcagtcctgcctaccttgtttacaataagtgctcttatacaggtataccattttttgtcttttatactgtatttttactgtatattttctatgtttagatacacaaatacttaccatcatgttacaattgctttaagtattcagtacgatagcatgctgtacaggtttgtagcctaggaacaaaaggctatactgtatagcttagatgcgtagtaagctataccatctaggtttgtgaacctaccctctgatgttcacaggataatgaaattgcctaaggacacatttcacagaacatgccccttttgttaaatgacatgtgagtgtatgtctgaggtggaatatctgtgtgcaggagggccttttcctccttgtgctgctattattttgatgtcagaaccatcccttggactggttgatattgttttaagcaattaaatatatcatgttcatgtttaagtgcctttgttttccctgtcttctaaatttcttccatatctttactcagtagggctctgcattctttatatgttttcatgatgattcattttagtgtcttaataaaattatattttgcctctatagaaaagattatgaactatgcagtatgctatgagctgtgatatagttcatgtatgcttgaaaatgaatgtttactttaggactttatcaccattcaggatatattgattgcctggtgtgcaaggagctgtgtgaggtgaaaatgatagggtaatggcaagcttggaaaatgatataggttttcatgttatgaccattaggaacaaggagtggttcacttatccctttagaatatttttcatattactctttgagatagatttaatgggcgtcccatggagagaggagtgaaggaaactaacagttctcagcttcaggaatatttatggaattatcaagaaccctagaggcagccataatggagccttttaaaaaggcactattttatattgttaattttaatgaacttttttgttgttgttgcttttttaaggcaatgaatttccaagggaagttaaagtatcttcatggacagaaaaagaaagggaaagatggatcaatacttccacctcagttggctttgtttgcgatagctactccacttcagccaccatccatacttgaaatccggaccaaaaattttatctttagaaccaaacacaaactagacttcacacctattggttgtgatgccaagtaagtgagactttttcacttttattttattggatgtacattatgtttcagtaagtctctcttagcatgtaaaacatacagtgtatgtaatattgtttattattagattggctattatcgtacattcttccagtgtagccttttacagtaaaataatttaatcaggctcacaaatcatctttttaatttttgcaatacttgtctcaaatgatgatgttcttatatattagtaaggtttattcttctgatgacatttatgttggtttgttttacatttttaaatggcacaaatgttatttgatttctagccccagaagttttagtaactttcagaaaattgtgagcaggagtctgatattaaacatttatatcatatcaaacatatcagtgcttttctcctttctaatgtgggaatgcagagaggtaattagaaaaaccttcttccctaaaaatagattataaaaacattccagatttttattaaagatgttctgttacccatacatctgctctattagattcatttttagcatactaatttccatggatttattcaggaaaagaaaataggctgaaactgaaatttgcaatcataagcaaagaagatcagtttacatggatgtgtttaatttcacatctacttatgtgaaattctaaatgtgaactaaaacatattgcagaaactagcgtaaaaccaatgaatttatcttggttatttcatttatgttaaatcttaatccattcttattttacctttttttattttaaacagaggaagaattgttttaggatatactgaagcagagctgtgcacgagaggctcaggttatcagtttattcatgcagctgatatgctttattgtgccgagtcccatatccgaagtaagttgtagttccttatgaacatgtcagaagaaaacggcatatactgttgtacatgtttcaaattcttacgtaatgtaaagtgtttaagtaaagtatatggataaacttctacttagtaacatatcattatgattaaccagggttacactctttgttcattaacttgtctacacctgccatgtagaaatattgttgtttagttattaaaaaatgaccattttggcccatgaagttttgcttgggaattttttaattacatcgttatcaattcataaatctatgttaatattgtaacaataatagtgttaataattctagtttaaaattataaagtattaggctgtaggaaaatattccctatttaaaatgaaaataattttttccccaacttatgttctctctatactttcctgtgttactagaattgtttggtacataatcttccctttaacatttaaaataataaatttaaaacaactctgaaaaactatttccatgccttttattattttttgtttaaaatttattgtctttggggataaaggaaatacatccagaactatgtcacaagagctttgttttaggaataatctttactatattgatttgggggtttgataatttaattttttaattttattttagtgattaagactggagaaagtggcatgatagttttccggcttcttacaaaaaacaaccgatggacttgggtccagtctaatgcacgcctgctttataaaaatggaagaccagattatatcattgtaactcagagaccactaacgtaagcacaaataatgtttcctgttttaacagttttgttttcataagtcctcttatgtgaaagcataaaaataattcaagcagactttagtctgtaaataaaaattgaaaagtttaattcatctagaaagaagagcacaggtgagagacattgagaagatagaattgacgaacttgattgagagctacatgtgcagagctatagaaagaataataaaactctagggttttatcttgggcatatgaaagacacatgaaaagctagtgtcattggtaaaaaagaagaaaaatataacaatgctttatttagaatatattctctaaacccagcagtgattttaagagtttcttacacatgctgcagatgagtcctttatcaaatatttgtattgcaaatgtttcctcccactctggagaattgatttttgtctgtagcttgaggtaaggattgattccccccagccattatacgtatacccaattgaccagtaacattgaaaagatgatttaccgagaaggtcattgtttcccggctgcgctgtattttgatcaggggattttgtctgtggttctctgtctggattgtgttgttctattaatagctccattagtgcagttgtctattttgtctagcattacactgtcttagttattctatctttattatatatttctatgtcagagtgtgtcattttgtttgttttgccttttttgttctccttcaagattgccttggttcttctttgccctctataattccatatacattttagaaagcagttgtctgaaaatctgttgagattttgagtgcaattaccttgaaactgtagatcatttggggagaattaacatctttttaatactgaatctttgagcccatgaacatgatgaatgtatgtatgtgtataagtacccatggaagtacatgagtatgtgtgtaccatatgtatatgagtgcatgggtatgtgtgtacctctacaaatttgtcacttctcccttgatcaatgtttctagaaggcactttttttaattagattttattagtctttattaggatccaacttttggtttattgatttttttctattttatacatttgttttcaattttaattatgtctgctcattattattttcttccttctactttctttgggtataatttatcattttttgcaacttttaaaaaatatatacttaaacatatatatcagtttccctttaagtacagcattacaaccctcatcttttgctatcttatttttattatttaattgaaaatactggctaatttgtttttatttttattcatgaattatttagaaatacagtgttactgtactttttggtgtttggggatttttctagttgcctttttatgattgacttttagcttaattccattgtagtcagaaaatattctctggatggatttcagtttttttgaaatttgtggtgacttattttatgatctaatacatggtctatgttggtaaaatatcccatgtaatcctatgaagaatacatgttctgtagtttgggagtatcttatttttatatatcagaagtctagtttgttaattgtgttcatatttgtatacatttgttgatattttatgtgcttctgttagttactaagacattttgttttcatttattactgaaggggggcatctttttacatctttctgttttttttttttttttgagatggagtctcgctctgtcgcccaggctggagtgcagtggcgggatctcggctcactgcaagctccgccacccgggttcacgccattctcctgcctcagcctcccaagtagctgggactacaggcgcccgccactacgcccggctaatttttttgtatttttagtagagatggggtttcaccgttttagccaggatggtctcaatctcctgacctcgtgatccgcccgcctcagcctcccaaagtgctgggattacaggcgtgagccaccgcgcccggccctttttacgtttttctatgacatttttcttttataaattacatttgtatcatttacctgtttttctgttgagttgtttgcctctctctcagactctattggagctctttattatggatatgaaattttataagtatattaaattataaatacattatgttacaaatattttctttaaaaattctattgcccgaggcgggcggatcacgaggtcaggagatcgagaccatcctggctaacacggtgaaaccccgtctctactaaaaatacaaaaaattagccgggcgttgtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaatctattgcaaaaatacaaatactttaatattaagtaattttcatattattatgccaatctgtctttatagctgctgggttttattatagaggttagttgtttcagattcttaactttctaattcctaatttttttatttttttattattattatttttgagacaggatcttactctgtcacctatgctggaatgcagtggcacaaatgtggctcactgaagccttaacctccaggctcaggcagtcctcctgcctcagactccagagtagctgaagactgtaggcatgtgccaccatgcccagctagtttttatttttttgtagaggtgagggtcttgccatgttgcccaggtttgtctcaaaatcctgggctcaagcaattcacacacatcagcctcccaaagtgctgcaattacaggcatgcaccaccatgcctggcccctaaattctcgtagtctgtttttatgtgtagatatttattccacacaaatttattatttttttctttttttgcagggtgtcaggtagggatgtaacctgaccatggaattaactaagttattttttaaaaattaaatcatttaaatatgcttgtctgaaaaacaattttatagcaccagtcatgagaataattgaggtgaaaataaaatatgtccctttctgaattcaattacaatgtattttgctttatgtttttcttttttaaattatttttattttaaaatgtttgatagaatttttttctaagacttttttgtacacaattttagagatgaggaaggaacagagcatttacgaaaacgaaatacgaagttgccttttatgtttaccactggagaagctgtgttgtatgaggcaaccaacccttttcctgccataatggatcccttaccactaaggactaaaaatggcactagtggaaaagactctgctaccacatccactctaagcaaggactctctcaatcctagttccctcctggctgccatgatgcaacaagatgagtctatttatctctatcctgcttcaagtacttcaagtactgcaccttttgaaaacaactttttcaacgaatctatgaatgaatgcagaaattggcaagataatactgcaccgatgggaaatgatactatcctgaaacatgagcaaattgaccagcctcaggatgtgaactcatttgctggaggtcacccagggctctttcaagatagtaaaaacagtgacttgtacagcataatgaaaaacctaggcattgattttgaagacatcagacacatgcagaatgaaaaatttttcagaaatgatttttctggtgaggttgacttcagagacattgacttaacggatgaaatcctgacgtatgtccaagattctttaagtaagtctcccttcataccttcagattatcaacagcaacagtccttggctctgaactcaagctgtatggtacaggaacacctacatctagaacagcaacagcaacatcaccaaaagcaagtagtagtggagccacagcaacagctgtgtcagaagatgaagcacatgcaagttaatggcatgtttgaaaattggaactctaaccaattcgtgcctttcaattgtccacagcaagacccacaacaatataatgtctttacagacttacatgggatcagtcaagagttcccctacaaatctgaaatggattctatgccttatacacagaactttatttcctgtaatcagcctgtattaccacaacattccaaatgtacagagctggactaccctatggggagttttgaaccatccccataccccactacttctagtttagaagattttgtcacttgtttacaacttcctgaaaaccaaaagcatggattaaatccacagtcagccataataactcctcagacatgttatgctggggccgtgtcgatgtatcagtgccagccagaacctcagcacacccacgtgggtcagatgcagtacaatccagtactgccaggccaacaggcatttttaaacaaggtaagggtgttatcaaactgaattaaatctttcagtgattctttttaccttatagacatgttacacattttttatgtcagctgattttaatcggttatctacagcattcatggagacagcattttttattatatctgtgactaccttttttttttttacaagcctgtactttttccagtatgttactaatatatcattcacctgattcatgagggagaaagatatcaaggaatgaagcaacatgaatgtgtccttaatataagatgacctaaattaccaggtgaaattagtttttagaagtattttgtttaaaatagataatttggtttattctttctggattctttaaaaattatatggctatttaaaaattcaagctttaaaaaacgtattgcaatttttaagaataatttcttcaaagctctatttttttatatatgtttgaaattgagttaaactcaaatttaagtgtgctttcttacaatgcctctgaaaccctagattaattatatccctggaattcagtcctaggcacctccatgttctctagctattcctccacattacctcccctatcctcatctcatcctttaaggtagaatggctttcttttctggctttcttaaaagaggtaactcagctggctttctgtcatggaaatcaagcttgatagtgcatttttgttgtttaaatgtgtcatcagaatccgtctggcagtgagcacactttaaatctaaaaatgatcacttaaaaaaaaaaagttaacataatgtcagtaactgctgtctctggccactcaggaatacatcatgtttgcatttatgctttttccattagaaaatatttagttcattttaaagtatatttaagtttagttttaaagaatatcttgactaaaattaagctccttgacccctgtttactctgtattagagtataataattaaaagtatgacctgaagctttatctttaattgtattttctggctttttcatacattttgcttgtctaatcgtatatgagctttttaatagaaaaggacagtgaaaatttttcttattccttacatccttcaattatattaaaattgaataatattcagttatagtccgtctcacaaaattgctatgaaagtatattttactcttgagtaaagcaaattgtacagaagttaattctgtaaaattacattttgaataaggagttgcatgagtaccacataagttctttgcagtgttttcccctcactacttttcactgcttctttgtaaataaccaaataattctatagacctacatatgttccagagtacatgttattgagctaagacactcaatattgagccactgagtagctgttcagcacttgaaatgtggctagtccaaattgagatgtgctgtgtgaagtacacattggatttttggattttgaagacttggcttgaaaaaagaatgtaaaatatctcatcttttattattgatttcatgttgaaatgattagttttttcagtagccgcattacaaaagtaaaaagaaacaggtaaaattaactttagaaatgtattttatttaatctactgtagccaaaaatttaagttctgtatgtggctcacattatatttctattggattacactgctgtgtacagtatgtttaaagagaatggtgacatgaattgtgttatgagtaatgagaaaaaatcattttaaactcaccattatctggccaggtaatactaactttttatttaaagaatttacagtgttgccattcattgaagatacaggttatatgatttttactatagattttatatatgttttggaggatctgtgaagtaattaacattttgattactgaagccagttatgtaggctttacaaaggtagattttatttgaagcaattaaggatatgattttaatctgttttaaagtttccagaacgtccactaactaaaatataaaggctctgtaatctataaaactctacagagctatacatcttcatgtccttcctttttatttttcttttttctactagcagttatagaaaccagattcattgcagtgtaagaaaacaagacagagcattttcttttggtaacttgattctgtaattagaactatgctttcagtagtattcattaattaaaagtatattatgaataagaaatcggttaagaaaatcatacctgtggtgtaatattttaggaatatttagaaacatttagaaaatcagaagctgccttttttggaaaagttttgcattccagtgtaagattcctgaatataatcaattcattgatacctataacttcaaacctggtcaaagcaaacctacttatgatagagaatatttaactgtaatttgtgacttgtgctgtttgacccatcaattcctacctgacccaaaggcaatctgaaatgagacagctgcatcactcatctgtaccatgttcaaaatttcctgtcaaattaatggaaaaacaggttataaatgcaactaatacataatatgtcctcagtatgtcttcactgtgtgaaagatttaaaatttagcaacagtaaaggaacttgaagtttacaactctcaggggtaagattttaaaaatacatgttaatgttatttactggcttaagatacttggaagatctattccaataagttgcatcaccatttttgttttcagtttcagaatggagttttaaatgaaacatatccagctgaattaaataacataaataacactcagactaccacacatcttcagccacttcatcatccgtcagaagccagaccttttcctgatttgacatccagtggattcctgtaattccaagcccaattttgaccctggtttttggattaaattagtttgtgaaggattatggaaaaataaaactgtcactgttggacgtcagcaagttcacatggaggcattgatgcatgctattcacaattattccaaaccaaattttaatttttgcttttagaaaagggagtttaaaaatggtatcaaaattacatatactacagtcaagatagaaagggtgctgccacggagtggtgaggtaccgtctacatttcacattattctgggcaccacaaaatatacaaaactttatcagggaaactaagattcttttaaattagaaaatattctctatttgaattatttctgtcacagtaaaaataaaatactttgagttttgagctactggattcttattagttccccaaatacaaagttagagaactaaactagtttttcctatcatgttaacctctgcttttatctcagatgttaaaataaatggtttggtgctttttataaaaagataatctcagtgctttcctccttcactgtttcatctaagtgcctcacatttttttctacctataacactctaggatgtatattttatataaagtattctttttcttttttaaattaatatctttctgcacacaaatattatttgtgtttcctaaatccaaccattttcattaattcaggcatattttaactccactgcttacctactttcttcaggtaaagggcaaataatgatcgaaaaaataattatttattacataatttagttgtttctagactataaatgttgctatgtgccttatgttgaaaaaatttaaaagtaaaatgtctttccaaattatttcttaattattataaaaatattaagacaatagcacttaaattcctcaacagtgttttcagaagaaataaatataccactctttacctttattgatatctccatgatgatagttgaatgttgcaatgtgaaaaatctgctgttaactgcaaccttgtttattaaattgcaagaagctttatttctagctttttaattaagcaaagcacccatttcaatgtgtataaattgtctttaaaaactgttttagacctataatccttgataatatattgtgttgactttataaatttcgcttcttagaacagtggaaactatgtgtttttctcatatttgaggagtgttaagattgcagatagcaaggtttggtgcaaagtattgtaatgagtgaattgaatggtgcattgtatagatataatgaacaaaattatttgtaagatatttgcagtttttcattttaaaaagtccataccttatatatgcacttaatttgttggggctttacatactttatcaatgtgtctttctaagaaatcaagtaatgaatccaactgcttaaagttggtattaataaaaagacaaccacatagttcgtttaccttcaaactttaggtttttttaatgatatactgatcttcattaccaataggcaaattaatcaccctaccaactttactgtcctaacatggtttaaaagaaaaaatgacaccatcttttattcttttttttttttttttttgagagagagtcttactctgccgcccaaactggagtgcagtggcacaatcttggctcactgcaacctctacctcctgggttcaagtgattctcttgcctcagcctcccgagttgctgggattacaggcatgtgccaccatgcccagctaatttttgtatttttagtagaaacgggtttcaccatgttggccagactggtctcaaactcctgacctcaggtgagcctcccaccttggcctcccaaagtgctgggattacaggcgtgagccactgcattcagctcttcttttctttagatatgagagctgaagagcttagacacattttgcatgtattatttgaaaatctgatggaatcccaaactgagatgtattaaaatacaatttttggccgggtgcagtggctcacgcctgtaatcccagcacttggggagggcgaggagggtggatcacgaggtcaagagatggagaccatcctgaccaacatggtgaaaccctgtctctactaaaaatacagaaattagctgggcatggtggcgtgagcctgtagtcctagctactcaggaggctgaggcaggagaatagcctgaacctgggaatcggaggttgcagagccaagatcgccccactgcactccagcctggcaatagaccgagactccgtctccaaaaaaaaaaaaaatacaatttttatttcttttactttttttagtaagttaatgtatataaaaatggcttcggacaaaatatctctgagttctgtgtattttcagtcaaaactttaaacctgtagaatcaatttaagtgttggaaaaaatttgtctgaaacatttcataatttgtttccagcatgaggtatctaaggatttagaccagaggtctagattaatactctatttttacatttaaaccttttattataagtcttacataaaccatttttgttactctcttccacatgttactggataaattgtttagtggaaaataggctttttaatcatgaatatgatgacaatcagttatacagttataaaattaaaagtttgaaaagcaatattgtatatttttatctatataaaataactaaaatgtatctaagaataataaaatcacgttaaaccaaatacacgtttgtctgtattgttaagtgccaaacaaaggatacttagtgcactgctacattgtgggatttatttctagatgatgtgcacatctaaggatatggatgtgtctaatttagtcttttcctgtaccaggtttttcttacaatacctgaagacttaccagtattctagtgtattatgaagctttcaacattactatgcacaaactagtgtttttcgatgttactaaattttaggtaaatgctttcatggcttttttcttcaaaatgttactgcttacatatatcatgcatagatttttgcttaaagtatgatttataatatcctcattatcaaagttgtatacaataatatataataaaataacaaatatgaataatatgttttaatgtaaattctttctggtccacgtaaaggaaattatttattctgtagtattataactatgttagatgagggcaatctacaatacttagggatatgttaagtcagtaattcataaacttcttatacaattttgccccccaatgtctgacctttatctggatataaaaaacactctcagtagcttcataaattaaaatgcttctgaaatgaacttttttaaagccctgtgttatcagtgtagtagtgtgtcttagattaaaatccaaaatcctattttaatattttaagaatatttctgaagaaattcgaaataacccttgttagctgtattttgtgcttagtttagaaaaaccattgcccaaacttagtatttctgtttaataagtataaatgatacagaagcctttggccttaaattcataactgttgaacattcatggaaaaccctgcaattagaattgattgaagaagaattcctgagaaaatgttttcattcttgtgacagttatttttctattagttttatatttgttctttacaattaggcatttttctcaactagcatatcataagttagcatcatacttaattctgaacattttagactaatcctgagtctttaagaattacataaaatatttagttttaactatttgatctgaaaaaaatcaagtaaaaatcctgataacctgagtgcatctctgcttgcgcttaggtgatttctgtcaccatgaatgactctagcttgtccaatttcaccagctctaccaaacaccgacccagggatgttggccactgacagggctggatgacatctctcatttctttcactgtctgcagatgaccttgcttccgtttttactaataaaatcaaggatatcatcctaagtttgtaccttcacctcagcaattcctctatccttggacttacctccagtatgtgaggaggagagtttcctgaactccagggttagcccccgtcctctctcgttctcatgcacacagcttcgacacctgctttctgagaggctctccttctctgtaggatttcctgtgaataggtcctcctccatcctggaaaaaaattacttgaacctgcactttcttctctattaaattacttctttaccttcttcctttgtaacaacagttttgatctcctgagatctggttttgttttccatccttccattatattgcagtgttgcggttcactaaacttcttaccataggctcattttctatggccctgcaaccaaactgattacactttcaatgaacttttttcttcccttccatgacattagttgtcctgtaagctcctattatcccttttctttcctttgttaaccactctttcctcctcccacctggcagcaggcttagttttgaccatttgtggctctttctgtacatactgtctaagaagaagtgattcaatgccttacctctgattgacatttgtgaagcaattctttccctgagagagcagcatagcatagccaaactaaacacacagactctggagtcagactactaggtataaatcctggctttgccacaaataagatgtcattgagaaggtttcttactttctcttagcctaagatgccttttctgtaaactaaggctaacagtacctgcctcactggattgctggaggattcagtgatttatataaaatcacttagctgccagtagccaaaactggaataatttgagcaactaaataagtgatgatagcattagattacagcacaaagaataaagtaaatatccatgaatccatactaatataaataaaatggttgaaaaataaatgggggagaaggagcacatctttcctatagaagaatcccaaataatattggtagctactatgccctctgatgcatgagcttagttctcctcccctggaaggatgagttagacttaatgacttgctttcaaggaatagagtacagacagagaagaaaataactttacattgttgaaatctggcaagcactactttaaccaagtaatcaaggttaacatcaccagtgaaaagtcatgttgatataacatgtattatctgatatgatactttgagaagtgtacatctcaaagctccctgattttcttaaaaacacatagtctaattatgacaaaacatcaaacgcaaattcagggacattccacaaaatttctgagaggattttttaaagtgtcactgtcacagaaagagactgaataattatcacagagcagaggaggctaaggaggcatgatgactgaacttaatgtgatatctccgattgcatccttcatagaaaaagggcattactgagaatctgcagaactctaagtctagttaatagtaccacatcattgttaattttttggttttgaccaatgtaccatggctatactacgttagaggtacctggctgaagagagtaaaggaactctatatccttttgacttttctgtaaatctaaaattattccacagtagattttactttttaataaaagtacagtttttattgccacatagcaagtatctttatgtctctcattactattttcctgtatcttcacaacctcctcttagttggaggtaaagctatacattgacatcagtccccattaactactgatttgacgaatatctttttttttttaatttaagttctggggtacatgtacagaatgtgcaggtttgttacataggtatacacgtgccatggtggtgtgctgcgcccatcaacccgtgatctacattagatatttctcctaatggtatccctcccctagccccccactggtgtgtgatgttcccctccctgtgtccatgtgttctcattgttcaactcccacttatgagtgagaacatgcggtgtttagttttctgttcttgtgttagtctgctgagaatgatggtttccagcttcatccatgtccctgcaaaggacaggaactcatccttttttatggctgcatagtattccatgctgccagttttcccaacaccatttattaagtagggaatcctttccccattgcttatttttgtcaggtttgtcaaagattggatggttgtagatgtgtggtgttacttctgaggcctctgttctgttccattggtgtatatatctgttttggtaccagtaccatgctgttttggtgactgtagccttgtagtataccacattctctttatccagtctgtcattgatgggcatttgggttggttccaagtctttgctattgtgaacagtgctgcagtaaacatacgtgttcatatgtctttatagtagaatgatttataatcctttgggtatataccctggaatgggattgctgggtcaaatggtatttctagttctagatcctcgaggaatcaccacgctgtcttccacaatggttgaactaatttactctcccaccaacagtgtaaaagcattctgatttctccatatcctctccagcatctgttgcttcctgactttttaatgattgccattctaactggcatgagatggtatctcattgtggttttgatttgcatttctctaatgaccagtgatgatgagctttttttcatatgtttgttggcagcataaatgtcttcttttcagaagtgtctgttcatatccttctcccactttttgatggggttgtttgttttttttttcttatacatttgtttaagttctttgtagattctggatattagccctttgtcaaatgtataggttgcaaaaattttctcccattctgtaggctgcctgttcacgctgatgatagtttcttttgctgcgtagacgctctttagtttaattagatcccatttgtcaattttggcttttgttaccattgcttttggtgttttagtcatgaaatctttgcccatgcctatgttctgaatggtattgcctaggttttcttctagggtttttatggttttaggtcttacatttaagtctttaatccatcttgagttaatttttaaataaggtataaggaaggggtccactttcagttttctgtaccattggtgtatatatctgttttggtaccagtaccatgctgttttagttactgtagccttgtagtatggtttgaagccaggtagcatgatgcctccagctttgttctttttgcttaggactgtcttggctatgcgggctcttttttggttccatacgaaatttaaagtagttttttctaattctgtaaagaaaatcactggtagcttgatggggatagcagtgaatctataaattactttcagcagtatggccattttcacaatctttactcttcctatccatgagcatggaatgtttttccatttgtttgtgtcctctcatttccttgtgcagtggtttgcagttctccttgaaaaggtccttcacatcgcttgtaagttgtattcctaggtattttattctctttgaagcagttgtgaatgggagttcactcatgatttcactctctattattggtgtgtaggaatgcttgtgatttttgcacattgattttgtatcctgagactctgctgaagttgcttatcagcttaaggagattttgggtgagatgatggggttttctaaatatatgatcatgttatctgcaaacagagacagttttacttcctcttttcctatttgaacacactttatttatttatcttgcctgattgccctggccagaacttccaatactatgttgaataggagtggtgagagagggcatctttgtctcggcctgaaattttctttttttgttgtgtctcagccagcttttgatatcaggatgatgctggcctcataaaatgagttagggaggagtctctctttttctattgcttggaatcgtttcaaaaggaatggtaccagctcctctttgtacctctggtagaattcagctgtgaatctgtctggtcctggactttttttggttggtaggctattaattactgcctcaatttcagaacttgttattgttctattcagggattcaacttattactggtttagtcatgggagggtgtatgtgtccaggaatttatccatttcttctagattttctgttttatttgtgtagaggtgtttataatattctctgatggtagtttgtatttctgtgggatcagtggtgatatcccctttatcattttttattgcgtctatttgattcttttctcttttcttctgtattagtctggctagcggtctattttgttgatcttttcagaaaaccagctcctggcttcattgatttttagaaaggttttttgtgtctctatctctttcagttccgctctgatcttagttatttcttgtcttctgctggcttttgaatttatttgctcttgcttctctagttcttttaattgtgatgttagggtgtcaattttagatcttttctgctttctcttgtgggagcttagtgctataaatttccctctacacactgctttagctgtgtcccagatattctggtacgttgtgtctttgttctcattggtttcaaagaacatctttatttctgccttcattttgttatttacccagtagtcattcaagagcaggttgttcagtttccatgtagttgtgctgtttttagtgagtttcttaatcctgagttctaatttgattgcactgtggtctgaaagactgtttgttatgatttccgttcttttgcatttgctgaggagtgttttacttccaattatgtggtcaattttagaataagtgtgatgtagtgctgagaagaatgtatactctgttgatttggggtggagagtttgtcttgcagatgtctattaggttcgcttggtctagagctgagttcaagtcctgaatatccttgttaattttctgtcttgtttatctgtctaatattgacactggggtgttaaagtctcccagtattattgtgtgggaatctaagtctctttgtaggtctcttgctttattaatctgggtgctcctgtattgggcgcatatatatttaggatagttagctcttcttgttgcattgatccctttaccattatgtaaatgcccttgtctcttttgatcactggtggtttaaagtctgttttatcagactaggattgcaactcctgctttttttgctttccatttgcttggtaaatattactccatccctttattttgagcctatgtgtgtctttacatgtgagatggatctcctgaatatagcacacggatgggtcttgactctttatccaatttgctagcctacgtcttttaattggggcatttagcccatttacatttaaggttaatattgttatgtgtgaatttgatcctgtcattatgctgctagctggttattttgcccattacttgatgcagtttcttcacagtgtcaatggtctttacaatttggtacatttttgcagtggctggtaccagctgttcctttccatttttagtgcttccttcaggacttcttgtaaggcaggcctggtggtgacaaaatcagcatttccttgtttgtaaaggattttatttctccttcatttatgaagcttagtttggctggatatgaaattctgtgttgaaaattattttctttaagaatgttgagtattggcccccactatcttctggcttgtaggatttctgctgagagatccgctgttagtctgatgagcttccctttgtgggtatcccagcctttctctctggctgcccttaacaatttctccttcatttcaatcttgatgaatctgatgattatgtgtcttggggttgctcttcttggggagtatcttcatggtgttctctgtatttcctgaatttgaatgttggcctgtcttgctagtttggggaagttctcctggataatatactgaagagtggtttccaacttggttccattctccatgtcactttcaggtacaccaatcaaatgtagatttggtcttttcatatagtcccatatttcttggaggctttgttgattccttttcattcttttttctctaatcctgtcttcatgctttatttcattaagttgatcttcaatctctgatatcctttcttccgcttgatcaattcagctattgatacttgtgtatgcttcacaaagttctcatgctgtgtttttcagctccatcaggtcatttatgttcttctctaaactggttattctagttagcaatttgtctaaccttttttcaaggttcttagcttccttgcattgggttagaacatgctcctttagctcagaggagtttgttattacccaccttctgaagcttacttctgtcaattcatcaaactcattctccatccagttttgttccctttctggcgaggagttgtgatcctttggagtagaagaggtattctggtttttggaattttcagcctttttgcactggtttctccccatcttcatggatttatctacgtttggtctttgatgttggtggccttcggatggggtttctgtgtggacatccttttcaatgatgttgatgctcttcctctttgttagttttccttccaacagtcaggcccttctgctgcagatctgttggagtttgctggaggtccactccagaccatttgcctgggtatcaccagctgagtccgcagaacagcaaagattgttgcctgttccttcctctggaagcttcaccccaggggggcattcaccagatgccagccagagctctcctgtgtgaagtgtctgttggcccctcctggaaggtgtctccccctcaggaggcacaggggtcagggacccacttgagaaggcaatttgtcccttaccagagctcgaacactatgctcagagaactgctctcttcagagctggcaggcaggaacgtttaagtctgctgaagctgcacccacagccaccccttcccccaggtgctctgtcccaggagatgggggttttatctataagcccctgactggggctgctgcctttctttcagagatgccctgcccagagaggagggatctagagaggcagtctggctacagtggctttgctgagctgaggagggctccacccagttggaacttccccatggcttgctttacattgtgaggggaaaaccacctactcaagcctcagtaatggtgggcaccccttccccaaccaagctcaagcatcctgggtcgacttcagactgctatgctggcagtgagaatttcaagccagtggatcttagcttgctgggctccgtgggggtgggatccgctgagctagaccacttggctccctggcttcagcctcctttccaggggagtgaatggttctgtctcgctggtgttccaggtgccactggggtatgaaaaacaaacaaacaaaaaacctcctgcagctagctcagtgtctgccctaaaggctgctcagttttatgcttgaaacccagggccctggtagcgtagacacccaggggaatctccggatctgtgggttgtgaaggccatgggaaacgcatagtctctgggcgggagtgcagtgttcctcatggcacagtcccacatggcttcctttggcttggggagggagttccccgaccccttgcattttccaggtgaagtgatgccccaccctgtttcagcttgccctccatggactgcacccactttttaacctcctaaaacgttcctttcttctttgatctgctaacatcatccttatcaatggcccttcttggtttgttctcatagcttctacacatcaactataataacctatttttctgttccaactaagtacagccacacctcagagtttgagcatttgtaactgccttacctctatcaacttagtatctccttttccaatcttttcttccttgttcaactagctctgcaccctccttgtgctccttgagtatacattgttttttcatagtccagcagcctggacctcagtttcaggatttcagaaatatttttgcttatatcctggatgttctcacttattagtaactgctgatccagtccatggccctggccaaaaagactctgttttcctgatatgcagtcttgctagagaaagtcacaaaacagaaataattggcttcaccacagtcttatcatgtcagtggcagagactgacagttgcctacagagatatcttcccttccttagtaagagaaccctgacttttcactggttacattgaggaaataaaagactacattttccagcctcctttgtagatacacataactaacataacttctgcccaaatatatgaaagcaaaaattttgtataatacttccaggaaggctgcttaaagggacttaatacaactaaaatgagcaatttttgcctttctgcttttcctctttgtaaccaacacatatgtatctagagagccaccagccactttgaaccatgatgacagaagccatgaactaggatggtgaagaaaaaatagaatgagcctggtttctcttgacttggaactaccaaacagtcaatccctagtctgcctactacctctgggcttcctgtacataagagataaacagagtctctgccccaccaccacccctaggtattttcatctcactctagaatgacattatctccaacttgactgaaaacaatctgaaataatcttcagttttctactttatgcctttgtattcctttctatcaactatctcctcagattttccttacctctttttgttgcaacttctgccattaaatacatgagtttcttccctttttttttctaaaatatgttcttattatggttttcttcttctataatggcagaatatctccagtttttatatttttatttttactgttttttaattgatatataatagatgcagacattttcaaggtccatgtaataatttgatgtatttatataatcaaatcaggataattggggcatccatcatctcaaatatttatctgctctttatgctaggaacattcaaattgttctagctattttgaaatgtataatagtgttaactatattcaccctactgatctatcaaacaccaggtcttccaaccctcttctaaaagtgaaatacaactaccactagatttttctttcttttttaacttgctatacatttgaaagagcagctggctaagacactttctttacttctttaccaacctctgtttcttaaaccttcccagtctgaatttattcccaattttctaggtacaaatggtctattaagtcaagaaatcttcattccttgagactttcttactttggcttctgtaacattgtactctcctttttcctgatttctgatttactttagccctctttctgtaattcttgcaaatcattagtataatctcaaaatgcaattattagactaaggaggcctgccccagactacactgtgaccctgactgcacttctgactctcacctgaaaagcaaaactgcctccattaggcgaactgcccttctctcctagtctcctagtagacctttaagatatcaaaactttctgaataaagttggccccaataactctcctgtgctgttgagtttagacttaaaaccctatcctaggcacagccagtcctgcctccagttctcacccccacccacagccccaccaccaccatcttgggcagatccagaccctggggggtcagtttctgatactagtctctccatctccagcaaaatttctcaagaggtaagatgggccacactctatgtgtgatgtctaaagtatacagtcaagcatgaaacaactcatatattaaaaagaacaaccagaattgtgaagaaacaaattcatacgtataagaatcttataattcatacattataagaaccggtgattaatatattgaaaaagagaagagtgatctgtgatatgattacatccctcaaataactgatattctagcatggaaagtgaagattcccatttggggcccagaaattaagccaggatcattgataaaagttaacagacctttaccttaatttgaagaagactaccctttgaaagatgactggagataaaacaacctgctttataatgtaatgatcttgtttctagaaatgatcacttagaattcataagaaaataattcaaaattctaatgtgtgttatagtttatcactgctaagtatccttctacttctgagactatacagttgcataaacttccatgttagatgtgatctttgagataatgtattttacacccgcaacattatgtttgaaaaatataaaggcctagagactgttttgtgcaagtatcattgtctgtgataaaattatttcatgaattctcagcttggatctgagtattcattctacagcacaagaagtcagctttattcttagggaaaacaacatattcacacaattttatttttagctttgataaataaaatttttgttttccttttattcagaattatggtttcaccctcctttcaggtaaagctgagcatcccaatgcttacggaatgtctacaaatttatcttcaactctattttcccagagtcctgtatggttacttaatattttttactaaaaggttaatgtcctttaaacatttttaaactacatatttcctgacatctgacagtatcactatctaacctgggggcttcagcataaagattagacactgtgactaaaacttgtgtttcagaattaggttagcttaaattcttttttcaagtgtattaatttctactgtctttgaaggtatttgtcttcctccttatggaatcaactgatatgtagaaaattcagactatctttgaataggaagatccactgcatgtagaagagaatagaaaatcttaccttattgtgaagagctgtggagattttaccctactttgaagatagcaagttagccagtcacagtttgatggatgctggcaaaatgacatgagactctggtatcagaggcaaaggaagtttattactcacagcaatagcatttgtgttgattccccacaaggcaacacaaagacagccaggtggcatctacacatgcaattccaggagaggaaccccgaggttagggttttgtaatgggcggaatgcatacctgatcctttgctctgaagagggatactacctctgtcttttaaggctgcttactatacagacatccttgaaaagtttgctcagataaaaaccagtccctctgctcacaggatgtgcagaaacacgagattcatggggaattgtctccatcttttatcatgactggctctgcctgctctttcaactaaaattgccaacctatcctgctctcttgactgcatcccagtctagactgcagaggcaacttttatttgagataaatagcatggcgaatctgataaaattctctgttctcaaattacaccattcttgctccccatggaaaaacctttgaaaccctgacttgaacactttgctccaagtctttataaaaggcaatatgccgtgatatttaagattcagggaagtgtatgctaggtttgaattcaggctctgctcccttgctagatatatgattggggagtttatttaactgttctgtgcctttgtttcttcttctgtaaaaagaagataataaaatggccctacttcataggatctttataggaaccaaatgagatactgtattcaacttgctcagcacaatgactggtacgtgataattggtgctaaagaattgtgagctcctgttattcggtgagtctgtattagagtaaagccaatctggtataatgaaataccaaaaaaagcattctttaaacattaggtgtgtatttgtctaatgtaggtggcctctgctccacaaagcaaacccacgtggtgaggcaactctttttcattgtcaatatgctcccaacactgccttttctaaccaggaggaaggaatgggagggatgtgtgcaggccaaggagctgtgagagaacaagtaagagcttggtacatatcacttctgctcacattctgtacccatgaacatagtcccatggtcacacctagctacaactataggcctgactaccatctgtctgtggaaaaagaagaaacagactttggtggaggatttaaagggccctcaaaactaagtagcacctctcttttttatttgaattttgaagcttttcagaaataacttgacaaagcataaacagataaagaagggggagaaaaaagtcatcattatgttaaaatcacatcatcattattaaacatgtcaccataacttagcccgagagccaaaggaggatggcccaccccattcccccagctccaatctaaacctaagaacatactattctgggatactctgactggaaagagccaacctactttctgtgtcactgactcctacaattctagatagacaaaagcggagaaagagatcaagttcttcatacccagtaccattgatagatttgcttcacatatttgaggaatgtggacagtggctgccacccactttggccttctaccacggggagaattaagtgatgatgagaagggctatttccctacaccccttcacaggacacgtgaagggtaggctcgtttactcagcccacagctctgaacctctcctggaagggggagcacgcaggtcagcaggtgcaggagcaggagtgaacaaatgctggaaccagccagttgctcctctcaggcggaggcaggttctgtgcaggccctgcagcagcatctaagtgtgttacaatgctcttttagctctgccatccaggagggggtatctgtgcccctgggaccccagagggtatgtgttacaatcagtgctctttcagcatttgccatctgtgggaagctacgcattaaccagctcagtggaggatcagggtggcagccttttacaccctgccctcttggtgcccatgttcttctctgacatccaggaagaatcaggtcacacaaatgaattgaagggtggtgtatgtggaggattgtattgggtgggagaagtggcttgcagtgggcacaggagctggaatgggaatggagtggaaagataatcttcccccggagttccaccacccccggccaaactcttctctaaagtcccgccatcaggtcatttatctgacatccagctgctgcttctcttctttccttctctgccgctcctctctgctctcctgccagtggtgcttggggtttttatgggtacagggtaggaagtggggtaggccagggtggttttggaaaaggcaacattcaggtgggaaagcaaggatgtgaagttctcatttagggctgcgggttcaggcatgagggtggaacccttgttggggaccccacccttttctacttagtatttctctgcctcctgtcctttttaatgagtcaagagcctaagaaaacttatccttcttcatggaaacctcataataggaaaaatacttttctatcaaaaacatcacctccaccaccaccaccatcatcatcataattataaggcaaatttaccgttttacccgttgagtaaaaacttttcctaagggttctttacattgcccattattctatgaggtgcagaagtcagagttcagacttaaaatatacttgtcctttctggaaaaattctgtataatttgcttacttcttgtacacttccaggaagcatagaattcagttttttacttatatgcaacagcttccttctgcctttatttcaggcaaaagtatatgtgtttctgccttactggtattcctacttcatttgttacatccctcttgataacacatcctttttttaaagttttaatgtaagctgccacatattcttttatggtaggatttaaattatccaaataaggatgcagaaagtaaacacaatgatgtagagagaatattggaagtgaactatgctatccatgagtgctgttagataaaatgttggcaaataaagctttgcagcctttacaggagatgaattggctcagtgtagaagtagtgcctcagtaatgggatgatggctatgaataatggtttcaatcctgtctttccagaggctgtcatttaacttatggttatttgcagtgtccatgaaattctttgctttttggcctctttaatgttcccagtcacagttgtcttaaatcatctgttatttcctattcctattatctgttttcctcgctggaccagagtaaaccaaagtggccccaattggaaagacttgagagagagagttcaccgggtgaatccatgtgaagcatcctctaaatatctttataaaaataaatgggtgagactgtggggaggttgtaagtccttcctttcataggtggggtcatattaaaacttgagtcattattaccaattctcacagggtgatgagaaaactcaagttacacacttaaagctgaggaaacaaaggccaaaaaaagcaaagtagcctgttcatgtcacacaggtagtggtggagagagatctaggctttgcacctgctaattaagagctctttcagagagtagacctaagagcatcatgtatgtgctttgctctgtttttctgccagttgcttaattcaggttatttcatttactcactacatccacattaggttaatacaagtaccctagtcttacacatgattaagttagaaatacttttttaaaaaagaaatcttatgtttaaaaggcagtttttcaaaaaagccataaagatgactaagatagctgaggtagacagaagaggtactaagcatgtgtgattaagttaaggacattgagatggggaggtgctaatataatcataagggtccttataaaaggagggtagaagaggggatgtgataacagaagaagaggtcagagagagagagagttgaagatgaaatgatgatggccttgaagataaagggtcacaagccaaggaatgcaggctgcccctaaaaggtagaaaaggcaaggaaactaattctcccttagtgccaccggaacacagctctatcagcaccttgattttagtactgttaagataatacatttgggttttttaagccactaagttgtggtaagttgttacagcaccaatgggacactaatacaatagttacagatcttaacgaagccaagagatgcattttctcctccatcgctagagaaaaataggagagctgttttctgtacctctccctggctttgataacttctgcaggggaagaccaggaaggtctggcagcacttcctgtccctcctctctgaaaggcaatggaagggcaccgtggatcaacaaggccgagaggagagacaaagagggcaaaaatcttctttattgagctctcgggcgaggttcactggtccgcagggggagggccagggaagtcgcgctgtgccaaaggggcagcacgcttttatggatgctgggtgaggagtgggcggggtaggggcggggtcggttgagtttcgcacttctctgtgtgacacgccctagtgggcatgcgcgttagtcgggttggcgggaacaggaaaggtgaacccggaaatgctgagtcagggtatccgaggtggcgatcgccatcttggagtcttcacccgagtccaatcactctccactctcagatgccttgggacctacaaaagaacctccacttgacgaggctgacagttgtgccttctgggctccagccttgccttggtattgcaaagaaatgtggaagaatagccaactcacagtttcattacagccttgccttgaacagatgtttagctcatgtcagaagccaggaaatgcatcgcttacagccccacatgtgtttctgcaaaagggtcctgataaatgtctggtctttgcaataatcctactaattggcccgattcctggaagaaaaatggctgtattaaagtgggttagacattacataaacaatgtcagttacacatctttaagtgttacttctgcatttaaaattaacaaagctattttggggacactttttacagctatacatcttaagatgtttgtatatgaaaaaaaaaaccaagtttgtaccggtatcatcatattatcatccagtaagctctaagaaaagacaattaaaagagaaaagtgacccaaaactgtcacaaaagctcttcttttctggacatagtgcagcatatatttgttcataactttatttgcacagaaattttacatccattatcagaattgattctgactactacactagaaggtgagttctcatgaaaaagggtgaatccaacattattaagtaccacacagctagtaactgatgatatctttttttttttttttatggagttttgctcttgttgcccaggctggggtgcaatggcacgaactcggctcaccacaacctctgcctcctgggttcaagcaattctcctgccttagcctcctgagtagctaggattactcaagtcatctgacttccaagttcaaacttttaaaaatatctcatggtggtctttgacaggataccataagtgttgaaccattggtttaactacatgcatcaaggatatacaatttcccttagtttctatgttcaactatgggctaatcccaaggaataaggcaggattactgttgtagaatctattgaggagttattattcccatggttgaggaaattgagaatagaatgtgagataattaatgcttattctgtctgaagtgcctctcatttgtatagtaaattaatataacaaaattttagaatgatttagctatttagctgaccaatctttcagggggtttctctccttgattcaagtgagatatgaaattaaatgtctctcattggacatcagtgccatctattataggacattcaagatgactctctttgttctttccagaattccatcttttctggaaaattatgtgtgcctctgccacttacaaaatttactcttacatttgtgtacgtgtcgaaggaaaagcttaaattgcaaattggatatttaaaaagttatgagaatatttcagtttaaaatgaaaacacaatacttggataatagactcccatattttccttccatttgcaaactacagcatttaaaaattcatttcaaaagtcaaattacccaatgtactttatagtatagaaaggaagtttcacttctgagtatcacccatgtgccagacatttaatagataataaatttttaccagctgtttggggttttgaggaggccattcttccattgtaaacttgtttgaagtgtagatataccagaattctattctggccctgggtgtgcaagaacactgagttaatgtccactgttcctgtaacatttttcactatgacattttcttggtgattttaatctcaataatacattgagtcaatatcttcagaaacattctacaaaatgtttttcaatatgtgttttacagaatatcaatcacacaagatgttaacatgcagatttcattatcaaataagtttgggaaacactgggcaaataaaagttaaccagattccttttctgcaggtctctaatgtattaatatatgttgtaattttccaaaaagtggaatttggtatgcaatatttttcaaactcatttgacactgaaaccattttcagagcttatcacatggtgctagcattccaaggaaaatacttaaataaaacctgatttatgataaaagatcccaggctcttttcttgtatgatccctgtggcccagagttcttatttaagatagtctttggaatacaaatgatgcatctgtccacgttaaacttatctgacatttctctgcctaagcacagagatttataagaatttcctatactcttctaccccatcccctaatctagcttttcaccgtgtggaagagtttaatgttatctccacacctaaagtatataatctttataagtgatatggtcatttctccacatcacttataaagatattcttaaaatttcttccgctcaaagttgactatcagataactctttgtggttcagctctatcatttgggccatctgcagaaagtgtttcactgaggtttgttgtgttgtttttgtcttagtttccttatgagacatattactctatttactctagggtacgtagttaaacctcttagaaaagatccataggccttttatttaagtgttagaactaagaaaacagcctgttttctccctaacaaactgtaaatgattccctttttatttcaaacaccaggaagctcaaaaccaaatcaggacaccactagagtaatgaattatgtccttacatgtctgcacaattgtgttatcatttcacctctcactagcttgtgttaacctgctactctccactttctctgctgttattttgcatttagatcttccgttcatgctacatacaattttatttaatgtattcttgttctaatcaaattcaagtccttctccatcccttctgcccccaacacacacacacactctttgagaatgatttagaaaaaagaacaaaccaaaaaatgtaaagaaaggaagaaaaattattctggtcacaaccctgtctagctagaagctgtggtactagatataactgatgctgagagagcatttaacattcatagtcaatttggaattcacgtcaataaagttcatagtagctgattctttttctgattttatgatggtggcaatatacccattaaaggatctagaacctccagttctccttaattgctttagttaaaaatccatgagaatttaaaaagtttgacacaaaccatcaatacagttatgaatggtacaagctgactttttgaggcaagcatagcatttcctcaccacttaaaaggaatgcccctttcatctctatgtagagcaaggttctcttcctcagcactatttgtgctagagaagtcttctgtgtagaaaaggctgtcctgtgcattgtaggacattcagcagcattcctgacttctacacctatagatatcagtaacacgcccacctccaggtgtaataaccaaaaaatgtctccagacattgttgaatgctcccttggaattgagaggaaatcacccttagttgagagccactaatagaagaaggagcactttcaaaaggacagagtttgctgtgttgaagaaagtccaggaaatggacttaagtggtagttttctgagaagtcctgtgtcacatctgtgtctttctcttttccaactgcccccatgaaattagtaaatggctgcttactctgtagagtcgatcacctggcacaatgtggcagttagaaggaagccacttattcatgcagagtccagagaaaaaaggcctttgatacaataaattatatgcagtgaataacagtttgtagtatgttgatgaccaaacagtggtaggattggtaatattatataatcaaaaattgttcatctgtattgttgtttcagcttacagaaataatatatgtccactgtacaaagtcaagcattaataaacattcaaaaaaatctacaaaagtagctcttgctattgcaaaaatttcagagtaaaggaatgtgtgaaacaaaaagcaaggccaggcatagcagctcacacgtgtaatcctagcacttgggaggccgaggcagatggatcacttgaggtcaggagtttgagaccagcctagccaacatggtgaaaccccgtctctactaaaaatacaaaaaattagcacagtgtggtggcacatgcttgtaatcccagctacttgggaggctgaggcgggcggttggttgaacccaagaggtggatgttgcagtgagccgagatcgtgccactgcaccagagtgagactccatctcaaaaataaataaataaatagataaataaataaagcgaaattaccatctccctaagccagtcttcaaaggtagccattttgaatgacctgtgaatatgaagatattaatacataccttcatattctatttctaagcaatcatttcaatgtagtgtgtgtgtgtgcgtgtgtgtgtgtgtgtagctttttcactgttaaggtgttgattgcatgattgtatatgtaagtcaattttttttacaagaatatggatagtgatttaatgtattcctgcaacacaaattatctaatctattccctattaatgagaatttaggctgtttactttttttactatttgacaatgcagaaataattatctttgtatgtgcatctttgtgcacttttggagacattttggttcattaaattcttagtattgacatatcagcaacaaaggatacgtacatttaaaatatctaaaaataactgccaattgctctccaaacagtttagattgtaacaaagcaaattcccaatacagtgcttaaaaattcatcaagtagtaatgactgctttataatttttaccgttgtgatagaagaaagactgagattctttttttaaacatattttacaaattaaataataataattacagtttcagagaggtgattttttgcccaagttcacaggaacagtgagtggcagagctgaatcacaatcctgggctatttgactcctaagtatgtgcttttcttttctccagtgattcccaagccagcagatcactggaaacacacacagagctttaaaaaacacagctttgctccagcagagatccatctgcattttttaagttccttggttgactcaaatatcagttctatctctaattagatataagaaagtgttataaagttaacatactcagtaaagcaggctgaccggctggaaacttaacctgtatgtgtctcttctgtgggtgcccttcatggaggggcaggaggagtgaaccctgtggctctttagccaggtatggaagagaaacattctccttctaggaggtggaagggctagtcttttctatgtctaaggtccaaactcttcctaatgggacagtgggaatggagtaacctcaccatggagtgaatccatcagtggagggctgccctggccaggcaggaagctgaacttatgtgggactgcaatggcagtgaaccagtgtgagcagagcctgacatgaggagcagcacggggtctgcagtagccaccagtttggacaccaaccccaggcctccaacctcaccatctgccagaggcaaggctcaagccttccaaattattgaatgaccagagagagaaagtaatccggagtttctgccacttgatggttggcagctgggcctagttctaatttgacttggtaaacaaagaaatgtggcattattcacaactttagatcatagagcagtttacactggcaacctatacaatagtaaacatatttttcctataccctagtataggaaaatataataagttcagtaagtttatagtaagtaaatatagtaagtttagtaaatatagtaagtttatagtaaaaataacttttatttttctactttaattactccatctttttcaaaggaaaagtaactttcaaggtccctccattattttataggaacagaggtgtggtggagtctgtgatttggcttgcaagtgtgatcttgcagtctcttgctcttttctattttgcatgtgtttgtaaattttgggcaaccaaatattttatttaaaatattaggttatatataatgaagcatttttgtatcctcacatgtagtctaatatccaaatatgtatgtttttccagcttggaggtataattattgaggtataattaacaagcaaaaattatatatatttaaagtgtacaatgtgaggttttgatatatgtgtgcagtgggaaataattacagcattcaaactaaggcagtctcttgaatgcaccaaaaaaagcaaaagtactatctcccgaaatcacttgccagaggtagtttttgaaacaagttgaactgtagatcacattttatctttgtgagctgtcctataagatcctcccacacccagcctgtctatattcagacagtgtttgctagaatgtagctggacaacctctacttcaacactcgagtgaggtggccaggggccaggagcagtgggcatggcccagtaccccttggcactcccaggcagagcccacttctgcagactgtgctggttctgagtaatgggttaatttatacacaatgttcagccaaacattgaggcagagaatgccaatgcaaagaattggcccaagtgccaaccaaggggcacaccccttcagtaggctcagtttcgaggttggaggtggaattgcataagaattcagttactgtttattaacatagctctgtgcacctctggcatctactggccagagaccctctggttttcacatttaccctcagcaggacaacccagactgtatggattgtgtttacactggaaaaaaaaaaaacatgatattccctacaatgtgagaaaagaagttagagatcttctcatcttcgctccttctttatagaaatgacagtactgaagcttaagaggtaaaccaactttcccaatccagcattgctcgtcataaacaaatccccacatattttgataagaataaaatccattttatttgcaatctcaaatattagggctttattaccatggaatgaagatcattccggtacttcttgatcttgaacatgtgtgggaatccctgaagaatcttgttacaatgcagactctgattctgtaggtccgggtagggcctgagattctgcactgttaacaagctcccaggtggtgacccaactactggcctacgcttttgaatattgagcatttataggcaatgccttgcctagtgtgggtggacttgagcctccacaagaaagtatgtagggctttccactgtgaatacatttcctggtatggtgaggagttcccatcaaagaattcttttgctatgcctaagaatagcaaaagaatagaatttcatgcaagtgctttcttcagaaataaagtaaaactgagaagatggatcatttaaatgttttgtatttctgtaaatgcacaaatcatatttctaagtgtccttggcagaggaaccttatcatagttaagaaagtttacatctgcatctcccactcagtctgagcatgctttacttcctcttaagtaataatcgacattgcgaaattgcagctaggcaactagcaaaatgttcacagggaacacaactgctagctttcgctcataacaagctcccttccctaacccatgtcattccctacatgagcttattcgtgggtttcgcagccttggcactactgatgtttggggtcattgttgcaggggctgtcctgtgcacagaaggttgtttagcagcatctctggactcaccgcactagatgctggtagcactccacccccagttgtgacaaacataaatgtctccaaacattgtcaaatgtcccctaggagacaaaatttcccttggttgagaatcactcctctacaaaaataatttatactatgttggaaaggacaactagcttaaaacattgatttatatagtttcagattggaaagagagctttactgcatttgggggtcacacactgagacagagtctcacagtcacccaggcagtggcacgatcatggctcactgcagcctcgaccttgtttctacaaaaaataaacagttagctggatgtggtggggtactcctgtagtcccagttactcaggaggctgaggtggaaagatcccttgggcccaggaggtcaaggctgcagtggagttgtgatcgtgccactgcactcctccagcctgggtgacagagggatacctagtctcaaaaaaaaaaaaaaaaaaaaagtgtttcctattctttactcatggcttctcagccatgtagctaaattctggaacagctcatgtgtacagtcaatgacagtaagtccgcttacaatacactccacatcactttgagagagaatgttttactaacatttaactgacaaaaagaagagagaaagagcaattaatcaatcaggtatttgcctaaatgctgaacaaaagtgatctactaaaataaccacttgttcttagatctgttgtcttgctgttaagggaactctgaagtaaaacacatattaagtacttcaaaattcacttcttgttcacagattctctaacattgttaagatgtgacagcctgaaaacatgtcatgcagacactagttatttactgtactaatattaataactggaggccctggcacagggccagagtgaagggaccttttctatcctcttttttactgaaagggaggaaaaggcattctctcagttctaagctggaggtggcatccatcacctgccaatgaacaagatctgctgctacgcagctgccaacaccccttccattcacactcagctgatatttattgtacacctaccatgtgccagatactaatctaggcaccgccacataatttatctattttatttttacaataactcggtacatttgggcacaaatggagaatctaaggaaaagggtttggctaataatgccaagcctattttacagccctttgcgcttaaaaaaattttttaagagaatttgaatggattttaagtattcattatgttcattacattcattacttacttccttgcttgatttctttatgcaatagatgtccttgaagagtttggaagcaaattgcagttttgtaagttgactcacttttgaaatgttttagtgtggctccatgatatttatgactcatgcagcaaatttgcctaaacaaaacaacctttagtaagatgactagccactctatctgatttttaattctgaattttaacttagtggtttccttatagatgaacatatataacattttctcaagtcatcaataaaatctaagccaacagtagtttgcattttgacagcaatgaagtaaacttagatacttggtgtaggaataaatattaaccccaatagttcaaccaatcaaatgaaatgtacagctgtatgtcttgaatgacgtcaatgtttgtattagtttcctatggctactgtgacaaattaccataaactgaatggtttaaaacaatgagaattttttctcttatagttctggaagtcagaaatccaaaatcagtctccctgggctactgtcaaggtgctggcagggctggttccttctgggacgtgggaagaatctcttttcttgcctccatcagcttctcaggccatctgcattctgtggctcttgacctcattctcatgtcatcccaacctcttgcctctatctgctgtgagtcactctgatctcctgcctccctcctataaagactcttgtgattacattggcccaacccaacaacccaggataatctctcacctcaagatctgtaacttaatcacacgtgcaaagtctcttttacaaagcaaggtacccatattcactggttctgagaattaggacttggctgtctttaagaggccattattcatcctatgacaacactgaaacaaaactcaaactaaacttagtaaaggattggtacagagccaactaattacctaaatcagtttaagtaattaagaaatagacctggaaaaaatgcagcgagtgatgaattttaatccaatctgccaatacaaatctgggactttccatttttataagaaacgcagcagtgagatgaaaataatccttaaaacatcactgaaaggccctgtaattataacctgctccctggaaattaaaggaaaactaaaagaagtatccagaaaaccccaaacttggctgtacttatcacagacattggtaagtaataatactatacaacattcactttggattattatctagaaaaattgattagcttgactgaggccattattttttcccagaccccatttataagcaatgctatctattgatgaaaagctgtttgaaagcagagtgtggcgtggatctcttctccataagcaacctgctctgaccaccctgaatgagcctgattagatgcattctttgctaagcaaagggcactttgtttattttttatttatttatttatttatttatttattttattatgttttagcacaacttgcacagtaatattcaaggaaaaatgtttgaaaccaagtgtctctgtctcactatggaatgaagttaaacagacatagttatgcatctatactgctttaagcaggggtaacaataaaatacttcagttagattgtaacagtacatgcactgcaaaatgcactacttatttatttatttatttgacagggtctcactctgtcacccaggctggagtgcagtggcaccatctcggctcactgcaacctccacctcccgggttcaagcgattctgatgcctcagtctcccaggtagcgaggattacgggtgcgtggcaacacgcctggctcatttttgtattttcagtagagacggggttttgccatgttcccaggctggtcttgaactcctggtctcatgggatccgcccgccttggcctcccaaagtgctgggattacaggtgtgagccgccgcgcccaaccgcaaagtgcactttaaatacagttgtatttatcttccaacaggtataaaaaccattataaactatataatgaattggctctaccagtttattcaataaatatttaaacagttattaagatggtaattatatactttgaaggaaacgtaataatggattttatccttgaggctaaaaagcacttgtggggcttttggtctcctcctcttgaggaaatttgtgactgtttttaaccactacagttcagcagaaattatgcaaaataattgtccaaagtagggacagaaaaaaccaagaagctgaaaagaccatggatgtcaggtggaataaacattcactcccagagccccaagctgccaggtgaaaagcctaactatcctgaggctcagaaggtatgaggaagaggccatgccgtgtggagagcccaggtgtaaggtgttaaagttgacagtctcagctgcagccagccttcaagtcattccagcccaggcaagatctataaatgaagaagcctccagataattcctgcccagtacaatcaagtcagctggagctgctacactgtggagcacagataaaccacacctgccttgcgatgtccaagtttctgacccatagaatctgtgagcatgatgaaatggtggtgttacctgccgctaggttttgagatgatttgttacatagcaaaaataatcagaagagtctttcaaggctgaccacaaattaatgtaatgtaatgtcaacgaaactttttgtgttaacacggaattgtgactgaagccacaaagctgacaaagtgaggtgttataagtgtatcaactctcattagagctgcccaaaatagggccagccaagagcagcagcacaatggaccattgtgcaatcacaccagcccccaatgtatttgacaggacacttattttgcaaatcttcatttatcgttaagtataaacaggtgtttacctcaccttcaatggtcaacaacctaaggtgacttaaaaaaaaatactgataccaagtccctccccagatggattgaatcagagctacttagggtggagccaaaaggcttgttttttaaagcttcccaggtaattctaatatgtgtgtagtcgggtatgagaacgattgcaagcaaaagcagctgagggacgctgtccaaggagtaggctcagtagcacgaactgcaaatacttgagaagggaaaagttcagccttgtgctggaaagtggtttagcatgctggagctggttttctgcttggtagccctacaactttggcccaactacttggcctctgggactcagattcctcctctttaaaatggtgctaataatagcacccaccctctgtgaggaggatgctgtgaggacaaaatgagatcatccacataagccgtgaaccctgttcctggtaaggtaagtgctcagtaaatgagctgctattagtacaaggttatgttggaaatttatgatgaagtactgccatataatgaagttctttttagtttttcaaacatttcatgaatgtaccttatttcagctatagttagtatccaaacaactttgctagattgatccactttttatcagatttttcttgatatcaggaaaagctgtgctttgcctgagcaaccactttttcattttttattttttcttaatttggatgcaatgaatcttgcggtcaatttgtctctttgctttggcattagaaaactaaactgacccaaatctcataactgaataaaactggctatattggtctctccttgttttttccgttcctccttaaaacctcagctttgattttatactttcatgcaacatgtacatctttttagaaggtgactcaagcacttggtaggatgggaccaaggtaagttatctgtattaggagagtttttctatgatgaggtccagactaataggcaactggttaattgaaaaatgtggttaaagcagggagtccttaaaacatgtatacacaccttaaatttttttaacttaaaacatacaaatgtgcatcttttaattgatcttttggtatacaggttgttacaagtccttgtctttagaaaaggatctactgctagaacttgtcactgtgtttcttgtatctcccacacctgaaattcatcaactactataaccactttttaaaatagaatgagaactgagacacttttaaagagtgtagaatcttcctagaatgttaatatattcctcccgaatctttaacaattttcttgcccacatcgaattcaaaaacatttttaattacttccattgtcaaaatattttaatacttttaaccaaattttcataggagcagtaaatttcttgttgcatttcatttgtaatatttttattctcaggtttgggacaaataaattgaatctcaggacacaactcaactggtggaaacaaaagagcttgaggctgtccattagcctatttgttgtgaatgtccatgttctgtcactttggtctgtatgttttggacagagtggggagttttgtataagtggttgatatagaaaaatagcgacatgaataggcccatgtaaaaatacatagctaaacttagcaatgagaacattcagaggtatccaaatatacaagtatgtagaggaacacgagtggatgaccatgggttagtacatctgtgtagatggctgtgtgcacatgtgcccatgctttcccataaatgattgtttttattctcttcctctcataatattgctcttggaaagatctgacagtacctttcatttggttgccattttcagaatgaatgtaactttagtttttacattggttccatgtagttcaaaagttgtttcctaaactgatgtttactgttctttaatatttctgggaatattttagatgtttgtccaaatctaaaaaaattataacacagcatgcttgggagagcacacacattttattggtaagaaacattctttcccttcatgactgtcttttaaaatttcctgattattgtgcctcaattatagaggaaacattcttgacttgggggattagcttcataaactcatgaatctcctgaatatggtaggtagatttaacactgagcaatgaaaactactaaatattaaaggaaaagtgaaagttgtacctcgtctgcagccaactgtgataggtagcaactttgtcacctgaggctctctagaacactcagaaaaggagatttgttcttcccagggtgataaggaagggtcctagtgatgggtgtaaaattcttttcaggtgcacaataaaaagcattaaggcaaaagcttttatctgattaccattaagtaaatcagggatttctgtagaaacttacatttcaggtgtatcttaaatatgataattgggccgggcatggtggctcactcctgtaatcccagcactttgggaggccgaggtgggcggatcacgaggtcaggagatagagaccatcctggctaacacggtgaaaacccatctctactaaaaaataaataaataaatatatatgtgtatatatatatatatatacacatatatatatacgtatatatatatacacacatatatatatacatatatatatacacatatatatatacacttatatatatatatacgtgtatatatatatgtatacagaaaattatctgggcatggtggtgggtgcctgtagtcccagctattcggcagtctgaggcaggagaatggcgtgaacctgggaggcggagattacagtgagccgagattgtgccactgcactccagcctgggcgacagagcgagactccatctcaaaaaaaaaggagtacaaattgtccagtttaaataaggtaatttaaaagaaagtaactttcccaagattaccaaataatgaagcacagagaaacctgcttgggtccttcccttctctttatctttattttatctttattctttaggtccctttatgggtccacctctgcctatcttaatgattaactatacaagctgaaaaaaattatagaaatatattaataactgatttaaccatattaagttcaattacaaagttcagctggtctctcagctctgggtgtgaccacagatcacaaagttctgagaacggctgggaagcatgtctaatagattgtgcttttctattaatcacacagctcttagttctggggttttatgataaatcctaaggtttatcccaaactactttcttccaatgcagcttttggtatatgaatattctatgggtagtatattttcattaataatgtctattaagtataagttagaatacatgtccctaaatactttaaacatgtggagaaatgttaaatctttaggcaaattacatacagaatagtcaatcatctttattgttcttccccagagaccaagggattaataagatattaaatggccaattttaagtattgtgttaaggcaaagttgattatagttcacagaaggaatgttagcaagatgcgtaattaaacattatttgggtcacagcctaatagtcatggattgaagagtgatagtgacctaatcttgaagtcttagaatttaaagcatgaaaacacttaacagcattactctctcaagtgtggttattgcctcccaagaagtgcacaggagaatctactggagtacacgagttaataccagaacttagaaatgtaagtttacattgtatatgaagaggaaacaagacaaactttacttgatccactcttcaacaccaatgctatggttcatagtgcatccctgaagtcacaagacatagactgcttgtgaggtgctccaaggacaggaagggagctctacagcccagagtagagcgatagaagcatctgtagtcattcattaccttctaaaatttagagacccattgcagtttacctatgaaaaatttttgtttcaatattcttctagatgtcaggataattttttcttgattttactaataaacttcattgcttttgtttatattctaagaattttattcacttagttctgtaataagtctgaagacaaaatagtttaagagtctgtactttatgttttattgaaatgttccaaaatgtcattacaacttgcagtttaaaatggtatatttgagcttcatcaacctttaaaataaatgtcatatcttgagtttgagcttctcttctgcatctctaaaatatattttagagaatttaaaatatcattgtcccatcttccaaagtctgaaaaactttgcaatggatagaccatctcattaaattagatcatttaaagaaaaatccaatttgatgtgtgtatttaaaatactgcgcctttgagacaaacctggaaaatatatatataaatatagaactgttgaaaaggtatgcgaatagtccacaacttcagggtgtcctggaggtgagtcctcatctcatgagacttagataatgagctgctcacagacatattccgtgtacttactaaaaaagaatgctgtctatatctttcattacagctctactgtcaaaagactatgaatgttgtcagttgttcattgtcaaggtacaatgtccagaacttctttgttgagtaaagtcaagtaaagtcatagccttcagttggcaaaaaatggtaaaaattactcctaggttgtctattttactacttgcacacaataatcaattgactggtgtttgtcatatccaaggcagaatctgcaataatggactcatattcgatgtttgtttatatcacttaatgagacagccaagtgtgaaggggttcctggaaaaattccaaccagcccgtgcagtggaaagtgtgcacgttggggtggagccacagaagtttgtgccatttgcagcagggaggagcttggcccttcctctctcctgggaggaacctgggattcaatctgcgaggcaggaaggatatactagcaggactcactctgctgagggtacctgtttccccttttcttcctttttgcccaataaattgcattttctcaaccttgaaagtatctgcaagcctcatactttatggcaatgtgacaagtaccccatttttagctgaactaggtagaaaatcctacaacattttgttcatgttttccaattttcttgattaattcccataagtagttgtgtgtataagttaccactgttttttgaatcctgactttttactagcaatcttgcaaaaatagatccaaatcagcaattcatttaatgattatgtgatttccatgagatttcctttgaggaaaaccatatttttatcatgccttttgaagagcaaccatttttatataaaaataactacaaagatcattttttagcacttgaagataataccaaatgctctatttattattcaagatgcttgtctgatggatttttattttatttatgtgtaatccaagcaaacatggtgttctttatcatctgtcctaccaagacttcagaggtccttttgtctatagaaagcccatatctgtctgttttattaactactttaacccgtaaacttgtaacagcttcagagaggttaagaacttttgttttttgtttttgtttttgttttacaatagaagtatctaaaagaaaactgagtagataaaaatatttaatataaatattcttgtaaactttccattttaattagtttccacacagtgagccccttttaacactgaacatattctgcttttcattaaatggtaaagtcgaatagaacttcagagatcagataaatcctaaaaatcccttaggcagagccaaattaaagcaaaattttacagaaagtgattcctccccaccccaccgaaacatccattcctcctgctcctatatcccccaaggtatacttaatccaaatcccacacatatttaatttcaattttgtggtgtaattgctcataaaaatttagctcagtagaggtcaaagcctctcccttcttttgtcaaagtgtgttaactttgtattacttacaacagaatagctcccttttccatagaccttctatatctttagtgaattaacctgccgtgtagttcaaatcatgtatctctatattgccacagcaaagaatcagtgtttagagatcaagtcaaatcaatttaaatacaaataaatgagaataacgatacagcacgattacaaatgaatgttttcctttggatcatttattaccatcttatcagaaaatagaccaaagaccaaagtgcttatttcagtgggaagaaatgtgatgattcagtgagttgctccctacagaatcaatagaaagcagatgtcttattcacatacccctgacaatcttgcagtaagtgctggtgcctagaaactctgtttgtaagatcatgtatagcatgtctgcatctaaatgaggatttgtgttactggaaatcatacatgagggattgctgccccacccccatttcaacactaggtaagcgggatacattttgtctatcataactcattagagacagagtcttgttatgttgcccaagccggctcaagcaatactcctgctttagcctcccaagaggctgtgactacaggcaaatgccactgtgcccaacttgtttattgtaactttgagtccaaataaacttgccctgatttatgcactgctttaatgttactacacctagcttctgtaataaatatgcaactctaagctattcttatgcttccatggaatatcttaccttggtcaaattaattgcttcccaacttaatcactgagaaaacagaaaaaatagagggccaagataagaatgacatatgaaatagactgttttaatcatgaagttgacagaatgagccctactggttttctaaattaaggccttatctttgttactgtgagcaatcattttgggaaactgccatctaaagtacatggatgaaagcaatattttattacttatattaacttttatttcctattaaaaattaatccatgtcaattatagaaaaataagaatattacagttaagcaaatacaagaaaatacacagtaatctgtaatcccaccagtaggaaataaccatgattagttagcattctgatacacaggcttctagacattacaaactccttaacctaagggctttgtgctactgtttcctctgcttaagatgttccacagatctgcatgtggcttcttaattcaggcctcaattcaaatgtcacctctgaggatacgccttccctgacaagcccagacaaagcaagccccagcccatcttcccagtcattttctagcacattaccctattttatcttctctatatcccttagcggtacctgcgattcatttgttagtgttcatagtatgtttctctccacttctgtcacctcttgtctccagaacctataacaacatcaggcacatttttgttttttaggaaatatttgttagcctgttgactgaaactgacatacccatgagcattttttttctgtcagtaaatattttcccagaacatctattggtggctatatccagttgctacatgtgtataggtatatgatgtcataaattattcttatgagtctacaattataggacattttggtggtttccagtttttactatgctaattgtatagtgataagcgttttaatagctacatgggtacgcacatccaggattatttccttagaaaaactcctagaagtaggatggctgtattatagggtatatacttcttaaggcctctgacaatatgcattaaattatgctgcaaaaatttgaaacccattaatactcctattgatgtaggacagtgatcaggtatcacacctttgctaatccttgagtattgtcatttaaaattccttgccagtgttacttttagtgtgaaaactgagttgaaatgacaaatattgcatgtgcctgcttgtgtcaggctagcatggagggaaagtgattaaaagtatgtctctgtagcagggtgagccgcagacaaaacctctcagacactgaattgtagaaggaagggctttattcagctggcagcatcggcaagctactgccttaaaatctgagctccccgaatgcacaatttctgtcccttttaagggctcacaacactaaagatttcacatgaaagggtcgtgattgatttgagcaagcaaggggtacatgacaggtgctgcatgcaccagtggtcagagagaaacagaacagggcagggagtttcacagtgttcttctacacaatgtctggaatctatgaataacattggtttctggagtcatgagttgatttttaactactaggtttaggccaggcaggcccaggtccggttttgggcctgccgtgaggctgcctgtctttgattttacttccctgttgttttttcttaaaacaggtactgagtataaaacaatataacacaatatgagagggtctctcttttctctcatctcaagattgttcttcagggccttcatcatgacatgactttaactgagcaccgtctcactggcaactagacctcatcttgttatacatctttctttgttctaacactgaagctgatttggctccaaatgagctgccttaaactgtaaatattatgcaattcatttaagtccagtaatgttctaaacttggatctcattattttttgttaacatctaaaaattttgcgagcagaaatacatcttaggccagaaagtaatttgatttggctagggtacaatcagctctctttatctgtgggttctgtgttcatggattcaactaaccacagatacaaaatatttggaaaataaagtggatgatggtgtctgtcctgaatatgtgcagatatttgtccttgtcattatgccttaaacaatgtggcataacaattatttacatagaatttacattgtattcagtattataagtaatctagagatgacttaaagaatacaggaggggatgtgtaggttatatgcagacatcatgctgtttatttgaaagatttgagcatcctggattttggtatccttggagggtggggttttaggaccaatcccccagagaaactgagggaattattgttaaatatctaaaactcttcataagaaatgcaaaaacagttcataagaattgcaaaaacaaaatgggatagattgagagcccttcctgtgtatatagggtgttcacacattcttttgctcagtaattcattgacttggtgaaaaaaaaagccagctggtgcaatggctcacacctgtaatcccagcactttgggaggccaaggcgggcagatcacctgaggtcaggagttctagaccagcctggccaatatggtgaaaccccctctctacaaaaatagaaaaattagctgggcgtgatagtgggtgcctgttattccagctactcgggaggctgaggcaggagaattgcttgaacctgggaggcag

SEQ ID NO: 1025 - DNA, 56769 bp, Homo sapiens
gggatgtgggagggaagggtgaggtcgtggggtttcagacagactggtcaggggaggcctctctgagggggcggcatttaagctgagactttcctgaggagagatcagtcatgcaaagatctgaggaaaagagcactccaggcaggagcagtggtgatcgcaaaggccatgagttgaagtgagtgattctgttttagcaacagagggcaccctggccagccagcaccgaggcagtgtagagggagatcgtgggagtccttgctgggcggggggcagctgattctgagtggaaagggattgggaattgggcaggagagtagtgtagcactaggctttattccttcattctccgggtcattcctcatgctttagttagttccacttcagaaggcctttgttcgggtatcacagaaaaatttctcttccctcagtcaattttccattccattccattgggaccaatcacaaggctaaccttggccaataaatgcgccgtagccttggagacccctccttgagcagctgaagggtgaccacacacccagccagcaccagcaccagcacccccacctggagaggtccatttccttaacatcccagcacagggacaccatgctgtccccatagctgtgcactaccaagccacccacttttgcagagaaggaagctgagggttagagacctccaccaggtaccccaggggttagagatgcaagtgccggagccggggagcctggaactagctactgaatctctctcagttcataccataaatgggagctctgtctagtaaagaagaccgatggcaaagaagaactacataaataaatacatcattataattctgtgtctacaaaatcatatgtatataataatgtggccacctcctgagttggaatatgcacaactcctaaagtcaatgctctcacggaggagcctgggccactaccggacggggctgagtgcctgagacagcctgcctgtagccttcatctcaagccactcagcctgagtcagggcggctgctctgagcccacgtggacggccccactctgtccttgcctcacctctgcaacctgaggcttggggccgtctctcagttctgccttcccattgcctgcttcaactgtccactgtccacacttgtccctttgatgtcccccttcagccattctggggaaacactttgtcgtgccctgttgcccctggggcctcacatcccaaagtggggctcttagcctggtaagattcattgcagcctctccgatgggcacagggcctaacttccactgtacacagagggtccctccttcttccccagagtatacatcccttctcagtaagcctgccttcctcaagccccagaattcaagagcagtataaagagcaatttgcatgcaatataatgaagatagaacctcttgttaatagtcttgccctggtacttctaggctctcatcttataaaagtgtgttgattaaaatccttcaaaaacactcccttgggtatagctgtaaggagcctctaaacagtgggggcagttgggatcttgactgggaccagtattgggctatccttggtctcacagtagaaggtgatgtcatctccaccctgaaaataaacagagaacaagaaaaagaggagctcgtttcagccattctgacaaggtgggctcttggtggggcagggattgcttttcctaagaggccaggtattagccagaccagagcctggtggcccttctcataccatgatgtgtatttgaagctcctgggtggggcttttgtcaacctgcagattccggctcaataagtctagggcagggcctgggagtctgcatttctatcaagctcccagtaaatgctcatgctgccagtctagggaggatacttgctggtagcttgttgttagatacttgttagtagcttgttagatacttgttaatagcttgttagaagggcagaaccctgagccccacatcagacctatgaatgcaacctgcctgtcaacaagatccctggtgacccctgtgcatgtcaccacgttagaaggccagtttctagggcttgcctgcatcctgtgcccacgaaagacatcactaatcaatcaggacattctgatgagagtcaagatccttgtctacacagtgctgccagtgccccaccaatgcctgagaggcagcatggggaagaaactaaaaagactgagaagaatcagccctgatacatggctaatgaaacaggagagagagaagcgagtcggggcagagttgggtgttcagaaacccaaagccagatagattcctagaagaagccccaaaagtgtctgctgtgttgcagtgaagcataaatacaagtgaagggatgggtgttgggggaatggagcctggcatgagccagagaagagtctggagctgctgaaagccgcctgtagcacagatcagagagaagaccgggaagaaagttctagaagggttgagaagctgcccgcccagctggaggcttcttggccagggctgaaggaagagactgaagtccatctccctagcaagaaagtctctcaagtgacataaaccgagcatccaccatacgccaggcaggggctggccctgtcacatcagcgatctcagttgcatttctcatcccatgaaggaggaaccatcatcttctacagacgaggaatctgtgaccaagggagatgaaacaatgaggctggcaaatgccccgtgggaatccttcccagtctacccgcctgcaaggctaaactcctaggctcatacacacttatcctttgccattatttatccttttgcaattcctttgcaaatttctattggggggtctgggttgtcttgtctgtgagagggacaggtagggatggggatgaggtgggcacccagggcccaacagagcagccagctcaggggtgatgcctcacagccagtaggacaaggttctgggtggtgctttctgtgagcttcatcaagggtcaggcagcagtgacgtcttgtctatcttcttgcaaatgtacttgtcgcacctccacctcacctacccccatgactcccttgctgagcaggaattactactcccatcttcagaaaaggaaacagtggttgaaaaagattaggcccaatttctccctgagctgagaacagcacccacatctgtttgatctcaaagctaggaacccattttaggcttatggagaagcgagtaggcttttgtgggctagcctgggcactaatcaccagttctagcatcatgtctgtggtgcaactgaagttttgggcactgtactgtgaacaagctcttgcaatgccatttattgctaagttgggaaatacctgcttctctcatagaaggaacttcagtggcaacttcctactcaacttggtcctgtgacatctagtggccaacaggagaagtgcagtgaaatctctggacattgtaagcaggtggaaaagcttaggacttcctgggattaaaaaaaaaatgcgctgaaattcatgatagctgaagtatccatggaatatagaagatgcacattgacatgcaccttataaagtctataatcccatgttttgttcctaatattcatgtttatttactctcactggtggaaaatacaccatatccaattcattgtctcttaattgatgaactatctttgcaaataatataatatataatacaatgtaatgtataatagagtgtaatgtgatgcaaactcagtgcttgcagatatgctcaataataaaggacattataggtatgaaaatactataggtcactaattaatctattcccctgggggtggagtgttttagaatcaccataatgccatatgaaactagatgaaaatatacataaataggtttcctctctgctacatacataacaggcttcctgtctgcctaaacatgttataagacatgatgtgctttatagacgctttctgattacaggggaacctcaagagtgctgcctgagtaactctcattacacaaagacacaactgcaagaggatccccaggcattcccatgagaacacagattctgacaacccctccatcccccaccttggtctccaccccaggactcacagcatggcaaaaatccaagggaagattcttgggtaactaatgctcctttacagggggtcccggatgaagggcagggggaaagtcttgtcactgtggggctaggatagatgaacccaagagtgatttgccaaacgtgcacatactcaaatcatttttcaaacattttgggtttggcaaaatgcatgttgctaagccccctttcccgacagtggtatacccatgtgaatttcaagggaaattcaatgtgtgtgtttctgattctcttaggcttatctcaggacaattatttagcaagaaccactttgtgtccaagaatcttcctgaaccctttcttttgtaagaccccttaaacaattttccttttaaccaggaagtatgttttgtctggagtaaattgaactgaaaccccaagaagtgtggttcaaaattcagaattcttgaattttgaaggagattggaaagtctgcaaacaacttctcacatcactgagacttgccggtggtggtattgaggggtgtgaagtattatgagcaaaattcactgattatatggagtgacattttgtttactttaaaacaaagtctgacttcttgctgcctgatttgagtgctggcctgaccaagtatcttccaggtctgggtgacccagggactttttcagtcactcaatctttctgagtgttggtgccttcctcagtagatgtgaggacacaactaacacctatgagcaccagaggatggcagctccacggggcttttgtaccaaagagattctcttccctagtaggacctcatcatccaatgaatcagtgagcttactccatttattccatcccagagctagtttttgtctttgttttttaacatactataaacctgagcacagcgcatcaaggttatttgattaaggtcaaaataacagagatggtgataagagttttatgtctgtgctgctccgtttatacaaaaatgagatcattattccacttgagttaaaattttgctcttcttgtcatagcgatggccaacagccagctatgctgcttaggattaagttggccacatataacagaaaacccaaatggtgggctttaataatatagggattttcctttttctcacatgaaaaaaaaatccaagaaaaaatatccagggatgaagggctggttccagggccatcagggacccacgttcttcctaagtgtctcttccaacttccttaccatggaacttgcatttcagaattgcattatggttacatgatggctgctggagacccagctctcatgtctgtgttccaggcagcagaaaggaagaagagcctttcagctgactcagtcccatgtaaagagtttctttggtcctgaactcctggcctcaagtgatcctcccacttcgacctcccaaagtgctgggattacaggcataagccaccatgcctaagagcttctttggaagcccaaaccaaaaacttcagcttatacttctgcaagagaggctgggaaatatgtttatcaaagcccactaccaccctcgataacatgggattccactggcaagaaaggagagaactattgggtactcaaccaactctctcgaccttaccctccatgttctctcctggctgggccacaactctcatccactggaagacagaccaaggggaaatctctggcagctgtgaactggcaggctgtgtgtgtgtgcatgtgtgtgtgtgcatgtgtgcatgcatgtgtatgtgtgtatgtgtgtgtgcatgtgtgtgtggcttcactggggcctgacccacaaataccatgatgtctctttgcttttatgtaatgagttctccgttggcttctgcctggtccaagactgatttgcctcagcctaacattgtgtagtgaaggcctttcccagggccagaaaggactggcagggctggagagaaagcagctggtggagctgtgtggtgggctggcagctcctttctcttcaccttgtttgggtgttatcagctcctctttctccaacctggggtgctcctgcctcgatatcatcaatcactgatggaaactcgcagggaaaagatttgtttgtgtgttccttgaggacagaacaatgttgtagtatttgatgggtcttaatatacggtgagcttcaaaggtaagtagttgcctattctagtcaggttgaggcgataccgaatgactcacatgaaacatggaattgacttcattgataccagcaaggaggtgctcacagtgaagtcagccctccctcaccacaggggcacatgccacccccattttgtagccaaaaaacctgaagttaggtcgcctccctgagtcacccaagcactggcctgagtgctgcacagtggggtgaccgggcttccctacatcaaagaactaccctcagcccaggggcctggctgtctaggaagggttcagaaggcacacccaagactcaggcccctgcctcaactccacaacactgagggaggtgagtagactgggtgggaggggcagctctgcagctggccagaggctgcggggacacaaggggtactcagcagacctgggcgtctctccacaaggctcaggtaccagatctgaaataacatgaaacacagtagggggttcatcaacgtcatcatcattattcactacgtttgcttcagacctcaacatcacccacagatgattatgggtttagaaatggaatgaggttgaacttagggggtgaccacctgacttctgttttatctttgtcttttattcatgcttctttttactgagtggtcatccgcaaacaagcctgcaacatgacatgtcttggactcagctcatttgatgcaccaacaagacaaacagcagacaacggcagcaccacagagctggaaacaaaatgaataaatactttttcacaatgaaatgagcagagggactgttgacttggggggctcccgcaagccagagacaagtggggggaacttgctgacttccaagaagaaaagccagcaaagaggaaccagtctccaggaagaatatgaaaatgaagagctggtatgtaggtagcacttcttgagagccttatcttgcttaagcctccccaaacactgtaaagtaagtgggaaggagattatggaaaagaacactgaagttcagagagatcaatatcccatccaagggtgcatagctgggactcagttcagggatgtgagcagaaggggctgggcctctgccatctccgatgctcaggcacctcatcactgaaccaaacacccagcaacccactgtgagcaaaaataaatcttcctccttcccggcccctgtggtccctgcctctgaggccacagctaggagatatggttcctaggaaaggcacaacgaaaagggatactcccgccatttttgaccttcaaagcccttcgtgtcttcactatgccctatgcagccccagtgacatgggaccaccctgggtcataggtgctcacctgcttgaaagaataggtcagaggaatgtcagagaagcccctcctccctgcactgcaccacccactctcacacagtctggccttagtttctcgaccgatggtgatgtctggggcaagtgtctgcacgcctctgtttactcacccgtaaaatggggagaagcgcatttgcctccacccctcctgccgatgggagcagaggtagagcctgcttgtctggacaagcccagagctaggcccatcctcctgacctgctctctgggagccacctactgtgacaaagtctatggctgagtgctccagtctgatctcaggctcccaggatcacgtgggtatcaaacggaggagctgcaggtgagccagtcggcatctttgcaactggctcctgagaccagacgcctcgggtcacaaggatgtctgagtgtgaggtgaggtggctttcattcctgacttcatagccaacaaagtggtgactgtctatctttgaccaaacaggctcgactatcttccctaaaggagcagagttctaagctcaaccccatttgcctcccccatcaatccagcaattatttaattaacacagtttcctctataaattttatttcagatttttttttaaaatcctggcagtgacataatttcaaccatcaaggacccccgataaagtctcaggatgggagttcagtttgtaaagcatctctagttgcagcttcctggggcctgctgcacacactggccttgggcccctggcctccatccatgcaggaggggtttgtcactactccctgacggtcctcttgggctcaggcacccaaacgctagggctcagcacccagccgggggccgtggcatagcacatctgcccagatgttttcaggagatctgagtgggagccatggggccagccaagagggcagggagccccggatttgcagaagcagctgaggaaagagctggcattgctcagactcgccagtgttagccagccgatatcggtcaaggctgccccgctcgagggtccattatcccctttccccggcctcagctgtgcactccaggccataacagcacaagacctttccacaaccccagggtaagggtcagatgtggggtttccaaaagcttcaaaacttacccctctatccagctctatccagaaggacaccaggggacagagagatggacacggaggcctcaaaacaggaaaataaggagacccctccccattgttgattacttggggttacctacagaaagagatgaactgaaggggctgagcctatctgaggattaaagcacagcttttgtcaggagtccgtgcctccggtctttgttccagcgacctgaggaatggcatgcatcagaagccgcttccgtgtctcagatggggcctgggtcaagtcctgggagttgatggagcgtttcccaaatcgcaaaaggagaggagctagacttacctccccctcctgggaagtaatgcgcgacaagaatttaaactcttaaaacgattagcagcaaaggtctcatgtgcttttttttaattatcattttttaatcgaggtataatttatgcatttaaaaaatcagatcaattgccccccgggctctgggatggaaggcggtgtgcgcctgcgaaggtcagaggcccagcggcgccagggctcctcggcggagagccgcccgggtccggcgctttgctttcgccttctgccccaccgcgggcgaagccccagggccccggggagactccaggccggctgggccggggtgcgcccgccggctgtccgcgctcgggcagggtggggcgcagcgggcgtctgtcctgctagcggggatcgggcggctggacccaagagcagggcacgtgcgcagcgacgcggggcggccccgccaggagccccgacccgggcgcggcgcagggcccggcggagagcgcgcattcccgagcgccgcgagccggccgaagtcgggcgagcgcgccgtgcggcggctgggagtgggctgcatgtgccgcgcggggagcccgcccgacttcggggaggcagcggggcgccgtggccccgcggctcagctccctgccgggtcgggtgtcccagccctgcgacttccggggcccggcggctcctcggggagctcgtccacaggcagcctccggggcgagagagcgcgcggcgcgggcgccgggacggtccgcggcacgcgggtggagccgccggcgctcgggctcccgcaggggcggcgggcggggcggggtgaggcgggccggccgccctcccctctcctccctcccgcagcccgccctcccttcctccggtcccgcagccaattaggcggccccctcgggcgggaggcgtggggcgctgcataaagcggcggggagctgccaccccgggagcgggctgcgcagtgtccgggccgagccggtgcgccgcagactagggcgcctcgggccagggagcgcggaggagccatggccaccgctaacggggccgtggaaaacgggcagccggacaggaagccgccggccctgccgcgccccatccgcaacctggaggtcaagttcaccaaggtgaggcgggcgcccctcccacccgacggccgcgggcccctgcgctgggcagccagactcggggcggcgggggcgagggagcagcgggccgggggtccgccgggcgccgccgagacccgagcctccctgcccgggcgcggctctccagaaaccgcacctttcgcgggacgtctcgggcgggatcgcaggcggcggggctcggcgctgtgagcctcgaagccgggaaaccgaggccgtccagcgcccgcgcggggccgggccgcccgcatccctgcgaggccccgacgtgtccctgcgctgcccgctttgatcgcgagtggaggtgcgcgccgcgttgactcggagcgcgctggttttggggagctccctccccaaaaacccctgcgatgatttccagggtggacgagtctggctttgagagggtcggagggtccgagagcgccaagagagagtccgggaggcagatggcggagctgcagttggaagactggggaagcgggtcctccgagcaaagcgcagcgggcgccttccgtgcttagtttatacccggctcagcagcagaacgaggaggagtaggaaggtgctcgcttactgacgaaacctccccggagcccagaggtcccggtgtttacacacaaggcgcgcgctccggaaggtcgcagacctgggcctttgggaagcggtgggtcgcgaggccgcagaagcgcacggttctctgcctcctcgctctgtgggctgggaggctacagcgttggcagaacggcgagattacctgcccggggcagaaaggaataaaagaagatggtgaggcctccgaggcctctgagctggggctgaggagggccgagagacccgggtccgggagcgcgacccgatggaggacacccccaggctgtctggcgtgcgcgtctgtcgtgggccggtgctggggcactttagaggcacaggccaggccgagagccattgccttaactttccccacctttggcttctcttgatttttgcttttacccatagcccccaactccagctgacaccgcacttagagaatttcctcatccgttttactttaagaagtagcaattatctttctcaaagaattttaatcaagcggagaaagttgcagggcactatgtgtggccttcagatttgggtctcttggcacttaattcccaatgtcggctgagcctctgatcacaagacatttaaattaactgttttcagaaggctctgtaatcaacaaagacacgtcgctgtaaactaaacgctggaaattattcttaatgtagttttatttgtaatatcagcttcagagtgaaaattccaacacgaattctgggaagagtgaaaatggtacccgaattttgtaagaccctaaccccaggtgcttggctgctgctactgatggttaagtggggaggttgtttgttttcttttggttgtacaggatttcaaaatactgtatatagaaaccagacagtaaatgtattatggtccttttactttttatgtttttgagtcctatcagcaatctgaccacatacaaaaagtttacctctttctctatgatttttaggacacttttaaagtgtagatgtagcccttatggagaccttagacaattcacagagcaatggttgcctgttgtcttggtgggtgcgcaacctttgccagttaaagggaaccagtgcaggaatgaggctgagggaagctggtggatcggcctggagtgctgggatcttgagtggtctcccaggcgataaaggccccaactgcctgacaccggctgctggctcctcacccgttgggggactgtgctgctgcctgctctgtcctggctcctggcccatctctgcagagacctccccatagcagttgtggacccaggcagcttgtgtggctgagggtggccaaccagtgccctggcacagtcctcagggagactggactggagaggcggccgagagtgaggccaccaagagtgcctgccgagggaaggagcgggataaactgaagtgcaggactgaggcccagagtgggcgagtggcccggcaggtgggtggcctggcaggagagcagacggtggagcatgggagccagcagtggtctgctattttccaaaattgactcatggtgcttctcgataatggggcacacaccagagttggtccatctgagccctagccccggcagtgccatttcccagggtggtccaactttcaggatgactttgtcaaagccccttcatttgtcctcacatgttaacatttcattctctagggtcatgctgtgtgattctggagagctgagagcccctccagggtccccacacagatctcagaggatagaagtcccttctaatttagagggcctctttctttccttataaaatttcttccagtagcagggattctcttcaaagttttctgatttttaaaacaccggtttttattatctctcttatgaaaaataaaattcccccaaatctccttttctgaaaacatattctttttgagtttagctgagtggcctgttgtcagatggaagttacgggaaatcggcatcaataggattcacttgtatgactgtcatcttcacctctgcctgagacaccttacagctccgtcctgcttccatgtcattctgttccttttgtaaaatgtgaaccaggtctacagctcaatgtagcttaatgctatacctctataaggtttgttgtatgctaatccacaaatcaaagacaacaattccttctagaccctttaccctgatttggagttcaaaacaatacagccagcataatcagtagaccatatttatataccctttccttatatttgtgcttttgttttgttttaatggagagaaaaatcaacagtagaaaccacttacaagattacttactactgtagtgtggtataaagtaaaagattttacaaaattaaaaacatagtgatgggaaaatatggttagagtcaaacagtctgatttttttttaaggttgctggttacagatcaatgtcatgaacaaacagtaattttttttggaggagcatgcttggagatgaagtatagcagtatagcagacatccgatcattgtaatctgttttcagcccccttatttatattctcttctgccaccttctcattttccctcccccttggagttgataccaggaaggacctagaatcagcaattttcactgacagtctctattatctaacccacgaaatttcatctttctacaaatgggcccctcttcctggctgcactttcctccccgcactaacttaactcttcttcctcagttattaatttctcgctgttaccaagtgatgacttgctggatggcaaaagtgaactcttggatttagtttcagctggaagaataaacctgtaattgtagcctggccttttcctggtgcgcttccctgggggcctggcctcacattggagacgctaagcttccagaagccagacaggcaaatcccaatggtgaccgatgctctcagttctggattccaaactggggggcagctggtctctgctcacctgcccagccagagtctgcctcctgtgcttggtccccaaccgactcagaccaggcttcctcactatgagcttcagaggtttttgtgggttttttttttttttaacattctatcaacttttaagttctggggtacatgtgcaggatgtgcaggtttgttacataggtaaacatgtgccatggtggtttgctgcatggatcaacccatcacccaggtattaagccggagctgtggagtttatacaggaagcccaatacagagaatgtaaccaagactcatgcttaggagatggctgccctctctcatctgtcatcactggggagtcaaatgtttcaaatgaatcaatttcacaataattgaaattagcccttgagggacgcaattcttcctttaaacaattcaaaaagaagcaaagtaaagctatgtataccacatgcagatagatgtaaaaacggaacctgatgaactaattctgtactcagaaattactgacggcattttacttgagagacatgcgtgtcagccatttctgccacgggggttcttctgatgctgtgataggctgtgatgaggaagccattccaagttggtgtagcaggagtttgtgtgtcttctggctgggcagccggggacctccgtgctgtcggaatgtgttttgtatattgtctgtcatgtctcttcctagttttttccaaaagccctctcttttaatatgacattaataagacaattagaacttagtgtaaactaacagtaaatagtacatatgtttcagtgcatggacttcgtatgttcttcttagtctgctcatgatgtcttttgtcaaaaaaactttcattctcatctgcattctggatcattgaggttcccagaaaagtgatttctgcgggttatataaacagttatttgcgacatctcttaatgtaacctggaaagtttctaacccagacatttaactttgtacttcaacgctggtttattatcaagcttcggaggtttttctgggtttttttttttttttgacattttatcaacttttattttaagttctagggtacatgtgcaggatgtgcaggtctgtgacataggtaaacatgcgccatggtggtttgctatgaaaatacacattttaaggggaatgtgctggggagggacatgctgatgtgcattggtgaaaactgaagggcgatggtgagatcctcctcaaagtgagctccttggcaatcaatcttgctgagtgttgccactgaaaggagaaagggagtgctcggtgcgtccttacccttcaggggcaggcggactgcttgggacttttatgtatataaacctattgactcttcccccaaagtctattggggtatgagattccattcacagcctctatttaaccatttaacttagccattcctctgtgaatccatgttattgctgaagataataataataatttagaaaaaaatctctaagtgactatagttttatttgaccaaaacttgaatttcgagtctgtcctagttgatctgttggtcatgcagtcctgggactctgttcccctccgggtctcatctataagatgtcgaaggggagagggaagcagcagagaggaaggtggacaagatggataagacgtcacctaaggtccttagcatgttgaaattatatgattttgatctaaacctaattggttacacttcctttcctggttagatatttatcaacaatgaatggcacgaatccaagagtgggaaaaagtttgctacatgtaacccttcaactcgggagcaaatatgtgaagtggaagaaggagataaggtaaatacttaaaataaatttgctctaagtaattcaattatggatgaccaaaggataaggaaacggttcggcttagctataagacagaactggcctatcctgggggcagggcctgggctagctgcgtgaattggcatgtggttctcagacgtgtggcacagaatggcatcaattaccgatgatcctctgcagagaatcattctcccttgatagatgtttctcctactatgaggatgacctcagctatcctcatcatatggctaaaggaaaggttttcttttttcttttttttttttttttatcaattatttggacctggaggcattaaagaatctttccagaaagcatttcccgctggtgtgtttcacgaaatgaagctttctggcagaagacactttagaaaaaaatagacactttgaaggaaaaaaaatagttgctacccgggtgatgcggggatagttaacaatgtaaccaccagatttcttttctcctagaaatttacatgagcatggaaagcggtaacctttatcactctatttgcaagtgcaaggtctatatagtaatacagaagctaagggacttccgaatgtgtcctttatacattgcaaggccatcaaatctattctgaatgtcagtgcagaggtaaagcccttccactgagggcagggagatgtaaatgtttccttagctgctggagtgctggactgatgttcttggtcagcaaactgatgacgttggaagtggatgcagtgaagggcgtgtgcagagtaggcttggattttatcttgcccatgagtttttgtgacagacgtgcaaatgcacactggccccacctatacagacccccctctgtgtggcacctcatgacagttaggctctgctaacaaagaaagtggcacagaggagctcatagaaaaatgtgagggcattggggggaagccatgacatggaatggggtttccactaggagactcccaagtgccccgtacaggtgctaggaggagaacgagacccttgccctgggccttgatttctcccttggtctgagtgactgttctgagccagaggccaccacaccctctgcagctggaaaggtcctggcctccaccccagagcctgggagaagaaattcagtgtcccacatctcccctgccaagcttctgctcacccccaagccagctctggacacacagagactcggtagagtcactcctgactggtgtcccacatccactccctgctgtaccttcctagaaagagagaggcatggaggggccttcgagatgaatgtggcccattttcctgagaaaaagagacagtgacactactctaaatggccctcacttctttccttttagaaagaaggttccgttgtgattattctatcagtgcacaaaagatccagttctgctcccatggggtgggtgaggctgaagggagaaaaacggccttcatgctcctccctgtctgcgaactgttccacgatggtcagttctgcaatccagaaaggaaggaatttccccattctcactcttggaccacaagttcccagctgggatcaaatgccaggcagacacttcccacctgatctgtgaacagcaggctcgtgtgcgttcacactgaggcagccagtggaaagtccttccgtacttgggtccctgagaaaaatactctttaggaaatatttttaaatgctttttataatcagaaacaaacattggtatttggccactgtagaaatattaagatgtaaagaagaaaaaaaatcacttgaacgctcccagccattcaagtgattgaaaaacatgctgctgcttgcagcctgtctgccagcgggacaatctgctgttctctataactgatggccgtggtcccaaactgcagtcacgtcaaaagatgacacccaaactgcagtcacctcaaaagatgacacccaaactgcagtcacgtcaaaagatgacacccaaactgcagtcacctcaaaagatgacacccaaactgcagtcacctcaaaagatgacaccgaaactgcagtcacttcaaaagatgacacccaaactgcagtcacgtcaaaagatgacacccaaactgcagtcacctcaaaagatgacacccaaacttcagtcacgtcaaaagatgacacccaaactgcagtcacgtcaaaagatgacagtctctctctgttgttctggtcgctcagcccgacgtggacaaggctgtggaggctgcacaggttgccttccagaggggctcgccatggcgccggctggatgccctgagtcgtgggcggctgctgcaccagctggctgacctggtggagagggaccgcgccaccttggccgtgagtacatgcacttgggggccggtgggggatgagccagcctcactgagggtcctgtccaccatggggtatgggaaaaaagatcacggtcctggttttgtgtggtcgtgggtctgttccatcctctgagacacggctctctggcaatacttgcaggtgttaatgcctctagactgaatccctttcattttgaagtcagacttttgtcctctgcagctcagcttcttgaccaagttgttgtctataggcagttgagctacatcagtggtctcagacttggggcactcacagattggtgaccatgagctgggccatatcctggtaccacctgtgtgtttatgtacttaacttttttcttttttgtataaacttccttttatttattttattttatttatttttttgagacagagtctccctctgtcacccaggctggagtgcagtggcgcgatctcggctcactgcagcctctgcctcccaggttaaaatgattctcttgcctcagcctcctgagtagctgggactacaggtgcctgccaccatgcccggctaatttttatatttgtaacagagacagggtttcatcatgttggccaggtcttgaactcctggtctcgaactcctggcctcaggtgatctaccggccttggcctcccaaagtgctgggattacagatgtgagccactgcacccagccttaactcccttttaaacttaagtttaatctcatcctaagaaacaatattcatgaaatcacaggtttgatgtgctaattttatttttctaatacttaccaaaataaatgccaccacttaacatagaaaaaattgttcccatgtgacctaaaatcattcctcagtcacccctgaactggctagtagcgagcatatgtggagcggtggtgagggcaggatagcctggttataggaaacctcagaataggaaagacctgggttcaaatccccactctgccacttactagctgtgtgactttggacaagttgtgaaacctctctgagatttatttcttcatgtaaaatgtcaccgataatgataactcagtggtgtaagaatgatctatttaagattctaggcagagtccctggcaggcagtaagcactaaatagatgacagctatcattaataatagcagttatcataatgaggtcatgtgaagacccattttctaacctcacctacatgcactgctggccagtaatttctagataccctaggtggggatattgatggagcataccccatgaggctgagctgccaaggcattcatcagttgtaagtccattttttagcaggatcctcagaccctcctctggtcatgagggagtgatcagaggacatctcagggccacgttgggccatgaggtcctttgcatcctgtccttgcccatctcagcctcttgtttttaaaagttgttccaaaccttgaggcccggttgtaggggaggagatctcctttctggcctttgatttggaaaaatggtttttctgatgtcgggaacaagcagtagggtagccactgtttaaaggagggtgtcagccaggacacggaaattgctgttgcccctgaatgtgtttctcagggtggaggaactctcaggccgtactcttgggtgcatttccctaagggtgcatccacacagaaactcgagctccccttccttccttcccagtcagcccggccagtccacatgttccccgggtgagagtagctccctcccagggtaagcgcttctctctgaggagcctctggtttcttcctgcaacgtaagccagcgtcaaccctcaagctgccaaactggctttttcaaaaacatttctgttttcacccggcatgagctcatcggtcggcaatgtccgtgtggactaatagcaggctagagaggatgtgccctgggcaccccccgccctgaaccctgtccttaagtgtcagtatcatcttaggagcagaggctacaaagccaccttcatcttcaggctgccccattgtcctggcacgactgtgttttgatagcagacagctttggaggatctcagaatgcaaacccagcaaatcacttctgccactggcacctcgcagcccacgagaaataagatccagctctttgccacaacatgaaagggacaagagaattactggcaaacacggtttttaaaactccaaccacatcacaggagagcgccccttgctctccacctcgatatggtttccgtgcatgttcatggagcgtgttctcttgccggctcagtggtttgacagagctgggtgtttatttctgtgctcagtgtctggaaacagatgtgggggatccagcggcccctggatggctttcctttgctggggcacccaggccccaactctgctctttgggcgctcattttgggagctcccaaacggaagccctccctatccactctccttttcaccccaagtgccatttctgggtcctctcgttgtaagccctgccgtgctgttttcctggcacttcccgtcattctttagtatctgagggttctgatgtgttaatttctcaggaggcacattttcctcttaaaatgttaaaggaaataaacttaggagtggctatggtttactcatgattgagccacagtaacaagttgtttaaaggatgactgtttcaatctgtagcgagcacttggactcactcacctgcataattttttttaataatttcccgtctaaacctatcatgacctgggttttgctcagagaaattccataaaactaacctggtaaattcatgttgtcactccagtaagcaaacttgctgaagttgacaataaaaacaaatagcaatgctggctgaatgttcgccatgtacctggcttgttgacctgtaggatttattatctcatttcagagatgagaaactgaggcccagagaggttaagtaacctgtcctaggtcacccagccagaggtggtaatccaggactggaggcagaatcttggctccatgtctcgcgcttaccctcagtgctggatgttgaagtcctctctcttgttccatcccagaaaagagcaaagaataaacttgcaattccactgacagatatgcagatactgtctggaataggtcagtcttagaggcctttttgcactatttgcaattgctaggcttcccctggaaaaatgaaagttcacgcttgagtgaaaatctataggaaccaacactagagtatacttgatgtcacactggcctgactcagtccctgagtggcagctgctgggggcagaacacacaccccaagctagaccagtcctgtggtctttagcaacccagtgcgctgtctgggtccccaggtgaggatcgccaagcccttctctggtgcctaaagggaagttgatgatagtcagtgtaatcatcagtgttctcatgtgaacaccaatccagcactcaccatgggcgggcactgtggttgctgctctgtggacactgactcctttcactctaacgctggccctgtgaggtaggaaccgttattattcttattttacagatgaggaaactgaggcaaggagtgattcagggacttacccaaggcccacttacttaactagggttcagcagatgtagttgcctcctatttaaagggggcttggctcattcctgaagcaaaggggagctggggtagcccgagcatccggagtggctgccctgcagtctttccagacacacctgtccaggagcagcctgtaaaggccagtcgctgtgctggccagaagtagatgcccccaattcagctgctgcattactgggtggccttggccaagtcactgggccgttagcgtccgtgcctgcaccttgaagtgggaatgcagtcatggagctcaaagggtgagacatcggggagtgcgctggggttaaagccctggatctgaggaggggccttcttcctttttcaatcaccatctcactccactgactcttccacaagaatccagccctgggctatgtgtcagggcggccacttcctgcagaggcggatgactggcggtttcagcgctgggctcaactggggccacttgtctgagggacaaaggggttctcttccaccccggctggaaatagaaaagaatccctgccattgagtggctgcacactcgccctgggtaatcacctccctcaccagcagggcagtctgctcccttccgactctgcatccggccggccgggctctgcagtgcaggagggaaggattgcatctttgtgctgggggcgcgacccttctcggctcagtcactttccacagccacactggccagcctggccgagaaggaagagcctacatcttctctttctcttttgttcgaggagggcagctcccactgcagccaccccagagccagctaaccttcagagagcttcctgggaacacacaagcacacacgactggccacacagcagaggccactgtgctacagatggaagatcagatgccagtgtgcgttccttcccagcacagctttaaatccgcctggcctccaaggggcccttcaaagagggtgcatgtctatgttttagcccaccaccctgcagcccactttaggtgttttgaaataaaagcaatcctcacactcagagacaggcctcgctttacatttggtgtcatgctttctgaagaggtgcatctgactgtgaggtctacagagcaatgtcctaggactgtgttctctccccaacttccatctttaacaacctgacagtgcaaaagaaaagcaagctatgtccgaaacagacatcatcttgttattgcaggccctggagacgatggatacagggaagccatttcttcatgcttttttcatcgacctggagggctgtattagaaccctcagatactttgcagggtgggcagacaaaatccagggcaagaccatccccacaggtgagcaaggtggattatagcttcatttgggatccctttggggctatatcttttcattaatccagagccccccctgactgtttccctaaggcaccattcccaaccccactccctctccaaatggtactgccaattcttcttctaagaacttcacttttaaagttgaggtcaaatcacttctctgtataatagacaagacttgaatctggcacccttgttggtttctttcttgtctttttactacttgaagttcctaacctggactaagtgagtgtgtccttccccaccatgtaaccctcttccagatgacaacgtcgtgtgcttcaccaggcatgagcccattggtgtctgtggggccatcactccagtaagtatggcagcctttctcagtagattctatgtagatcctgccccactgccctgtgtcctttggaatcaatttctggtgtgtttttatctgattgcaccagcgttgaacaagcattttcttcgtggcatggaactccatgcttgggggctcttgagatggattagaccccatttctgctctcctaagaccggctttaggcatgccacagaaagcactgtggttcccagccagagtggtcaggaatggccagcattcccaggaaggtggtctcttagctgggccttaaagataagaaagacttgttcaacaaggaaaaggattttccaaggagtgggaatggcctaggcaaaagtgcagaggtggctgggctacttggaagggaacagcaggaaagctggtggggctagagctcaggcaggagcaaaagtgaggaaaagggtgagcacacgtggcaggtggtgtgggccagcttccagcagctttggctgctaaggggccgggactttattcattgggcggtggggatgcttataggtgcccaagaagtgcaacaatgctgcctgtctgtttgggaagcctctggccattgcaacaacagccaggcaggaagctgaagagccaggtggcaacatgaagtgagggttcaaaaagtgcccatggaggcagggaggaggacacgtcttcagcagatgttttagagggagaggtagaacacatgcaacagcatcctctttgcaaaggctgcctattagtaccacccagaatgcagtttaggaagtgctgtgcaggattgcagttctgatcattgcacactcctatgttaccccacataccccaaatccagaccatgaaaagcaagtgtcctccacaaaggcatcgttgagcacatgggacagggtaagagggtggatctgggcctccaaagcccctgtgctctgtcgcagtggaacttccccctgctgatgctggtgtggaagctggcacccgccctctgctgtgggaacaccatggtcctgaagcctgcggagcagacacctctcaccgccctttatctcggctctctgatcaaagaggtgagacatccaaaaagaaaatatcacatgttcttggtaacattcccactcctaggaaccaggccaccgtcacgagatgggacagtggcagactgctggcaatcgagtgggaagggaatgacttccagtgttttgtttggcgactgcacgttctttctcctgcttgtggccactgagctggagaaactccattcctcccagtggtcctaatgagaatgcttaactcttattatgggctcaaacctatggttgaggacccagtggtttgtctagagaattttcagggggggtcaaccaagagggagccaaatatttgggaggttctctgggatttgcattctcagtttatgaaatggtccatttttctctggagaggtggcctcgtcagctctagctgggcggctgcagcagtccgtgtgccgggtccctgctaatcagtgccctctgctctgaatgcaatctcttctccctcaggcagccagaacttagggaaacagaggctcaatgggacacctccttccagacatacctttagtcattccatccccaggttgtatggagcaaagatttagagaaagcaacaggaagcaaagagggacagaagaaaagatccattcctttctcttcttagtcgggctgatatgaccggcaggcaggtccacagttgcttagaagcaaggtgggaacagctggtgatgagccaattttccactttcctttggtgatgtggggcataattaagtcacactggtgagacttaggaatgtgaaaatcccaactgttaagaaacagtgcctaaaaatctaaagactcaagcagcgtgcctaaaatcttgattttctgaaataatgtgttctaagtaagactcagcacaggtggggaagagcatcctccacctcgtttgttttgtgttctcgcctgataaagaggcttagtatatgaaaaacacgaggcatgaacgtgaacgaggtggcagtccctgccttccagaagggcttgctccaggtgagacccaggttgaacaagcaaagaactttaagggagtgataccctgtcaccatttggaataataacgggtctgattaaaaaatgaaaactgggctcacgcctgtaatcccaggactttgggaagccgaggtgggtggatcacgaggtcaggagatcgagaccatcctggctaacacagtgaaaccccatctctacttaaaaaaaaaaaaattagccaggcgtggtggcgggcacctgtagtcccagctactcaggaggctgagacaggagaatggcgtgaacctgggaggcggagcttacagtgagccaagatcgcgccactacactctagccagggcgacagagcaagactccatctcaaaaaaaaaaaaaagaagaaaaaacaaaactgaagctcttggcagatattttgcaggtgcctctgatcctgggcagggcattctgatcaaggtacccctctccccttaacgcatacacacactctccctcacacacacacacaccccacatggaaaggtgctgtgctacaggcgggccatggccaccttgaagcataaccacacatttgcactgcatatcactttgggatggggtccccccccagaaggagaagtgggcatctccccttgcccagcctgcacactgggctggcagcaggggatgagaagcccaggtcagctcccagggtgcccacggtcaactgcttctgggtcctgggtaaatccagcccggcccgggttccctgtggggatgtgaggcagccacggctctctcggcccaaatgtggatccgtggtggatgaagtccgttcttcttcaagtgctatcttgatttcttcccaggccgggttccctccaggagtggtgaacattgtgccaggattcgggcccacagtgggagcagcaatttcttctcaccctcagatcaacaagatcgccttcaccggctccacagaggtaaccctcctcacagggtgctggggaaagtgaaaggggcgtgttatttgacacccgtgagcttttcctttgacaggctttaatatgatttgtttttcttctaaatttgaccatgttttagtacataacaaccagttaaaaaaagtcactggtctagtttccaaactaaataaatatctaatagaactcagaagccttagaagaaaagattgagagataagataaagtagaaatgtaaaatattcatctgtcaaacaccataattaagattaagagataaataacaagctcagagaaaaatagtcgtgatgcatgcagtgctccaagaatttatatccgtcatatgcaaagtgctcctacaagtcaatgaaaaaaaaaaaccaaactgaatggtagaaaaatgggcagttcagagaatagaaatacgacgtgcccattaagcttaaactagtttgctggtaatcaggaaaatgcaaattcaaacaaaatcagactttccttttgcctgccagattgctaagaactgaaatgatactgctgagaatatggggaagcaggtgctcagcgacacttgccctaagatgcacagtgttttggtagcactcatccaacatttaaagtgaaaaacttttcgattcagaagctccatttcaaaaaaagaaaaaactacttagagaaattttctcatgaggcttcagggacatattttcaaggatattatattcattctctggaatgttttacagccgttacaacaaggaaagctgtccatgatctattgttgaagcacaaaacagcaaacggtagaaaattacccacaatattttcccattcgtagaggtgtgtgcttgtagaagtagaaattatctggaaggattcccaagaaatccttactgatggccacctatggggtgggctcggggcagagccggagggaagctgaaggctttctccctgtaattcacatacatctctatgtggaattacttttaatgagaaagtatttcttctgtacttaaaaaagaaaaaaacacccgctgcaatcagtgtccccatccccctccttagttagtccaagccctggtggatgctgttactctccttggagacagacactgccctgtggatggattccagacctcattcagccatcacccatgagcttgctgatgtttaaaatgcgctcacaccttagcattggagaaaacagtctcagacccggaagagcctgggccgcgccttgctagcttctggctctaggcctccgtgtctgcactggtctctgaggatcttcccagctctgaagttcgtggtgctgggctttacttgttgccctagataagtcaccgagtcatgctgggccagccctcccctccaggggtacagtgggcaatgggagagaccccgtgggggccttgagcatgactggtgagtggcttttctgctcatagcgcaccccttcactccctgcctgtctgcggcagcctcagtcttagagtgtgtttccagagaatcggctccttctcatccggaaggctggctgccctcgctacttctctaacacttggaggttccctcagatcacaccaaagagccacacagaaccacccccctactgggctgttggaatttcagctgtttctagtgagaggtagaagagtcaccctgcggtccctgaagccctttaccagactggctggaccagcctgctgggctcagaaggacaggcaccaggacaggttagcgggtggcagccctgttcccagccagctgtgtgggcttccagaggctctaactcacacctgtaagtggagcggcttagaccaaggatcccaggatgtcatggtctggcatgggaggagatgctggcagaggccaggacagtgaagggacggcatcggggcctggagcgcctgggccgagagccaggtggtggcactgccacccgggcttgatcagaatgttcactgatgtttacgcctgggccaagttcagcaacatccaaggtaaattgtgatctgtgttctgtcctggaggttggaaaactggttaaagaagctgcgtcccggagcaatctgaagcgggtgacgctggagctgggggggaagaacccctgcatcgtgtgtgcggacgctgactgtgagtctctgccctcctgggctttgctggggcttcagggcatccatctgtctccccctacttcctggcctgaattcaaaaccaactgagagtaagatgtgtgcacacacagtggggacgcttccaccgtgggcatcctgcccacagtcagccagccgcagacaggcaggtggacatcaaaatgccagctttacttctagcagaaagctgccttctactgccaaaacgatatggcttgagtggcacctgagaggctgcctgtttctgcgccttagcgttaagtttacctgcctgttcctgcagagctggggtcacgaggagcaggtctggcttctcctccagagccccctgggaggagtggggagggcaggtgctgcccactcccagtcattcattctcccctccaagtcacatttcctatcatatgttttaagatccctgaagagtggaggtgctctttccttgtgtctcagacctgataaatcagaggagggcagtagcaactgatccttcaaattacccgctttgcctggttctaggcctgcacccctgccctgggaaagcaacctgcccagcagtttggggatagcttgcgtcttgacagccaaacgacacagcgttaaaatatatgctattgttggctgccatgtccacaagagggaaggaagggctggccgggcattcattcacctgctgacagggtcagctatcaaaaggtgtgacttcccaagtgccttgaaacacctttgccttaaagaatagcctcccagacctgtccacgggtgccagaaattcctgtcgtggagaacaaagcctttcacttcacactcagataaggttggaattgcaaatatccccaagaaaaatgaccctggcacaatttcttactaaggtgtaaatgactgatatcagttcctttctggcagctggctttcacaatgggagaaaggacaggaggaggatacaggctctcaggaaggaaaggggagctgggtgtgaagatggactttccatttcttgcctgggtcagtgttcccttgtggaagcaccattagtgctatgaatagcaagtggtttttggagccacacggagcatttctggcactgtgactcacatttggagtcccaaacagccaggactcctgttttgctttcctgtgccaccgtatctggatacgccacctgcactgaagttcatcttcctcctcttggggaggaaaactgcagctaaagcacaggactaattgtgtttggggcttggttttacttacgagggtcataaaaacatgctgtgtagccacctccttctcctcatcagggcggtgccagtccacaaattacatcctgacataaccagcatcccaggcaagacatcaagggtaacaagccaccattcccctgccccttcgcctcacccctagctccgtcaggagcaggaaatgagtctgttatctcggaggaggggcagttccaagttgggacctggcccagccagctgcaggggtcaagggtgcagagaggtacccccaaaccttatggtgctgtcctgctgccactgaaacttccacaaatgactcagctagataggagcagcctccttctcaaagccaagggcacagtcccttggagcagcccctgtggaattggaacggatcaccttccaatgcccagagccactgccagcctctatgcaaaggaaagctgcatttcttaagaaagcaatagtgcgggggttggtggtgatgaaaccagccaacggttgaacactagaaacccctctgtagatgtaaatgacatcccaataccattcttatccactaagcgtgtcccccaagatcttattctctaaataccctctggcttggtttgaataactggttttagttcaatgtcagctctgcaacttagtcagcccttctaagtcacacacatgatattatcttacttaataagacccttcttttactcaaggtggaacattttggcttctttagaagttctcgccagggggcctacatcaataattaccgaagtttattctataaaacattagtcctctagaaaaaggggaggggaggggagtcctctagaaaaaggcaagtgaaatggagggtgctatgactctctggacttattagcatattaaaggtactgagaagtcctgcagtcagggaattgatttaaccccaaacttggtggaccccaaaatcctttctcccttcctctctatttgggaaagtctgcaaacaaaattaatttctgaaatgcagccatcctggggcctgttttcttgtgtgggcaattagaattgcagctgtcaccagtcctgctttaacaacttaatcgcttcctctcgctctgcccgcctccctcgcccctccccctccagtggacttggcagtggagtgtgcccatcagggagtgttcttcaaccaaggccagtgttgcacggcagcctccagggtgttcgtggaggagcaggtctactctgagtttgtcaggcggagcgtggagtatgccaagaaacggcccgtgggagaccccttcgatgtcaaaacagaacaggggcctcaggtaatccccctggtgtgtgtgaaaccatggtgcttgtctaggggctgaagcaggcagtcccatggcaaccgcctacagggtccctctccgtgaaaggaatgctgacctgtcctgcccaggaggctttcttttctttagaaactgatcagaaacacaatcctgtcaggtcccgggggctcacgaaagggggcaggacacactgaggcatgggaggagggcgctattcccagggcagaaggccatctgcctgaaccctccactctccaggatgacctccctacagaaaaggggctgtaggctggctgaaggcagcagagtgcaggcagcgtgtggcctggagtctcagtcgcagcccgaggccctcaagcccacgtgggttacaggacaaggtgaaccatcagaaatcaaacaatcccagacggagagagcctggggcaggagaatgtatctccaggcagtaggaacatgtctctggaggatgagtttgggaagccaaggacaggatgaaaatgatcataaccacgagatttaatatcctctttaaaacggcacatcctgtatcactttcttactaattatgaagtgaagcagatggataaatatttaaaagagggcagcctgaccatcccatgcattattgaaatggagctcagcagtcactcactttgcttttagccaaagtcctgccccagccatgaaatttcaagtcacatgtccgtgacttacccacttgtgtctatcccgggaggctgccacttcccctactgtgacagcactgcatgtttacaggggaggctgctgtggatctgagctcagatttggccctgggttttatgaaagtcacaaaaacccttccatgcctcagtttcctcatctggagagtgggagtaatcaatgaatattatgagaatttcatggcacctaggaagtattcaattatgggcaggttttatttttaaacaggaggaagctttaaatgacaggttctccagtctaggtggcagtgagtgtctgtgcatgacatcaggctgtcctgtggggatgccctggctggggaagaagggagggcctcatggaggaaggatgcatttctggccatcagtgcccaccctccactggccccagtccacacactccgacgccacgtgaccctggcagaaagcacttcttgtggctaacattccttctcctcagtcattgcctgcccagcctgtgccccaaacccagcggtcagtgacacaaggttgtctaatggcctcggctggatttcagatctgaacgcaaacatgaccacaagtcattattgaatccgccgtgagttttaaagctaatccacaatcagtgggaaatatgtgaactgatccccatacagaagaaacttttttaccccgtcgttatttgtaagtctctttctgtggctcttttcttggcttatgcctgatgtctgagtcttgacttttgaggccagatacaccgatttcttccaagagaacagatagaggcagaatgggtgctgatttcatcagtgcatttatgccaccgctcaaagtccttctgaaagctcactaaagccgtctaacctcagcatattattttagaatgctgttggggtttctttttcttccaaagtgctttttcatctacggtaataagattttactctgagaggacttacagctgtctaaatagtcctgtctgtctcatgcctgtaaaacagctagctgacctagatccgggtccacggccgggctagcgctcacaggaatgctccaaaatcattcaggtttatttggcaactgagcaacgaggcacataaacattatgcaggccacctggccgggcaggatccggcagcgtcctccgggcagagagccgagcacagccttgagccagtcctgtgggggccgtatttccctgtttctggtgttgtgccctgctgcgtcatctcacttcctggcaggtctctcttcctgtactgtaaggcaccagctgacatttcatggaggattattagatttaaacaatgtgttcctacgggctctccagggagtgtggagtttggatgtgtaggttttccacggggacccagcactgcctgcaggacaaacagggtctgccagatggcatatgcccagcagccagggaggacctgcggttgggcgaagcccctgtgtcccttttggcccctcagggaggggaagagcagctcagcagcatctggaactgttaacctgagacttggttcacccagagagaagttgagagaaccttgagctcttccgggatctgttgcaaagctgtttttgttactttttttgagtggagtacacatacacgggtcaaaccccaaaacgcctaaaaacgtctatagtgaaaggattcccgcccctcccgcccccacctttgtacacctggttcttacccttctccccacggtatccccagttcttagttcctcatgtttccctctagaatgttttcgtgtgcatgcaagcagatgaatgcaagtcctgattgcctttgttatttttacacggaagtttccatgatagtatatcatcttgcactttgtttattgttccctaaaaaaactggaagagctctttataccagtccatgggaacctgcctgattctttttcacatgtgtatggaattctgctggatgaagccaccagaatttcagtaacatcttctgattagcatgcaggtatgtgcagtcacacacaaggcctcagagtatgtgatttcacacacacacaaggaaatccctgggacagctttcccaaagtgggttgctaagtgggaacacatttctaatttccttaagtgttgctgaattaccttccatagaggctgaaccaacgtgtattcctactaacattctagaagtttgtctgtttctttaccctttccaacagaatatggatttttgcccataggagagttaaaaatgctatcttgtttcattttaatatgcatctaccgcttataataagcaaggtagaacatcttattatatatttaaaaaccgtttgtatttcctttattatcaaatgtgctttgcgtatttttcttgcaagctgttaggcatttttcttatcacttctaagacctctttacatacatagtagagagattagctttctatgaatatgacttgttaatattttttccaagtttgttgttttgctctttgttatgataattttgcccccaccccattttttttacatactcaaaattatacatcttttcttttttggcttctgcattttgagtcattagaaggcactccaagtttgcaggataagtctcccacatataaaacttttatggttttgtttttcctggttatatctttgatctatttggagtttggcctggtataaagtgtgaggtatggatctgagttagtatttttaaactgggtttggagtttggcctggtataaggtgtgaggtatggatctgagttagtatttttaaactgggtttggagtttggcctggtataaggtgtgaggtatggatctgagtcagtatttttaaactgggtttggagtttggcctggtataaagtgtgaggtatggatctgagttagtatttttaaactgggtccatatttcatgagatgattggtcaagtggcatgcacggtttatgccctctctcctgctcctccaggacagaccgtcatccaattgcaccactgggtttgcttctttttctgtttatgatcattggaatgaaaccagttttcccatctaaaaatcccagctaaagtaaacctagtaaagctttgtctctcccagccaaagaggagggagaccagccacagatcatgataaaggacaagattcccatagatttcaggaagaaggaccagtggagggggcagaaagagcattttccctcttgagcagtctcccaaaagggtgcgcttttgacaactgctcagtagcgtgttcacaagctgtgggtcaggctggtggcacagggcaaactccagccaaggagacgtctagacaagatagcaaaagggagagtctttctcatgagctgttcccaccaccaaccaaggagcagccctgccaccccacctggaggctcattctgctttgtccccaggggtgttgagtaaggtggttagcttttcttctcgcttctctgcaccatgacaggagaattccagtaactattaccctgattcacggtgccaactgagcagggcacagggttgccaggtgatacatggcacccaggtaaacatgaatttcagataaacagtaaatgcacttttagcttaagtatatcccaaatattgttttgggacatactaaaaaaaattatgtgtcatttttctgaaattcagattcactgggcatcccgtatttttatttgctaaatttggcaacctgagtagaatgtaaagagttgggagaagaaagactgtgaccacttcagacctgtgtcactcatggactaactttgctgcatggaaaagggagatagaagtgtaaatatgtcccaaacctccagaggatgagactagtctatctccccatctctcccctgctccaaagagcccagctctgtgcatcagaggaatatttgcctgcaaggctcattagttacatggatcatggcttgacaagaacatgcagagggaggatggctgatcatgttgaaggccactgaaaacatgagatggcagccactgcccagaaggaagccaggctgtacttcttgtttgtgtcttgcagattgatcaaaagcagttcgacaaaatcttagagctgatcgagagtgggaagaaggaaggggccaagctggaatgcgggggctcagccatggaagacaaggggctcttcatcaaacccactgtcttctcagaagtcacagacaacatgcggattgccaaagaggaggtacaagggggctgtggcaaggctacgacttgcggggcctttcaaacacgagtccttccctagggcccagggatcccagaaatccttgtgatctgagtgtttttttgtttttgttgctgttgttgtcgttgttgttttttctgtgtggtctttcccctctcctttggggtccctagggaagccgttttgtcctgcctctggcgaactccaagcatgatacagcaggtaccttgtttgttctagctagttttcactcatggctcaccctctctgggagcagcaagccctctctgattttctaacacaaccggtccccgagtcagtcatgcagccgcaggtggagaactgttgccacctgtgggttttgccaggaatcagttcaagaacctgtggattcagggcccaaagccgccttcagtgcccctagactgaatttcaagtgttcactcaaggaacatgtcacagctggaatttttattgacattttccaccacggacgtcttgaaaatgagggaaattaaggagactcccccactcccataagagtgtaaatctttctctttcaactccactgttacactagacgggaactggttcccacacagcatttgtaagaggagagctggatcccaggaggttagaccctggaggtggtattttggggcacataaaaggatgagtccctgccaagggctttctggggcaggtatttcagaggcgtcttccttgagattgttatgtgccgtgatggcatgaagctcagctccttaaacatccctgtgacgagaggtcctggggaacccggaaggtattttggcaggccaggcaccatcctgccggcttataattatgtctaatattgaatcaattacaagctcccttcaaaatcacctttaaatgttcaagccttagttcttccatttccttttctttgctgtgtcacaaactgtggtgaatattgtgtcattccttcccctggtagttattatggaaacgttctagggtgtcttccttggtagaaaacacagctccaagaggtaggagcacagtcttacaaagtgcctgcagatatccttcaggacaactccgaaaaaagttacctaaaggttttgtgttctgtgcatctatgggttactccaaggctctctggctgggtttctcggaaaccctgatgacaacaagacatcttaaacacaacatatattttttgttattattttttatttttgtttcatgttaatccttcccttcagtctccaatggcaatgcagctgaagcaatgtttggacgttctttcttctctaatcatcgtttttcaggcatgtgtgtgctctgggcatatgaaaaacatgtaaagagaaggaaatgcttgttcacagcatgcatttccattcagtcatgcctctcattgccattcttgcaattaatcatagattttcgggccagtgcaaccaatactgaagttcaaaagtatcgaagaagtgataaaaagagcgaatagcaccgactatggactcacagcagccgtgttcacaaaaaatctcgacaaagccctgaagttggcttctgccttagagtctggaacggtctggtgagttgactgtgtgtgtatttcagctctcctgagttgcttcttgctaagttcattattcttctattaactgagagtttctcattgtttacattgtatattatataccaagccctgtctcagtgcttccttccatcctcatgaccatcttctgaggtagctgccattatgtctccatttcagagatgagaaaattgaggcacagagagatgaagtgacttgcccagggtcacacagctagcagatggccgagagggctccagtacctgtgcctgtggcccctgtgctgtactgcccctccaactttattttccattctgattctaaaagcagttcatgcccatctgcaaaatgtggatactagtctctgcctcatcagtaattctgcagattatgttttgtgatccccatattaaagattaatgaattgaggctcagagaggttgagcaataagcccagaatcatataaccaggaagcaggagaactttggggtcagttctgtctcatttcaaagctaattcttattcctctacaccctgatttttctttttctttctttctttcttttttttttttttttttttttgagatggagtcttgctctttcccccaggcaggagtgcagtggcacactctcggctcactgcaacctccacctcccaggttcaagcaattctcctgcctcagcctccccagtagctgggactacaggtgcacgccaccacgcccagctaatttttgtatttttagtagagatggggtttcaccatgttggtcaggctagtcttgaactcctgacctcaggtgatccatccatctcagcctcccgaagtgctgggattacaggcataagtcatcatgcctggccctctcttcttttttctccccttatcatttcattcctatcccaatgaaacacactctgtacttgaggatttccaaattttagttgctgatgagaagaatgagaagacaaaagttgagagcaccctgtgttttcatcaaggaagctttggcaaaagactgtttattagacaatgccctgcactgggggctaagtggctgcagtgccaggagccagggggtcttctccagatgactctgagctttcttccattcttttctaggatcaactgctacaacgccctctatgcacaggctccatttggtggctttaaaatgtcaggaaatggcagagaactgtaagtgtttccatcattctgagcctgccgtgggctgaacactagatccactagatttgcaggcagtgacacaggctccaatctgctgacaccccgtcccccccacaccgccgctctgtctgggccagctgtgtccctctagggttggtggggacccatcccttcctctctccagcccacccttcccacttacatcctcagcctgcccccctccaggcctcggcttttgtgtctgcccagcagccatcatgctggggacattcagtggatatttgacaaaagctccctggacggggacacaggcagaactgaaaaagtgtacttttgccagatgtggggtgtcattattcacacaactccccactcacagcagtgaagacaggtaaggctgacccaggtaaggctcctacctgctgggtccttttttctgagcctagtaggggacctcctcccaggaggcatatgacaacacctcctgctgggcctctgcggccctctcagtatatgcaagcctactgcaaatccctccacatgcgtgtgcaaacccactgcaaacccctccatgcgcgtgcaaacccactgcaaaccctccacgcgtgcatgtaaacccactgcaaacccctccgtgcgtgtgcaaacccactgcaaacccctccacatgtgtgtgcaaactcctcagtgtgtgaacccactgcaaactcctccgtgtgtgtaaacccactgcaaaccctccacgtgtgcatgtaaacccactgcaaacccctccgtgtgtgtgcaaacccactgcaaacccctccacatgtgtgtgcaaactcctcagtgtgtgaacccactgcaaactcctccgtgtgtgtaaacccactgcaaaccctccacgtgtgcatgtaaacccactgcaaacccctttgtgtgtgtgcaaacccactggaaacccctccactgtgtgtgcaaacccactgcaaacccctccacatgtgtgtgcaaactcctcagtgtgtgaacccactgcaaaccccagtgtgtgcaaacccactgcaaacccctccacatgtgtgtgcaaactcctccgtgtgtgtaaacccactgcaaaccccttcgtgtgtgtgcaaacccactgcaaacccctccactgtgtgtgcaaacccctccacacttccttttttgtcctgcctgctgggaaaatgagttccctaggtttagattaatgggtggaacttcttgcgtctggcccacacccagagctggctagagcaacccgggagtggagatgtgtggtttccagccggacactgtcttctctccccagctcaggattttattagcctgtgtggacaaacattttgtaggatcagtgttcccaaggaaccatctgtgacaacaccccaggttcctgggacatctctagggacccaaactcttccttttatttcactagtctgtcctatttatatacaaatgtagtcccttgtttgcacttcttccagcgggaacagactcaaacgcttcccctcaccttgggccttggttggggcctttgtgtggctctcttttgagattcttaaagatgctgtgaagggatgggcctggcttccatccccaaacagatgttcttgaccagtctatgtggaattggggtcctgtccccctcccacctcagtcctgctttgtagtccatccctgactctcagcaaatactccaaggcgtctgcacttgtgagtgaagcctgtccattagccttcccccttatccctgtggctggcttcgccttcagcggacatcagtaattgttggccatgaaacccctttgcagaaattgcatttcctccctctagtggcctgtttgcatttgagttctgtgagcccctgcttcatcacttcttacacctgcccctccagggacaggcagccagggctggggtcaccagggtcccctcttgggccctccaacagcaacagtactggcaacagctgggatttgctgagcacagactctgcagcaggctcggttgagctctctatgcctgttccttcataccatcctcacgcccatccatgagatgggtccagctgttttcagatgagaaaatggcacaggaagctggtaagtgacagtcagaaatgaatgctggcagcttagtccttggacccaccgcagtgcaggaccttgctcaacagggatcacccttgtccgccacctgttcatgaggccacccagggtttgcgtggtcatttgtctcctttcatctgctgccttcaaccagctgggtcattagggctggggaacccagaccccacacagtcctcctcccagacgccagacacagcctcacgccacagcaaggactccagtccccgaagcaaatgtccctgggcgtagaagctgcagggcccccaatccctggtgtgtactgctttgcactggtgattcaccctcattgcaaccttccctcttgccaccctaacagtgcttttggctccttaacaccccctcgcctggcacagagcagggcttggtgaggactcactggacacagcccatgtgtcctcctgccagttagcctccatcgggacttttttgaatgtctgttttttaggcccttggcctatattttctcaaggcttttgataaaatatttaaaaataattcacaaggagcctagaaactgcctggaaaaccaatttctgtcttcagttgtctctaattaatgtcttcatgttgcaagaagttccccttttttaatgctggagcatcgtgcgggggattccatggttttccccgtccccggccacctggactgggctggcttctggccgcccacccacgggcccctccgggagctgtttctgtgcgggtctcaggatggagcctgaaattcctcttcctcctgggagcctttcttctgaataaaaatgatatagtaaccaaaaaatctacgcaatagagatatggaaagtcaaggcttccctccctgaccttcagtcccatttgttagaggtaaacgttgttccatcattcatttgctcattcattcttttgttcacttggcaaatacttcttgagcatctttgattcaccaggcatgatgctaggctctgagcatactgcagtgaacaacacagccaccagtccctgtgcctcctgacattctggtgaggtttaacaggagtaaggctgggctcctggatagctttgaactgcaaagtggttgagactggctgagaatccattgaggagatgtcccactgggttgaataagagcagcaagaatttgaaccaggacagcaacttcagaaatgaaagaatgagaggagctctgtattgattcttaaaggaatgctgtaatcctactgcatgtgttagttatgtgttaattcaatctgatttcatcactttgtttgcgtttcttttctttactaacttgataaataattattggctttgaatttttacaatgcaacattgtattctcacttttagagtgtattgtgcattttatttgcatacaatggatttatatatgtgtgttcttttctgttttcaaatgaaatgggagcaagctacatttcgttattgagactgggttttggatatccttccgttctttttattgatgatctcccatgaggaacttttgtgtatttccaaggggttctgctattacaaaccatgctgatgtacttccttgtgcatacaagtggaagtatacacttgtgggagattgttttcagaataaattactaaaattgagtaatctgccacatgaaaaatgggctcaccactgttttggttacatttctttaatcatgatggcattgagcaccattttcacacttattggtaattcatatttctttttctgaaaactaactattcctgtcctttgttgatttttccatttgggtatttgtgtttttcttgttggtttgcaagagctctttgtatattaaggaaaatcacactctgattttcacacagtgttgtaaattttttttctagtttgtcatttgggagtttttaatggagtctctgctctacaaaaatagaatttagcattctgtttatggcttttatgttttgtgttttatttaggaaagattataaaataattcacttattttcatgggttctggaactatttgttttaggaaatgacctaaaaatctcaatggcacctaccattcattttctgcctaacacatagtaggggctctacatgattatctgtaattgttataattacaaggaggtgatggttttcctatttgatagttgatgaagttgaggctcagggaaggcaaagaacttacctaagcaacatagttctaagccagtggttctccaacttgagtatgcatcagaatcacttggaggacttgttaaaatacagatgtcggccgggcgcggtggctcacgcctgtaatcccagcactttgggaggccgaggcgggcggatcacgaggtcaggagatcgagaccatcctggctaacaaggtgaaaccccgtctctactaaaaatacaaaaaattagccgggcgtggcagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaatacagatgtctgggccccaccatagagtttctgattcagtaagtttattagtcttttattgctcctgcaagaagttaccataacatcagtggcttaaataacataaatctattatcttatagttctgtaggataaaaatctgacacaggtctccctgagctaaaatcaagggcttcattcctttttggaggttctcaggagagaatctacttccttgccttttccatcctctagaggctgctcgcattcctaggctggtggccccatcctccatcttcaaagccagcactgctgctctctgaacctgtttctataatctcattttgctctgcctctcttcttctgccagttttggggacccttgtgattacactgggtctgcctggatgatccaggagagtctccctcttttaaagtcaattgattagtaacttgaattccatctgcaacattaattcttcactctgtagcccaacatattcacaggtttgggggatccaattttggatacctggggagatccttattctgcctacgatagtagggctgggggaggcctgagaatctacatttctagcaagttcagaggtgaggctgatgctgctggtctggggaccacactttgagaaccattgatctaagggaggagatgggattctgtcacaggtctttttaactacagagactccagtggccacctctaccttcatctcttcctaaacaagcacacatttttcttcacctgacagcagatcaagcgcttagaaggatttaaatctctccaaagctgcctcttgggtcttggaagggaagctaccctgaagacggcccatggtgccagggaaggatcacctgagccctgcaagatttaaagaaaggaactataccaaggatgtgaacccaaaagctgtggcctccccatgtccactctgtgctaacgtctgcttctctcatgccccctaggctggcctcactgcctgacagctggtccccagctgtgcactctgaggccagcttcaggcccttggtgttcttcccactggtcctctggccacatccccagccaatagctttgggcctctgcctcttctgtctcctcttcaagcagctcccaattgccatctaaaagttatcaacccagtgtaatttctgcccctccctcgttcacagacaccccaccgtccaccaggctctctcgttttgctctctattgccaccccagggaattcacctctttactttttttaaaatccccttcattctctaaagggaaacccttagtcctggccatttcaaaagcatcacacagaagaagaccttgatatttacatttaagtcacatatgcagctactgacacttactagtgctgttatagtcctggctattattccatgaggtcgtcacattttaaccttttgcataagcctccaacggcctgatggaatgatgaagcctcagaacagtttctacacaatggctaagggatgtacccattttgaattttcctcttttctgtgatcacagaggtgaatacgctttggccgaatacacagaagtgaaaactgtcaccatcaaacttggcgacaagaacccctgaaggaaaggcggggctccttcctcaaacatcggacggcggaatgtggcagatgaaatgtgctggaggaaaaaaatgacatttctgaccttcccgggacacattcttctggaggctttacatctactggagttgaatgattgctgttttcctctcactctcctgtttattcaccagactggggatgcctataggttgtctgtgaaatcgcagtcctgcctggggagggagctgttggccatttctgtgtttccctttaaaccagatcctggagacagtgagatactcagggcgttgttaacagggagtggtatttgaagtgtccagcagttgcttgaaatgctttgccgaatctgactccagtaagaatgtgggaaaaccccctgtgtgttctgcaagcagggctcttgcaccagcggtctcctcagggtggacctgcttacagagcaagccacgcctctttccgaggtgaaggtgggaccattccttgggaaaggattcacagtaaggttttttggtttttgttttttgttttcttgtttttaaaaaaaggatttcacagtgagaaagttttggttagtgcataccgtggaagggcgccagggtctttgtggattgcatgttgacattgaccgtgagattcggcttcaaaccaatactgcctttggaatatgacagaatcaatagcccagagagcttagtcaaagacgatatcacggtctaccttaaccaaggcactttcttaagcagaaaatattgttgaggttacctttgctgctaaagatccaatcttctaacgccacaacagcatagcaaatcctaggataattcacctcctcatttgacaaatcagagctgtaattcgctttaacaaattacgcatttctatcacgttcactaacagcttatgataagtctgtgtagtcttccttttctccagttctgttacccaatttagattagtaaagcgtacacaactggaaagactgctgtaataacacagccttgttatttttaagtcctattttgatattaatttctgattagttagtaaataacacctggattctatggaggacctcggtcttcatccaagtggcctgagtatttcactggcaggttgtgaatttttcttttcctctttggggatccaaatgatgatgtgcaatttcatgttttaacttgggaaactgaaagtgttcccatatagcttcaaaaacaaaaacaaatgtgttatccgacggatacttttatggttactaactagtactttcctaattgggaaagtagtgcttaagtttgcaaattaagttggggagggcaataataaaatgagggcccgtaacagaaccagtgtgtgtataacgaaaaccatgtataaaatgggcctatcacccttgtcagagatataaattaccacatttgccttcccttcatcagctaacacttatcacttatactaccaataacttgttaaatcaggatttggcttcatacactgaattttcagtattttatctcaagtagatatagacactaaccttgatagtgatacgttagagggttcctattcttccattgtacgataatgtctttaatatgaaatgctacattatttataattggtagagttattgtatctttttatagttgtaagtacacagaggtggtatatttaaacttctgtaatatactgtatttagaaatggaaatatatatagtgttaggtttcacttcttttaaggtttacccctgtggtgtggtttaaaaatctataggcctgggaattccgatcctagctgcagatcgcatcccacaatgcgagaatgataaaataaaattggatatttgagaaacattgtgctttttcatttaaagaccaaagtcatttgaattcgatggcaggcctttctctttctgagacctgtacgaaatggctgatattaaagcaggatcaataatgtaagcataaaattacatttgctcagtcagtcgggcccagtgctttgcctgagtgtgaaacccatttctgtgggcttgggggttgaccaggcaaggagctgggcctcagaggttccatgtcatagctggctgagtttcagctgttatctaagctgcctgagtctccttttatcataaagtagtgatggtgtcagtgtgcgaaatggtggggaggactgcatgaggattgacggacagcattgtgcccctgacggtgagcacaagtgtctgtttttgtcaccttttcctctagagaaatctagaggatctagagaaaggatcaatttgggttttactgacctcaagtttctaaagcttctaaccaagaagcctcaatcaccccgttgtgagctgacgctgccattggctcaagatcattgctggtactggggtatgtcctccaagctcatcccttgcatttgatgtggaaagcccagatcattttgacatgggtggcaaagcaccaccactttaacaaaaaagggaggctgggatcagatctctcgtaacatatgcacttatgttaagagaatttagacacattatttagagacatcccatttctcaatccaaatgtgagcaggaaactgtaggagaaggatattttccctcatttggtgtcccggaacatgactccctgaagggagccattctggggacaattggagggtgtggtatgcgtgtgcacacatgcatttgtgtgcctggtgtgcgtgtgggggttggcacctctctagaagtggaccctttgggatgtcctagcttctcctgctggtggatgaagcctttctaatggctttgctccttgctcctaggcatgagcttgaagggggataatgaagggcgtttaggaagttgctcaaggaagactgtctgaggaaactgcgtactgggctgaagaaagacaaccggaaaacactgaaggagcgctcagccactgcaccttcaaaaaggcagaaaagtcagttcagggaggtgcctcccagctaccccacccacctcaggaggggtcattccaacctagggtgctgagaatctgggtgggattaccagcaaaagctagagaaccatgggtcagcgacccttaggaagaagtggaaaggagtcttaacttacctgcaataaccttcctatgcgaagttgtggctaacgcatgcctaatggctagaattaaatgctgggaatataacgagctcagcacaggttatccgcgtgtcagatgttcctgctgtcttctacagtggggacatttcctagcctattcccaggctcctttagaagggaagtggaggtgccccatcttcacctgccgcgtcccctccagcgtctgcccgggccctgggcctgcgctccctcgcggtggcgccaggtggcggggctgcgcgccctggaggagctgcaccgccgtcgcggggctctctcagcactgaggacaccacgccctgcaaattgttgggaacttgtcggtggcaatcacactgctggctcctgcaaactggtgtgaggccctcaggggtgagaacaggattgcagaactgcgctcacccttttggaaagtcgtccagtggcagaagtagcctcccaggagcagagcgaagctgctcggtggtcccctctccaaccagggacccaagaagccgctcaagggaacacggccccgcggcgtccgggaggtcctgcaggagccctgcggctgccccggttctgtgaaatggcagtgagggtgggggagatgtgcgctaaatcctgggaacgtgcgagtcataactttccaggagaggggcccagggcgctggtcctgcagggcgtggaaccctctgctcttcctgagcaggctttgtccccgggtcgacacggggagctcagcgtgaggcccgcctgcagcgtggacgcagatcttttttatggtctgcgtttctgtattagcctcagcagcctggtgacgcctttataaaaggtcgaaacacgataaattgccaatattccacgttttatgtattccccccaaagccgacaattaacaatgactcaccgagcagcagattctttgcacacatccataattgaatcagtaaaatccatgtgttggaggatatgcaaattgcaggtcgttaacgctttagaacgacacatttctgtatcgccccgtgaagagctctacgcacatgaatgttccccgtctgtttaactgttacggccgcagtgtgtgggccgcaggcgcgctgggggctcatctgctgattttgctgcccctggagcagagggatagcgaaagcggggctgagcgcagcacggaccgatcccatcgccgcgctcgccccgcgtggaggcagccgggtgcccgaacctgaaggaggacccggtgccggaagggcccgcggaccccggcgtctcccggggcatcgagcgccatcgcccgcgttttacggccagggaaactgaggcggccgccgaggggacgcctcgcgacggttcctgggagagctggcggcggccttgctctgcgcgctcttcgcgccgccctccccgcccgcccgcctcaggattgaggaagtgcgtctgggcccggccccggcgcggggggcagacggcggtgggacggccaggccccggccccgccagtgtgtccgcccggccccgcgtcccggagcgcccgcacccggccccgccgccgcctcaggtaagcgccgctcctgccggcgccccccggcggcctggctgcctcccggccccgcccggggaacccagagcccgcgcccggcgcccgcggggagcctcggcctctgcctgcccgcgggcccctgcgctccgggcggccgcgtggtcgggcacggggggccgttgcgcaggggccgcggcccgaggggcgcggagggcgtgtggggcgaccccggtctcacgtccccgctgcctcccgccgcgcccggagcccagccagcctgtgggaggggagcgcgcggggcccgagcagggaaccccgaaaccccgtccgggcagggtcgggaaagctgggaagcggaggcaagagacacgagtcgggagacacgagccggggagcccataggtttcctctgcctttggagcgaacccagtcccttagcggggagcgggcggagtgtgagcgcgcgggtgagcccgtgccggggtgtcggcaagagaccgcccgggagcctctcgctggtccggggcttcctggggttgcggggcggcccagcgaggcttcaccctcctcgatgtctgggtcacgcttcttgcccaggtggtctctggctggcgcagatacaactgctctgtctaccatggtctctgcaagctacaggggaccttcctggcaggcagggacgcgggaaggaagcctaggaaggccggggtcagcgaggagacgctggtggagaatctgagaacccccgtggccatctcaacctaccccttcacagtatgaggccgcgaagtttttctcccacgaacacttcccctgcaacaggtagagaaacgggggcatatagctttcagcaaacctctcaccgtgtacactaatgatagagtttgccagccactcacagggtatcaaaatgcccagacattaaagggatagctagaacatgcacaattttggaaaatgttaacattaaacgccttttatgatttgattctcttcatctttgcctatgtcctgaaagagaaaataatataacaaactaacctcacacctaatttgttcctaaaggaggttttgcggtcagccaaacctttccctctcccaaaagtcgatgtctctggcagtgacctcgcagtcaactcggatcctcagataaaaaacattcagtctgttgaatctatgtctaaaatgtgtcctgatctgtcccctttttcttatgcccccaccccccaccctgccccttgtccagggtaccagcatctctttactgtaggatttcagttcccccttcctccattctctatatagcagcgtgcgtctgtgtgtgtctgtgtgtttaaatgggtaaatcagaccatatcagtcctctttatggagtccttcagtagcttctccttgcaactggcacgcaatccaggagacctccttctcctcacacccccagctgatccagcctctgctgtctcggaccaccaggccattgccccaggccacactggctgagcttgctgtccagcactggtcccctgcactgctgcctcctgactcttcacacagcctcagaaagtcttccctggtcaccctctgaaaacccacgctccctctcacatccctcactctgcagcctccctgcagtccccattctgtactccttctttatctgtttaatttctccttaattatcttgtggtctccactggagctcttggggtcagagactgatctgtcttgcttattgctgtgccctcattcccataactgtacagggagataccccgtgcatggtggtagagtgactggatggggaatggacaaccctaacttacctgtggtttcagactcatggagcatttctctcctccaccctttttgggctcatctgggattgagaacaacatatttctctggcctgcagctccaagatatttggatgcccccaaacccattaaacacattttataggcaaaagccaatgctagtaagggatgcaaatagcactcaagagatttctagaatcatgggctaaccattttgaccaggattttgtttcaaaaaggaactaggtgatatgaatgagcatgtctagcatgctttgcttgcaagggacttctaacttctaactgatatcgacagtccttcccaagcctcctaaaatatctgggcttctctgctgtcagaagctttatagcaattacttagctgtctgctcccccaccagcttcacaaactcatgaagttccctcttcatagaaagaactcaataagacatttgtagaatgaatgacaggttcttctcttttcttttctctagagtcttgctctgtcacccaggttggagtgcagtggtgcaatcttggctcactgcaacctccacctcccccagtttaagtgattctcatgcctcggcctcccaagtagctgggattacaggcgcccaccagcatgcccagctaatttttgtaattttagtagagatgggtttttaccatattggccagggtgatctcgaactcctgacctcaagtgatccactctcctcggcctcccaaagagctgggattacaagcgtgaaccaccgcacccatctattttcttttccattaaatgtttaggtttattcattaatgcaggtataaatagttggcaaaaggaaattgatgaggttttgaaaaatcatttaaaccatcattactgctgaaaacctcttgatgccctctttagggtgtataatgaagacatgtaacttgtaatcatcacttgttggcacctctctggacccaaaagaagcaggaggaagcaaagatccgtttgagggcaaagattgagcaaaatttgaattacctcatcttaaaacttctaccttagaatataagccaaaatagtaactagaattttaaaactgctccaggggcagagtcttccactggtaaagtgattttcaaaaggaaactgaaaatgaaaaggggaacaaaatgtgctgggtgagggttagcctgaaataattttaagatttttttttttttagaacttaaaaacattgtatggtaagacacttctgttttcaggaagaatgtctagcgtttggatttttgaaatgctgttggttatgtgcggtagctgttttggagaggtgtctgaaagcagatggcaactgtgcttctcagtttctggatgtgaatgtgtgatcggaacgtttattttaaaacagattctgtcttgctggctcttcctctctctgtcacaagttgattttccaaatcaggttttgctatttataaggctttcatcatcccctaaattttgcccagattgatcgtttttcctttcctccttcgacttttcaggcttcccaacttcaaacacaggtgtttcccacacgtggtttgtgtcgaccatcccttttgcctctgaaacatgtgcagcttgcacaaggctgctggagcctggcttttctagctccacctttccctgccttgacgagtccagtccacctgggccaggtgcctgagttctaggcttttaggtgagaaattcccacagccttgtcctgtaccttacttcgtgcccctactgctcacggcatcttctagaacctacccgctggtgaggctggcatctgccctccagcattgatattctgatcttattaattagcagggaagtgggagacccgctggcctccaagtctgtgcgctggtactacaggtaatgaccaccccagccctgtcgtagagagaggctgcagaaacttcactttggttgaattcacacagtaaccccactagcaggcccgggcataagggtggatgtctatttttaacaggtgaaaactgagacacacatacctttcagctgggagtcacactgcgaacatgtgacacaggcagtccacacctttaacgtccacgctatgcttttgcctgtacagattctcttaggcattatttttatataaccttgatttaaaaaatatatttttggctgcactatcactccccatttcagagttgtctatctgagagaacacagacaagaggtgctaattacctcgtacttcatcacatgtaggatatgctataagaacaaggataggcgcacatgcattacttatggtagtacctcatgtcaggcctgagctaggcatgggtcttaccctccctctggtccttcaatcaccataccaggatgggcacttatgcccatggggggactctaagctcagtgggggcccagcatagaagagcagcacttggtctcagtttatcatagtcattagtttcagagattagtctaactccaccctggaacttttggggccagataattctttgttgcaaatagcagtcctgtacattgtaggatgtttagcagcatcattgacctctacccattagaggcctgtagcactctcccccagccaagttgtggcaaccaaaaatgtctccagacattgccaaatgtcccctgggaaaggggcagaatttttgaggctcatgtctgctaacctccgtcatttagctttctgctaaagctcatgctaacttgacttcataaccagtaataattccatgtctttggaactgttgcctgaccacccccttgggatgacgtgctcacctctggcttccagaagaactggccccgggcaaaaggagagccttgtatcgtgactaaccttaactatgtctgccctacccccactggagtgtgcccctgagggcaagagcctccttgagccatcttggtgccactgagcctcacacagagcctggctaccttgcatgtgacagtaggtgtgcgttgactgaacaatgattgaagctgttaccagtatgtgttttccaattgtctggggtttgtttgagactcttctcaggtagacaatacctgagccccgcatcaagatgggatggggggagctgtgccttcccactgaccacacctgatgggtttggctggatagatggactacaaaaaggaatgttgcagagggaaaactaaatgaacccatgcaaatatttgcaggggaggaggacaggaattataaaggctttctgttttgattgtttttcgccaccagagcaagaaagctttctgctcagccatggctacgagtccacgccttaatgcaccccacagccagcggcagtggcagtgacaacagcgggacctgcctttgaagatcggctgctgcaagggttgatggctggcatgtcgcaaagaccccccagcatgtactggtgtgtggggccggaggagtcagctgtgtgtccagaacgtgccatggagacgcttaacggtaaggacagggctgtgcttatgcctgcctgggtgtgacctgccatgctcatcctgcagggtgtctaggctatgtaagaacaaggagttctcaaccagtggaaatcaaatgtccatcatttggtgctctttcatcatataatatatcttgggactcttaaattctaaaaattgaggaacagtgtacaaaatttattgtggactcacagatcttaacaattgggacatcacttcatgctgggttaaagaacttttaagaaaaaggatgtagttttgttttttcattataaaaataatacatgtttattaaggaaaaattgaaaaaaataatttaaaaaaaaggaagaagggaaaggaatcatccagaatcccgctatctcaaacacaagtacaatgagcatcttggcatgttctctcctagtctctgcttctctgtgtttaggggactttgttttaaccttattgtacttacaaggtgtatgtaatgttgcatgttgcttttttctcttcaccgtccatcagtgacatttgcttagggcaccacctggctcccgcaatcaagtgaaacatcatttcatttattttattttatttttttacgatttaataattggatcaaaaaatgattcataaattgggcagtactccgaaccaaaacaaacatcattatctgcgggagtgctatgtgcagttattgacctaatccttattctcctgtgggacatttgggttgcttctagttgtttactcctactgagagcatttccttcccatctcttcatacctggtttcaaggttatttctgtaatgcaggtttacagaagttgaatgattggtcttgaacatcgttaagctcttggcacgtattttgccagattttccgctacacttgcaccacctttaagaccaataggatatcatcgtttacaaatatttgtcaatcccttagtatgtaccaggcactacatgtacaaagttcagaactttacgaaataatgtcataaaatcctcacgacaacctggcacatggtacttttatttccgttttatagctgaggaacatgagggtaagagaagcctggaaacgtgttcaaggtcaacaactcagaaatcacagaattgccatctgaaccctgtcttaatgctgcaacactcattcttaaatgctaggccacactatgggaggtgaaagggtcaacaggttgggtctgagaggcccacgtttgtacccttaaccgtgttaactaacgatcggccactgtacctggcttggcagacactttgttcagttgtttgagtgttttcactccatctgaaatgtccagcagctgaccagggtgatgtttctggaaggtgtcgtttcacatccatcacattatgaaatgggaaacgaatttgcttcttgacattgcccagcactaaatctttccagagtgttcaacttgcatctttgtaaattttctttttctttgtattagacgtgtgtcttttttcagttgtgtggtaggaagaccttgctctgttggtgtgagatcgaggtggcgtgggtgatagaacgcagtccccgatttgggggtagcacctccacctttccagtgcacgtgaggctcccttatcctcctgctgctcctcttcgcagccctgagggacgagggtggggacagggaccttgggtctgtttggggcctgtagggtaggtgactgtgtcatctgaaaaagcccacaggaggcgctgctccctcccctcctggtcaacagttggtgatctaaaggagtgcttctcaaccacggcccacacagtcactgggtagtggctcaaaccggcagggccctggcaccacctggacccactggagcagcatcttggggcaggggggcggggagtgaacaagcatg

SEQ ID NO: 1026 - DNA, 748793 bp, Homo sapiens
aacacaaagcacttttcaaacatgatgcacttttatctttgtgaataatttactgtcctttcctcctgggatatgagaaacattttaaaaaacgtatttaacagaagagagcaaataaagatatatcaggaaggatgtattagttatttacttaaatgtttataatatctggattttttttgttttgttactcatagaactggtgttgtttgctgtttttatttctctaattgttgcagagttctgcctgttacaaagctacagaactgtattgtttttattttccttcttgagcacatgttaacaaactaagcttcacattagagtgatgtcataatgtaaaatgtttgcattgtggttaggtattgaagtttatgtcctgtctgtgtaaagattcatcttttattgtaaatatttagactttaccacagaaatattggaacagtttgctttataagattaaaaagcatccttcagaatggagcttgccttgtgcttagaaataatatgttgaactattttgcaatatactattttaaatctaaattctgtcacttcgctgcctttttaaaatagtgtggtatttcaaatattgctagagctattttcctgaaatacatttgcaaaataaggctgctttgtaatcaaggaatatttttattgattgaaggaaatgactgtactgcgattcaaaagtaaacttattttattatacagattatttcttaaaaactctatttataccttaacatgaaatccatgaccacaccaaacttggttattcataatttttcctgttaaatataaaacactgtaagttaaaaacagtaatgccaacattgaatttatttttgaggtcaaagaaccagttgttctctttatatttagatgaggatgattgagtccatatactatgtatgtttacatatactatacatgcacattaggtgttttcatttgtgttttgcttatgaaatgtcatttaaagttcacttcttgagcatcaataaaaagggaagctgtgtggttttggaatggtatcttgtcatttaccctatttgcaactctgcttttctcagtaactcagggtgcatatgctttgaactttttcctcacggtaatggcttggatttgtcctgtccctataaagagtattaaaaagtatcatgctttctactcaacagtctatgttcatagccaccatcctattagtattgttttgatgaatagtgagtcatttaagaaaagaacgtatttctacagttgggatttcacttgtttatttagggtaggatggaacactttgaatttagattaaaaaatagaaataattagctgccttttactaaaaaactttgtttttatatttagggtgatttggggggaatatttttaagtatgtaagaatgttgagtactgctgtttgctaactgtgaactctggtgttgtaatcttgttgtgagtctctggcacctcctcccaagagctccttgtttccctctcatgttttatttttctctttagcatttggtcatgcttattactgattacaacttcttgcttattatttctttcttccttcacgagattgaggagtggatttttgactgttttgttcaccactttatccccaacacctagaataatacttggtacctagtagatgctcggttttgttgagtgaacaaaggcagtaaaggccattgattgttggaaatagagatagtatctagctagcttcacacaaggggccttgcaagactaggccacagaacaggtaaattttcttagacacgaaaggaggaaggaggacaagaaaagtttgaatccaggagcccaacttacccctgaagagtgccgtgtaagagacaacagatgctgagtggcgcagcagtagggaatggggaggaaagacgcagcaggaccacctggggcagctccctttcccttctgcctggggctaactttgaattcctattttaatatgatgataatttagagaatatggtaatacatgtggtctaatatggagagaatgaactggatcatactcaagtggggataacgttgatctccagtattaaatatatatctctatctatctatatatatattttttgaggcagggcctcgctctgtcacccaggctgtaatgcagtggcgggatctcggcttactgcaacctccgcctcctgggttcaagtgattctcctgcctcagcctcccgagtagctgggattacaggcacccaccaccatgcccagctaattttttgtatttttagtagagatgaagtttcaccatgttggccaggctagtcacgaactccagacctcaggtgatccacctgccttggcctcccaaagtgctgagattacaggtgtgatccaccgtgcctggctgtgttagatatttttatttcagagttttattttgaggctccctttttagaatgtgtgataatattatttaaaccacatcaaccaatggctagaagcctattgtgttaaaatcattcttaattgagaaatagttctagtaattttaactacttaccagatggatatttgttatctaagtaacaaatgactaaatgactcagagacatataatattcatagccacattgcaagccaatagaaggattaatttatttttttcatgccctttccttcacttatttataatacaaatacagtggttaatacaaaactcacgttatcgtgtatatttttagtaattgtttagtatcccttggtacacaggccttatttacaaacaatgtcacatatactgtttgattataaaataaacattcctaatgaaatttgtgtatgggctgaacaagttaagctttcaggacatgttaatagtgtattataagcagaatatgatgcctttgcataggcaaaaagattttgttctaccatattttttttgctaattctcctttttatgagaggaaaagtatacgtggtggaatttgagtagacgagcacatattactgacattaatatcgtttcattatgtgtggtcaaatgaaactttttgttttatagctctcccttgagagcagcctcaaggtgtaagagaagctttttccgtttatctttttagaatgtcttccagtgaatagaatgttcatgacaataaatcagcagcaaatttcatcatttactatacctttcaaatagggcaagcgtagtcgtcatggtggtgctgagaaggggcagggcattctgaattattaaagatatttcaggtgtttaaattgaggctgttagctgaaaacataatctgttcccaaggatcactggtgtcattttttaaatgctcataaatctggtttaaattcggctctaaaatctcacatgaacccagatatgtgagtttgttgctaccgtaaccccaatagactcctgtgtcaggagaaatttggtctcaggattagatatgtagtcagagttgtttcaactggctacataaaatccaactgggatcagttgaactgagcaagctaactatcctgtactgaatttgaattttaggcatttctaaagcatggaaggtttaaccatccaagtgctgtgttcttggcctgtgtccatctggtggaggttaagttctttcagttccagcccttcatgactttattccacgtagacagacttaccttattgaagactgaactaattattatttttcacctaacaaatcaaatcagactgacatggagatgaatcaggttaagattatatgcacagcttcaagccatgcgttttgttcttttctctagtatgacttctgagattcagcttgaaactcagtcaacagtgttaatgacattggctgcccctgacagttcttgtcgtgaagggtgggtgttactatccagtatctttggggggaaaaacccctataatggatttttaaatgaattttaatagtcataaaaagtcttgtattgatggcaaggggaagcggattttgcattacagacaatatagagcattacagagcagaagaataaagcgaaaaattatagtcacctttattgaacctgctaatacaaatggatttctaataagaattccaatacattacatatattagtgaaaatactgtaatttttcagatgatattttctctttcttgaagggaatagagcttagggaattaagaaatagcatgagattcttgaggcctcactttacaccccctggtgtgtgacaaaagaaaatccagtgtaattttctgctttagtttcttatcctttataaaacatcaccagctgtttcctggtacgtacttgaggaaaaagaatttctatcttgaaaattactttatttcttctgagaactgtgaaatactatataaatattactttgagaataatgcaaaaagatttaaattgtttcttttctcaactattagatgcagtaaaatataggaaatttgcccacagtcgtcacaatcttatcttggtggattgtttgaattggctatatttttggattccctgtttctagggatccattataaagctatatggttcacaacagatctccaaaaattgccatccaatggcagtggatagctctataaaacctgaagagaggggttctatccaattctatggtgattgtgagagaagactcctgttcctcatgaattgcccatcataatggcacttggatgcgcttgttgaggagcgtcagaatccacaggcatctcctgctctcaaacacctggcctgctttaggctttgccacctcactttgggaatgggcaccgatgtggtttggctgtgtccccacccaaatctcatcttgaattgtagcttctatcatccccatgtgtcacgggagggacctggtgggaggtaactgaatcatgggggtaggttttcccatggtgttctcatgatagtgagtaagtctcatgagatctgatagttttataaagggcagttcccctgcacacacactcttgcttgccgccatgtaagacatgcctttgctcctcctttgccttccaccatgattgtgaggcctccccagccatgtggaactgtgagttcattaaacctctctttctttataaattactcagtctcaggtatgtcttcatcagcagtgtgagaacagactaatacaggcactaagaggtgcaaattgtcaactgacaaaaagaaagtgcatcagatataccatcaaatattaggtgtgataaaagataagttttatggttttactttgctaataaggttcccattatagcaaatgtaatgaaagagaaataagtgatgtggcactgaaagcatgaaagtcattaaatggacatgactcatagttctgccggctttgctgctttctggaaatcatccctgattaatctcgttttgctatggtaaggatttgatgatttgttaaagagatctttgaatagaaagatctttgaataaacaggactgatactaaactctctggtctacttctacataaagattacatatgatttgtctcactgggataagagttaaggtcaaggacacatgcacacaccagtgatgctccactgataatgactgggtgttggaatttaccttacacaggtgaagtcctacagaatcatggacttgacagttagaaggggcctttgagaccaaagccttctatatatatctctatgtatatagaagatggagtcttgcactgtcacccaggctggagtgcagtggcgtgatctccacttactgcaacctccgcctcctgggttcaagcgattctcctgcctcaccctcccgagtagctgggattacaggcacctgccaccatgcctggctaattttttgtatttttagtacagatggggtttcactatgttggccaggctggtcttgaactcctgacctcgttttttaaataaaatgagagtttcagtaacttgcttgagtcagggaggtagtaattgcagtctagtagtggtaggtctcttaactcctgcctggtctgcttgctgttttctcaagtaattgatgaatgctaaaccatccgagatgatataatcatctgaagttttatcaatttgatattcatctatgttagcaaatacctcttctaatatgtaaatattgtagggagaaatactaccctagctgctaaggtttcaatgtgagtttgtttaataagactgtctttcacctaacaccagctgaaatgaacattgagtgatggaggaaaaataactgtgggttagttctcacaaggaggcaataagtcttaggaaattgatgggatggggagagagcccgaggatgtcaagaagagggatataagaaatggacatgtgaaggcactaaagactaattttggtatttgtgctttttctgaggttagacttgtagtgccatctttccatgtcaagggtaacacacctgttttacacttactgcatgctgaagagaggaaggtgattcctgtagttttgtggtcatagttcatgtaacttcccgtcccccgcaccccccgtatagtagtttgttcttaccaagtttttcaaatgttttacagttgttaggctacggctaaaaaatgttttgcacctgagtagtgcatcaaaaattaaacacccccattcaggacaccaaatgaaagtagaatcttaatagaagccttactatttgctctcagtaatgatcttgtattttacagcagcatgtttaggattacgggaatgctggttttgctttttcatgcaacaacacaggagccatctgctgcaatgaaattagcaaagtcaaattgtgtgttctttagggactcattttaaaaaccattaaagacagattgacaacacacttcatacaattttatgaatcttgtcatgcgtagcctgttatttagagtaacctgaattcaaatgcatctccttttaggtctgtaaaactcatacggattttaatcctgctattactactgaaaacctattaaaatggcttgatcattagaatttcttagtggtgtgctatgggaatttggatataaaggcccatgttttacagaataaactttactgtagttacataataccttacagctatagggtttactaagtactatgtggagatgccaaattttttttttaaagaattactgaaattgtggtagaaactttatgttcttcttttgagctgaaaaggagttgggttctggcagggttcctgctactgtcattagagttaggaggaggaataagtgctggtgttcagttgcacagtcgggtgactatggttaacaatagtgtatatttcaaaatagctagaatagaggattttgaatgttcttaccacaaagaaatgataactataggaggtgatggatatgctaaatgccctgatttcatttatataatatatgcatgtattgaagtatcacatgataccccataaatacacatgattattatatgtcaaaacaacaaaaccaaatgacagatgaagaaaacatggcacaaatgggaagagccaagagggctggatgtgagtggggacaagaaccactgctgagcacgagggcagggaggcatagacatacctgcccccacacccagccccacctcacctgggggctgccaaggtgtaagagggggcgcctgtgctttcacatagtgcatgatctccctgaggagctgtgaggaagggaggtgattgtcctccttttatgtctgcagacattgaggtaccaatgggtcagataactcaaggggagtcagaactcagactctaactggtggaaagagaatccagccttttaactactgagtagagcatactctttttaaaaagtttattcctgctagtctgaattgctataatcctgaggtacaacatattaacaaactggtcattgctcacaaattgccagcttcccagtggaacagttgtgaactttcgatgggccttatagacataggatataaataattatgctagattacggtttaattagcatagcttctgcaaactttaattgtgcccgttcatattctgggtggaactttctatcatggttaataactttattaaaatccatagcgtctgtatgaattgtagccatgtgcctggagcaatattcgagtggaccatagtccagattaataccatgctgatacccatgggttacaccaagttaaatgaaacatcttcaggtcatcgcatctcagtgtggagttgtttatttacttatccatgtatacaagcttttaagacttgactattatttacatgaaagttgataccaataaggacgattagagagatcaacaaatcaatctcagtggtagaaaggcacaacctgaaaatgtaatggatttgtcgttcttaaaagtggaaagaagtaatattttccccatgaataacaataaagagatggctatttaaccagatagcttactcccagcttaattggttactgatgttacaaatctaaaatggaggtgtttttctcagttattgacaactcctctgtcagtatcctttaggaagagtgtttctcaaagtgatattctcgagccccttcagatggtctgtgagttaaataatgtgtatatgattaggctacttttgtgcctggcatgaaccagaattttaccgatacatttatttagagatgagttcattgatgtttcatcttcatgcatctctgatgaaaatatttttggcagttaagcagataaggaaggtagcctctagccatcagtgcttttacagttgtacactctaactccagggaaaggcaactgccttcagagaaaggaagagttgtctggtgttggcttttaacataatggctttcccacgctgaaagtgatgcttttgacgcaggtgaaactgagaaggtcagaaaaaggtatgtatatatatactttttataatatacacacacatagtccttttgtttggtaatgtttagtaactagcaagtaataagagaattgctttcctcttgaatgctttggtgtagctaccaacaggaaagaaagtgggcgtgaggctagaggagaagcagaaagaggatgaaatgaggacttactgataaagcattctaagcattacacacataagtatgtgtgtaaaattaaacagattcccaatgcgttttcatggaagtaaaattcatctgtgaaaaccaagttcagaactcccactctaacatgtcaatgtcaacctcaactctccaagggttccacaattcctttcctcatcgcctcctagggaaaaaattctttgttttaatctgcctttgacagctatacaaattatgcgatgtgtatttcagcacatttatgttcccagtgtacttggatcacatgaggaagggagagaaaacgcaggttaacggtgaaaggaaagagactggatcagtgcctctccttaggaccaccagcggcctgttcctcccggggccctgtccatctctacaggtacaaacttgagtttggtagttcattccatgactgaaacgaatagaaggttttggcctaaaatgtattgacgcttatgcccacaaatggatatgtttccatgcttccatgtatcactgctgcttaaaatttttgcttttaaatgatcaaaatttaattagtggaaattttttaaataagtagtttaaatcttgagttttaaatccagtaggaaacctcacactcagtttttcacttctagtaggaggattttcttaaggcatgaggtatatttaataggatgtttgaatctctggatctgtattggtgctttatcctactcaaagcacttggaatgtatgcatttcattgagatgagtatatacacacttctgctatactactggaactactcacgacattttttacaattggtgatgaatcagcacaattaaaagcatctaaccgtcacctaaagtgacatttcagttgtctatgattttttctttttcaagtaaagaatgtctttccccatgcttagtcattacaaataactcctttatttccgttccctctcccctcaaatggctcatgtccacatcaacaaggcaaggaaacatctatgaccccaactatgaaacatagaagcagctaattctgactacattgaagcagagcacacacaatttgaaagaagcataaggaagtatacaacaaacatgcataaaaaccttatgcaaccacatctgggccttgtatttatcactcatttttatgatattttcttctttcgaaagaataggatgaacccatgctcaaaacctttctaaagcattttcaaaatacagcttttttggtggtacttcaaaataggttggcacaaaacaaaacgtgacatttggtctctggtttgtgaaggagccattgcctctctctcctccacggtcttagggatcccaaggaagagaagtgagtgtgcgaccgagctcagggcccaggctggttcatgctattcttgcttttcagaatggtatcctcgtaatgaccagctccaggggcagtagcggcttctaagggcaagccctgttgctggtagccgtaattgacattcccacaagggaagtgacgtagcctgaacagaggtacctccttcatattggcagtcagcgaagagggctctaggagcagtgaggcccccggaagtctcccagttgcaacgttaggtgggacagtacagcttccctccagccccaggttacccctgtcgtgtggctccttctttgctataggattattctttttggtgggtttctctgtaaaccaggagccgtacgttgggttccacaagctggtgggcttgtttctggatccgtggaccttgtgcaactccgaaggagggttggactgagagaatgccatattcacgtgtcccccttccacggccggccctctagggactcgaacagagatctctgcagctgtgggtttctttgcagccttgccagaggaggtggtaggcagaggtggtggggcagctgggctgcgctcctcctcccgttttgcctgttgagagaccaggagaggaggaaccccctcagggtccttgggcctcacaggcactttctcttcctcttccacaagtggaccatattctatcggcaaagcggtgttgattacatccgggtcctgccgtaggggaaattattaaaactttgaatcagagacaaaaaatgttggatctagaagataccttagagatgatgttatctaaacatattctacagatgaggaaaccaggatttattgagaatatagtaacttacaggcactggggcatacaaaatgaatgggaagtcatccttatcctcaaagaccttagaggataagcgctataatggaagtgtgtatgggtgcctgggacagagtggagcaggaaaagctttgcagaggaggagacctttggccagtttttaaagattagtggatttaaaaaaaaaattaagattattatttgtattattccagtctagttccactaaaatcgttccaactggaaaaaataaaaataaaagcctatgtgtttgacttcaagagtgatggtggggggctggggggaggaggagaggagacacatgccatgttggcctacagggtttattttttgatctcttcccagctgctttccatttccatttgggtactttacacttgattgtaagttttcctgtgccacatcatcacatgtgcaggtaccacagtgcatgtttttgtgtttgttttttagagacagtcttgctcagtcgcccaggctggggtgccatggctcaatcttggctcactgcaacctctgcctagtgggttcaagccattctcgtgcctcagcctcctgagtagctgggattacaggcatgcaccccacccccccacccccccacccccgctaatttttgtgtttttagtagagacaaggtttcattcaacatgttggccaggctggtgtcgaactcctgacctcaggtgaggcacctgcctcggcctcccagagtgctgggattacaggcattctttaactagtctggatgtgagggaccctttgcacaacccaggaaatgctgaagtgctgtgaggaaaaccatttacaaaaacaactgtgtgctagatcattttcacagtaatagactgtaacatagaagaacagaagcagctgccagaagtttagggaaaatttgtggaagaaaaattaaatttggagaaattaattaatattttatgcaaattgagaaaataccctcattacctgagtaacagaaaaacacgagtgttcgagtttaaaaaataactacctctgactcattaaaacattctttagttccctctgtgttttagtaatttctatagtgaatcaatcattttaaatatgcttgtgtaaaactgccttttaagagggatattatagactattgagaaaaatactcctaagaaggtatatatgtttaagtgggtgtattccattcagattacaacaaaataacctaatgtcattaaacagagttctctgaaagaaccttcaataacgtgatataggaagtctatagataaaaatgccagttcactcacgtgagctgaaaggaataagaggatggagtagtgaggctggaaaatgactacagtttgaaaaatgtgtctgtctttagtcacaatgaagaggaggggatttaaagaaatagtaggtaggccaggtgtggcagcactttgggaggccgaggcgggtggatcacttgaggtcaggagttcgagatcagcctgccaaaatggtgaaacaccatctctactaaaattacaaaaaaaattagctggatatggtggcacatgcctgtaatcctggtcactcaggaggctgagggaggagaatcgcttgaacccgggaggtggaggctgcagtgagccaagatggcgccactgtgctccagcccgggcagtagagcgagactgctcccaaaattaaattaaataaatagtggtttattgactcttctaaaatattctcagaattagatatcctggcagaacgagaaccaagagagagggaaagaaagtgaatacagggaagaggagagcatcggacagaacaaagccctgagcaggcgattggtgatactggcagcaaggctggccttgaaggggaggagagacgggaaggcaggtggtgagaaatggcggcagaggcagagaagtttgtatcagagacagggaggaaatgagggcattctcttatgatgatctccaccctcttggtgagggaggaagcatagctgtcggctgaaaatgagggagagaagcaaaaatttcgagtcgttattgaaggaatgggagagggatctgtagaggaacccacaggattgctagaagaatgtttgacttggacagactcttcaggccttaactcctcatctataaggtagggatattttacattccccactaaggataaaacgaaatacgcaaaaagtgatttgtgcagtatgaatgatagcaagtattattgatgatgttaaaatttctccagattactttgaaatttcattcccttaatcctcctgacatatatagttggacatataatctatcaattttatatgcaattaattacttcacatgttgttatttctccagccaggctctaaactatttgagagcagatgtgttccatacgtctgtgaagcttcaattttggctactaaaacattaggtccccagtagggacttgataaattctcgtggactggattgattccccagtttttactgtgtgtctggcactgtgctgtgtgctggtgaagttactaatatttattttacaaaatgggcaaatggagacaccagtcatttcattttagagaaaattaattttcactattttgatcataaatcttgtactctgactggcttgacctatttcatatttcggtatttgccatctttaagactgtttcatatagagtaaatgttgaccaaagggagaaaatgttttacctgggtgcagtattcaatcctctccaaaatgatggcaaagttgggcctgtcttcaggctgatgttgccagcactgagtcattatccggtatctaaaagaagaagcacattaattaaaataaggagaagcacaatgatgaaaaatatattttcttccagccccagggttgcaacgaatacgttgagggtgcgaactcgtctaggccccgtgtacttggcctatgctgccccctgctgattggtcaaggaagagtgcgcaggtgtaaaggtatctaacacagacatcctgatgtttatgttaaccacggctgctgtcactccattcctgagttaaagccactttggggacagaatattccaattatatttcccatccacgttgcttgtgggaaggaagtgaggggtgccaggcagggcaggagacattgcagggaatggaaatctttaaagtagacacagacatacggtgtagggcagcagggactgggcctgggacacacattcccagcaggagcttggggaatgtaggcctggtgagtccacagcctgtagccagacaatggatactttttctgggatggcatccttgcttttgagggcctgggagacgcatccatctcactgaagtcgcagtcacattcgcatcttggggcatattaaagggagggcagccatctgccccttcatcttaaagaagcatatgtggctctggatattttttgaaaagaaaaactgcttagtaactagcagaagtgttcctaaaagagtcatacacaggcccagggcagttcttgggtgggtccatccggcctccactggtgacaaactccagaacttcctggttgcttttgctggggtatggcatatatccaagagaaaagatttcccatagcagcactccaaaggacctgggcatgggacagaggacatggagatggatatagacacacccacccacattcacacacacacacaggcacacagacatacaatttcaacctttttttcccccattatacccttttccataacatagaactcttaaaatgtagaaaaatttaaaaaataagaaaatactacacatgatgctcccttaaaagacaacccctgttgatttttaagtcgtttctgtgctgagattttttttcacttatttgcagttatattcaatatgcaattttgaaccttgacttttctgcacatttcattatatcataaacattttccatgccagtccatttcataaataacatttggaatggctaatggctgtaaaacattccattgagtagttggtttgccttatcatttccacattgttttcagttttcaaaatatttaaaatactataatgaacatctttgtgcattttttaaaaggaagatttccttaagataaagtctctgaattactagattaggatgtccagccagctgatttcatagtctcttacagttctctgagcttcagtttcatctatcagatgcccactcatcaacttcactggcctattttaataggcaactcaaatttaacatgcccaaatggaactctttctgtacacacatcatctcctttattcttttccaactcatcagcacctctggttatacatttgctcaagcccaaaacctaggagtcatccttgattccattctcccacacccctccacttcccatccaacagtcagcagtcctataactttcaagatagatcttgaatccagataggataatctagtaattcagggtaattactgaattaaaatgtaggctaattctagtaaaataactagatcaaaagactatgaatattgacaaattcttggtgcatattatttggtttccaaatgtgttactctgttcatctaccagcaccatgtaaaagcgtggtagacacactcaccagcattgagtattcttaataataatgacaacttttgctgattttaagggaaaaaatggtagaatattttaaattatgtttattgacttgataattcacatggttggatgttttcccaagtgtttattaattcatttcacttttttttcctatgaattgcccatttttatctgctgggacaaattggtatctatcaatcaattttctttttgatttgtaggcactctttatatgtcagagatgttaaccttttataaaaaattcaaatacttttattagttgttttctttttttttttttatgtagtctcactctgttactcaggctggagtgcagtggtgccatcttggctcactgcaacctccaccttccaggttcaagtgattcgcctgcctcagcctcccaagtagctgggattacaggcgcccaccacaacacctggctaatttttgtatttttagtagagacagggtttcgtcatgttggccaggctggtcttgaactcctgatctcaggtgatccacccacctcggcctcccaaagtgctgggattacagatgtgaaacaccgcacctggccttagttgctttctaatgctactttttagcataccaaagaaagatttttatttttagatagtcaaacctatttttttaatgtcatgatttcctttattttatagttatacaatcttcccttcaccaaagattagataaatatttgctatcttcttctagttgtgtttgtttttgctctcttcttaaatctagttggaatttaatttggtgtctagtgtgaggtaaggacctaaattgatttgcttttcaaataactactcttccaacactatgcataagataatttcctccttacccattgactcacgattaaaaacaggtctgtttctggctatattttcacttcatctatttgtctgcttcttgcattgataccattctattttactttctgtgtatttgtcttaaatctgaaaaggcatttttctctatttctctttaaaaaatatttgatttctcatttgtttttttaaaagctttatgagatgaattcttcgtgttctaaaagaatcacctttgatattttgattaaaactttaaaccactacctaatgatcagctttttgacaaagactatcttttagtgtgattgtagttttctgaggttagcaaatattaccacaaaaattgtagagaacaatagttccttcatcttctaagaaacatggggtgcttttattgtcatcatctgtgtgaaatttcaaagactcttgtgagaaggattgggcaaagatattttccctatttttcaggtgagaaggttgaagcacaggttattatacaactaatccgagacagactggaatacattattagatctcttgattttgctacttacaaattgcctggcacatatattattcctttctgtttggagatctcttgattttgctacttacaaattgcctggcacatatattattcctttctgtttggtgatcttacttcccttcaaggcaaaactaactaggcaaaatcaaatgaacaagaaactggcagtaaggcctaaagaattatagctatatgttttctgtttttctagatagatataggttatagcatcctttgagagcactaatagaactgcacatgaatatttattttcttagtttagagttcaagggagcaagaagtagtattggtcatagaactttgacaattttgaataagtaggattttcatatttgcaaacaataccagatacctagttaaatttgagttccagataagcaacacatagtttttttagtatatgtatgctccaatatttatactaaaaaactatttgctgtgcatctgaaattcaatttcactgaccattttgtattttatctagaaaccctacagatgaggcaaatctatattttgtatgccagatggttctttcatcacctataagcctgccctaaacaggagcgacaaaagcccaaagctttgcaccagagcatttaaaatcaaatatacatacgtatatatgtatatatatacgtatatatatacgtatatatgtatatatatacgtatatatatgtatatacatgtatacatatatatgtgtgtatatacatatatacgtatatatatgtgtgtgtatatagatacgtatatatatgtgtatatatatatttttaaacttcactttcttttggtattaaacttgctctgcctggaatgattgatagaaataatagcaaacattattgctgattaaactgttaaacatttgaatcgatgaagataatctgataaaagattttaaaatatcaagctgttctgtatcagcctttaaaagctacatttttctccttaatcataacctgaaaggaggttatgattaaagaaaaaaaaaaacattgtggaagatggtctccaggtgtgatagaggttatgctcttaggaaaaatgggagccaaaaattaatatctttaaatgtccatccagtggattccaagatctcatacaccaagatctcatacagttctctgatctttagtttcatctatcagatgcccactcattagcttcactggcctattttaataggcaactcaaatttaacatgcccaaacggaactccttctgaacccacaccatctcctctttcattctttcccaactcagcagcacctctggttatgcatttgttcaagcccaaaacccaggagtcatccttgactccgttatcccacacccctccacttcccatccaacagtcagcagtcctgttaactctacattcaagatagatcttgaggccgggcgctgtggctcatgcctgtaatctcagcattttggggtctgaggtgggcggatcacttgaggtcaggagttcgagaccagcctggccaacgtggtgaaatcccgtctctactaaaaatacaaaaattagctgggtgtggtagcacgcgtctgtaatcccagctacttgggaggctgaagtgagaggattgtttcaacctaggaggcggaggttgcagtgagctgagatggcgccactgtactccagccggggcgacagaatgacagtctaaaaaaaaaaaaaaaaatcttgaatctgactactttgcgctacctccactgccaccaccaagccacatcgctctcctgtttctctcagctagcaatgtgcaggattttcttaactggtttctttcttcacttacccacctctagtgtaaattcagtggcagagagattttttttataaagcaaagatcatatcacactcctgcttacaacccttcaaccggcatcccatggtgtttagaataaaatccacatcccccatctgagttccaaggccgtctgtgttctgacccatcccttccacccctattggccctgggctcccttagctccgaccatcaggacttgatttcattcctcagcaagcaagctaggctccttcctgcctctggctgttcacactggcttttcctgcagtctggaaagcctttctctcagatctttccaaggcctgccctttctttcaggtattgaagttacctccggtaaggagcttccccccgcccacctttgccaaaaaaaccccagctcctcctctttctgcctgattgtcttagagcacttcctaatccttgcagctatataatttgtttaagcattccaattgtgaaacagtcaaaactttaaaaaggaacagagttatctatgtatctagatgttaatcttttgtcttattcttgtcagctctccctttctttatgaagacttagagacagaaagaccccacctccctctctctgctctcctgaagttagactgtatcctacaattgtatgtttcacatttttaaacaatgcgtgaaagcgcaaacgatactgtgttatagacattttttatattgtaaagttatacataaatgatatcctactcctttttgtaatttgctttttccccactgaacactgtttttgagatttatctatgttgatatatgtaggttgtcttcttttatactgcggaatagttttccatgatgtaagtaaaccacagttaatttttccatctcctagttgaggggtagttgggttgggttttgtttttatttttgtttttgttttgctttttctctattgtaaacaatgttgcaagtgaacatccagcgcccaagtctatttgtgtcatcttctctctaatgtatttacttaaaaataggagcgttaggtcacaggatgtgtgtgtgttcaggacaattacttaattgcttaagttattctctgtctctggatcccctgggttgctggtgctctaacttccctgcatatcagaatcatctgataaaacacagattgcagagtcccacccctagagtttctgttgtattaggcctgaggtgggggccgaggattcgcagttcccaggtggtgctgatggaccacacttagagatccactgggttaggttaaaaccaaatctcactggtgtaaaaacaacaaaggctcttgctctcattatctaatgctggtcagaaaggcagctctgactatttgtggccgcaccatcttatgacatgatctcagctccaggctttcaaaatgtggaggtttttcattcttgcattgtcttcttatgtttcctgtggtgctgttaagcaatttgatgccatttggattccttatcttttatctctattattttttactattaatttttaaattttctttgtggaagtttgcaggatctttatcaccattggcctgaggatgtgcctttttttttttttttttttttttttttgtgagacagagtcttgctctgtcgcccaggctacagtaatctcaactcactgcaacctccgcctcccaggttcaagcaattctctggcctcatcctcccaagtagctgggattacaggcacccgccaccacgcccagctaatttttgtatttttagtagagacgggtttcaccatcttggccaggctggtctcgaactcctgacctcatgatccacctgcctcggtctcccaaagtgctgggatttcaggtgtgagccactgcgcccggccgaggatatgccctttttccccatggtgattggcacttggtgaattctttcattctggaaatttatgtcctgtgctaggaaatcttgaatgattgctctgctgtctttattctcttcatttcctctgttccttctctctgggactcctattttgtcagctaaattggaccttttggtctaccccttaattttttaaataaaaaattattatattttcctatattttccatctctttttaggtttattttctggaaggtttatttagcttcacactccatccttttcattgcatttctgtcatcaaatttttaaataataagatttttttcttagaacagttcaaacttggaagaaactatgaatacacggagttctcctatacctcacacttgatccctgctactgttagcatcacactagtgcgatacacgtgttacaattaatgaaccacagttaaggcattattgactaaagcccatacttcattcagatttccttagttttcactgaatctctgttttctattccagagtcctactaggatatcgcattacatttaattgtcttgtttctttgggcttctcttgactatgacaacacctccgactttcctcgttttttatgaccttgacaggtttgagaatctggtcagggattttgtagaatattcctcaattgggatttgtctgtttttctcatgattagactgtggttacgggatgtggggaggaagaagaccacagaggtaaagtaccattttcatcacatcaggggaacatactggcaacatgacccagccctgttgttattactattattatttgagatggagtttcgctcttgtcacccaggctggagtgcagttgcacaatctcagctcactacaacctccacctcccaggttcaagcatttctcctgcctcagcctcctgagtagctgggtttacaggggcctaccaccatgcccagctaaattttgtgtttttagtagagatgtgtttcaccatgttggcaaggctagtctcgaacttctgacctcaggtgatccgcccaccttggcctcccaaagagctgggattacaggcatgagctactgtgcttggcccctagacttatcactattgaggttgaccttgagcacctggctgaggtcgttatttgtcaggtctctccactgtgaagtttctcttttcccctctgacccagccctgtactctttggaagaaagtgagaacacgcagcccacacaggcttcagggtagccatgcctatctccttgaggccacctcttatcacacttggatttccttatcctcctaagagtattgtttaaaataaccttttgtcctccatttatggttgcaatagtttttctgatcttttggaggatattatagttttttagaaagttttcctaaactttctacatgtttcttcaagttcctttttatatgtgtgttttcttcagattagaatattttcttaaatgtttgttgattcttggctgtctgttcatattttaagactgggatattaagaagccagtagaaagttctgtgtaacacattggctggtgggtagcttgcttgcttgtttcactagctgtaattttctgtgactgttgtaaaaaacaaaaccaaccaaccaaccaaacaaccacatgcttggtggcttaaaacaacataagttcattctctgacagttctgaaggccggacatctgaaactggtatcacaggactgaaatcaaggcatcagcagggctgtgtcccttctggaggctctaggggataatctgttccctccttcttctggcttctggtggctgcgggacctccttgacttggggccgcatctccagtctcagcctctgtgctcacactccctcttcttttgtgtgtgtgaaatctcctggtccttctctcttataaggatacttgcgatggcatttagggcccacctagatgatccaggacagctgccccactctagtatcctcaacttcatcacatctgcaaagacccattttccttataaggcaacaattctgggcccctgggattaggacctgataccctcgggcggccattactcagcccactgcacctgtgccccacttggcagtactgtatctgtaattttctcttcatcggtcctccaaagagaaattctctgatgatctgcccagttgccagtattcttggtgctgaggggccagtgggggccaggaccagggagacttcagttcagtctcttcagagagagagcccaagtcttgtgctgatggtagataagggacagccagcaagcttcaggggtgaggggctcagccacaggatttacttattccttaaacagacctttcatgaattttcctgtttgctatacctccccttcttttcttcctccctccctccctttcttctctctcctctcttctctgcccctcccttctacctcctctcccctccctttctttctttctctctctcgttccctccctccctctctctccccctctcttgcttgcccaggctggagtggagtggcatgatcatagctcactgcagccttgacttcctgggctctagtgaacctcccatccaagcttccagagtagctgggaccacatgcgtgcaccaccacacctggctaattttaaaatttatggtagagatggggccttgctatgctacccaggctggtcttgaactcctgggctcgagcagtcctccagcttcagcctcccaaagtattgggattacaggcatgagcaaccgtgcctggcctacacccctactttcaatttctggacctttctggggctctcaggcagagggaaccagccctgtttctggatctggacttggtttagagatccattttctaatcttctcagtaaggtaccacttgttcatgacttcccagtttccaaaattttgtcattgttgtgttcttgcagggtttaatgcaactaaaagactccctttattggtgtgtgtgtgtgtgtgtgtgtgtatgtatgtgtactttgtgaggggcatgtgttcaatctgccatttaaaattacatgtggctgttaatgtgtggtcccagccagcaatggcagcatcactctgggacttgttagaaatgcaaattctcagctagatcccagaccttctgaatcataaattcccagggtagggtccaataatctgaattttaacaagtctttatgaattctgatagatgctcacgtttgagaaccactgttgtcgggtgtattgattcttctcttttccctccctactaacacacgggctcccggcttagagtatagagtcctttggcccaggagcaccaccttatggctgcagggatacctggaggatgatggctgacttaccatgtgtctgttttagaagtgaatattccttccatgaaggcctctgggggcatccacttaactggcagcatggcacagcctccctttctatagtagctcgccctgtggggaaggagaggaaaaccaaactaggatctggagatggcattaagcatctgccctgctgggaaagttgagaaagtggcaacaatatagtctacccattaaaggtctgaaattaaccatgagtccttggcggttcaggaggagagcaggggcacacagatcatttagttaagaactttggtgtcatttaatagaagacaaaacaaaccacgagaggcatgagaggaatgatctatgcaatgactaagatacctgctagcagatgtttagctttctctgttgggttttgtttattatagctcacaatgaataacattactccaaccttataagtatagtgtgtttctgatgatctgcagtaatgcaagatccaaaatgggagaactgagagcagggcttgtgtcttaatcattttggatcctctgacactcacacagcatttagttcagtataggcaatcaaccagtaatctagacagctgtgtggatgctgcctcccatgacacacccagacaaaagaacacagggctaggtgtggagttggcttacaaggtagatgagttaatttattagttttcatcagtaatgtcattaatgcaactcactgctaaaaaccaataaattaactcatctgcctgttaggccaattgcatgtctagcctggtgttctcctgtgtgagtgtgttacaggaagcagcttcctgccagctgtcgacattaattaattacctcaataaataagtactgaatatttagtatgtatcaggtactctgccatgtgctgaggacataaataggtcagtctctctctcccaaggatattgtttagtggaagaaatggatatatatgcattgcaatatagaaaacacagtaatgcaggtatgtgcaaggctcagtgacacaaatgaagaattgattcattctacttgaggcaggggtagggaaagcttcacagaagggcactgatggagctgaggagaaaagacgctctcccagaagaccattcctgacccgtgccattgtacaaagtgcagagtaggtggggaatgaaggactgtaggtaacttagggtggttgaagcctggagctgggagctgtcagagctgagcctgggaaggaaaagtcagataacagagggctcgaggagtcatgctgcagcatttgtatttgaaatgagaggcagtcccagggtattctgaggagggagaggaaggaacgctgagcttgtgggtagtgttagaaggcgaagtggagcagaggagaggagtgcgacggatagcagtggtagacactccagagacgtctttactacatcttccacatgctgctgccccgtggtaacatgatggcctcagcatgctcacccctgtggggactgttaccatgtttgatggaggccttcaggggtggtgtctggatcagtctcacttattccccaaagagttaaagctccatataacgattgctcctctctctacccctgtgagttagggaaggggtcatcctgtgcaaggagggacttgctgagctcacatagcaagtcagtgttgtaaataatcagggaaaaaaaggaactagaggctaggaagagaagagtgagaaaaagtacaattaaagtagtattagcttttaaaactgaaaaaaaaaataatttttaaaatgtagtcttgaaaatgtgacagggaaaaaaaaaataaggctgcgctaagtactgatgggttctgcgctatactccacatctcctggggtggctaaagctgagcaatgagccaggccctgcatcctgcccgacctgggatgcagatgcctgcggtgttagaagccatagccacttagaattcctgagtactgaggagttgaggaagttcaataaagctcactttgaaggtctttccacatcaagtatccaagttatcccatgtctcagagcatggccagattacagttggaaccgatggacaacctaattaagaacttggtgttggctgggcatggaggctcacacctgtaatcccagcactttgggaagctgaggcgggcagatcacctgaggttgggagtttgaggccagcctgaccaacatggagaaacctcgtctctactaaaaatacaaaaaattagccaggcatggtggtgcatgcctgtaatcccagctactcgagaagctgaggcaggaaaatcgcttgaacccgggaggcagaggttgtggtgagccgagttcgtgccatggcactccagcctgggcaacaagagcgaaactccgtctcaaaaaaaaaaaaaaaaaaaaagcttggtgtcaattactgcaggaagtgtgatcccagatttaggccttcgggcatggtcactaattaaggtttcccatagcctgaaaaggaacttagtgaaattttaggtagaaagttgacagggtaccaggagatgatgtaagggacaagcagccacaccccattcttgaggggctgaggtggaagagacaggcccggaggggtgaggcagtctttactcacctgtagatgtctcgggccatcccgaagtctccaatcttggccactcttccagggcctggacaggtcaagaggcagtttctggcagcaatgtctctgggaagaaaggaaatgcatttcctaattttatccctaggaagatgagtgtacaacggccatcactaggattttatctccaagctgaagtttaaatagttccttcccttccctatatttcctttagtatagtatacttcagtgtgagagaaacagccttaacaattctaggcctcacaactaagagagaaatggaaaaggattaggggaaatgattaaaaatgtttaatggggcaaccataatgaaatgcatcatactaggaactaggatttattagccttttactaggtgctaagtgttgttgtaagtgcttcatatctaactctcacaacaaccttataagacacaaggtgctattactgtcctcattttattttttaaaaagtaagctaaaagtagataacatagggccataaggaatgctatctggccttaggcagatttggtacaaaccacgggctggtttctgccagttgtttgaaaaagtgttttagaacagcatgacttccctgaaatcaaattcaagtagattaagatattcacaaatatttctagttttttgttttgttttgagacagagtcttgctctgttacccaggctggagtgcagtggtgcgatcttggctcactgcaacctctgcctcccgggttcaagcaattctcctatttcagcctcccaagtagctggggttacaggcatgcagcaccacacctggctaattttttgtatttttagtagagacagggtttcaccaagttggccaggctggtcttgaactcctgacctcaggtgatccacctgcctcggcctcccaaagttattattattaatttttaaaataagccattatggttcttttgtccatgattttatctaaagcccttgctaagctacatggctgaagaatcgcttcttccaggtgataaagttgtcatctctgctgttgactatagatgacctgctttcctgtagcctgcctctgaggcatggtcaaccgctgtccaagactcatcagcttctactctctgcttaccattctggtcatgcatgtaggaatgaaggatacagccagaagaagtctgggatgggtctctaataatattaaggtcctgtgcaggaaaaaacaagatgtacttagggagcacagctgctgttttcatgttcaactggtttcatgatggttctgatcctaggttgagaaaggacttagagaatcaactggctactaggatactatttaaaaaaaaggatcttgattggggatcatgactgagggtacaagaataacgggttcaggtaggagattcatgttgttaatgctgctgacctgatccagaaggtttaagttgaattttgaggtggtgtataaaatgcccccataaaaccataaaagcataacacatatgacatcaaaaagaaagaaaaatagttggctgtatagccgttaattctcaagagaaatatagcaaagtagaccaggaacaatatttatggctccagaaaagtctttacactgatgtgtatggaatggttgttttaaaaagtgatcgtgaatttaatggcaagaaggtaaatgcagtacatagaatacatcaagagttgggagagtgacacgtcatttatgaaatggcaataaaccatgtccaaaggaaaaagatccaatttttttaaaaaaatggaagcatgtggatctggtgaggaagttccactctgaattccaaaagcgtaaaagtatacatgtgtggaagtccatgaatcttaagagcagataaagggtggagggagagagagaattcgaggcaactctgttgtgggtatgtaccacagacctcttagctagttagaacatgtaaaagacgttttttccatacagatgaccaaattgccccagaaggacagtttctgccagaagttttcttttgcttaaaacagatcatctgataccttcttgatttggtgtttgacaatttaatttcttaaaaaggagaaaagagcaataaatgattactctgggatctaattctaaccttcagtaactatttccagatatggaagtgacaggagtcttgagggaatgtaatcctgttaacatcatagcaacagagcattgggtatcatcaaaatgtcttgtggctgtaggaaaggagatgtcaaaaggtcagaggacaaatggaaatgatccctcagccagagaatctgtatgctatggtgaccaacgtgggcagagataaaaaacaaaagacaagtagaaaagatcccagtgctaagtgaaggaagacatctggccaccaggtgacgcgggttgctctcataggagtctagacttaaagcacatggacaaagatggaaagatgactctaaccaaggacgacttcaaaaggagcacagcttggtcttgactgagcaatggaatggcaaagcccagagctgagatttatggaaagttctgggtacaatgcaaaggacaagaacaggactggggagcggggaaagggctgaaaaactaccttaaaaaaaagaacagaactgatagactcttagaaggagcagatggtaaagctaggcccagctcctttttggcttccattatttctatgaagcagtatgacctgcaagttggaaagggttagaagctggagggagaactgaaggctaaaaggatgaagtgacaggaagaggataagctcttctgagagttgactgcctcatgttaggagtgactttggaacttaggcaagtgtacttcctgacctctcatttccccatttttattagggagaaagcataacttgttatatatttgcatgattttctatttctttgttttttctttttttttctttgagatgcagttttgctcttgttgcccaggctggagtgcaatggcacgatctcagctcactgcaacctccacctcctgggttcaagtgattctcctgcctcacctcccgagtagctgggattataggcgtcccccaccatgcctggctaattttgtatttttagtagacatggggttgctccatgttggtcaggctggtctcgaactcccaacctcatgtgattctcccgcctcagcctcccaaagtgctgggattacaggcatgatacttttctatttctaagctcttacaacatctctcattttctcttttgtacttacatattttaattattatgaacatgccttaaactcttagaagacatgtgttaataaattattgtgagttcaccaggttattatttactacattagaggcaaatcattaaggaagagctttgcaaagagcctgatgatctgttttacttttctgatttcaagctgtcagctgagaaagtcatcagctttcacaaggaaagacatacatgatatatgatgttcacagcatgatgtcccagtctatacagcttttaaacacaagaatgattgtaatagaagaaactaagtatagaagcaatgaaaatcatctttatgcttcatttcagagtattttagaaaaaattaatgtatccaacaaacattgtgtctatgccaagtatacaaagatgactaaaacagcatccttgcctataagccacccattgtcaaaaatgcaattccttaacttccccataaggagcccagttttctatggcagggggaagccttaaagtgatataggacttgaacattcaagatacaggcaggggtcctcacaggaggttaagaataacttataggtctccagccctggcgaggatattttatgacacttgttttatgtaaggggcaagtgaatccctgatagaataagttaccatctcaaagacaaagctgaaggggccaggagccatcgctcatgcctgaaatcctagcatttcaggaggccaaggtgggaggattactggagcccagaaattcgagaccagcctgggcaacaaagtgagaccctgtctctcacaaaaaaacaataaaacaaagctgaatcatcctacatccaaatggctctggagggagacctagtattctgctctgaagggggaaatgtgagcccttgagatctgcggggaagcacacagatcagcgacaggatgacaggaagagcacagtcactttgactcaccggtggatgaagtggttttcctccaaatactgacagccacaggcaatgtcccgagccacgtgcagaaggtccagcatggccagggaggagggctggctctgtggggagacagaagcgggccactgacgaggagcttgtcagtgagaggagggaaatctgaaatgctggcttccagtgctcacaaggaggcagaccgtgaacatgcagctacaccaggggcctcggccctggctgcacattagaaatcacctggaggcatttgaaagaatttggatgcctgggccccaacccagacctctctgggtgggcatagtatttgtacatttgaagtcttcccaggtaatatgatgccagcgtgcagcgaaggctcggaacacccagactccgggaagctaggttggagcaggtgttctttcccttttaatttattgtgcacattctctcaccccaatcttcataagcatttgaatacccccaatttataaacaagtttgtgaggaaaccacaggggaataggggagttttaaaaatcctcgatttaaatgtcttaaaatatttcttaaaactaattttcttcaagcagatccagcgctaaaattgattgaaaaagaaaagcttttgggaaatgctgggcaattatgagctatctcaagcttttccgcatgaggtctctttcattcaaaaggagatgtcacctccctacccctctggggacatctcatcttggcttcctggacagccttgctgagcacaatgaagcctttccagaaggcgacatcccatcttggcctctcttttaattcctaaatccctgacgtgtgcggcagctcagcttcatgcagtgtccgagtcactgtgttgttccatgttgatttcaccatttccccaagtcacggtgatgaagttccagagacagggatctcaccctcccacagcacccagcacaatgctggacacacactgggggttcagtgagtgttgcgtggctgattggttgattatagctgcaggccaggatttacctggaggagtatgattcacatacctccccaagaaagcacacgcaggtagggggtcaaatcaatcccctttagggccgccccaagaaaggtgtttgtttaagctggtgactcttgagcacctgggcaaactccctgcaggaaattcatgcttgtagctctcctattttgctcttcttttgaagggtgggctgaggactgggctctttagtcctgaggtgcccacagggaagtcacccagccaggcggcagcggtggaaccaggtggggtctgggtgcaggcttagcctgctggaggtttttctctgccatagatcagggcctccccaggactccctggagcaatggcctgggtctggaggaggtagacagagtcttgcttctctaggccgtgcttcagttcttggggagacaactgagagtggatagttcccctaccggtgccttacatgccccagagcacatacatgatctgctgtgtggtaggtagggaagagaaggtgatctccatattaacgatgagaaggctgaggactcagagaggctacctgactcaccccaggtcacacagctaataagcgtggagccaaagctgcccggagatgggctttaaggatctgggttgggagaggcatcctccctcttccctgggatccaaggagttaaaatggaagagagagtgcctgaagggggttggagcgtatgtatgtgactacagtgcccaatgcacaccaaatgcagaatacagcacccacaaacggcaaacaccacacttcagtggcccatcgagctgacccgggctccaccctgctggcctcttccaggccatgtagtctggggctggctgctcagcctctcagagccagtttcatctgtgacagtggcgtgggactgtcggtctccctgggttgtcaggagcacccacgccagcagcctcgggcagtgcctcatcaggggacccgaggtattgaggggtttccacatgggagaccagggggactcagaaaatggctccttgtgtttggcttatccagaggcctcgttaggggcagagggggtacctctgcacaggcgggcagcagagactctgatcattcccatcaagcagcactcatgcctgcatcatccctcctgcggcaaagagttggaatcaggattttatccccatctgccgctggagtgcagcacttcctcggacccagctgttcttctcatggccatggtcgtgggccttgctgcaggtgctccccatggtgggtttgcaggatggaagagcgaaatatctttttgctcttcaggagcatgctctctgtccctaccagaggaggccctggccctagctgtgctagggccttgaggaagattttcttcctaccagtctctttgtgtcttagcatccatcactcaggatgcgagggccatagatgtctcggaagccccaggagcctggagcgctgtggggactaaatctctctgggcattaactcacgggctaggctgttatggccccctgtccttggctgctcagagcagattaactgctccactaatcagtgtgcacagggcagacagtcagcaagcgtgggttatggggggtgtctggtgtgtacgtgtctgtggtgtgcgtgtgtattgtgtatatgtgcgtatggtgtgtgtgttttgtgtatgtgttgtgtatatgtggggtgtatggtgtgtgtggtggatgtctgtggtgtgtatatgtgtttgtgttttgtgtacgtgtgtggtttgtgtaggatgtgtgaggtgtgtgtggtgtgtatgtgtgggggtgtatgtggcatatatgtgtgtggtgtgtatatgtgcagtatatatggtgtgtgttgtatgtgtgtggtgtgtgcgtggcatgtgtgattggttgtgagtatatgtggtatatgtctttatggtgtgtggggggtgtgtgtgtggcatgtgatgtgtgtgtggtgtgtgcgtggtgtgtgtgtggcatgtgaggtgtgtgtggtgtgtgcgtgagtgtatgtggtatgtgtctgggggcatgtgtgtggtgtgtgttgtatgtgtatgtgtagtgtatgtaagtggtatatgtctatgtggtgtgtctgtggggggggggcgtgtgtggtgtgtgtgtgtgtgtgtgtagtgtatgtgttgtgtatatgtctgtgtgttgtgtacatgtgtggtgttttgtgtgtgttgcatgttgcatagatgtgttttatgtctgtagtgtgtgatgtacgtgtgtggtgtgttttttgtgtggtgcatgtctgtggtgtgtgtgatgtgtgtatatatgcatgtggtgtgtgttttttgtgtgtagcatgtgttgtgcgtgtgtggtgtgtgtctgggaggggctgtgtgcatgggtggggtggggtgggaggagctgtggacattggcaaacccgatgctgaatctagactcgcagagcattgccagccagtgcaccctgggaccaagtgattttttcatctgtacccatgcatttcgtttccacaacaggcacggctgacctgggcatccactctgtctaccgcgtctgcacatccgttctgtcatttcatgtttgcacagatgttgtctgaggccagagccttttatcccatctcaaagggtctttgatcctgatctaaggtctgtggagccactgagctacagagctggcaggaagtgaggacagagacctctgattctgcacctcaagcctggttcctgcacacagtaggtcatcagggaacccctgggagtatcaggagtatcagggtgattccaacaagcgaatcaggtggaattcaggcctctgaagtccaagtttcagaatctggaggcacacctccgcctactttctcttcatggcacatgtttctccatccctcatgtcccttggccgattcaccctcctttatcctgtgtaggatttactgatattagtcctgtctgtctgctggaaatcacattcctttctcacagtccactgaatcctcatcttacaaagttggattttgtggccccgagaatccatgcaggaagcccagctaagccccagggaagctgctgccacaaacacatctgcattggtggctctagagggccacaattggacatttgaaatcggccaaggatcccaggaaggacagctcacctgggcctggtgggtgtatgggaggcggggaggaccatgactggggtgctgcctgggtgtgcctggttggcaacgagagccacacagaggaaaagcggggccaagggttgaaagagcagattgggtgagggtgggactctggccctgagaagtggctcttccaaggacaggccccctccccgttctgggggtccctcaggtagtgcctgctgttagagggtagaacttggggacaggctcctgttctgactctccgagggtggcactctggggtgggggtagtgagagagagagaatgatctgcctttccttgctggactatgttctttgtaataatattggaatcatctttcatcatcaaaggagagagatgcctttgtctttgagagagggagagagaaagggggaggggagagagggagagatagagacacaccactcctcactcctgccatctcctgcccccgaagtccttgaacttgccaagtgctgggctcccagactccctttgcaaagtccctctcctttgcatgcatacaactttctctccttaagcctcaggaaggtccagtgggagaaccagggctgtgcctcttcccaaagtgtgatgccacgtgtcccccactgacagcagtgctgctgagaatctcagggcatgagggccaaaggctctgccttcctaggtggtggtgggaaagccagtgaatctgatgcctgtaccatggcagagatgcctggatgcctggcagtgttggctctaaggacacaacctcatcttgatagtttacagcttcccagaggggaccactggataagcagtaagttggagagggcactgaatcaagagtcacaaggcctgagttctagtcccagctcttccacttcctgtgtggccatggcaagtcccgtaatctctctgggccaccgttttctcatccatagaattggggagagacctgcattgtctgttcatagggtggtgttgagaaatgtgaaaggtctgaggaggatgccagctgatgagggctcttatgagacagacaggtgtagtctttatctccctgctccctgcccagtcctcctgccaggtatgctcaggtgcacacaaattcctcttctcaaggggtaagacagtattcttcttagatactgagatgcgtcacccagtggctaaggtgaaggtattttacatggatcctgactgaaggtggagatcagaatagctatgaccttgcagggcttccatcaccactttgagtccctttgagcagtgtggtcaggttgggctttctggaaccactggctgtcagtcttccctcctttcctgggagcgggagggtggccgctgcttttactgtgcaagtcttccttgtgatccccatagtacagtggttcgttgaggaagcctggatcctaaccttggggcctgctcagctccagttcctggtatccggggcctgctgaagacctgcagacccaagcatgggcagctgggctctgggtctgcccagggtgctatgtttaataatttagaaccacctttgagatgttctagtccaatcctcagatctcacctgtgaggatacccaggttaaaggtttaagactgccctaaactacacgggtgtctaatggccaagttggagctggagcttgggattcctgggtccaccctgggtatcttcacttcccaagctctgttaaccataagatgtgtgtagcaccttcctaaatatacggttggaatgtccaggtattattatccctacttgagacgtgaggactgtgggctctgaatgagtagctgcagagtgacctgcccaggtcagttgcttgagtagttacatggctgtcatgaaagttctcctctgtgtttgtctctagtttggttttccagagtcagcaggccatgagaatggatccaggctatagaatgtggatatggtttggatttgtgtccctgcccaaatcttacgttgaattgtaatccctagtgttggaggaggggcctggtgggaggtgattggaccatgggtggatttcccccttgctattctcatgatagtgagtgagttctcatgagacctggttgtttaaaagtgtacagcgcttcccccttcattctgctcctgccatgtaagacgtgcctccttccccttcaccttctgcaatgattgtaagtttcctgaggcctccccaaccatgcttcctgtacagcctgcagaactatgagccacttaaatctcttttctttgtaaattactcagagtcaggtagttcttatataaatgcaagaatggactaatacaaatgcattgcaggagccttgcacaagctccttggggctggggctcagccatcatctacctctatcttctgtccattctcttccagccagtcagtcacccccctgtccaagcctaaagttgacaccctgggttccatcgaggaacttgctacccaggctgcccactcttgctccttccatccttgctcctgtccttggcacaacaactgcagcaaagactggttctcactcaccgggcgagggcgggtctctcggaggaaggacttgaggtctccccccgccatgagctccagcaggatgaaccggggcagggattgcaggctcaccccaatgcagcgaacaatgttctggtggttgaatttgctgcagagcagagagggatgtaaccaaaattaactgagctgagtctgggcaaatcttaaactgggaggaacaggatacaaagttacattttcagcagctacaatgtataaaggcattctgtaaacatgggcagcaggggtcccgggctgagcctaaacccagaatcttgctggtgagcaggtgggaagaaccacagcaggctccacaggagttccatttgcaggagagtggctggagctgtgaggatgttgctcaggcacttgggtgaggaagtgtctcagggggcaggagagtgtctttctcagatactggtgcgtggactgggtgctagaattcatggtcgatttctcccaggaaggcctcaggcagaaggtgaagcaaaacaactgcttccaagagagactgggtgagacttgccaagtgacagcgtgtgaaacagagccagcaaaaggggatggcctcacgagtctatcagtttcccgtggattcctcatgggagggaccaagacttgggttttcttgttaacatgatccctttaggacacacagggcagtagggcctaggaattccacatgggccaacatgcatgtgtgtgcatacacacatgtacacacagccccccaagtgttgaaagactgggtgattagacaccaacataataatggttagttaccaccaagtagtgagatttgagtgatatgggtcttcttcaatataatctcatacttgccaagttttattcataatcaggaattatatgtatcatcagaaaataaatgttattttgtgtgtcctcctgtggttccagacctcacagccatatcactcacactgcctggccttgttacccctgccacttccaccaaggggacatcccagtctgcccccacctgtcaggacgttcagagtcttcccagtgtgacagggggccatgagcccccacctgatcttgaggtcaaatatctgccccctccttgaggggatctgctgtcacagcggacgccctcaggagccataggcactgagactctcagcttaaatccagatcttggagcctcaagtcaaaaggtgcagccagctgagactcagccctgctgatgggagcctaggatggggtggcctcccatcatattagaagcacaattactgggattggtgaagggtcttggagggagattatatcttgtactgtcaaagtctagcatgctccatttcttaagaaaaagtgagggaagaagaaccagtggataacagcagggatactggttgcagacagtgacatcggtgggattattaggccacacagactttgtttctgaaacaaccatcaagggttgttccattctggtaagaagtgtctagaatgtttgggagtctcctactggagaaaaggggacatgctagggacaacacgatttcccttggagatatcgatctgttagaaacctctccaggttctttgggggcagaggggagttggggtgagggtgtctctctgtggctttacctgatgatcagggcttccatgaggaaatccagttcgtcctgttcagagcacacttcaggcagcgtctgggcagagaaggggagggtggggaggaggaggaggctgtgagctgagaactgcagcctacagagtccgcaagccaagggcaggctcaagagtgagccacttcttaccttcacagccacttgcagggggcttgggtcgttgggcattccggacacctggccttcatacacctccccaaaggcgccatggcccagacccctgtgcaaaggagaagacaagaggagacagagtcaaacaggccacaataatgaggcagctgggggtcctgagcctgggcgtcacatttagtggacaaacacgagaggcgggggtaacatacacactcaggagtaataccctcaacatggctttgctatgcaatctcgggcttccagttcttcacctgaaaactggtaagaaggattccaaccagggactcatgacaatggtcaaatgtttattcattcaatcagtagttattgagtctctgatatttgccagggacacaggggtgcataagccatggcttttccccgggggaggttcatgctccttggggagagacagatcactgtgggtactggctggggagtatttccagtgagtgacagaggaaggcgcagttgctctagatgctcagaggaggggccctttgctcccctgctcccctggagggaaggggagccaggtagacttggagagagcacatctgaatgaattttgaggagagccctggttctcctctcattgtataaactccataaactatgggagttaatgtaagccaacatacatggccctgaatgtcaaggcttgtcctcctaggagggctaggggtgcccatagggagggctctgccggccttttgtggctagaggagtctgcggtgctgtgataacattcagcccctacactgcacccctctcctcccaggacggcagcagggcgctcaccgaatgagggtgatgtttttccgcggcacctccttcaggtcactgatggaggaggtcttgccagcaaagcagtagttggggttgtagtcggtcatgatggtcgaggtgcggagcttgctcagcttgtactcagggctctgcagctccatctgcatggcttgcagctcctggtgcttccggcggtacactgcaggtgggtggtcagctgcaacatggcctggcagcctggcccttgaagcactacacaggccacttcctacaggaagcctccctggatctccatatcctcccctgagctctgaacctttccatcatacttagaaatactaataaaatgattaaagaaggtgtgtctttaattgaagcatgatttaaagtaaatgcaaagctaaaaatcagatatatggaaaataattatttgtattatatagggcagagtcatgttagtctggttcctccaagaagcagactggagatgggattagacccaatatggtctgcagattttattagaagaaatgcccatgagaggaaatggggagggagccagggaaggctgggtgaaccagcagactgtgttgcaagtataaccccacgtgaacgagggagggagggaaggttgggtggaagcaccctgggtgccatggagcctaaggaagtttcagcaaggccctaaggggttctggagccaaagtcagtcatcagaggagtcccatgactcccaggaattggcctgccttagtatttctgctgtgctcagccattgggtagggcagcttcagtgcaatcacagcagtggatttgagggtgcagctgggatcttggtcagttgtgtttcctatagttggagaactgccaagccacagagttggagaagagccacatcatgaaaagatctctgaattggtgtctggggatctgtgctctaattccgcctcttgttacttacaagctgagccatgaggaccaggtcacaggacctctttggactgcagtttccctctctgtaggcagggatggtaactcctgccctgtttccctaaccactgccactccccaccctctagggttgtcaatgaaatgaattcaccaacataaaatggttttgaaaaatcctaaagagctctaccaatgtgagtgaccattatcactcctacatgtgaggatgttctggaaggcaaactccatggaagccagaacaaaattgtgattcagtgggtagattctgtgtgtaaagcccagccccccaacacatgggccagggcaaatgagtcacccgctatgtgctcagttccctcctctatgcaatggaccgaccgtgatcagattagggttacctgaggatcgaatgaattgaaatgtgtaaattgccgagcacgtagtaaccatgcaacaagtgttagctcctattatcctgtccctttgagggatggcaccatatggggacacagtgtgtgctgccatctcccttctaccggcagatccctttgcctgcaggggcctggcctgcgagggctctcaagagcctttccctctgcccttttcaagcctctgcccatctgtcctgggcatgtctctgccagcagtaagagctggttgggaccacactgagttctctgtgacctgcaggtcagctcaccttggctcacaggctgaacagaaatatactcagaaaccgattttcctatctctctgcctggagggtggtggagggctggtttggggaagagtgggctagtgcattacatagggtgggagccaaacaggagctgcgccggtggaagcatgtgggagctagaagtgacgtctaggggtgggggcgagctttcaccatcgtgatggacactgaaggagctccccaccccctgatcagccaggaggatacacacggggctgaggtgcagaatcaggggctcctcagggaactgcagctgctctggtggggggaaggttgggagcttccgttttggcttggcctgggctgccctaatcaccaccccacccaattccagggactagcataacgaagtgacaccttggcacctgtggcacagcctgagacactattcagtcctgccttcctgcccccttgggagtccctggggctctgtgcactcaccaatcatgatgccggagaaagccaggaccagggcggccacgagggcagaggtcaccacagagaggatcagcgagagtggcaggtgtggctccggggtgggtgacactggaagacaggtcccactggggtattgacaaccacaccaggtctcctttgagttggtcccaagtcagaaataacctcccccactgagacaaaaactacttgctccttcccatcgctggagaccttgtcacacttttcttttcaggggaccatgagcaggaccagactcatcccgatttgacaggcttttagcagtagcttttgggtgaagggaaatttaacagggatgaatatcagtggcgggatgttggtttgaaacatgagctgcacaactatggggtgaggatggaaggtgaaacgaaagtggatctggaagagatgtgggggccgcaggtgaccaaacaacagggtgcgctgtaagtaacaccctctgaggctaagttacttccttgtggccctgaggcactgggctcacagtggggaggggtcctgtgccctctgctggccagaccacacggaggtatcgtgcttggtactggacactacatttcaaaagggacatcgatagtggaacacatgcagaagagggacactggtggggcgggggaagagacacaaaactgcatcttgtatgaactgctgcaaacaaatgggttatttagtctgaagaagagttaaaggaggaggatggggccaggtgcggtggctcacacctgtaatcccagcactttgggaggccgaggcgggtgaatcacctgaggtcaggagtttgagaccagcctggccaaaaggtgaaaccctgtctctactgaaaatatgaaaattagcctggcatggtggtgggcgcctgtagtcccagctactcaggaggctgaggcagaagaattgtttgaacctgggaagcggaggttgcagtgagccgagaccacaccattgcattccagcctgggcaacaacagtgaaactccgcctcaaaaaaaaaaaaaaaaaaaaaaaagaggaggagaatgggagcactgtcttcaaacactgcacatgcacagctgctgctgtaaggaaacctaggagaggaaggttaaggcaacaggtccccagctctgaaactgcccaagggaacagagaaccttaggagcagtaagatccctgtcactgggcatgtttaagtggaggcaggatggccccttggtgggggtggtagagggcttattctatagtagaggatttttaagactccttcaggagccatgacccacctttcacacagtggtcagagcactcgagctgtggcaggtaggggagggacagaaagtttacaaaaccgaatccagggtgttctggaacccagaaaccatttgtggtcatgggccaaatctcaggctatgggcccctctgcctcccctggccctgcccccttaccaatgcaggagacgccatcctcagccagcaccgtcccgtggtcacagaagcagatgaccttgtggctttcagggtccatgtgacattcgtctacctcacagtgactgcagtttagataatgcttaatattcacttccccgtggccttccatcactagtgacaaggagggagggtcagtcttgggccgagcctgcctccccactcccagcctcagtactatgtctccaggtggtcactgtgggtgctctggtggtccctgttcctaggtcccatagccactggaagcacaactgtgtagaagagtcttcctgtgcatatagagagtgcagcggaggcagcgggcatgggtgtctatggatgtttgcttttgagtcagtggtggagagaagcccacgcacatgatctttaggttggctggtgcaggtattgggctattactgttacatttcctaggattctgcctctgcattcatattaaagcacacatcctgacttctggaaaatgtggtgacctgcgccataggaagcttgcctgccagggacccataattgtgcctctgtatcctggatacaggtcagagactctgaggttttagcttggtgggaggactgacctaagcaagtttgttctgctgcctggcagagaagctaccttttaaagctggggtgtacaggatgcccagtggactgatgaaggaaaccccatcttccccatccatttcggggtcattgtttgaggctgcattgccgcctgagtagcaaaccagagcagagtttaacatggggggtgggtgccaaaatcttaacacacacacacgtcagtggggcatgcagctctggccaaagttagggggtcactggggacctcaggggcagggatgcggggagggaagggaggctcagggcacagaggctgcatgtgggatttggctcagtagatgctgggtgtgtggctaatttcccctcaggtccaggccagctcccactctgccggtggcccactaagaagtggttaatgtgagcaagagtccaaaaagttctagtctttccaggctgggatatgcccatggtgcctctcccaggactggtcaggatggtagcactgaagagttgctcttcagccccattgggtcagggttggggtgtggcgggctgtgcggattgcgggaaatgagcccctgtgccctgaggctcccgtccctcctttcatctggggctgggctatctttgggctcccccctcgggctcctcccacccacccagcttggaaaagaagagcatgtggttaacacaagcatcttacacacagcgtcaatgcaaaacacagacacgaacaccacagagcatgcatgcattcgtcctaatctgtggggagcggggagccatcgtctcccagcctctcagcttcagaaggctctgctgactgtgctctgaagcccagacgaggcagctggggtcaatgggcagctgcttgctgaagggctgggctaagcctgcctgcagttgccctcgggaatagctcccatcagcaggcacagcggcgcctttcaggaagctggtgggctgaggtagggagcaggagtaaggagtccatgaaaccacaaaccagccccttcaggagctggcttggccaggccatccaagggaggctgggggagtccttatgggtgactcagagactagtctggcaagccaaagcctctttatcatcgactttgggggacatcaagaatcacatgggatcttgatgctgtcgctgaggaagcctggaggcagggtgctggctcgaaagccagcaccctgcctctggctggtccaggcaggtcgagagggaggcgtgcagtcacatcacagtccacacttgggcaggccaggggagggcaggggagggcagggcagggaggtgaggagcctaggactaagcagggagggagtgacaccttgaacacgaatcatctttacctatatatcctccgcctcctccacctgaggagcacccccctccaccccctccgaaaccccctcttgtctcccacccccacttcttcatggcctgggggcaggaatgtcctccggtggcaccctcctgcaaagattttccggcccagagcaaggaagtgttatcattccagccacctccaccacctgcgggaagagatagggaacctgcgtgaggatgctggcaaggttcaattagccatgctggccagagaagcaggatgcaggacgccttggagggcgcccgcaccagctccagctcccggggcccatcttcagtggggcctgggggcttcagatccacactaggaaaaccaggaggctgcttgccctaggagacctgtttggccacagctgagtacacccagatgagagcgtgccttgtacccctgcttcctgccagtactctctggctcaaaagcaggggctgtgcttggttaaggatggggggacgtgggcagacaggcagcatggcgactaaactcgttcctctatcttctcttcatgtcagccaagccccgtagcactggaccttcgtttcattaactgcctcccgtcctaacgagaaaagggactcaccagtctttgagcagccacatgtcaaaaccttgcactaaagttccttgcaggaatcctggactaggctgaccagagagcccgttgctgtctgtgaaaccctggggaagaacgccccattctgagcctgtgtttcctcacctgtggcttggggataataagacccacctgatggggttgatgttccgctcaaaggagacagtgagtgtacgaaatgctccacaaactgccaggggtggggagcgtcaggggctcgagaggcagaacacacgcgtgcagacagcctcacacctgggctcagcctgcttagaggttctccagggccaggcgctcaggaactgctccaaggtcaggagcagaagccctggtgggtggacgataccctggcaacaaaggcagcctcagggctgtgcttcccaatgcctggggctgctttgggctcttacaaaggaagctatctacagagccgaggttgaatgtagccacaggttgaccacaagaaatctcttctgctaacctttgagattccaggatatcccctatgcctactgttccataggacatttgaatagacatctacagttgtccctcagtatctgtggaggttccaggatccctccatcacaccaaaataaatgtccctttatataaagtggcatagtatttgcacattctcctataaaaaaatcatctctagattacatataatacccaatacagggtaaatcctatgtaatagttattgtattatttagggaataagtctgtacatgttcagtaaagacacaatcatctttttttttttttttgagtatttttgatctgtggttggttgaatcccacgaacgcagaactgatggataggaaagggtggaggtattctaaaaaccctaaaaccctttctgctgcagcagatgatgcatgctggggacctggaaattgatggtggaaggcagaaacagcagtgtgtgtgtctgccggaaccctacgggtgaaccggcctggcagggtttctggaagcacttgtggcccagattctttgggacccagagggacctgtaggtgggatgactgtcttgctagaaagaggaagccaggttttgaaaatgaagctgaggtcaggaacaagcttgaatctagaatggggacaagcagagctgaggcgaggccatcaggcaagctggggggactttgttagccatgaaacctccaggggtgggtgttgagcttgggtttgtttcgctgtcctcccttctgctctcaggggagggtgtgggcctgtcaaggctgttgtcatgtggcagagagaaggccccttaggcgcgttaggggccagaagttggcgctggtgtttgtgcacggctgtgagtaagcgcgtaataaataaatcagaacgagatggacggagaccatgcgctgtgctttcatcctgctcagcccccagctgaggaggtttctgacccccatacccgttctgcagccttcgagcaaatgtgtggaaaggaaaataacccatatcaaaatcagaacaacggtgttttaaaaatacgaattgagtctggccaggcgtggtggctcacgcctgtaatcccagcactttgggaggccgaggcaggtgggtcacctgaggtcaggagattgagaccagcctgaccaacatggagaaaccacgtctctactaaaaatacaaaaattagctgggcgtggtggcgtgtgcctgtaatcccagctactcgggaggctgaggcaggagaatcgcttgaacctgcaagtcagaggtggcatgagccgagaccgtgccactgcactccagcctggtgacagagcgagactccgtctcaaaaacaaaaaacaaaaaacaaaaattgtctctatcactaaacagctcggccctgttgagaaaaaaaaagtcatcatgccttggtgagcccattggctctcctgtaaaacaggaatggtatctgcctggaaacctgcaggttgttttgacagcacatgtgcaacagaggcagaggtgcttcagggtttctcgggtgctgggcctcggtgctgcaaacgtcactggagatcctcagggtggacccatgactgtttctactcttctattctagccgtctctcaattgagagacagtttgcacatttgttttaattaatcccaaatcttaaatgccttctaagatcctcccacagtctgattgtgtggaaaagaaaatacaaaaaggaattgcattttctgtctttaggggtggctgactttagaggaatcagggaattgacactctcttccctgcctgtctcacatttctgtgcttctggctcccattaatgagggaggagagctcagccgtggagagtcaagtaagagattttccagcggggatacgcttgggtctggcagcccagggcctggaggtctgtaccatgggggtctaggaggcctgacattgcccagatttttttcacctgctcatatcctaactggggggcccatctgcccctggaggaagaaggaatctcagggggaggctctaacaattgcagggagggccagctggctgattgacggctgctccctgcctcactttctcagtgaccttctacaagtccaagctccaggtcagcaagatggcctgcagggctcccagggtgctgcctgccctccctccctggatatcggtaccaatattcagagctcctagcatcccaggtgccagtgactaagatgccctcaggcatgcgatggcatcggggcccagctgaaggcctgggagaggttctgggagagggcacgcttgcagcgctttacctgcggctccggaattgccgtttagccctagaaccgaggagttattctccagtctctctgggtggaacgtgtctgtcttggccccgtaggccctgccaccacctccggctgcaatgatcaggggcaccggcactccatccttcatctgaccaggggagacattcagacattgagaaaccgagctgtgcttccccctggagcccctaagctctggtaaattcaacctgactgagggtttgctgttttggggtgacctggtgacctctcagtggtctgaggtggtttgcgggctctgaacccttgttacaatagcccatcggctccgccagcttctctatcagtcagggttcaaccagagaagcaagacctatataccaagagcaaaatatagataccaggaggtgggggttgatcttagaggctgcttcctctacttcctctagcccctttcctgaagctccttagactggcctcagaggtctggatgctggtgattagaagcaggtctctctatgctctctctccctcattcttaggggtctctggctctgacccccaaagattcaaggttaagccctcagcatcacagtcctgtgggaggacctagcaggtggcctctgtcttcagtttctggcctggctgtgatgatgtcagcaaagtccaccttagggcagagagctggtccaggagggcacagtgggactctctgaaagtaggatggcaaaggctgtgcatggtgaaattgggctgatgtatcagtaagagaagagttctaccctttcctggacagacagactctatatctctctggatctcagtctgctcatctttattttttaattcttttgttggttttagagacagggtcttgctctattgctcaggctgaagttcaatggcgtgatgacagctcattgtagccttgaactcctgggttcaaatgatcctcctgcctcagcctcccaagtagctaggactacaggtgcaagccaccaaaactggctaatttttaaattttttttggtagagacaacgttttggtatgttgcccaagctgatcgtgaattcctgacctcaagtgatcctcctgccttggcctcccaaaatactaggattacaggaatgagccactgtacctggccctgctcatctttacacggggataagagcatctgaggtgtttctatcccagggctgtcatgaggctctgacattgcagatgcacaggaacctggtggaaatctggcagcacacaccataccttaaatacgtaggtggctccaccccctcctcctccgcctcctgcccactcatgcacgcttctgttcacacggatttcttcttctatcacattgttctctccaatgcagactttctggattaactggtttgtctgtagaaacaaaaagcacgttaggtttgtggccaaaccagagttctccactttgcagcagacagaacttctatgcttaaaaacaggatctgactctctctcaaaaaacttacagttgagttgaggaggcagaaaaatataccaataactgtcactctgggcagtgttagggaaggaccacaaggatagcttagacagaaaatgctaggagaaactgggagagagagagcaaggttttattgctgtgaggactgcttgtaggaggcggcttttagttgagccttgaaggatagggagtttttttttgtttgtttttgtttttttcacagagagtggggcaaagttatgtcattccaagagcagagagtggcatgagcccagagggaagtgggtgagtggggtgcgtgggggaaaagcacaagggtctctttggcccagaagtctatcaggacagagagattgtccaggacctgtttcgatcctgtgggatgaagagatccaagaaagaatgggaaaggtcctatgtggtgagatggggctggagggagcgtaaattaggtgggtagagagaattaaacggaacagtgtgatcatggctagaggccttgaaggcactgcaaggagtggacttcattctctatgagagccgttctctcactgagagccatcgaggttttctgagaagtcacagttctgaagcatcaggaggagagaaaaaaaccagcaagaggccagactcaagttttattcccagttcttctctgggaagatcagttctcccttttggacatctcattcctcctagctaatgttccattttttccctccggaatccctggcacacccctctgcttgccttgtagagtgagccctgcaatcaggtagtctggattctccacccaccctgggaaactgtgacaggggccctcgatctctgatcttccagtgtggctgcgaatgaagacaacacaggtcgttgtggcatttactgagcgtagtacaagtactaccctcaggcatctagtggagcgcctcacacatggtgggaactgagtaaatggctgctgttcttatctgtttgtttttgccatcttactccgtgcaatggcacgaccttggcccactgcaacttctgcctcccaagcagctgggactacaggtgcacaccaccatgccccgctaatttttgtatttttagtagaggaggggttttgccatgttggccaggctggtcttgaacgcctgacctcaggtgatccgcctgccttggcctcccaaagtgctgggattacaggcgtgagccaccgtgcccagccagctgctgttctaatttagattcacttctgggcccacatatgctcctggttggggctcaggtattagagagtccccaggattgtgctggagatttctgtaacagaatcctggaatccctgaagaagtaggatggtgcttcaaaaacagccacgcctgcttgtcggccaccacagctcagacgaattcttcaaacatcagcctgaccttggaggaaagtgacttttctttcacttaatagaaaaaaagccagtaaaacatcacatttccatcgatgctgcttcgtaaccagctagtggatgcagccattcttcttgagccacttcttacgctaaagcgctcaggggtgccggcaatgagtactacagaaatttccagataaatagccgagatgcagtttgtttcatggaattttggatttaacgatggaaataatttgatatttcttagagtggatctagtgtgggtggaaggctctgaattgctattgtagagagctggcatttcccatatgtatgtgcagctatgtcctggcctggggggagactcctgggaggagaccctgctcactgccacctggcacaggcgtgagttgcagggaatgtgccctgagggttggccctggggatgggtctgagggatgtgagctgtcagctgggcagagcacaggattcagggtccaatctgggttctttcttttgagacagggtctcactctgtcactcaggctggagtgcagtggcatgatcatagctcactgtagccacgaactcctgggctcaagtaatcatcctgccttagtctccagagtagctgggactacaggcacaagctaccaggctcgactttttttttttttttttttttttttttttttttaagaaacagggtcttgctatgttgcccagactggtctctgactcctggctttaagtagttctcttgcctcagccgcctgagtagctgggagtacaggtacgaaataccatgcttgactaatttttgtatttttttttttttttagatacagggtcttgctgtgttgcccaggctagtcactaactaagcgattctcctgactcagccttctcaaagtgctgggattacgggcatgagccatcacaccctgctcagtctgggttcttgacagctctgttggagatttgctgggctatacttggtgaggcaccccgcctccctggacttgcctcctcatctggagatggaggggctgcccagtctgaaccagtggtgctgagaaggtccaccccgtcggcctctgctccatctcccctcttggcttgcgggcagcagtgggacctccacccctaggtgatgccctcccctcatgaacagatccagagattgctgggatggggaggagacagcagtggggcttgaggatgggctttcctgtagttagagccaatttctttaaccaatatttattgagtacctactttgtgccatccctgttacaggaacttgggatatattggtgaacaagagaaagatcttttctgacccatgctcatcccccgcacccctgcttctgatgtctcctttagatcaggtgggggtggggagcggtcaaggctcttgctggaccagtagcagcatttggaggagctgccgccctttcctcacatgacttccaggactccccatcctcttgcatcctctcctacctccctggttcctcttctttgtcccgctttgctggttcctcttcttttcctgacctctaaatgttgagggtcccttaagctcggtcttcacattcttctctatccgtattgcatcctaggcaatctcatcctgtctcaaatttatgctaatttctccaatatttatatccccagcctggacctctctcctgaactctagcggcctgtctcccatcgtccacctgtctgcctgtggctgtctaccaggcctctacaactcagcatgtctgatattgaactcctgatcttgcccccagatttgctccttccacagtgttccctaactcaggtgatggcagctcccttcttccagtggctcaggcacaatttttggagtcatccttgactcttttctttctcttaatttctcattcaatctggcagaaaatccttttggatttgactttcaaattacacccagaattcaaccacttttcatcccctccactgttacaatcctagtctaagccatcatcatctcttgccaggattaatgccatagcccttgaattcattgtcttgacccttcccttgtgtccatagattcttctatggtagattcttcacattgcagccagagtgagctttttaacacacataccacattatgtcaccatttgcctcaaaaccctcctatggctccaacatgccttaaagtggcctgatccagccctattacctctgccttatctcttacctacccttcctttggctccctctcctccagcccgagtgttccttgagcatcgatgaacctctgggacatggcctttgctggggtcactgtttccccagatatttccccctccctctcctcagatgtaagttccttgagagcaaagatctttcttttgttcaccaatatatcccaagttcctgtaacagggatggcattaagtaggtactcaataaatattggttaaataaatttgaatgaattgagtgctgtctggattgtgggctggctcttcacaatatttgccttgcaggggatggtaatggtggaatttaacatttagaacagacttggcttcctaggggacatttggaagtgtctggaggcttttgtgattgtcatttctgggggctgttactggcaccaagtgagtaaaggataaggatgctgctaaacatcctgtaatacacaggacagatccccgcccctagccacaaagaattacctgctccaaaatgccaataatgccactgttgagaaagcctgatttagactcatgccaccaggcgaggtttgggaggcactggagaagcaaagacggagggctgtgtatgtgcacatgtgctgtgtttgggggtggggtggaggattctagcagctggagcccatttccagcacaggagctccagtgtggccgggtacatagaagggcaactccccgctgcccccatagatgtgcagttgaaccagcaaagctgccacatccggcagtttaattattttttatttattaatctttttgcgacagagttttgctctgttgcccaggctggagtgcagtggtgcgatcttggctcactgcaacctctgcctcctgggttcaagtgattctcgtgcctcagcctcctgagtagctgggactacaggtgtgcaccaccgcacctggctaatttttgtatttttagtatatacatggtttcgctgtgttggccaggctggtctcgaacttctgacctcaagtgatcctcccgctttggccttccaacttgctgggattacaggcatgaaccaccgcacccggcccctgcagtttaattcttagagtccacttcattatcttgagaattgtgtctagacaccattttttctgcctagtgagaactggagatggaggtagtgcctgacaaccgccatttttccccctttccaagtgcctcctcagaggtggagatgtgaagccacagcgaagaccagtcactctccccacatgcccctgctatgccttgcccaaccagcagagtgagctgccctctgttcctggcccagaatcgcctcctcctgcctgcttgggaacttcctgtgcatccacaaagtttgagagctagtagattgattaataaaaatgataaagtgcagcaaccccgaggaacaactagatttcaattgaatttttaaaaaagacgcggtcccgtgaaaagacataactgattacagtccaatcaagtgaaagtcccttgcagaagataatgcaatctttctgcttagatgaaggaattacattagcactcaataaattcccgtgaaaattatagcagcctgtaatttaatggcttaatatattatattaggttggaaagtcccaattatagttgctaaataaaagttggagttgagacattttttatgcaaaaggttgcacttgctaagcttactcctgtcgtttcaccttaaccccgaaggagcagaagggaaaaactgaactttacttttcatgcttcctcagctcctagcccagggcctggctcttaggagccctgaatttattttgtggaagtaaactgctttctcggtagcccctcttcccatatctctctgccaaggatgttctcaaataagtttctggagaaggagctgggggtcctgggtgctagaacatagctgtctgctttggccccttttcccaagcaaaagctgtgcttcaggtgagggagggggggagcctggcccaaccaggagattcacctggcagggtgctgagttcctgctaggatggccagctctgccaggtcctgcctccccctagcacaggcaagaggtgaaccactggggtgctgggagtttgcaaagctgctgtttaattactctttgctgtctcattctcctggtatgaacttccaggaggagggtgttgagtgttggtgcctccaagaggccttcccggggcctgacagagtgcagacgagaaacccctgctctgggcacttacactggggcaggcgtcctctccctgctgcccaaccaggatgtacagcatgtcatccttctccaggttgaagatgcccagcacagacacgccgtgggaccgcatcatggtgttcttcccgcctttcccgccagcagctccgtagcccgagatgctgcaatgggacaaagaacgttggctcccgctgtggtatgaagactgtcccccttcctgccaacccagcagcttccagtgggctaagcacatcgccatcgtggtctgagggttctcccccatatcagtccctgcagaaagggattcttctcccccacttcaggaaaggacgatcaagtttagagagggacagggagttgcctcagtcacagaactaagaaggtgaaagactagtaaagggtgcaagagagaaagagaggaaaagggcagggaggagggagggaagaagggagagaaggaggggagagagagagggaaacagcagagagagagagagagagagagagagagaggagactatatgaatgtggcatattggggtgatggctttctgaatacctaggatttcctcattatggttttctctccttgtcccagatcaatggactcatgtgaccttagacaagtaacttccctattcctcatctatactatggggataataagtgaacttgcctcctagcctacatgtgctatgaggattaaagaaattaagacatgtggtcttagaattgtggctgacatgtaataagcactcaattagtattagttaattattattattattaatgacggtagtagccataattgacttggtacaaagttgtaaagtctccccatggggtctggaaacaaggaggttcctcacagaatgactgaggagagcagtgtatatgagccgactgtctattcccatctcactggtaactcctcctggagaaatatgtgtgcaaacaaacaacccatcatgatgaaaataaaaacagagtgtggggatgggagatgatttctgctgcctcttaggttgctgcaatgaagtcaagcaaggatggggagaaaagaactctcttctgaaccatatcagaagagcggcatgtcttgaagacagctaacgcaccagctaacaaatgtgtccccagggaccagctgccagggtatgggactcggcagactttcacatccatgtgtattcagatccaaggtcttttacaaaaaaccaggaagagatgcaaggcagttttgcccatgtgcacatagtagctcctttatctacagttccaggaaatgtcccttcttccaagtgtgtgaggggcctcccggagctctcacaaggcagagcccacggcccttctgcagaggctgtttgcgaacatggcaggcaaggaactgaggtcttcatggaatgcaaatggagaatctagtgcccattgccctggtgagtgcctgggcattgatgggagtttattgaatgttgggagcggtgtaaggcgttgtgaacctgagatagctccaggctcttcaagagctcacaaagaaactgaggagacgatcttcatgatgaaaagagaagtctcaccatagggtggctatgttgaggaggcaaagtggagtgctcccgggctccctgatcaggtggggccatttcctgcccctgtgccctctctgagccccagcccctttcctagtaagagaagaatcattttcattccaaacaacatgatagtccaacaaaaggagctcatgggtgaaagccccggggaagctgcaaatctctggccaaaataagggtcgtcaggtgcttagggccaggagggagatgggggattgcgacaggtggttgtggggtgtggtgatggggtgaggaaggctgatgttggcttcacatggagcttgcagatgggtagggctctgagacaagcagaaagaggtggtgggaattggggcttgtgtgaacggaagtgaagaagcagggagcctcaagtatgtctggctgcagcaggtggatggagggggaagctgagggctgtaggtttggagagggctgtgggctgattaccagcatcctccaatgtgccaggcacaatgcatgctcacaggcacacggcatcacccaatagccataaacggcaaatgttattaatctcatttgacaaatgaggaaactgaggctcagagggactaagtaactcatctgaggccacacagccagtcagtggctggctatggtccaaacccttgcacatcccctcttagaggtcatttcctccccaatgtgctgctgggatgcacaaagagaggggtctgagaagctatttgcccctcctaattcccagactctcagccaaacactccctcctgatccatgagaaatggacaaggtgataacaataattaaaaggctgagaaaaaggaaggcttattggtgaaaggtaagaggaagcagcattatttagctcagtgaacctgggcaggggacgatgtggcggcttcctgtagtctagggacagcagtgtggatgggccccaactctgtcctgctcactgccccaggtttctgagtcctggtcaggctgcataaaaaagtcatctccacctgaagatgtggtttgcttggaaaacttcagcccaggacaaagtcctcatcctacccactcctgctgtggttgagaggtaagcgtcatgctgcccattccttttggcatcatttgcatagtcatttgcatcaaccatgcattatgaatcattctgaactctttcgtatgtttaaatttagccaaattattatattttagacgttgtttgttcctgactccttttacccttcctaagccttctttgctatttttctcaccccgctcccctcaaccacatctgagagccagccccatctatgtcttgacctagttcttgatggtggggtgggatggaaaaagcccagggctccaagtcatctgctggttcttgtccccgttcttctggctgtgtgacctgaggcaacatggtcaatttctcagagcctcaacgtccactactgaggaagaaaatgaagacaagaacccctgctctcatgggcatacaaagcgaatttgagaagactgcaaacccatgcaaagcacaaggcgagacccggggctggggtcagctctctagattccaaagtagacagcagagcttggcaagcaggtttctgtggctgggttgtactttcctgggtggtggcctcagccccacatttccaacccagacaaggggctggcttaaagtcagggggagcaggcagctgcctacctgaaataattgcaggagtcctagaaggagtagctccctcatcagtcccctgaagcctgaaattccaccattagagcttcactcctctggaagcttctagttgctactacaggactgattgccttaggagtgggatgtgccacaggtagaaaagcaagggcttgaatgcagacagacctggatccagatcccagctctgccactcagggccaggagtaggttgagcccggcgaggtgcctccctcccagggaggaccttgcactcgactgaccccaagaagaagcacctccttaaattttctgcccaaggtgctttgcttacctctccccagtcctggccctgccagtgttactcactagctgtgagaccttgggtgattatttacccccgctctgagcccagattcctcatgtataaaaaggggataataatacctaccttggaaggctgttatgataattaaatgagatgatgcttataagggacctacttcagagcccagagggtagccagtgagtgacaaatggcagctgctgtcatcatgtgcccccatgggtgagcctgtccactccttttccgggggtgacttctgggaggcagaaggggaccaagtgggcgaaccagggcatggccaagggggcttggggtcaaggctgttcagtttcacccagggcccacctctgtgtaaagcacagggcagccttagctcttctgaagacccctgcaccctgtgaatcacgttacacaaactcatgctatgataatagcctcagcctgtctctctgaagctttcttcccatcccttgtaaacaatttatttctgatggttgagaaacaacaagaaattaatatacctgccactcaagtggggaaaatgacttgcagtgattccaatttactggaaattacaagatactgctctcaatgagctgatgctgtaattttttgttttttcctcatctaaatccatgtcccctggtcagaagagatgtttattgggtttgtgttttgtattagaaactgttacctgatgtaattgagttgtgaatcttttttaaataaagaattagcagcaaatcaaagaggctgcctgccggatcctgaaatgagagcacagctggtgtgtagcacatccacagtgtccacacacacggggggatcttgcgggagagagtggactgccgctcagaaaaacagaagcaccccattcctttccggcacaccctctggaggagcggcagagtggcatcctgctctgggctctgcctttaactccccgtgggatcctgggcaaggcccttttctcccgtttctcagtttcctcatttgtgaaatcaggatggtgaggtctgtcctacccaccctgcagggttattgtgatgacacatgacgcgtgtgagtgtggacggagcttggtcagcgggagatttctgatcaggtatatagttgtattatccagataggagtcagggttgaagggcccaattgtggaggcaggtgcttctcagtggggccggcccaggttccactcctgttgcatcagtgagcaaggttcatggtctgtttctcccttagcaccttcctggccagtgtagccctaagtgccttgaaacacctgagcttgcagggacctcagtgacctcgctctatagcccctcgctctgcagatggagcctgtggagaggagggaagacaactttctaagtcacatggagcatcggtggtggaggttgaactcaaacttaattctgcctgcagcccatccatcttttcctaattcctccatctctgacattccctggtctgtgccctttatagcgatggctatccatacaattactttggcaattaatcatgcctgtgatatctctcctactattgtctagaacctgactggcattgtggactgttattaaacttttctgtcctgtggtctttccagagactgtgaggctccagagtctcaggcctttctaccagtctagtcagtgcctggaacacagtagggctccatggctcagtgcctggcacacagtaggagtgttatggctcagtgcctgacacgtggtaggactccatgggacagtgcccttcacacagttggggctgtatggctcactgccctgcacacagtaggggctccatggctcagtgccctgcacacagttggagcggtatggctcagtgccctgcacacagcaaggtttcatggctcagtgccctgcacacagtaggggctttatggctcagtgtcctgcacatagtaggggctccatggctcagtgccctgcacacagtaggggctttatggctcaatgccctgcacacagcagggctccatggctcagtgccctgcacacagtaggggctccatggctcagtgccctgcacacagtaggggctccatggctcagtgccctgcacacagtaggggctccatggctcagtgccctgcacgtagtaggggctccatggctcagtgccctgcacgtagtaggggctccatggctcagtgccctgcacacagtaggggctttatgactcagtgccctgcacatagtaggggctccatgtctcagtgccctgcacaaagtagggctttatggctcaatgccctgcacacagcagggctccatggctcagtgccctgcacacagtaggggctttatggctcagtgccctgcacatagtaggggctccatggctcagtgccctgcacacagtaggggctttatggctcaatgccctgcacacagcagggctccatggctcagtgccctgcacactaagggctttatggctcagtgccctgcacacagtaggggctccatagctcagtgccctgcacatagtaggggctctatggctcagtgccttgcacacagttggggctccatggctcagtgccctgcacacagtagggcttcatggctatttgtggagttgaatgatggcgttgtccggctgcacacgctggtgccccaggtgaggaaatgagtgtcattgacagagaccatcaggaacagctgtggcccaaggtcagttggctccagctgggacctggggcctcttgtccattatgtctgaagagcaggtgagctgtgggacgactgccttcgggagctatgggccatgcttgacaaatggtgttatatacgatctgtgtgtgtatggtagtgggtggggaggagatgggggcaggactgcgggctgagaaggatgctggtcctagacaggtaggaaggcaggcaggctggagggggagagagggaagaaggaggaaagaagtcagggagagagagggggcgggctgggctgagtgctggcgcctctgcctgtggcaggccacccgtgggctctcactgagtcccccaacagccctctcagagctgggctgtgccatcatctgtctccattttatgacaacacgaggatgctgtccccctccccagcacaaaccccataatccacgttcttctcatggcactgcagtggcctcccactctcccatccgctccagccacccaccctctagacaccatggttactcagcaccacggcccagaggcctcctgatcagggcccctctcgctgctgccctggccttgcctgttctcagccaagctcgtgggagagtggctgcgctcctttgtcctcgcttcctcagtccatgccagagcgtggatgtagtcccagcgttgcacccgaccccacattcactcagtcctcaacttacgctgatcccacctcctgagcacctctgggcctgtcccctgcacctgaccctcccctgccatctttcccctgtcctggctcagtccttttgaccatggcctgagtgacagtgactcccttccaactgctctccccacctccaggccgtttctctcacttccaccctcatgctttcaccagggggagcgagaggccttttggggggtaacactgcagccccaggacctggccctgctgcctccagcctcggctccccgaggccagccttgcccgacttctcatcggcagtaccgacttcttgtgctcaccgcaggctctggccacccgcttttttgtagacaatgcttagggccttcgaacttaacccaggtgcccctctcctggcagaagccattcacaagctcagctgagtgcagcgcctttcccccggcctccgcggcagcgccttttaccccggcctccgcggcagcgcctttcccccggcctccgcggcagcgccttgtggaaacctccactgtagttctccctacaccccacggagatgcctgtgcacacaccaccaccaccactggcagcagggcctctggggcagggctggatcttcatcacctttgcacacttggtgtcaggcacagcatcctaattggtgcttactatgggtcactgagatctgcagagcagggggagaatgaagcccaggaacctggacacacagactgcatcagctctcagaggaaggggtaagtccagggcagggaaggcaggacatggtgggtggaggagatgggggttccagggttgcacccaagcccccatgccagcctgctgtcttctcctgcctgccccgcacccccttcctctccctctttctgggcctcttcctttgtggaggtgggcaaagctgtagagggtgggaggtgggcccaggataagttaccagctaagagtgggggtgtttccaactgtgtacatcctggaggaggccccaggcaatggtggcccccccttggcatgaagttggggcttggtagcattcgctcccttcccttcacctccccagcagtgggcagagaagtcagtggagccgtcccagtgccaggcctcggtggcagccatgcctccaggatgggtgggttcgttagggctcggctcccacctttctgtttccaagcacctttttctcacgtcctctggtgcatcttgtgtttttttcaacagatgaactgcacttattaaatagtaataattactatggagaaaaagtctttcagagaaaggttgctgacttctcagtcatattctgacttggggacattttgaagtggtctaaaaatcaaatcattaactgtctgcttcttagattactaagttatgtgaccaatagactcaggtcatctaagacctgagtctcttccaaggccaaggaggaggtgagggtcaggaatatctgttagagcctttatttggttaaaatataagtattcaaaaacaacagtgactggccgggtgtggtggctcacatctataatcccagcactttgggaggtcaaggcaggaggatcacttgaggccaggagttagagaccagcctggccaacatggtgaaaccccgtctctactaaaaatacaaaaattagctcatgcctgtaattgcagctactcgagaggctgaggcaggggaattgcttgaacctgggaggcggaagttgcagtgagctgaggtggcaccactgcaccccagcctgggcaacagagcgcgactctgtctcaaaaacagcagtgacaaaaaccccaactgagcggcttttggttttggttcttccattttgatatggtcctatcttaggccagaccaaaatgcctcctttactaatttggacacttcgaaatgtcctgcttcaacagaggcaaaatcgccagacagtgctggggcccggagctggcctcagtctcaatatttcaaagagatgagtggagacagctttctgattttggctgggattctatgaatgcactgtggaaataatgtggcacttcatgcagatcagaaacctgactcgacttagatatggctgtgattaataataaatgggaaaatgaattaattattatttaataagtgtagttcatctggcagtccaaatttttcagaatacagggctcatctgaggaagtcagagaaaagtctttggagacaggaaaagtcagaaactaccgcgtatggggtcggcgtgttcttggaaacactgcctgcctgctgcctgctgctgcatagcagcattgcttcagctgatttctccacccatgggccagggagcacccaccacgtgtaagcattgtgccaggcactatatgtcacctttacagcccctgccacttacagatgggaaaacagagtctcaagagattagctgacctgtgcaagtttggaagtgagcttgattcacactgtctcgggggaacacagcccaagagaatccccattcaagggatctcctgagagtttgtccccctctgtgggacagggagcaggggaattctggccaagctggcattggagttgccctgggcaggggtaggacaatgggctccgctgggggcttactgttgggtttcctgtgcgcctcccagcgcctctgctttcttcttcatattgctttttgtatacggggtgtgttgcccaatatcccttcaggaggctgggcccctctcatagcctctcatttccagaggcttccaggaggtgggtggtgggtgattcctatgccctccttcctttcctgtcccttctgccctctgcatgcctcccagagtccaggcatgggctttagtagaaacaacacagactttgagccagagcaccctgggtttgaatcccagctccatcactgattgtgcagccttacatgtgttgctaagctcctccgactccagagttctcccttggaaacatgggaacaccaataataatgctacccaccctatgctcatacaggagcaacacctgtgggtccttagcaagcattcctctcctcctctccaggagtcctttcctccccgccctgggccccacggaggcttggctcagcaggaaggggaggtctggcttgcttggtgtagcagggccaggggtggtccggtgtcttccgggatatttactgggggtgtgtgggcactgtagcagctaatctgattgtagccaaatctcgttatagcatttctgcccggagtgccatttaaaaagcacttagggctgtccccgtaacacatttaccctgaggccccagggatggggctgccacaagaaatgttaacctggagagagaaaacagggcaacttgagaagtccctctccttcccaggaggcccaggatgttgtggatcccggaggctgcggggagaggaggcgagctcatttcctattgtttcagccctgggggacactgttcccacaaggcatagtggttttgctttccttttaacctgccctgccatgctccatggtggagccacgggaggccctgccccagaactctggaggtggaggctgcttctggatgtgtaactgtggggaggctcctgactctctgagcctcagtgtcctcatttgtaaaacgaggatggcagcactggccttgcctagtcatagagctcgtttgggggccacccaggtttatttaagtccaagacttgatcgagctcagaggttctaaaaggctgcattgacaccacccgagaacttgttagaaatgtcagttctcagcccccactccagacctgcagaaccagatgctgcaggagggggtcttgcaatcagggtctccaccagccctccagtcttaccattagcttcattcaatgccatggcctcaaagtggccaagtggagctggatctcgttccagcctggctctgctctaagggaatactgggggctggggtagggttggggctgggaggagcgttccagaacagtttgctctcttaccaacagtgaaggcccaggaaaggaggcgcaaggataagagcatcagctttcaggtgcattgtgcttctgtttcccaaacattttacatgcatgcctcatttgaagagcattaagcaatattcaatgaacaggccaccataattatccttattagcaataattctgaagctagctcatgcatgcatatcacctccacgaacagcctgtgagtttcttgaggacaaaggacacatcttcttttgttgccatatttcactctcccaaatctccccatctccaacctttataccccctatgggcctgagtctgttgcctttgaaccttgacatgcctgggcaccccaggaacatgcacccataggcaagactccaggcttcttcggaaggggtggtctgcccctcccctccccctcttccatacgcacctgtaggtgtcggtggctggcaccttccagatctggatgcctttcagggggccctcgctccccacctccacgctcaggttggagttctggtaggcgttgttgcactgtgcctgggtggggccatggggcccgctggccccacatgtggtgaacagccaatgaactgtggcacaagaggagaggcagtcactcatgtggccaggccctccctcctccaggggcctccctgggtggcctctgagatatctgctccatggccccaaaccctccatccaagatggcaccaaggtcagggcaagaaacaccaatcagccatcgaactggaaacttccacagaaagcctactatgtgccagaccctgagtcagagacaaagatggggcagacttaagatggaccctggccttaagcagcttacaggctactatgagagacccaaagggaggccaggacagcaagaatagcaagccacaggagggcccagccaacactgcgctaggggagttccaggaaggggagaaggcccctgcaggtgggacaggcgtaggcagtagctgggtcctctcccagtctctcaccgagcctagcacggtgctgggcaaacaacaggtgctcaatctgtgctatagttgactgcaactaacctgctcccaaaggctcagcattgcctataggagcctcttagcttggagacaattgaaaaagagaattgaaagctcggtgatgctacattggctcagggacccaggctggtggtgggagcaggaagccctgcactccctggccatggcttggcctgcctgtcagacgctccctaacagacctgcagcaaggcagggctcaggctccttattaaaaccagcttgcatttggaaatgcaacgaagacagctttcaggctctccaagcaacagagtataaaaaatggaaaaacaggtcaactttgtctttggtgcatgctcctccttttcccagctccccctcacccattcctggtgttctgtgtcccacccaacgtccctaggtggctttctgggggcaacacaggaacactcagcacaaactgcacccccccaccccccgcgggccatttcctttcaaactttctatctttgagccagaccaaaccttggggagttgtcagatctcatgttggccaaaattctaacatttttacaacctataaaaacttttaaaaaggtgttgttgataaactacttttacttaaaatacaaaaatctcataagattgcagaaattcccttaaaagagagattaagttctagtctaaggaaaatgatggaaacattaatttgggcatgcataattttgctaagacattaaagtgaaaacattttgaagactgcactaatttaattacgtaaatgtgaaaggttaacttgggttgccgattataagcaatagattgagactgccatgggcagggttgctaatctgaaaactgggccagttgtcgtgggtttttgtcatgctgccctggcccagaggctgggaggtggaagttctgggtggggttctaatgcatatgctactcagcacggagtcctcaacacttttctgggcttcatttatttatttatttatttattttttgcaaaggaagatgtttatttctatttggtttcaggatggtcatttcaggggctagaaggtaatggagccattcactttgggtgtgaatggctgattgttagtttcctgattttttatttatttttttttagacacagggtctcactcttgctcaggctgagggtagtggtacaatcatggcttcctgcagcctcgaatttctgggctgaaacaatcttcctgccttagcctcctgagtagctgggactacagacctaccccaccaagcccagctaatttttaaaactttttgttgagatgggggtctcactctctcacccaggctggagtgcagagacacaatcatagctcactgcagtcttgaagtcctgagctcaagcgatcctcctgcctcagcctcccaaaatactgggattatgggcatgaattaccatgcccatcctctatttttattataaagagggcaaacctgctaattcagactctttatagaatgcatttttggcagagctagtttgaccagctgcccttttactcactcctgtgcccaaaatatatgtgtgggctgtgctacgtcaccacacgaggggtgatgtggaaagaacacaggctttgaaatcagcatgaacaccagggtttgggggcagcttcatcatttattgattaggggatcttgatctagttcctttgtctgtaaaagaggctggattgacatattaaaagaagcaaaggggtaggaaatttcgctgctaagtcccaaactctaaacatgtgagtgtgtccttgactcctgcctgtacccaaggctggtgctgtcctggacagcaggacatgtggccaggggagttgctgtgaatatggatcccgtgccaacagcacctgggaatttaaagtcagtgggttggggaggagggatgggggcagggagaaaaataaaaccccagaaaagaagttgtgaaatccactcctctccttatctatagttccttgaaacctgttctgcagacccaggctttccttacagcaagcagcctgggtgtgggggtggccttatcaatcacagggcagaagcgtggcagtttatttagttaattcaaccctgaaaatgaaagaatacatatatctatattagatagatagatagatagatagatagatagatagatagatagatagataggtagatagctgtggtttggctgtgtccccaccgaaatctcatcttgaattgtagttcccataattcccatgtgtcatgggagggaccagatggagataattgaatcatggggtaagttttccccatcctgttctcatgatagtgagttagttctcacaagatccgatggctttgtaaggggcttcccccttcactgggcactcattcttctccttcctgccatcatgtgaagaacatgtttgcttccccttctgccataagtgtaagtttcctgaggcctctccagccatgctgaactgtgagtcagttaaacctctttcctttataaattagccagtctcaggcatgtctttattagcagcatgagaatggactaatacatatatgaatacatattctctctctctctctatatatatatatgaatacatatatgtgtgtgtgtgtattcttctcaatagagtgctagggaagacatctaaaggtatgggcttggcacactacctgagcatctcaccttcagtgggaaccacttcagcctaggttagtttattctgagggttctgaaatattcccagagatgctgggcttctacttctggcaaggtgagacatctggtgagggaggaagaagggcttaggctttggattcagataggctgtgttctcattctggatgtctctgctggccagctgtgagacataaggtagattgtacaacctctctaagcctcagtttttaaaatgtgaacaattggagactgtaagacataccacctagactttctgtgagaattagacgatgacctaggcaaagtgcttagtacaacattcagcattagagatgcacaatgactacagtttaaaacgtgtgtaactttgcattcaagttttcactgtgggaagcagatatccaatctcaaaatttatgtcctccatttcataaaggagggactccagggtcatttctcaataaaagggacctgtactttcccaattcagtggacatacattagtctccagtggtttccatacacaaaattttgttttgattttcagtgatttcagacggatgggcctagagagggaacgctttctaaagtggattctgtgggaagagaggatttgccatcctgtgtcagacccatgatttatcttgccagaattctgttgctcccagcagccttcaaggcatggtggtcctcgctgccttggatggctctgaccctcataaatctgcccagagttgcttggaatcaatttatgattcccaccagcactgcctctgggggtgtggagtttctgagtgtattgctcattgtgcgagggctgtcctgcttctcatgtgtgggctgctccagcttcatctgctggttccctttgttcatactgtctgcaatcctgtagtcatcagagaatgtcacagcacagtgggaccttggcaatctctgaattcagtgttttccaaaccacctgaggacctttcacatacagattctagggacctggagattcaaatttagtagatcctgggtggggatgagaaggcaatacttgaaacatttaaaaagcattctcaagagaatctaatactcgatgagacttgtacattagtcttctgcacctcattgtccaggtggagaaacagcattttagggagaagtgacttttctgagcctatcagtattggagaaggaaccaaaattgagggttcctccttctcggtccaagggtcctttgggggtgattaaaccgttcccagatttctgccttgaagacttccaagccttgtcagattgtccctacataagtcccggacccaccttgtctttttcagaaccttacttaataccagagtctgattttcatgattgacccaccagagctgtgggtacctgtgactttgcataaggggactcttgttattctgttttatctatagtgtctctctgaagctgctccatacactattgacctctcttagctgtgcactggactgaggcttgctggggacagactctaattatttccacatccttgcccaaggggtaggctcttgcttcaagcaggaagaatctggcaggtacttcaggtagggtagacatgagatcagctctacgctaagacaggttgagtcagaaccatgagaagacaggcagatgctaggttgattttcaaaagtgttgctgaagtggaaggcaatgggcaccactttgtggatcaaagtgagcaggtctaaaaccagagaggcaagagagttagcaagagtggttccaggggacaggaggagtcaaggtgagccttgatccccaggtagaagctgtgtgcttcctgacttgttttgtccttcttcctgggtaaggagttggggtgggaggctgcacctcaggcacctgagaggtaatctccactcacaaaaggggtgaaaacctctcagtgtttactgtgcacctaatataggccagtcactgcgctttcacacatgcaggaaatgccgttatgcttgctgcaactttgtagtgctgcgagtggagttacagtgttccctccaaaaatcaggacattcaagttcagaggagttgagtggctggtctgcagcatacgaagtagataactggtctagccaggaactaaatgtagatcttctgagtccaagttcaaggcttgaaaaggggctcagctccccaggaaatctctagggaacacttttgagtgttttttttttttcttttgaaatccctgagcctggggctcagttctagccaggacagaccatatgaaggttgctcaggcccaaagagtaggcaggccactatgaggggacaggtgagagtatggtcactatactgaggtgagtggaccctccatcccagaaagtcctgcagtggcccccgcagtcgcttagcctagtggagcatgggctgtgcaggatcaaaggtgtcagccaatgagagaaggtgctcaggttgaggctctggtccccagagaggacatgggagcaaggcagtgtcataagggaaacctagtaactggagtgtttataaggtcaggaagcagagagagactgtgtcataagcaacaggacaaaaatcccagtttttggagagaagatcaaggtcacagtgagactagcagtgaggctggcttgatgctgagcagacaatctaaaggtccccatatctcccctgctgagggtctgccttggtctctgaagccctatggagctgtaggatgatcaaatggtccccagggaggatctgggatggggggcagaggagggacgtcacctgcctctttcctcttctctcaaacaaacaaacctattctattaatactcatttatgaaagaaaaaaaaaaagaactgccttatctcattcttacacataccccatactgaaaacatagtttaatactcattcatatctaaactgtataaagaacccacaaatatcaaaatactgattggttatagacagttgagtacagaaaagtctattaagcactgggtttcattttaagcacattgtagcaccctccaagaagaaacaaatcaattagtaataaacagtacatcgctaaaaaaaaaataggctagacaatgattgtcctggttttattactgttgctaaacaatctcatctgctgaattcaatgcaaagaaataaagcataatacaaaggaaagttctcgatcgtcactattaatcacaacagtaaggatctgcctcagtttggaggcctgtgtgtattgtaccacggaagagcgctcaatgcttcatgtggatcatttgtacaatttttattcagatccatagcattgaatttcatccacatccactgactgaactaaatgccatggatgctgtggcatacagagccattttgatgggcaccctaggtcccagtaaataaaaatcatgaccaaaatccaggcaaatataataattcatccatttctttttgagacatagtcttgctctatcaccgaggctggagtacagtagcatgatcttggctcactgcaacctccatctcctgggctcaagcgatcctaccacctcagactccagagtagctgggaccacaggcacatgccaccatgctcagctaaattttaaattttctgtagagatgaggtctcactatattacccaggctggtcttgaactcatgggctcaagtgatccatggcctcccaaagtggtgtcattacaggcaaaagccatcacgcctggcctccatattttctcgttttgaagaaactgggctatttgactgcagcatttcccagattctgaattttgctgactccttctccatggggcagttcaacatgttctctgtcctgcaaattgccaactagatccttttgcaagactacaggtcatgttctttcatcaggagatactttgtgtctgattattgctctcttttatcatgttagcacttatcaaacaaagctcaatgcttagaaccatttatttattgcaagttgcaaaataatgttattctacttatttacctctttcctcatacattagttggaatatatttataaaaagatgttcccccaatctactatttgggttactgagtaatatggttcatgtagaaaatgcagaataaatgctgaattatttctccttatgtatacatttcaagatactgaattggttctctatcatcctctgaagctggccaattaactgtttgtacattattatgaatccatgaatttaaacatatttttcagttttaattattcacaattactattctctgaaagctcaaatgatcacgtctttggtcagtggtagcctcccaggtccttttgacatgacgctagtagacttttaaagcttctttgctatatgatatgacaaaatacttcttctccagacctggaatcaaccgtttcctcaaaagccctgatttctcttagtaggaaaaggtattttaagtacatattctgggtgctatggaagctttttgctactgggttggtgattgtctatttttttgagtgaacagagctaggaaatatatatgtgcatgcatatatgtatatcagtataaacatacatctatatgaaatacacatacatatgtatatcacaaggtacatcatgagttcatattgatatttccaactcaaattcaggacgacaggactttttatttaacctcgtgtatatcatatctgcatttcttttttcacactgagaaccatgtctctcagaaacacatgtgatagttgaattagaatatattgtaattattcatttactttacctctccttacacacagtattagagtcacaatctttactactaccaccataattaatataaaaattgagagcattcaacttttttttgtatatgttctttccattctcctgtgattttgtgtactgtactacacatagctgccccgggcagatagccattacatatgcttctctttcctctttatcccttacttcgtcatagttctgtaagtatttatatttattgctcacaccagtcattatgttgctatttctgtagtcattttcgttgtccgaagcttgttttaaagtaaattccttagagaggggtcactggagaaatattccttgaattatttgagtgttgataatatatttttccctagagtatcttaaagatgctactcattttcttgttatataaagtgttgctgtcaaaaactgataattttaaatttccttctctaataagtcacttgctattttgcttaggtgtccaaagtaatttttttctttctatttaaagtccagcaattttactagaatacacattggtaccgctcattctgggttaatattcttaggtatacagtgtgctcttttaacaagtagcttcaataaggatattttcctggagttatacttttaagtattttgttttgttctagttattcggttttcttcgtcaggtctttcaattatttctatgttggatcttcatgtatattctagtaaagttgccggactttaaaataaaaagaaaaaaatactttgggcacctaagcaaaatagcaaatgacttattagagaaggaaatttagaattatcagagtttttgacagcaacactttatataacaagaaaatagagtctttgatgtgtgtcatctttttcattttaaaaaatttcctctttttaacttctatttcttataaggcataaactgttgtgtttgttggctttttgttccttcccttaatagattagccttcatttttgaaaatagtttttcttttattgcaaattctttgctgagttctagcaccacatttctgtttttcttacaatgacttacgttatttttcatgtcttgtattattgtttttgtgtcttttagctcattttaaaacagaaggttagattctgactcatccaataagcacgtctttctggcatgattttgctttctgtaggcgtgttattccgccctctgtatcctgtttttgttttcttattttaattttgaatgatatttgatcttgatgctcttctgttatgtatttttatgtgagattagttttcctggatttttagggttcaggagcttttttatttcacagaactccctctactcctttttttaatacagtgttcaaaaatatggcagtttggccaggtgtggtgactcatgcctgtaatcccagcactttgggaggctgaggcaggtggatcacctgaggtcaggagttcaagaccagactggccaacgtggtaaaaccgtctctactgaaaatacaaatattagccaggtatggtggtgggtgcctatgtcccagctacttgggaggctgaggcaggtgaatcacctgaagccaggaggctgaggttgcagcgagctcagatcatgccactgcactccagcttgggtgacagagggagactctgcctcaaaaacaaaacaaaacaaaaaaaaaaacaacaacaaaaaaacgcagtttgctttctgaggtttctgactgtttctttccttcacttttatctggacattctcttatttattctctattatccctttcctactcaatattgattttatccccagaactttcttctccaagtgggccctttcctgcaatgacgtttgctggccaggctgctccagcgccttcagatctgactgtggtactcctggtcccctgcactgggcaaagccgctcccactttcagaagctgctctcagactggctttctgtaatttctagcaactatctcttggctacttaggggttctcctgttctcaggcctgtttctttcctgtcttatatcttgtacagatgctgataccatgcaggtcttgtggttgttggtgctttgacctatctcacttgcattttgaagttttaggggaatgccttattttcaaattttgctgtcaatattgttcatgggttttcagttttgatatatgggtgttctgtgcttatgtagggatttggaaagattaaaaaaaaaaaactatgctgttaccaccatcactgccctcttcccagaatcctagaaacattttttaaatgtagaaatcatttgagctcatttgctatggtgagcccctgtatgccatttatctggtcagagccctcacctgcatttctcttcctgggctgcaggtttgttttttcagatttcacctcagggacatctccaatgaccatggtctagaacctgccgtttcattatgctctgcctattttcgatacagctcactaagtataatttaaccttttcttgatagtgcttcccagacttaatgagttgtttagggctatttgactcttcactaaatggcctcaggcataaatattttatagtgactctgtctctgctggcaggtgtctctcggtactgcagcatgtccacccgtgtttaatcttactttacctctaagatcaggtgagggcatgagagtggccctacccctcttcatgtatcaggctaaggggcagttaactgcagaaaatctttatgtcacagttttggaacgtatttatattttggcatttatatttggtggatggtggaaggtattggaagtctaacttcagataaaaggatggtatcatgattctgaatgaacagggttgagaatgttgaggccttcaatttcaatggacaatttatggtacatttctcctccagtaagcctagctccttacaaccacgataggtcagtagatagggaagggagaagaactgtgacttttgtctcataagtcatgcaatcatgtagaaaagttaagcaattggccagtgattgcaaagtaaacctggggctaagtgaggaggggcacatcaccttccctctttctacaacacgaactgttttcagttgatgaattttccatgctgttcttccagcttgtttctcagaccgaatttatttgcgtgtatgtgcatgcacaggtacacacatgtgtgtgcttatacacatacatgcacatatgcttgcatgtgcacctgtgagcgcctgcccatgtgtgcctgtgtatacacacccaccccgttcattcaggcaaagctttctctgtggttctttgtgtatgatgagaagttaggggtggtaacaacaacaatgatcacaccagccctgtcttttactagaaatgctcacacacatgatctcatttttactgttacactgttgtttccttgctccagacacagtttctctagacaggcagagtgcctgataatgctgaagtatcccatggaacaaagaccagaggcccatctccctccctgcggaaggcagacaccccttcttggagagggacttccgagtgagcttgcccccatcaacagggcagcaagctggggctgtctagataaaagctgctttcagggctgaattgccctaagcagctctgacacccagtgatctgcaggagattttaatggctcctgtgatggctgctgtattgtgttcgcagccaccccctgctccccaagggaaagtcaggaacacaagggagaagagaaaggtcacaggaaaaacactaccctgaaagcagagctgtaaaaattaagttaagggaggcctcagggctaatttggttatttctaacttggcttcgggccagagtggggccaataaagtgtttgatatcacatgggtgctgtggactcagccatctgcaggttacgcataatggatttggttttgaggcttaagtgggaagtggttggtggtttaaataccagctctgccacactcaagcccaaagggtcatggacttctgccttgtccattcttgtctgcggataggagagatttaatctagtgcatcaccataggggttatgtgattaggacttgcggcctcctgttgtaaggttcactagcatctaagagagaggcaaacgtgtgggaagccccagcccctcactctattctaagtcattcctgctcattgtttggttctaactcatgatgactgaaatctctacaaggcccttggaattgtaacacttccgacagatgagcagacggaggtgcaggcagcccaactggcttggggatttggagctagaaaggtgtcccgacttctgggtctaggtcccagatcctctaaaataaattggaggactgagacgcatatgagaagatatgagatccaaatttcaggggcagaaaagaaagcagtggggaagcattaggaccaaatactagaccaagaagagaaggcaaagtgtgtaagactagaggactagagaaaagaagggaagggatgcttcccctcctatttttgtctgcaatgcagtcatggtggctggagttgcagcagccattttgtaaccatgaggcaacaagcatgaagaaaaggccaagaggatctcagagatgtgagtcttgacattatcaggcactggataatgacagtagtcacttctagggccactgaattaacatcagcagtcatctataaaatagtttttgttgtaggactggactaatccttgggctcccagccattggctggatcctacttcaacctcaatggagcctcctagaatcaagatctcccagctacttgcaatgaaacaccactgaacagagaatcctgctgctgtctctcaaacagcaatgccagcctggattggaaccaactttttcgtgcttcttcagagttgactgcacgtggccttctgcctgacttcttcgatgaagagccaggcaccctggtcactcccccggcccagtctggtcagccaaggcatgctcccctactccacccaccctctgctgtgtctcagtgcacttcaccgtcaaggccttcagagctttgggtgttgcaaggatgttgtggaaggccttgaagatttccctaggccacaccagcctagagtaagaagtagcatcttaatattagtagccagtagcattttcctgattctgctcccacgtccttgaaggaacctgaagtttttttccctcgatacttcattgttagggcccacattcacacacatgtgtgcttggccaccaccacccctgtccccttgacctgctttactattttcacggcatatcactttgaaatgatgctgtctatacactagtttgctttctgcactagcacatatactccataagagtagggcttgtctgttttgttcactgctttgtgtccagggcctaaaacagcactagtcacagagagggtggttaataaatctttgttatgtgaaaaacaaaaccaaagcaaaatgaaatagaaacaacagagtagcccaaatgccatctccaaacccacctgagtggtcagaaggaggtggtcatgcatgccaggggtacagtgagtgggtgctgggacacttttggccctttggggctcctgttttagtgttagaatgtttaagatggacaaaccagagtggttttgttagtgtaagtggacgtttgctgaaagccattttgttttgtctcttacgcatgattggaaggggttgggcttctgaggagctggcgcacactctcacatactcactcgaacacacacaattgcgcacaccagcccacactcatacatgcatgcatacacatatccaaaatgcagggtgccctgttttttttttgttgttgttgtttcttttttgagacagagtcttgccctgtcacccaggctggagtacagtggtgagatcttagctcactgcaacctctgcttcctgggttcaagtgattctcgtgccttggcctctcaagtagctgagattacaggcacataccaccacaccggctaatttttgtatttctgtagagacagggtttcaccatgttggccaggctggtcttgaactccggacctcaagtgatctgcccaccttggcttcccaaagtgctgggattacaggcatgagccactgtgcctggccgagccctgtgtttttaagaaaacacgtgagtcctactccttagcagcgtggccactcccctaatcccatgtctgacgaaatggattggctggtagactgaatggtctagttagtaggatcacgatcataaagccagctgaggggaaagaaatagtcctcttttccaggaaactattttgacgctcagggagtttttctgattctcagttaggttgctggacaaccacacactaagccttgttttctttctttttaacatttttcctagaatatgatcattgttagatctgccaatcacttactaaaaaataataaaaattagatgactacaatttgctcttatcttattatgaagacactgttaatattcaccataaaaacaaatcagagctgggcgtggtggctcatgcctgtaatctcagcactttgggaggcctaggcgagtggatcacctgaggtcagaagttcaagaccagcctggccaacatggtgaaaccccgtctctactaaaaatgcaaaaattagctgggtgtggtggcaggtgcctgtaatcccagctacttgggaggctgaggcagaattgcttgaacccaggaggtggaggttgcagtgagccaagatcacggcactgcactccagcctgggtgacaagagcgaaactccatctcaaaaaacaaaacaaaacaaaacaaaaaccccaaaacaaacaaacaaagcatctccaatttaatcacttcaaatttgtttaaaagaattttcgtgaacaaggttttgacgcatccattgttttcaagatcttgataagctttagaagactaaagatcctcttttaaattctacggatgagaggatttttcgggcaatcctctataccccacacaaatcatttatttcccccaaggggagtttgagggctttacctgaaaactgatgagcaattaggttgggggaatttactgaatgagaggacacaaaattcaagatattaacctcccctccagatacatatttatgtgtatacataagagtgtgcagctcatagaatttcgtgtatacacaaaagtgtgcacaactcatagaaggaggtggactgtaaatgcactgaatatttatagaaggcaacacatgaggggtgagtgaattggcccatctttttgcttacatatatatttaataataatgttaattacaatgtcacaacagcattttatatcagcatattgttttgtacctttgaaagcctgatagaaatgatctcatttgctcagtacaatagccagctctgagaaagaactgtggcaggtaattaatatccctacttgatggatgaggaaacggggcccagaatctttgactctcctgaagttgcatggccagaaccttggtctctgggattctatgccaattcacttactgtcttgctattgcctggcactcagtaggtgcttcgtgactatttaagcatctgtagaatattgaatacatagtcttgagattgatcctaggaattctgcccatcagaatccccactgggctcccagagcttcctggtgaatgttcgtctccagcatggagaagccactacaggcaggctctaagatggcctcagtggtctccagcttctgataatcacacccttgtgtaacctcctccctttgagtataggtgagatctgtgaattgcttctaaccaacagaatatggcacagatggtgagatgtcgttttcttgcttataaaattataatttctgtattactagaagactctctctctctctctctccccaccccaccccctcgtccccacactagctttaaaaaagtaagctgccatactggggagaaaccaaggttggcctccagccagttaggaagtgaggccctcagtccagtaaccctccaagaactgccaaccaccatatgagtttggcagtgaacccttccccagtagagctttcagatgagaccccagtcctggctgacaccctaactgcaaccttacgagagactatgaagtggaggacccagttgagctgtgtctgatttcctgacctgcagaaactggtataataaatgtgtgttgttatagccactgtgtttacggtcatttgttacaacacaatagataactatccaggcaccccaaatcccctgctgcacagctggtacacactttggcctcctcatcttttgtgtaagcacccagcagggagggcactggctgggctgagttctgccctgtgccctctctctcctccctgactccatgatagctaaggcaattccacctcttgtttcttttcctctcaataggagaggggcaagctgggaagaccaccttttgtgatcaagagttagcattttaacctttttactcctagattcactgtccacctccaggcccggatgaattaaaaaaaatgtttttctttgtccaaaaccactgaagctttgctgcaacaagcagagagctaaataggctctgagaagatgcagagctgttttacaggcagaagcagcaagtctgagagaagaatgataaaaaagcagtcttcccaaacaagtacttaatgcacttgccctgatggaggggcctttgtgttctgttagtcttcaagctaaatgatcttaatcaaggcatactgagcccagagttcctggatcatttattgtctctcacttatgcaagctttcactgaaacaaatgagaaaaaacaacatgttttctcaggccagccaggagagagaaaggcaatggttcctgtctgctgcttagaagggcaacagtatcgactttatgtggaagcattttgtcagcagctttgccataattccaacccccacctagcattagactggaggttcatgaggcatctttgagtctgtcagagctgggtgagtctgtgctatttcttaaggagggcctgagtttgggaagttctgaaataatagtgttgatgcctttctatctcacaggacacattttgaaaatgatgattagttcagaataatttgcaatgcaccatctagggcaaggtcaagtgagggcacctgtcctggttctagaggtgatcagaatcagaagtctctcttgtgctgggatagtagtggcttcatactgggcttatgcagacgaagctttgggtaatcatttttcaagagaacactttggctcgttcacagcctcagagccccaggcccctgcatagggtttggcacagagcaggcacccagtacatgcttgttaaattgaactatatgagttgttagtccctaggcttgggattcagggaaagcaatgatgttgtctgcattgggcgctgagttgaatctcccgagtggaaagaaaacagctgatttggatgcagcaagagcttctcccttatgctggtcagcaattgggcagtatttagtattgttcctaacaggcatgggcttagagttggaaagactttggattgagccggcttgactttgaaccctggccctgcatttgattagtgggtcaagtcacataatctttctgatcctctgtttcctcaattgtaaaatgggaagaaaatgatggctcaggtagctccgtatgtgtcaggcacctctctaagccctggatacatataaacgtatgtgatccttgcatcaaacctaagcgctgtaagcattgataatctaagcaccattttttgatgcaaggaaacaaaggcacagacagcagaagggaggtgcttagagtgagtggcatagctggggtttggacacaggtagtctgtgctcttaaaaaagatgctatattgcttcctgatagtgacatctccctcagggagtctgtgagaatcaaatgaaagagacactgaatgagcttagtgactgtcaccctgtgttcagatggaaggaggtggctgacaaatggcggaacacactctgggaagctctattgctgatgggtgcttggccttcagcccagcctccagttccaccctgtcaccgtcaccaggtccctggagaagtgctttctcaccatcaagccaaccctggtgttcactgatgtccacctcttggggatgctgactggctctccagcgtgaaagcctcttccactggaagagactcattagcgttggtaatgggatcatgaatcacaaattagttctttgccacctctcttcctggagcacagctgtgcttgctccagggaagggagacacacccaaatgaatagtgacattctaattgggagggcgccgaacgtgctgcgatgactggggtcccaagagccttgttaaggctggtacttcctgcgtcatcactagtgtgcttgctataaataggtgataatctaaaattagcgagataatctaaaataagcaagaacacagagcatgaggttaatcagcagggcagctgagcagggaaatgaccagtgtctcaagcggctccaagggttctaactacggtcccatgcctgccaccccttaatgaacagtccccccccagctgaatgggtgctaacagaagtgccttccaagtgcaccagtgaaggctggggagcatggaggaatgccaattagctgcaattatcagctttcttacatgtgcgtgggaacactgcctgcctggggcaccgtcttgaatgttagtgaagatgcagatgtgctctgttgaaacgaaaactaacataagaagccagatccctctggaagacctattcagtaatgaaagagagatccctcttgaagacctattcagtaatgaaagagagatccctctcgaagacctattcaataatgaaagagagatccctcttgaagatctattcagtaatgaaagagagatccctctcgaagacctattcaataatgggattcctaaaagatttctttatcacaactttgaccttctaaatgttatctggcttagaaattttcactttctgcatgatttttaagaaacatgatcatttgccttttacacaagttgtctaacttagtgcaagttagttcacctctctggacctcatctgttaaagggggatactatgatagcaccaagagctcagcacagtcctggcacacagcagtgcttggtgaatcgcagttaggattgctgcgtgaagagggaatgtgatgcaaagcctttgctttgggccaggctccttgtctgtaggtcaggatgcagtcccgggttcctaaacttttttgctaatcaaactttccttgagggatggttaaaaatgtggattttgacttcctgctcccagacattcggattccataggttgacaggggcccaagaatctgcatttttaacaagcagcacttgcagacaccaggggacccagatgctgatgatttgaggacacacttggagaaacctggggctgaatctagttccttggctggccagctcactgctgcacttgtgagtcctggattgcgtctgtaactggggatttctggggaaagctgttaatgatgccattaacacaagagtctatctgagttccctccagagggaacttcctgcttcctgctctgacttgtctctggacttctcacatcttggacctcccaccttcaaggctgggatgcaatgatgagctgtggctaaagagaggaacttggcttcctccctgtccccagcatgggattttctgcagggctagcaaggaagaggccaggatttttcggaactggattagaatacattattgattcaggaacggagtgactctgaagggaagaggcctcctctattggggtgtgctactgaagtaggcttggccggacctgccgggcctgagtgcagcaggctctgaggggaacaaagacccctatcgagtggaaagacagggtctgagggaggatgcaggcctgtggagcctgccttccaaggatgccgtcatccccagaagggcgtacttggaacataatggctctagctacaaattctattaactctaatagttgttctgtggtgaatggataatgcatttagcagaaatagacccaatcaatttatatgaaacatataaaactttctcattggaattggcatctgttcttgaatcaggagcgtgtgtgaaagtggacagcctgtcaccctcacttctgggcacattagcagtgccatgggttaattggagatatgggccaaataaagccatggctccctgatggtatcgcccttcaacccttggaatcttggagctggaaacgggaagggacttggacactgtctacttctaaccttgattttttaaaaaattgcagtctctctgcccttgtctgtgttcacattaacccccctcatctgcagacttgccccgatgggaggacctgcagaggcagaatggccccacgcccacggcttgccagtgcaaccagccagggcccagtgggggtgttctctcttttagtccagtgcttttcccatgacactatatagttttaattgcttttatcccccctttggcgagagatgtgtatgcagaaaatggcagacctacctctcaccaaatagctagaggcaaggctgtggttttgatgccaaggctccatagttagggttgtggagttgggcccaaagtttgggcgggttctcccattagctgagctgattcccttagactcgccctgcacagacagcctctgagctccaaggagaaggatagaggggtagggaggttgaggaagggtccttgggccctggggggcctgcttgtcccaatctgggctttttagggaaagagtgtggcagagcctgactgttcctcctcactgctaacattcattactgccagagagagacagtcacagggaggggaaagagatagaaagagagagagagagaaggagggagtcgggtgagggagagagagagagagagagagagagaagaacctggctctgcagccccgtggtcacattaccccaatcatttggttagtgtaattgtatgtgcaaagctgacaaatgtaatttccctggacttaatacttgccccattttctctttcagcatcttcatctgattagctaaagtgactcagagtcttccgagaatgctgcatgaagcacctggacaggattttcccagcctggaaacttgagcggctcagctctgctccatgggcctggaggtgaagaacctcccagatccaaggagtcaggctgagtccctcatcagaagggagggctgctgtggggagtgaggaatgtttagggaagcttagaagtgttgtcagtaactgttctcaaaagaccccaaagggcctttgcgtttctagttctctaaagcctgcccggaggagagttgaaatgccaccaaccacctcgttccagcccagcagaaactgacagctttgaactttggaaagaaaaatcttattatcctgtctcctcgattgtttgtcagaaggttgggagctgatttgtttactgttcgttcagggcctcttggctggaactcttccctgctcttttccatttttagtgtttatctccgattggagactttgatacctagaagtagcttagttgggtgaaagaatgtggactccaggttgacttcctggccctactgccttccagccttggggcccttaaattcttccataccattttactcatccctataatggtaaaaacagcaactgtccctgggcctgtgtgaggacaagctgttgtgtgaaataacctaggctatgggaccacgctctatgatctttcctttcctttccttccccctctggcctatccctctgtccttcttcagggggcctcccaggtagaagctctgagcttgggctttgcaaacatgccctgctgcctcgtaggccactctcctcccatggcccagaagctccagaatggcaagaattggctcagccctgtccctgttgtaaccatgcaccgtgctgggcacgtgtctgctgggtgattattactgactgggtgtggccttggcctctgcctccatgagtctgcctggacccataggcactacctcagtattgctctgagactggggttgagaatgaggggtcaagtttctcagtggggagacttgtgttccagctgctgtctcctccagcctgtaattttatttagaggtggtgggggagtcatcgccacgtgtgagccactggtgatttcattagtctgagtggccattgggcaggcccttactgagtaaccttttagggacagtgggagttatgtggcaataaactcaggagttgagcagggtggatggctgtttcctaaatgctggctgcagggggctggctgctgacacctgagatccaagctcaggcatccagccacccactagtcaatagatgtttctggagtctctgctgtgtaatcagtgctgttgattaggctgggcagggggctatggctatgtttacttagcacactaaaaggggaagtctggcttcttccctccatttataaatttatacatttcctgaatttataacagggaggtggtagttgaccaagagccaaggagagagtggaggtgaatcactgggcctggggggtagggcactgaatggagaagttagaaggctgcctctatcaggtgagacattggcatgaactgggaggtgagggggaaagcagagagagctgcagttttgtaggacgggctcccctctgtgtgggaatatacaaaggtctttcatggttctagttaaaggggaagggagggatgatgcgaaaagtaactaactctttctcctgggtctggcagctggattagatcaggcaggaatcaggaaggggtgacggttagccctggggcagcttttcatgggacagaaaggaaaggactccttcaaagacaaagccatgctaatgtctagttcacatgttgagagcagatgtggcaaaggtatggacctcattttttgtactttgtgccaaaaaaggatttcacattataagttgaaattagagatttatcattgatctgttattattttgataaagacttatcttttataggaaaaagagtgtgggtagactgtgtgttgtacacttgtttctccaggctatacatagcagaagacacctcacaggcccaggcaccagtgcctgcctgggaaaatcccttggctggctggcatggggctggggcagccttagtcagcttctgcggggctaggttcacagccgctggtctaatagaagagtggtggagaagtcacacctgtggtttataaccagaggctgacgagttctgctgaagtggcaaggggccatgagaagtcttggcttggggtatgctgaatagaacagctttggagggatctgagctctgggggaactgtgttgaaaggaagctttgggggctttacccatgatggggtagcctacctttgtgcaacagataaccttggccaggcccagccctctttataaggaggagaaatcttacagtaagctttgctttgttcagtaaggcggcagtgaattcaaagcagagttggggaaaaaaatgccagcttggttctctcctttgggtggggcctaggtattccctaggcatagaggaagctgctcctttgtacaacctccagaggtttcctttgctcaggcaatatgagaaccagacagcttccccttggaccccatagtcagagtgtaggtgatactccttctaaagactgtttcattctttcagcacagctccccaccctaaagacagcaccaatctttcttctgccttttgcaacaagaagttactgtgctcacatttgtgagctgaacccttacctgtagggtcaaagatgggggtctgtcttggtgaattttccccgggtttcagctccttgtttgggtttctctcaaacaggtttcttgatttgggtgctgtattctgcaggatcttgtcctctccgctaactgcaatagagaagaccccacgggctgagttaggtgagggttgatttcagggtgagagatgatttcacactgagggaggtgggagagacagtcaggcttaggctgaggaggggacaatgaggccatgggccatgggggttgggggacagagtgctggggtcagagtgaactcactggtgaggtagcagtccaggctgatggagatattgtcaaaagccacgatggctctggatccttgtccccaccatgcgaccatctgcagccagaacctgtacacatcaagaggaatgtgtgtgaggagcaaactggggggtcttgtcttaggattcagcatccagcaggtgtgtgctgatcacctggctcagaatgtgagtttgaaaaaggctcgctaatcccagagcagtggcgagagaagagcagtcagctccccctacttctgcaatgcagagcacttccccttccgaactatcgctccgtactgttaatggctgacacactggtccttaaatccagcctggagtttggggcctgggaccaggactccctgataatctgaggagaaatcttttgctttctgggtgtgcaggatgcttggaaatgggaagaaatctgacagtaactgcttcgttcagtaaacggggagtgatttcaaggcactgagttggggaaaaaaataccagcttgggtgtcctgtttgggtgaactgaacaggagaaatgggtaggtctgacattcagccagtggggcttaagtcattattaaaatattaaaatgcttctgtaccagccaataaagaaccacagttccaccagttccccttgcttgttgcttcaggcaactggctccttccctgctgccccgacccctcaatttcccaattaaccagcacccatagggtttatccattgattagcccagcaggggtctcaagcatcctgggtttcatccagcatcactggaggttgcctgcctggtggttaaatattaagcgacttgactatcacccctggaagtgttgtaaccaacacaggggtcataaaagtgttaacaacaaacccattaagatattgtttctttcccccaccctttcatatccttggagggccaggttctcagactgtggccagggaaggccttacagtgacataaacaggaaagtacttttggtttgtttgtttcctgggaaatcatcccatggaaggctagcagagtcagctggccctttcctgctctaagtgaaggtttcctgagaaccttaaaatcctttcctaccctccagaacgtcaatccagaatgacatgcagaacagggcgtggtctctggcatgggtatgaaaacaccaagagaaagaagtcatacccatccattggtgactgggcaaactccatatggtacagccatatgatgggacgccagtcaatggtcaaaaatggacccggagacgtgctataaaatggatggacctcaaagacgtgatgctaagttaaagaagccagacagtaggtgaaagaccgcctattgaatgattccattgatagaaaatgtctagaaaaggtaaatctgtggggccagaaagcagattagtggttgtctggggctgggagtgggcacaggattgaccgcagactagcacctaggctttttttggggtgatgaaaatgctcagaaacgggattgtggtgctctctccacagctctataaatctgttggaagtcactgacttgtacacttaaagtgggtgcattttatgatatataaattacagtctgataaaggtgttagaaaaaaaggagagagaggaagagagagggaacccaggccacagggcattggccacatagggtgtcaagagcagaaaaccagagcagggtggcactggcaacatggagagaacagggcctgcagggtacaacaaggacaagaaatgggatgtcaacagtgggaggaaagatgcagaggaagagatatggaaagaaagggcatttgctcatatggatttgcagtgaggcagcaaagctttagccagtgggtaaactacagcaggggttggaagctcccgttgcgcctgtgtgcagatgatctctgatcaacgtgtagaagatgctggcttgttagatgctggcttggttattcctggccagagaacaattactgtttccatggagcaaagccttgaatcccaaaacttttatccgaataactgtgatcgattatgcttaactgaactactccatacatttatctgtgctttcaaccatcttgtgagatctggtcattcagaaacaatcctttctgtctgaaagtcacaattacaggacccaaatctggtttgattctaaagaagaaatgcccaaatctgttgtagccgtggccagcatcactggggttggcccttcaggccatattccccatgaagaagtctccatgctaccctcagtcaggatagtgtgtgctggtggttgggtgtggaaggagaagtgcctgatggagaaccttcaaatcctgttctgggtggcttgggcatgccagatgagtgtgcaagaggggatggacagcacaaggaccctcagcccctgccactctggcactggggtgtatgcctctgagaggcatctctcattccaaccttgatacacacctatttttgtttcctgtaaagctattacatataggtctatggggcattctaagagaaatcgacatgaacgctgcattcaagttacttattgtccagtgtgaagatgaagtgtgtgtaccttggtgtggaataaagtagaaggaggtcaatgcttcataaaggtgcagatacagcagtgtgcgagctcagaggaagggggaattacaccagggtggggagagcaggagggcttcacagagaagacagtatttaagttggttttgaatgcagggaagggcttgaggatgtgggtgtgggagtgcagtgcagggaggagatgtctggagcagaggaactggtgtgagggccatgtgggcagggataggacctgtcctgctggggagcaaggagtgaggaaggaggtaaagatggtgtggacctctgaacagagatcaggcaaggaggttctgccattatttcagggaaaatggagagccactggaggtttctaacaggacagtggcaagatcaaagacctcttagaggataattgtgatgggagtagtaagcaggatggggaccaggagaggaggcagaggcaggggagacagcatgagaggcatttctgcacacatctcacacgccttcatcaggtttctctacaaatcttggcaaggttatagccacgatttccgtggggtctccccatgggaaacagtccatagatgagtttctggcttgagcctctgtaaccctggacaaagcccaagcctgggatctcaactggaaaaccagggccctaatactgctgtcttgttaaagcaggtgcaacccttaggaaaatgctgcttccaggtagcaagaaaacaggcacttagagtgacagagagggtgaatagaaggactcaggttccctgtgggagcatcaggaaggcacagctgcctggctcgcctgcacatcagggggtgagtgcccccacagggcacatttctccaccaggtcatcatctcctaatctgtcattcacaggaccaggggccaagccaggccctggtttcaatgctgagctatatgaggggtgtaccttccaggaggccagaggggcttgagcgagtaaatgacatgtgtgtgcctggggggggggacagaatcgcggctatcctctaaatgggtgctccctgggaagctgcatgtctccctgcccctctctgtgccttccttccttattactaagagattagatctgcgaagtctctcacagccactgggcctcttagcatggatgggatgatgccggctgaggctggaatggtttctaaatagaagagtttctaaagtgctctgcgcggcgacagcagtggcagctgctgcttaaaagagtttgattgacactgtgaattgcacatattttgagtcaggaacacgcacaaccatcaggaagattcaatcagatggcaatatggaaccaggcagtgctgcctctgtccacccggggccacccacacatgggtgcctctgtccatccatgggccaaccctcccccatggctccagcccccagaggctgcagggaagggacagtgggacaaaggtgggacaaaggtgagctgctgaaggatgggtggagggtggggcaggagcagaggccgtctaggaatggggtctgtgggtggtaggtgatgggcagtcagcaggtagagcagcaccaatctaggaggctcttttctgtggatgtgctggcccagagacagagtgggcatcaggaccacccagattcaggtttccctactttcgaaggtgcctggttgtgtgtctttacctgataggtgaagaagaggttgcttctggcaccgcttactgtctccttgctggagatgggaaaggcttcctcaaggctctcgcagtctcctggttctacccactcctttccgtgagtcccccagaagtacagctaccatgtcactctccagagtcagctatggcctcaggtctggagttctaccacttactagctgggccactttgggattgagggaaagttctggcatgtaccaggtggaccaccatgggactgagggaaagttctggtatgtatcaggtagaccactctgggactaagggaaagttctggtatgtaccaggtagactaccaagggactgagggaaaattctgttatataccaggtagacctgacacttagttgggacctgacacactctgggactgagcaagagtcctggcatgtaccaggtggactgctgtggggctgtgggaaagttctatcatgtatgaggtggcccactctgggactgagggaaagttctagtatgtaccatgtagaccactctgggactgaggggaggttatggtatatacagatggactactctgggactgagggaacgttttagtgtctaccaggtagtccattctgggattgagtgaaagttttagtatgtaccatgtagaccactctgggactgaggggaggttatggtatatgccaggtgtaccactctgggactgagggaaggttctggtatgtaccaggtggaccactctgggatgggaggaaagttctagaatgtacccggtggaccactctgggaccgggggttagttctagtatgtaccaggtggtccattctgggactgacggaaagttctagtatgtaccaggtagaacactgtgggactgaggggaggttgtggtatatacagatggaccactctgggattcagggaaagttctagtatgtaccaggtggaccactctgggactgagggaaagttctagaatgtaccaggtagcccactctgggaccaagggaaagttctagtatgtaccaggtggtccattctgggattgagggaaagttctggcatgtatcaggtggaccctcttggactgagggagaaaattctagtgtttaccaagtagaccactctgggactgaggggaggttatggtatgtgccaggtataccactctgggactgagggaaggttctggtatgtaccaggtggaccactctgggactgaggggaggttgtggcatatgccaggtgtaccactctgggactgagggaaggttctggtatgtaccaggtgaaccactctcggaccgagggaaagttctagtatgtaccaggtgatccattctgggattgaagaaaagttctggcatgtaccaggtagaccactgtgggactgaggaaaagttctagtatgtaccaggtggtccattctaggattgaaggaaagttctggcatgtagaccactctgggactgagggaaggttctgacatataccagatgagccaccctgggtttggctgaaagaaagcaaggaccctgacacatcactgccaagactgcgagggacaggccatcctagagaacatagttactcctctgccccactttgaaacctcagctctggatggggaaaggaggctgggttccccaggatagaagaggcttccccttcctctctgtgggcagcctggtcaaggagaagggaagcgttagccctttggggttccttccactctctcaccaatctgtgttgcctaagaacgtggcaggggagtctcctctctttcccagtgcttagcagcagagattttgctcctgacccttcatagttcgtacctgctcagctctttctgtttcttcaaagaggacacttttgattgcatgggttgttgttgctttttcttttcttttttccagccggtggagtttggaacttgttattaaaacagacttggctagagatcttggttggaggctggctttgcataaagaatgcattcgccctgactcttctcattcagctctacagagacgccttttgaaaacagactcagcggggatctgggaggtggccatctgggcagtgggccaagtctggaagggcagcttcagaattgggcgcctcggagactcatcgggcagatctctgcctgagaaatgccgatgctgctcacgtacgactcagaaaatgtaccatctcattcaggcaacagactgttaatggacagcgaatataatgccttatttgccaccctgccagccttagggattgacaaacctaattaagttcacttaatgattttaagtagctgacagaaaggtttgtgtctgatgtggatggagggaatggcgaagctttggagggcagagcaggatggagtggctggactgggtagaaggcatttgccagctgggcaccatgtctcacattccttccttggccatttagtgggctcggaagaagggagtgtcctgcatccctttttgctgctggtgcttgtctgggccctggctgcttaggatagagctggcaggtactgtagaggaaaaacactttctccaatttctcgctgcacagttaatttgctctgcaaaagtcttctaaaatgggctgtcatgaagcttgggtcgcagtaggcatatctattagaataatatatgtgaagaaaaagccctgccacatccctcctattatctgtataatggacttcagctctaagatgaagatgggagctgatggaccgctttggattcctgggaccatccttggccatgtcaaacgcaatcatggctaggaatgtgtgtcttggctctaggagtctttaacttctgcacagtaaactggagatgagctggacattcaaggccatactcaggagttgggaacatacccctcctggctccatcccactcttagaagtaatttaccacctcctgccttggtttcccctctaggcataacgacaccaggagcatgagtaaaagtcaacacagagcttccagggctttcaagggccatagagatctttcacaatgagtctggcttggtgaggaagcccttctagaaataagagagaaaatgaattttcagccaggctgagcaagcatggagaatcactcagacccttccacattctcagtttgaggcttccaggcattctgtgctcactttcgggggctcagcctaaaggctcctggctccctcctgtgctctggtgtgtcaccaactggaaaggcctgctgcaaggatgttccaccacagcagatggagacccatctctggcaagttcctgtttttctttcattctcgaaatctgtgtagtgtatgttgagctctgctgggccctgggttttgatgaggaaagacattgcttcctggagccatggtccagcaagcgaggggcctgtgcacaaaaatactcgacctacagtcaaatgccaagtgccctagggaaggattcaagtgcctcttgggcccctgccattcttttgacttgtgtggttgcaatggagatagtagcggatgtgggatgagagctcaggcctcttgcatccctggccaattttcccatcatctcttgcagaaccatccaacttgtcgaatctcatttagtctcatatgtactccgtaccatcggaaaagtagagcaagctccttgggatgactgggggcatgagggctgtctggagctagaaaggcccgccatccattcttcttggagggacagggatgtctgctccccgtttcttggaacacacaaacatttcctctgtcctctgttgctgtgttggcttgcggcttggggagctgacatggtaccgagatggcagcactgacaatggcgagaagacccagaaaaagggtggtttctacctctcttctcgcctgaccaaaagcatctttatgagagtaaattagaagtcttttctgcttggtgaggactagtttcaaaaagtagagtggagtgaagactgggtctatatagttggtggggccctgggcaagttgccaaaacttttaaggtgccatcttggtttttaaaagaatctatgtaagatgtgtttttttcccccaacaatggaaccctttgtttagcatgagatgctaatttattgctcctgttttatattatatgtttactagtaacatgtgcttcctcaagcagtgccacaaatgacatctctccccctctttctttgagcagagattatctgcgcaggtactgtaaatcacatacttgtgcctatagctaggagtgtagagatgtgtaagacgtggaccttgctcccgaggatttcagtcagtgatgtgattcacgttatttactgaccgggaattgctgaagtctcttttagttgtgccccctatagagctagaagctactcaagctggaaaaacattgcatctggacaatgagagagaagtcaagaaagacttaaaataatgaaaagtcttggagaatggtagaactatgggcgaaactctcactaggcagtggggtgtgctggtgggagcaatgtggaaggtgtgggtgggacaccagtcaggcagctggaaacccaggtgtggaacccaggtggacataaagatatttgagtcatctgcatagaggtaagggtggaagttatgagcattgatgaggttcctggcgcgggggtgggggcagcatagatagaactggattctttgcttcaaatattggaagctcaattatctcctaaattgcaggctttgtgtttagggaaagaaggggctgagaacacagggctacattttccgagacattaagaattatgaaaaacatacacatctgttgacttgtaagccaagctgtggatgttaccaagaaaatcttgagcagattcgaacatcctgttattttaaagaggttcacttagtgccattttgagcaactgcctcctaaaccaagctcatgggccggatctgtctcactgctttgcactcttgattgtggaaacttagcaatcaaaagcaacaacttgtcccaaacgtcacagtaaatcagcgttagaaataagatttaaagctcagaattgctaatctactccttgctccaatgatctgggatattttctgagaaagaaacagggccagatccttccagaattatgaatgtttgatttctatatatcaatgcctggttgcacatcgtgtgctgagccaccggccgcatctcttctcctcttcttgaacggctgaagctgctcacgtacagctcagaaaatgcacaatctcgttcaggcaacaggctgtcgatggacagtgaatatattgccttatttgctaccctgccaaccttagggattgacaaacctaattaagttcacttaataattttaagtagcccatgtctacttaagttcgcccaaggctgtcctgagccagtggtgccatttggaagacagcagaggaagaaggttcttctcctccaggttctttcttcacgctttctgagcttcacactgaggctccaatcacttgccactgggcccctcaaaagaccttccaatatcccccatgctctgtgcttcccgccctccagcctatctccgtgctcagtggctttcttattttttcttcttttttgagacagagtctagctctgccacccaggctggagtgcagtggtgtgatcttggcttactgcaacctccactttccaggttcaattcttgtgccttagcttcccgagtagctgggattacaggtacgccaccttgcccagctaattttttatatttttagtagagatggggtttcactatgttggccaggagccaacatatgtcttgagcttctggcctcaagtgttctgcccactttggcctcccaaagtgctgggtttacaggtgtgagccatggtgcctggccctcagtggctctttttttttttggaatggagtctctttctgtcgcccaggctggaatgcagtggtgcgatttcagctccctgcaatctccgcctcccaggttcaagtgattctccagcctcagcctcccaaggaactggaattacaggtgcatgccaccatgtccagttaatttttgtatttttagtaaagacggggttttaccatgttggccaggctggtcttgaactcctgacctcaagtgatctgcctgccttggcctcccaaagtgctgggattacagttatgagccaccgcacctggccttcagtggctgtttattacctgtattcctaaatccaaaacacctggcctaatattcacactcactctctcccaaaaagatttctcaggattctctgacacaaccaggttggctgttcttgaacccacaaaaaacatttctgcatctccaagcctctgctttccctgaaggccttctctggaatgccttgtcccttttccatttctctaagacttaaattttcctcaagcaccagtttataaaaagctcattttctccgtgatggttcatctgactgctcctgtatctggacgtcaatgcacctgctgaaccctggtcatgatctgttggaacctgcagggtgcctgtgtgctactgtttgcctgtggaggtcctgtgatctggcaagagctgatcaaacatccttttccatcctctgtgcttgatggaggcttaatatatgtttgccgacaatgtgtcagccaatgacatttctccagtcacttcttgattccctgtcttgcccagatccagatacctggatctgccattatataccagtgacttccaaatgtggttacgcatgaaagtcaactggggaactttaaaaaatacagattcctggtcccaatatgtcatctgtgaatcagaatctttgtgtatgagatctggggctctgaaagaaaaaaatacgttttccaggtgatcataatgttcatccaagtttggaaaccatcgtcctacactgtcctgctagttttaagccttttcaaaagcactttctcttgtttatttatttattttttgtttttagaaatgacaaattcgggggtggggggaaattctgaggtggtttctgccagaaagtaagattttgctgcatcataaaaatttgggaatgaaacattcataccttagaatagaacctggaattgatttcagccttgagttatgaggctttgtggagaagaagcgtgatcaatgctcagcatagctaaatgaagaagagacattctcaagtgacactctgatagatggccagacatgagagctatattccttgacttagtctgtgacacaccatctcatttttttttttttttcaaatctaactcacttcttttatttgggcacacagctagactacattccccagcaccctttgcagtaggtgtggccatgtgactttttttacattataaaatgttttattaatgaaaacaagctttgagaaacatggtgcattgcaaaagctaagaaactcatccacagaaccttgaacgcttcttgtgtgcaccatgtattctagagtttttccaagtcacatttaatgttatcagttttgagttactaaattcagaggagtcttatttctcactgcttgaatttttaggaaatacgacgaaagcacattgtaaaccactaatatttacaatagtcaaaaatgagctcataataaaatacatttaggccatgtttcaaagaatacttaacaggtcaacatcattctgcgttactgttggccttgtgtcttacacacaatagatgcctaacatctaatgaccaagaccttcaactgaattatgtaaccattttctttgattcttacatgtgccaattttagacagaaaccttaaatgatgatacagaagccacagtatgatattacaggtagtgtggtaattctaaccctgaaaaaaaatcccaatgactgaaaatttttgtttcctaggtacgaagcataaaaaccagcccagataaggcaaacaaaaagtcagtaaggaaatccaaagagagcagatggcaaaggaggcaatgtgagcggagcagaagtgatgattcataaaaatcttcctgttcaaggcttcctaagctctttgcccaccgactggctgaatggaaaggattccaaggccagaggaaaggcccacccttttctctggccttggaatcctttccattcagggaaggaaaagggtggaaggggcctggatccctgaatgatcaggtggaaggccacccaccaaccagcatgcttatttttaatttcacacgagcaggaaataacatttcttttgtttacagctcctggagtggagatgtaatgttacttcaggtagtgtcaccccctctcacatacatgtggcacatacctaggtactcaggtgtgttcagtgcacctggcattgttgggttgatgactaacacactcatgggggtgggagggatgggtgaacttggtccttgactggctgcaggaatctgcagtattcttccttcacagctatagccttcccctctgcagcacactcctgcactactccaggactagggacaggtctgagtagggcagggggcataaaggagcttggcccagggctcgggatgcagatgcagctctcctgtgctaatgtgctatttgcataggctttaggctcattgaccgggtttctgtcatgttctggaggcctggggcctcgtcttgtcctggtttttcacttgggtcctgaccacacacccatatccctctctggatgactgatctggcaccccagtctgtgcctggtgtgctcctacaagtcagagtcctttctttggctcttaactgcatggctgggccctgcaggtacaggctgacctcttcacggctgacagggtcttcaggtggcccaggcctaggcgccatagcacagttctttcatatcagctgctgatgtgtgataacacctgctgcctgttgtcactgagattcatggaaaaaattttttgaccatgaaagcatggtgtttggaaaagggtgagtgtttgagctagaaaactgtgccttgaactgggtgcggtggctcatgcctgtaatcccagcactttgggaggctgaggcgggcagatcacttgagctcaggagttcaagacaagcctggccaacatggtgaaatcccatctctactaaaaaatacaaaaattagccaggcgtggtggtggatgcctgtaagcccagctacttgggaggctgaggcaggagaatcgcttgaacccaggaggtggaggttgcaatgagctgagatggtgccactgcactccagcctgggcgacagagggagactccttctcaaaaaaataaataaataaataaataaataaataaataaataaataaataaaagaaaattgtgttttgaatcctgactcttctgcttcttagttgtgtgcctctggacagattatttaaactactctgagtcacagtttctcattgataaactaaggtcattaaaatctgacttataatgatgaagataaacgggcacagatgcttggttcagtgagaatgccatccctcttctcctgtcctcgatcattatggccccaagaggcacaggccatgggctccaggtgggaccccagccctgccaaagtcccctcagccttgcaggctgctgatgaagccagggactctgctcccacgtcccttatcatcaaggtaaggagaataaagcatggtgtgcacttgaagtgttttgaaccccttggggaaagacttgatgggtttagtcaatgtaatttaccctgcatggcttataattgcctctgagaccaccattttctcccagttcaaagaactgactcagcctaatgccaataagcatgtcaatgtccccagcccctgtagcttcgggaagggacacttgtgctgccacagcaggtcatgagtagagagcaccttttattttcttcactcaccatgtgaacgaatcggttttgcctaagtgtatatatatatatggcatcagggcaattcaactcccctcgcgagaggcaggtgagacattcctctcccttctgccccatttccaactttggagcctgcaggtctactctggggtaagttcctggcatgtgtctgctgagagtggatgagcaaatgcatgtctacctggggtggtagtcattgctctctgcttctattcgtgtgggaatgcccagcagagggaggactcaccactggcaaccagacaggtgcctgttgggaagcaaggagccccaacagctggggctttactgggctccttctgctccagctcccaggactcgtgttctgtgatgccgtggtcttgtcttcccgccagcctccctaattagatggagattgagagctggggctgtattgcttgtctgggtgtgcccatcacctggcacccaacactgcagtaaatgttggtggacataatgcctcaggggattttggaggtttgtacatttcatgcttggaaaccttcacaggatgctgtctcgtgaagtgaaaggaggggaggaaggacctccacagaggggcctctatgtttaatggcaagttcttaaacccctctgggcctctgtcttttcagctgaaattagggaatgacatctaccctagctgctcagatgcgagcctgagtgagaaccttgtgttgtgaaggagccaagcaccctggaagggggcacagggctgccgtggatggggagatgtgggcagagtgaggaggcgcaggagctgctgggactgtcagccagcttgtccagcagagggtcagtaggcgagtgatgtctgctcctcctcataggcatccctttttcctgaggtggagttagaggcggagcagttacagatgaaaatgctcctaggaggggcagacaggcaggaggacaagagcagatgtggggggcacccctgggccatgtgctcctaaagatgaagcagggctctatttagcacagtgtaccaaccttgtggctggggtctcctgttgatccttacagcagtgaactttattctcaatgaaagggcgatttgttaaatgtacagtataactaaaggttatttttatgccttggttagacttggtacatgaatagatatgcaaattaaaaatgcctatcagagactgtgctccagtgctggggaggaaacacatggtgtggggatagtcaaaggcatgccggagtgggaggcacctggagaggggacacaatggcctggaaggataaggggagactccagctgtgagcctgagaggagaggcaggcaggcaggggccgtgcggggaatggtctgcagcaggaggtggtggtgggaattgctaggatgaatttcaggagctggttgaagcaaagggaaagcagtaaactaatgtgaaatggataagagatgtggcctaaaaataaccaagaacctaaatattttgttagtaacaatggctattgaccaggtgcgatggctcctgcctgttatcccagcagtttgggaggcccaggcaagaggatcacttgaggccaggagttcaagatcagcctaggcaacatagcaagaccctgtctgtacaatttttttttttaattagctgggcatggtggtgcacgcctgtagttctagctactagggaggctgtggcaggaggattgcttgagctcaggagtttgacactgcagtgagctgtgatcatgccactgcactccagcctgggtgacagagtgaggccttgtctctaaaaattaaattaaaaaattaaaaaacaacaacaatggctactgtttttcaagtttctgctacatgccaagccccatgcatcacttcctcaggcagtacataggaggcagaccagcctaaagtttaagggaaaattatttaacctccatagccctcagatttctcatattaaaaaggggattaattataatatctaccccaaggggttgttttaaggatgaaattagataatgcatgttaagtacttgttacatgactggcaggcagtaagcactcaacaaacgctagctctaatcatcatttataactcttaaatggctttatcaggatgctgtgattcaattaacagaaatgtgaattaagcagaatttttttaggggtgtgtctagacctgcaaactgaggcttaccggaaatctctggatttccactcactgaaatctactatttctctacacagataagaacaagtaataaaagacgctcttcaatgcctttctcatcacagaaagatgctacacaaagggagagtgttgttattgacagcatcccacataaaatgagaattctgtcggtgataaaaattgaatagaaaaaaaatcttggctctatggagtttctggtctaaatgcatgaagacataactctcagtttaacccatctcatttgaaagatgcattggtgaaacacaccacttgtcgtttaggacaaaggattgcaaagggaacaggaaatctaaatatctccagaaggaacaatttttcttgttagactatgtatgtagtgtacggctaaaagcctttataatgatagtgctgaggaatggagcctgcacaggtgtgataagttgtgtactttatatttgactgtacaattgcagtgatttgtgggacatgatttgatccatggtgtttccaaatccatctcataacgagttgaacttagcatggcttctgctctgtaagcgtgtcaaagcttaggatagtgtgggaacattgtgtttaatttagtaagatatatagagagaggaaaaactaggggtatatctctgcaagagactgacaattagaatcaggagagagaacttgcctttcttctattttgagaaaaggtagaattaattccagcagaaagagcagcaattgaatgagggaggtggggctgataaagtggggagaggatgaggaaaagtagctatgtgaggtggatgtaaagtaatgagataatttttaagcacacatcaagctgatatttgaattggtgttgtccttcaaaattaccttgagagcatttatctgtattcagaggacattgccactgctcaaaacatcttaggcattgctcttagagatttttcctgttactcattatactatggttgtacagttaacataattctgtaatgatgacagactattacattccttctatcgctttacatgtttgtaagtggacagaagaaatatcattccatggatcaatgcctccctgtcaccaggctttatgtacctatgacttattcaccgagccttcccgaggactactgtgtggtgggggcaatctgactagagcccttttctctcaagtgcacaactctagttctctctatcacaaggaccagggcacccaattaggatcaaagtctttcttatgaagtgattccaacaggaatgtgaccagagacaaagaaagcacaggtaccaggcaagtccctaaagataattccttgtcacagagtaacaaatgctgttttggttcatctgatgggacacaggtgttgctctgatatacagaacactttgcagtagtatttattataaagcaatcatatctgttttgtcggacacaggttgaagagaggaggaatgttagatagattccatcaagtgaaattctcagtttattcaactggaatttgaaagtatatgcaatttccctcaatacatcattctgtcaatgcatatttattgggcatactacatgttaagtatggtactaaagattcaggaagcagtgatttataagacacacacaatccctaccttgttagtttgtatattcagatataaaaaagataataaagagtgataaattattatagggatgtttcaagagccatgagaatatattgtgggtacatatagagtataggtgtctggggataattttttttaagtgaaggaagagtagtatttagagagatggaaagtaaaggcagaacattaagttcttcctttaactttaacatgcctttaacatggcaactgcaaaagcctagaagtaagaatgtagcatggtacaactgagtggaaggaaggggagattgagagagaaagaatggtttaagaagcagctggtgaaactagcgctggacagatcacacatgggcttaaaaaaggtcttattagggagttttaaaggcatccccaaagccacaggaagccacagaaggatttccaaaataggaaaatggtcagatttccaataccgttgactagagcctggagtctcttaagtgctaacctctaagccctaataaagttactttaaaaattttgtaatgtgtgaaggttgaggaacctgggagcagaggtgatttgggacagcatagggaataaaatttctgccgctttcaaggttcagggttggggagctgtccacaaagtaggtgctgaatagctgaagccaggagctgcctaaggaagcttcatgggatgtggggcaggtggcgccaggtgttaccgcctacctcagaggtgggaggaagagagttggtttttctttgtcttttatccatcctatttttctattttccttgcttatgtcttcctctaccttctcctttctcccattttcatcttctagcaatctgggcagctatagctgactctccctgaaggaagagggaagagaatgctttttgctcctccatcagtgacttctcataaggagtcaacagagcattgtgaaaacaaattcataagaagcccgcctttatctaagggttggatgactggttatattgctaaattggccatcccagacccttctgagccattaggtggggagatattgtcattattatactatagttattagtagttgagcatttagtgtggatcaggcagttaaacaagcactttacttctccaaacctaagaggagactgtgttgtctgttttatagaacatggcttgacttggaagatcagtggttgtgatttgtgctatttgtttaataaattattactgaggccaaataactgaaagatgcagaaaataaaatctattaatactctgtgtagactctttcaatagtcatttcatttagtctcataacaatcttgtgaaattatactgttattattctcattttactgatgaggacactgaggctcagagagcttaagtaattggctgaggtcacacaactagtaagtgaccatggcagttttcaaacttggcactatttgattccaaagcctctgccctttcatctagagtgcttctttggtttctttggggccagtcacatctacagtctagtttgattttagcgaatgaaaactgctgcacttcattttccttcagtaccatttgcctctggatcttgatgcttcccatatcatctgtacctctgggagggcagcttccaacctcagagcatgtcagtggtatgcaggctcccagcgaatggaagcactcttgttttctgtaattgtacacttattaggtcacaaggcatcatcaaaccaagctgtcttttgtcggaatccccactggacagtttggtctcagtatcaatactggaaatgttagtctggtaaacagcctttaacagggaagaaggaggctgagaacgaagtctccttcaaatgaaactctagaggatgagagtgaaccgagtcaacatcttactttaaatcccctggagtagctatgaaagagagaagacttgctggattgaggagaaaaaaaacactttgattcatctgaattaatttcacctctcccaggagggaggattctttcaccaccctcctgttctccaccaactgcatgcagctccacaatccccaaagacaaaagactaaactatagtgggcagagctcacacttcctcctttctccacttaaatccatttgtcctggggtcactgatccttggaatgtccttgggctttgatcgttaacccacacacatctgaaggagtgggtagctagtgctcagagtgaggacaatgcctttgtcctttgacagcactgatgcagttatgagctcttggacatagcagactgtggggtttgggcgaaaaatgtgaaaccagctttacacttataaagctgcatgccaactagcatcaccctccaccttgccttgagccctctgtcctcattttttgaaggtggatccaccaggatggtaatttgattgtgttttaggagtctcaggcagaggctgctgtgggttgtaagggttgacttttagcccataaaagatggctgtcccccatccagatccatttatctgtcccctttatagaaatggcccctcgcccctcttttgtctggaacagatcagcacccaccatgagggttcaggatgatacggcagggtcacatgagtgctgccatgcagggccatctttattcaagtacggcttgctccaggctgactgcaggtggcagaatagtgccatcctgggagacaagtggcagtgaacactccatggttcctgctccattgcagagccacgtggagttaatgattttctagttcaaacctctcagcttaaaggtgaggaaactgaggcccaaagaagtcaaggatgttgctcaaagtcacagaggccattagtgatagagcccaaataggaactaagaccacaagtagaagcattcctctgtttactgaagaatttgccatcctctttatcaacctgcctcaggacctgactcaacagagaacactggactcggagtcgggcctgggcaccagtcccaattccgattccaacttgctggcacttcaccgttttgattctgtttctccccttataacaggacaggagtggtaaatgatgataaggcctgtcctacctaccttgcaggttttcttgttaataaggataaaataaaagtggggaaagtaaggcaaagtctatcatataagagaacatgctatatacatgtaaaaccaaactgttatttgggggaaatgtgagttgttcaattttatttttcctccagacactgggggtagccaaccaggccataccagtggtcccgagacaagtgttcagtagcctcttcatcccttggagaagcttgtaaactgcagaaagtgtgtaacctgcagagtgtgtgtgtgtgtgtgtgcacgtgcgtgcacgcgcacatatcggtgtgtgggcacatctgcatgtgtgtcttgggtaaaaggcacggggaaagggaaggcatgatttctttttcattttagctgatagaggagaagggtattgggggagatgcatagagcctacctgtcagacacatcgaggagaggcaacaccatccactgccacaggctcaagccttcataggcggcgacatgccagaccatcctgccttgctccttcccggttttgttctccactagcaccaaggacacgtttcccctcaagactccacgaatgagccaggacattcggagctgtgagggcgagaagagtcagaggacaaggtatgattgctgaaaggtcccctttctggaattctccactgaagtttcaaggaccttataagagactcagctgagttcagcctggtgagaagagctggatgcccaccacctgtctcaccaagaggctttcagtgaagttcaagtatcccatttcctaggataactgaacgaatctgttaattttttttcttgggcagggacaactgatgggcagttttggaactttgttcaggttgatgttatcatcctacctttcacaagattctgcctgtaaggtgatatcaagatcaatggggtagtaaatgaacttcctaaagagtagccaaagattcttgcctgtggccccaatttactttgtgaccttggacaaatgattttgtgactcagtttcttttagtgatttaggtatcatagatttttctctcttccccaaagactctaataatctcatttgaatggtgtcatgtcacatgtcagctaactaaagacccaatgacttgacacctgtggccactggcaggcaaaggccagacaaaaatctacatatcaagatcttttaatatgggcatctttcgaagaggatgcccacttcgccaaaaggaagttacaactgtgtttttcattgtgtctttattaaaagtttctgtggcattgttcctaaacatttgaaagaaaattgtaactaataacctttgtaagaaagtttaagtacgatcatattcagaggtaggacatactataaacaaggtttctggtctttgtgtttaaaaacctaggacaactatatcatatcattgcctaaaataatcctgtaagaaaaaatggtggttattgtagaaagaaaggtaaaatatgtcttatggtaaactggcagtttcgtcagagtaaaggtaccccctttttactgattctctctgaatacctgcttctttgtaaattaccactcctttgtcttccagtccttgatacatggttgcctcacaatttgattgaagaggttaagaaccatgactcacggcagccccaaacttcccactttcttgcatacaaacccttcactaataaggtcacaccagggcattggggcccccagggactgatttacttctgagtccctggaccttgtaagcctggtctataaccacagacacttcacttacacctttcccatttctccatatcctgggtagcaaatatgcatctctactgagacctcctaggataaatgaatgaatctgttaatttttttttctggcctcacttagctttcttgtacaagccatgattggaaatttcaactctacccctgctaactgtaaaccctttcagctctcagcccatgccatgcagtgcctagcttgggatcacgatgctttctccttttgctccttggctgaagaatactgctaatttgaacttccatgaattcagactgttgagtctcaatgccctggatgtgaggtggtacttgttcattctctcttgatttccacagttgatttccagacacacatagtacaatgggtgtttcaaactctccctcgcatactgacactctcaccccctggttcccacctcctaatccactgatttgatttctactttactgagaagatctactatgtcaggaacaatctccttcagtccccttctctcttttttgtgggcccagtgtttatttatcctcctttcttttccttttctctcttagaggaagctgcatccttcactgtcttccacgttagcccagctcattttctctcccccagtccttgctcttttagttactgccctcctttccctcctttccccagcatctcagagtcaatcttttggctcctttgtctacaaataagatcaaggttcacccattctggagaaatatcctttatttcatcctctgggctcctctggcttgtaaccatttctttgccccattcagatgctcacatcttgaacagctgggatgtaactgctgccgctagttacttgttgctcattctctctttaagttctttcaacctggtttctagataatctcctcattactctagcaaaatagagtacccatgtcctttataactctttgaactcttcagagtctcctaaagtgcctctccctctccactctttctctcttccgaattctcttgtatatttctatcacattctcctgttgatcatgctcatctgtgacttgggctcaacaactgtcgatggtttctcatgccctgtcaaaaattatggcatttacattcctctattatctgaggaaatcaactttttcatcattcaacaaatatttgttaagcacttatgctgggtcacatgaattctccatttcagaatggtctaagacctctagaatcagagagttctgaattcaaaacctgtttttaccactttggcctagttatttaatcattttgaagctcagtttcctattctctaagatgagaatagttttatctcttatagggttatagggactgttaactgaaataataattgatgtaacaaaatattaaaaaggcattttggctgaagcatggaggcagtgggtgctgcatttcaaagggaagtgtaagagcacaaggttgcagaactttcaagagaggtggataaaaatgaatgacataattcttaacccttcactcatactttgcatattacaaaatgctggaggttgactattaggagagagtttttggaaggtgcttttggcataccacgagttccatttcactctcctgctaagaagaaggtgggaagggtgttccatcttcatctcaagtcaagagagaatggttttatgataccatatcaaggacttgatacttacccctgcagttttggaaacacggtggattagtgtctgtctcctacctggaaggtctaaagtttgaactaggggctggctagctgctctgatggcagaacaaggcaaggtggcagcatcgggtggcctacactcccagagtttgctggggcagaaatgcatgagtgttgcatatgggtgggaggagaaccatgtataggggagcccatgcagggtcactgtagatcttgcctaagagggaggtaaatagacaatagtaggaagaagctgccggtatcttgagatgcccaagagtggaggaaggtggaagtgaccacctataatagagatgcacatacctggccgggcacggtggctcacacctgtaatcccaccactctgggaggccgagtcaggtggatcacttgaggtcagaagtttgagaccagcctggcaaacatggtgaaaccccgactctactaaaaatacaaaaattagccaggtgtggtggcaggtacctgtagtcccagctactcaggaggctgaggctgaggcaggagaatcccttgaacctgggaggcagaggttgcagtgagccgagattgtgccattgcactctagcctgggtgacagagcaagactctgtctcaaaaaaaaaaaaaaaaaaaatgcatgtgccctaagtcaaggcgaaaaattctaagccatggtggaggggatgaggagaaaggtggatctacaaaggaaccccaaaagcccctgtgtgagaaacagtaagccttggacatttgttacatccagagaacaccaatgcaagattacccaacagtctccaataagaactttcttgctcccctgaaatcctttctgtgtctatgcttacaaccccaacaagtcagaagtcaacaagatgacagaagaggaggagaggttgggtggagaactagagaggccactgaccacaccctttctctcatttcaggctttccatctgcaataggaccaagtttggaggcggcaggagagggcaagaagtgatgactttaaagcaagattgaaattgtgactggatgagcatgctgattactaaaaagcctgtgttttgcatttttaagtgactgaagaactgtctgcattaccttccagtgaccagagaagtagtctgtcagttttcacctagcaatccacacaaggaagctgaatgaatgcgggttccagactcccctacaccagtctacttgccagatttgcacctgacttgcatttctctgcttctatactttttattcttttgttttctctacctgctttttccttctgtcttcttaaaaaatgagatctctttccttttcaggaggcctttttcttttcatccatctcagaaaccacttcctcctcctcttaaatcttctaaggttattgggacctgctgccttgtcttctctctctacccttggtcatgaattccttcaaggcagggactgtcttattcatcttatgttcacagtggctgtcaagcaagggcacgttgtaggaaccaatcaatgtcagcatgaataaaattgcatatctatatagggagacactctcatctttgccaggctttcctcttagaggtagtcaatcaactttccatcctaggaagctccttggcactttcttacattctatgggtcagggaccagggaaggggagaagttcctcactttccagccacttggctatattctaaactgccccctcctcagctgctccctggaactttacagtttaaagtagagtctgctgatggtatgagcatgtcagcaagatgcagccctgtcttgtctattctgggaccaggggccagccagcagctgagctctctccatcttcctgttctgtgttttaggccaatcaggccgggcaaaagagagagaactggactggccacccagggatggtgtgaaggctatggcatccttagccttctgaggcaatccaccaggatccttcctgggattagtccttaagggagatcatcatctactcactcgcagatagttactgcactcctactctttgctgcatactctgttcttgaagatgagctcctgccctcatggagcttatcatccagccaggaagatagaatttaaatgaatgattacaaatgttctgattgtagcaaaaggtgaagtaattggagccacttgacagtcaggacatatgacacaagataatcgaggcaagacacatgacatcacacagtaaagacttaggtccagacagccactggacccaactgttcagagctaggaacaaataggagaattaaataattaacttccggccgggtgcggtggctcacgcctgtaatcccagcactttgggaggccgaggcaggtggatcacctgaggtcaggagttcgagatcagcctggccaatatggtgaaaccctgcctctactgaaaatacaaaaattagctgggtgtggtggcaggcacctgtaatcccagctacttgggaggctgaggcaggagaattgcttcaacccgggaggcggaggttgcagtgagccgagattgcatcattgcactccagcctgggggacaagagcaagacttcgtctcaaagagaaaaaaaaagaattaaccttctttcatcttataatgatacctcctatgtttatagcagaagacactcaactacagccacaactcaagccaaggcatgcactctctgagtttcaacaatgtctcattctagaaatagatgcaaaaggcctggaataagattgcaaactggcagtcagtgaatggctagcaaatgtgtattttttggccattttttttcatccactgagtgttcagtaagggagtatatccaggcagatgttcttcctcaggatataagcagtccactggctagccataggcagaagaatgaaactggatcccacctctcgccatatacaaaaattaattcaagatgtattaaagactgaaatgtaagacatcaaactataaaaatcctagaagaaaacctaggaataactcttttggacattggcctaggcaaagaatttatgactaagaccataaaagcaaatgcaacaaaaacaaaaattgacaatggggacctaactaaagagcttctgcacaacaaaagaaactataaacagagtttataacagcctacagaatgggagaaaatatttgcaaactatgcatccaagaagggattaatatccagaacctataaggaacttaaacaaatcaagaaaaaaccaaataacttcattaaaaataacacctttgccctttgtctgggcaaaggacattaatagacacttctcaaaagaagacatacaaccagccaatacacatatgaaaaactgctcaacaacgctaaccaccagagaaatgcaaatcaaaaccaatgagataccatctcacaccagtcagaatggctattattaaaaggtaaaaaaagaaaagatcttggtgaagatacatagaaaagagaatgcttacacactgttggttggaatgtaaattagttcagttgctgtggaaaacagtatggagatttctcaaagaactaaaaacagaactaccattcaactcagaaatctcaccactgggtgtccacccaaaggaaaataaatcattttaccataaagacacctgcagtcacatgtttaccgcagcacgattcacaatagcaaagtcatagaatcaacctacgtgtccctcaatggtgcatcggataaagaaaatgtggtacatatataccatggaatactacagagccataaaaaagaaagaagtcatgtcctttgcagcaacgtggatgcagctggaggccattatcttaagtgagttaatgtagaaacagaaaatcaaataccgtatgtgctcacttatgagtgggggctaaacaatgagtccacatggacttaaagaagaaaacaatagatactggggactctaaaaggtgggagagtagggggaaaaggacgaaaaactacctactgggtagtaaactcactatttgggtgatgggtgcaatagatgcccaaaccccagcattatgctattgcataacgtaacaaacctgcatgtttatcccctgaatctaggaaaaaaaagatacaagcagtccagagcctatgtctgtcccttggcctacttctcacctgtagttataatcgtagtttcttccacattgtgcctctaagagccagtcagtggtttcctgcttagagtgtggtcctcagactggtagcatcagtgttacctgggaccttgttagaaatgcagaatctggctgggcgcggtggcttgtgcctgtaatcccagcactttgggaggctgaggtgggcagatcacaaggtcaggagttctagaccagcctggtcaatatggtgaaaccctgtctctactaaaagtacaaaaattagccaggtgtggtggcaggtgcctgtagtcccagctactcaggaggctgaggcaggaaatcacttgaacctgggaggcggaggttgtagtgagctgagatggtgccactgcactccagcctgggcaatagagcaagactgtgtctaaaaaaaaaaaaaaaaaagaaaagaaaaaagaaatgcagaatctctggcctgatgccaaatccctgtccctgtgctcctgtgactcatcccatgacctttccagaatgcactggaaccacctgccctttgcatcaacattcattcttcagtggcttgtcaaaccatcctcttttcttgtctgctgactatggcataatttggagtctgtgcttcaaggccaatgtgtattaactgtgtgaccttaagccaaccacttacctcctctgaacctgtattttgttatagacaaacttgtgataataaccaccaccccttccctgcctgcctcaaaaggggattatgaagtatgagatgaagaatgtggaagtagagctcctgtgatattgtgaatgacatggtgaaaccagtggttttcaacctggggtgcaaattagaatcagctttccagacgactaatgtctgggcaccactccagagactctgatttaagtagatgtgggtaggtcctgggcatcggcagattttaaaatttctccacgtgtttctaaagtgcagcctgggtagagacctctggggagctgggttacttagtgcaggaagtgcctgaccctctcagtgaggggtccattttcatcttggactttgagtaagaggcaattcttaataacttacaaatggcttaaaatgtgcccaccatcaccaaggtgtagagggggcgattttcctgcagcggggagtctgctgccgtcagctaagggccttcttggggctgttacatcgcctctagaaaaagactgagaataaccgagagagagaaaaagagagagagaccccgtgagcagtaatgacccgaggatgtatacggggctagaactaccctcttggacctgcagataaggtttttaccaatttcttaattagaagacctggaggcctggtatcagttcttactgagtattccttgttgatcacatgtgtctaacattagacagcactcactgtatgtggttcctagagcagactgcaggctcaagtccctctcaaagaccttcatttcccttacacagtccttggttagaggtcccttgatatcattttatgtaaatacccatgccaagtatacccagcttgatcttggcagtcaaggttctggtccaaaaacacccttagaattccatcttaagacctatttctatctgggtggcctacagcagaggtcctcaacctttctgacaccagagaccagtttcgtggaagacaacttttccacagaccaggggctgggggttggggggtagtttcaggatgattcaagcacattacatatatcgtgcactttatttctattattattacattgtaataaataatggaataattatacaactcaccataatgtcagatcagtgcaatagggctcgcacttctatgagaatctagtgccactgctgatctgacaggaggcagagctctggcagtaacgcgagggatggcgagtgggtgtaaatacagatgaagttttgctcacttgcctgccactcacctcctgctgtgtggcctggttcctaataggccacagagcagtactggtcggtggcctgggggttggggacccctggcctactggatatgaagtcatttgttaattgactctttactgaatgccaggaagctgaactaggcgcttgcacgtaggcttatctcactgtatactgacaacatccctttgtgtagatattattccacccatttttcagatgcagaattgaaggcttagagacgttaagtcagtcacccctgggcactaagcccacaggctgcagacctggagtccacactatgctctgtgttctttctaccatacatggagtgcaatgcccatgtaatatattatggtactccttaaagctttgggggcatattgcaaagattttccagatctttgttgctcagtgtgtggtctttggatcagcaatgtgggcgctacctgggagcttattagaaattcagggtctcagggcctgccccagctcttctgaatcagaatttatattttaacaagatcttatcctagaaatactttcgtgctggagaaattagggagctagtgaattttaatgcatttacaaccattgtccttaccagacaattaacagtcgtgtgtgtgtgtgtgtgtttgtgtgtgtattcacacaaatatgcgaaatctgacacaaattctaaattatatttatgggaaataacgcttgctgatgccagtaacaataaaatttttgatccttctagacacatcctagtagatataggttataaatggcagtgtttgactaataaactcttttatatgcagacagcaaatgagacaagtgagtagagacaacaccaggagtacgccaccagcaattatatcttctggttccagccagcgctttcacaagggccattttttcctgcctctcggaagggactgatagactttccaattatgtggtaccagtgtttgtcattttattaattaaagtcctgtatgtaaagccggaacggcattgtggctaggcctaatgctattatttctctcatggcccattcctcctccagaggtaattattgcaattttatgtcttgaatatgccccatgtttgctatgcatacctcgtggcagcttcaggacaatcccttcaacccacagaaaatactgtgtgttcaaaagcctgcagtgatcaaaagagactcagtgacatcaaataatatctattctgcatgcaacacccctaaatgtaggaaatgttctgacggggcaggtgctatctttcttcaaatttctgaagacctgcatgaattccaatagtagagacaaaaccaaggctagatgctgtagtgtgtatttcacttcaagagaaggaaacacatttttaacagagatgctcaaagatgagcttgcatggtgggggtactccctgggtattccccatccagtctctgttgaatgactgggattggaattgtcatcaggaacatctctgtatgggggttaaggctctccctcaatatagggtgccagagggttgtaattctcagtgtgaaccggtaattttgacttccctggtttcagtgtggtatcttcttaacttcagctgagaatactgactcactgcaaaatccagtgtttttgttcaccatcttctagttcacctggaaaaatgaaacaccaactctctagctataaatagcctaatgacaaatcaacccagcacagcaagaagctggccagatgcagatttttgataacaaggaaataaaacacgtttctggcaaatgcttgcaattatggaggcttaagaaatgctggattcctggtcttgcaggatacttaaaagatcaggatccttcctgaaaataccacttaatgtttcttttctgagggattatgtagaagccagggaacaccagtggacattcatatgccctctttctaaaaacatgaaggccacatacaaaaataatcaccttgagatctctggctggtgaggttataaagttacaagttttttttttttcttctgtggtcttttctttcttttccaatttttttttttacaatgaatatctgacttttgataactagaacaaaaacaatgaaattaatttagagtgtgcagctgttaaaagcatgtttatgaagactaatattgatatgggaaaatgtaatgttaaataagaaataagacacaggatgtttatatttatataaaccctttctctatagcaaagctcaaatctaaatctatctgtctggaaggaaatgtaccaatatctttggggggtaagattttgggcaatttcaattttcttcttcatactttcctgcatttttcctaatgttctacaatgaacataaagttcttttataatcagagaaagcaataaatgctatattaaaaaggtggtgagagaggattctgatgttggaaaacagtaaaagctagtactatgtttttacccacttcagggagaatcaagttattgtgcctgtactctaggctttgtgagggagatcaagggaaggtgggagcttctgtggaatgcggtgggaccgtgctgtgaacggaacgcaagctttcgtatcagaaagaatggtctattttttacgtatcacgtaatatctcagagcttcagcatcttcttccgtcaagtggggtcaacagtaccctgcttagatatttattatggggctttaataagattatatgagaccagtgcccagcttagcgaagacatttgataaatgttagttcctttctcctgcatggaaaagagcaggcaggggacactttgttagagataaacagttcacaaaaaacagactacgacagggtgaaaatgctgtgttaaagtttctgtctggtttttttttttgttgctgttttttaatcttctgggttccctagagaattatctttccaggcttatgggaagaaaaagatggtattttcttcagtcacactgtcatggtgtgatcctgggcaaacggcctcctctgtgtctcagtttctctgtgtatgatggagatgacactgaggagtagctttgtaatctgactgctggggaacaggatgattctaggcaatgaaactcccacagccttcacggacaccactggaaaaagtagatgtggggcacaggagcatctgcagggggcccagagccctctggggagtatttttccctgatagctggagggagtgtgtgctctcaatggggtgttcccccatatatgggtgacatgaatgtgttgcaatgaccactagtgggagccagagaggtctgtgattaacatacagcttttgaatgggaaccaagtctgtgccaagtgccaaggaagatcctattcacacccaggggctgagacagtgattcttcctagacctcagcttcatcatgcaatgggagaggtattagttgtgaatggctcaaaggtattacattaattatgtctgactgcagttacaattgctgttgattactgcaggcattagcaagtgctctggcagagtcgaccacttaacaggcagtggtgatagaatgctgggctccagtggcttcctagctctaggtgctggggtaagaatgactttggctcagaaagctcaggaaggtgtcatttgttgggtcctcgagactcattgaggagtcttcttgttcactctcatcctggaagagggttatgcttgcaaccgtggggggtgggggtggggctgcacaattaattagttaattatcaacgaagtgggtttattgggcatgtcctgctggtgctaatgtggacactgtgtgaaataacgctcccgacctgcccacgtgttgctgattgactgagaggagaaatcagaacacaagcagtggctgaatttatgcagcagcaacttcctcatgcctgagtaacgtaagatgagggatcataataataataattgctgccattcatcaagctttgcagagaagacaaaggcttttcacattttcctctgatcctggtaacaacctcatgcagcaactaaaacaggttttttgttgttgttgttttctcaaattaaaggaagtcacttgcttgaggtcatatggctcctcagtggggcagagctgggatctaaactcaggccatctaaatcaaatcgagtatttatagatttggttggggagttgggcagacctggtttgaatcatgactctgcctctagcagggtgactttgggcagtcacttaaactctttaagctccagtttctgtatcaataaatgggggtaataattttttataacgagataatgtaggtgaaatgcttagcatagtgccagccttatactagggaatcaatatttgaaaactacatccttagttggctttatcgatactaagggtcccttcctccagcactggactaagtgaaggcttctttctactagggtgcaaagagctagggtgttcgaaggccctcattaagaataatggcttgcttttcagcataatacagccaagtgatttgtaagtgacctgaagaccagaagttttcacactgaatgtaagtgttcttaacttttctgtagaataaacaccccaaagagatcccagattcctgtgggctatctccccgcatggctggccacacggcaggtttgaaatcaatacttgctggttcaccacctaactgtggaccctcagtgtccctccctcgctcatccctcttgctcggggtccgtgtgtgcatccagccagtcaagtgccttgttgccatggctcaggggctcatcagaacagggaagattttatccactcacagggtagccgtgggaggtggagagactctgtaagctttgacacacaggggattctcattacagtgatgttattacaggtgtctggacggttgtcattagagactggaagtggggcccaaatctcttactcatgtagagagcctttggaaaaagccatttggaaaatgcctcgagaaccactgcagcttcctcctttgtattagaggcccttgccctctaacacaaagttgcggatgcctagaccccagctaaaggctttctgaggttactgtctccatcaccagcagtgttagcagctgccagggctcagccctcctgaggtttcagcaccagggtgagggtgactcatggggtagatgaggggcaaccatagttgaagctgacttcagggccaaccaaggcagagcaggtgctcttcaaaatgcaccatctatgagcctaattgtgacctaggggatggagtgagatcctaaaggtggggaggccttggggcttccgaaaacggcagtgagggtgggagctcttcctctgggtttcttagagtaggggcacatatgctgctcagctcttcctaggggtacccaaagccacagggcaaacagggtgtagcttcctggagtgttagccactcaatagtaaataatgaggcatgtttttgtgtccaaacaaataggtatgttaaggaataaaatacagaattgacatttaagttaaaaaaaggggtttgtaaaagaaaagtcaggcttatgacgttctgctctgggccgtgtcaccagacttcctccctgccttgagtgacctcgttgacggcagctgtcccactcccaggagctcccctggggaaagtggagatgctcttgcatctggaggacactgtgggccttgctggccagctgtgtgtggtctaggttcctctcctgagccttctctcatttataaaaaggtgacaatatcatcttctctgggggatgggggcgatgtgggggaaggcccctctgtaaacatgttgggactatatcaaggtatggggttattgttctgtgtaggtgtctgctgatggggcagtggagcaaagggacttttggcagattggaggagggagctcccatgcccatgctggctggggagaggagctggtggagatggtggacaggggtggcagggcccccttggctgctgttaaagcataaacttcctctgactccagccactgagctgggcaacacccctctccactggcaatagttgggagaggggtgttgccatattgccaggctacccagggcagggcagaggccaaaccctccagattcaggctccttggagaaggcaggctccagccttggtctcagaatcatcactaaagtcagataagaagataataatagtaatggctacaacagagtagcagaaaccacaggttccatttttaagcacctaattgtgtctagattcaggctgggcatgtttcatatctcctctcactcatttctcctgacagccctggagaggatactgaagccgagaacagtgggtcgctatactcaaggtctccaggctagaaagtgggggggcttcctccaagggctaagggacttcaagccctgtccttcccactgtaccacgttgccttggtgatgctccttttgcactggccccacatggccagctggattcttctggtcacaggagatggcgtggctgttgggctgtggggcaggagggaggcagctctacctggagccaccaccctgctccgacttgctctaggtatcagcattacactgtgggagccagaggagccctgtgctttctgataggcccaacattatgtcctcctgggcagagagtggacaacttagagggatcatatgctagcttggggtcctgaccgtggtctccaatgcaggaagaggcgtgtgcagagaacagcatgtgtgaaaacaatccccagccagactagctggatctgctcttaatttaggcaagcactgactcctagagctggacttgctttctcccaattcaggcacattctgtcactgcagagatgtcacagcatcagatgagatgggggttggacatccacaggaactctgcctgatgagtatcttggtccccaaatacctgaccaaagggacttgggcttagtgagggagatagagataacattaccctggaatccctctagcttggtactggtccccaactatttacaagaagggttttacaaacaccacaaagtgtagcattgcttggccatgcatgggcagagaggctggtcccaggtgggctctgataggggcttgcttgttcttctaccagtcagcccagagaggggaagtgtgcaatattcttctccctagatggtcatccgttctatgcagaaggtaaactggctccaggaaataacaactttatttgcaatcaagcccatgaggcctcctggaatggcttctccttcctgatttgctaaagtaagttggatcacatggggccgagaatgaggcccacccaatgaacaaactccatttgagtcctgtaggtgagtggcagtgtccccttggtggctcaggagttagacccagtgactactcccagcctgtggagagacgaaggggagaactctttgtttacacaatggggtgggattctctatctgcctgcagaaatgaggtggtggggctctgagttaggtgacagtaatgccagttctgatgcttttgaagctctcatcaactctccccaagttgagaaggttccatctgtctccagcagggcagtgtgacaggaagagcatgaaactcagaatcataagatctaggtttggtcttgtgtttattagctgtgggtcttgaggtgaatttcatgatctggatggggagcccgtgatgcataggatctgctctggaaaacgagttgaattcaatagttatgctcatcttctttggctcctgtcgagagtttggtgggggctgataaaggaaggtccccttctgcttttgtttttcctcggtctcatgccatctgatactaagttttcttactcttatcctccttttcttgactttccacagaagattttgtcactgagtttaataaactttaaaaacacagcagtcagaaaagttcctctctttttcccatcttcagagtcctatttgcctgctgccgaggtcgggggcaagcttcaataagcccaatcaacacagcctgcctctcggcttccctgcttctgcgtcacactgagaggctggagggaaggataagcctgtttccagggatgatcaccagcaccctgaaaagtcttacaaaatcaatcagagagcaatttacagaaaaattccctgccttcgggtgccttcctttgagaagggcttcagggatggatggccaaggtcaactccaggggccatggcgtcttctcacatccctctgggctacatttgctggttttaatgacacaaaggatgggtccccttttctccaggcccatgtagacgtggaaggggcccgctggtcaccttctgcctagatcacagcagctccccacagctaatccaacctgattccttttattgctagaggtgacgtcaggggtggaaaggttcggctgtgtcccaagatcccagagggtgtgtgcacgcatgtgtgtatgtgtgtgtgtgtttgcgtgtacatatgtatgtgtgagaagaggggagacgcaactgcagctctggccaggtaggaaaaccagcattgaggaactgaccaccacaaattggggggatcccatctcatttttggatcaaattgcacttctgtagctcacacaagaaaaactgcttccatgccttggaggggaaagaaaatgaggaaagtccactttttctccttgcaggcccagaaggcctgagaacgtggtttaaattattctagtcacaggcaggctattcaaataaaatagaatttcaaaccacacggggcttgttgagacattcaggctgctggggtgtgtgaaaggcagggggctggggtggtgtcagccgccactctgccgtgctctttattaccagcggctgcaatgccagacacatccgcgggtgtctcaaagccgaggcggattcgagcaggtctgacagcaagtgagcacatgaaagccactgcaagccttccctccccggtggcaactttaattatttgaactggagctcagaaaaataaaaataaaaataacatcagaatatattgtaagtggctccccagtttcctgcagagaagagcttgtggcggagaggaggaacacaaaaagaaaaccaaaaccacagcgttctttcttgtttgtggctgggcgaggcagaggtctttaaatattcatgccccgtgtgtaactgtgcagagagataggaggcagccgtggtagtcagcaagagcaggctgcaggagcctggagggaggaggtgggagtggggcaggcttctggaatgccctggaagttagattggcacaaaggcacactgtggctatgcctccatcatggggggctcctgacctggtttcatatgctctcccacccgcttctcttctcccccgcctccatcatttctcatcccttttctgactcatctttctaaaagacaagtgacatcacgctatttggggccacagacaggaggaaaactctctgcatgggctcagaatgaatttcagtcacaattggcaagcacacctacggccaatagctctgaagtttcagtgcacctccaaatcaccaaggatagggtttaaaaatgcagagccctgggccccactcttcgcgatgtcattcagtaggtccagggtggggcatttgttacattttccaggtgaatgtgactggtgaaacacagaactactggttaactcactttctagactttgcaggaaattcttgaagatgacaccagttcttctctgggaatccactgatgattgtggtgtcttgagatagtgtacgatgactttaacttcccggagaccaggactgagctgggtttgaagaaggtccttcgtggtaggcatcagcctcagggctcagctggaccagtcgccagtccctgtaggcctgatgctcatcagagtcctgtccccaaaactctgcctagtgtccatctttctgcactcgggccccataggcaacagaggcccctgtagggttggtggggtttgaaagccctgagtgaacctcacatagtcccccagagaaatgcaatatccatttttttctgccactggggtttagcccgcccgggaggaggaaatcaacttcctgcattctgcatttaggattcacataaaataaatggtagggcttacaaatctagaaatgcatatttctattttggttatttattttcctgataaaaacatttctcccaacattgggaattcaaagacccatcagcattagacaaatggtctgaaaacctgaatgtgaaatcatatgaatatatataaatataaataatgtgagtgtggaatggacttattcccttcctttcattatgcctgctgagccaagttctggaaaagggcagggaatagcagaaacagcccagagcaaattagactgcaggaaaaataaaacaggccagtaaaacgaaacacctgtttaagctattgatcaactcaaaggttattagagaaatgatgaagtattagaataatatcatttgtaccttgacatttctttttctgaaatttggctcatattaaacccagcgaagagtaaatttaaagaccaaatgctcttaaggatcctcccgtcctctccggtgggccaaccatctgtcttcatttatatgttctctcaaaaagccttcctttctaggtacctgctctcagacacctgagaaatatcagcaatgactgtgtaattccaccatctgcatgagatagcatggtttctcaaacacaatttaatttaatgaatctatttatttgtgctcagaattcttccaaaaaggatttaaggtggttcacagagatacataaaatctagtaggatagcatagcctagaagagggtgagaaggaagtggcgaatgtcgagttataaaatcaaaccaggagtaagctgctacaaattgcatatcacaaagtcccatttgcttgccaagtggagccttggttttaatttaaccactcctcggattaaaaaatcatttctacatcttttccattcttatttgttttctgtctgtgagtttttattttatgagaaactcgaggggcttgattctgcctgcatcccttagcaggggcaatcctgttgtctgtccctctgctggccacagaaccaccaccctgggatttctattagccacagaaggagaagtgaatctggtcagtttcacaatgtctacaacttgacaggaaacaaattgctcagagggtgcatagctattcctgaaactgagccagacaggaatttctcctgtgagtgtccagaacgagatgactggccaaacccaaactacgtgtaggttttctactacacgcaagatgttgatgcaggtgcagtgagggagtacaaagaagcacaagacatggcctgctctcttggagcttacagtctgatttctggctcaagttctcttcctcttcccccagtgtccttctgaatgttgatacagtgtgccaggcaccctgtgggctaaatactgcagtgcttactttgtgcccaatgctcttccaagccctttggacattatctatttaatcctcactcttcaggataggcactataaatgtgttcactttcccagtgaggaaactgaagccccaagaggttaattaactgcccaaacaaactatacaatcaatcagtggtggaacccgacttggactcagaaatttgattctagagtccatgagcttaatcactgtaccatgctggggtcttaagtacatttcttggcccctaaagaatatgactgtatgctaaggaacagggcgccagtccctccacccacaccaatgagataacagcatcaggaaccatttgagagagtagttttggaggtacctcactgaatgccattgatgtcttagtgaaatttatgtaaatcaaatttttgaggatgtatagtatttacaatgtattacaagagctcaatgtttttaaaaaggattctgtagaaagtcttttgcaatccttgtcactctcccttgttatgccatggaaaatctcttctgggtttgattaaatcatggttctactgcaagtagttcagtgcagctgggtatggctgtttaaggcatgattctctgtagatagggctttaccatgttgatggacatgctctgcctcgaagatggcagaggtggccctcttgttctctccccaggagaacgaccagcccagccagctaggctactttcttaatctgggttccggaagtgacaagaggtgggaggagaaattagagaactagagaaacaaggagacttgcctcacatggagagctcttgatcggtgcaggaaacgtagcactggtcactgtagcactttcagaagcggggacatcagtggtactgagcaatagagcatggtctaggagagaggaaaagaatcacaagcacgccattatcaggaactgggggaccaggggtgcagggttaatggactgtgcacagttcttatctagcctagggatatctttgaggaaacaggtttctggcctgcaatggagaagaaagcccacctgtcaacaatttctttttttttttttttgagacagagtcttgctctgtagctcagaccggagtgcagtggcgcgatcttggctcactgcaagctccgcctcccgggttcatgccattctcctgcctcagcctcccaagtggcagactacacaggcgcctgccaccacgcccggctaattttttgtatttttagtagagacggggtttcactgtgttagccaggatagtctcgatctcctgacctggtgatctgcccgtctcggcctcccaaagtgctgggattacaggcatgagccactgcgcctggccaacaatttcattctaaactgcctgtgaggtcccagcaccatcatctgggctaccacatccctgatcttccaaggtcaccagctttagcccatggcccaggactagcctgaagcacactggcctccccagctccaccctccccattttcagtcatgcgtggccttccagtggtttctgtgaccttcactctcttctcccctgtccagaacccaggtcgtcctgtgcccctgcccatgaagactcacttcttatattttctaagcatggctctgcctgaaaatctgggagaacaggggctcccatccacacgtggtggtgggaagaagcatctgcaaactttcagggtctgcagagcattttgtacgtggccggtgctgtggtatgagtgccattgtgagctcacaacactttagggggccacagaaccccaagcattatactttagtctttcctttctacctttctgcctctctcagtaaaggctgttattaagtaacaaattcgggtgggtcaagggcagagtaaccaagagatctcagcaagcatgagggagattcaaggagctggcattgtgtgactggggacagaaaagccctcatgcaggcaggcgggtcacaattgttcccttcagatttctgaggggctgccttggtgggagagggggtagttcagttctgtggggctccagggggcaaaaggcatgataaatgagtagaagtcatggagaggtggagcttgcctccaggtaaggaaagctaatctgtgattgagaacaacagcatgtctgctctaggaggcagtgggagccctgtcactggcggtattccgcagggctggatgcttatttgctatgggtgctgtagtggaaattatcaaactgggaacagagacatgaagggcacatccagcttggaactccatttctctcctctgcgtcttttacagacagaatgctaagaaggatgctgctgcacagtggggactgagccaactcactgttcaacaaataagcattggagggtctctagttccatagaaagaaggcaaatgaagaggacagaagaaggagagagaccttcccaccccatcagccctatgctgcagagaggtgggcaccagggcctgcccgggtcccaccactagggacagcccccaaggctggctagcctggcctctccagcagcctaacgttgggagctctgctggccatatagaccctctgtgatcccacatcctgcccagcctggtgtctctgagtctggagtcagcttacccaggaggggctggctatctcttggctgcgtggaggccctttgctctctgccagacacgcagggtttgtggggaggatggaccccggagaggggaggacaggcattactagcttaaatcaggggtgaggtagggggatggctggagaggctgtgctgcagggaatggaccatggaccgggtatagggtgaggctccctgggcacaaccctggggcaaatgacacaaggacttgctgtgcctcagtctccccagtcataaagagggctatggctttccctgcctctcaatgaattatgtgcctgacacataggacgccctcagcacatacttgttgatggaaaggattattatcgttgttgctattatctttttgttaatccctcctcatggttcttattttaagtaaccaaaggtgacatctatcttggccagatttaatcactcgaaagcccaaggtgtgaagagggaattgtgtgtgaacgctctaggcaagctttggtcagacacccgagcttgccctgcaggtggggtgaagtccagccctgagtctcccatctgtctatgtgggcatgaagatgggcaccagagagaaggcaggagagcagtagtaccttggtggtcctggaaccgggcatcctttagggtcctgacctgccattgaggagtgtggggtgacagtgtgccttgggtccagccacagaagccatcttcaaagttgcagtaaaaacccacaggcagtttccctatggagagagcagagaggcaccatcattttcaggaccactaaaggcaaaatatgccaatgccaagtcgaattagccaggcatgaccaaattatcttcattagtaatatagctccccagccagaatgctggatgactaatgacactgattataatgaagagaagcccccaagccctaactgatgcccgtgctggtttacagttttcttatctacagaaaacaaaataggaaaaataactcttcagcatgggtgttgttagtccagttgtatatctgacaaagcagaggctcagaaatgtgaagcaacttgaccaaggtcacacagctaacagataacccagttaggactcgaacccaggtcttctgcttctaaattctgcactctttatactcagccaccatgaatgtgaccccaggagaagccactgtatagctcactacatttctaatggttgatacaatgtccagactgtggtggtggttgtggtagtgttggctgggggtttgtctgggtccatcaaattacctgtctgcagagacacatattgctcaaaactttccatttgctttcctttctctcccaacccgcttgcagttaagtgaagacatatgatgtgctctggccaatgaaatgtgagtggaagtgatgtatcttctctgaattaaggctgctaaaagcccttgtgtaaatctttggtctctctgttcccttgctgaaacaaccaatgaaagttcttgttcctaagggtgacactatattgacggaggagcctctgccagcctgggtccctgagtgatcctgtggagcagaggcccctcccacccacaccctcattggacgggtactgtaaatgttatcccaagccactgagatatggggtttattactgcagcataatctagcctgtcctgatcaaacaatcccagtcattggggcctctttatatcatcagtgggctcagcacaaagggcacgtcatctttttctctacatcagactgatctcaggtcctattgaagaggtgacagtcagctttctagactgtatatttcccaactgcccacagaaggaagaggaaaggataagagggtgagggagagagctcactttctccagctcactctgagcatggctccaggaaaggcactcagccctaaggagctagtggcctattccaggcgattctgatggcccccaacacctcccagcctagctgcagagaagcctgtgtctccatgtgggaggaaagaagctctctagctgagacccacagcactgcatgtccttcctctgtctcagccttcttggcagcagcaggctgacaaagagggccctaacgcttcctggctgtgacagcaccttagtgaattattactcatttcccccagattctctgtgcatttcacacagaggcagaattataaattaaaacaggctgtcactgactttgaacatctcttcccatttatacccccctgaagaaataatttccccctaagccccacatgtttctatgattaaaaatcccaaagctaagaagaactttctgttttattttttatttccccctcaagggatcccacatctacttctcttgcagaaaccaactggtggaagtgaccttctcatggagtgtccttcacaagtgagttttaaaaaccaaggcccgacagggcacggtggctcacgcctgcaatcccagcactttgggaggctgaggcaggcagatcacctgaggtcaggagtttgagaacagcctggccaacatggggagactctgtcttgactaaaaatacagaaattagccgggtctggtggtgggtgcctgtaatctcagctactcgggaggctgaggcaggagaatcacttgaacccaggaggtggaagttgcagtgagccaagattgtgccactgcactccagcctgggcgacaagagcaaaactccatctcaaacaaacaagcaaaaacaaacaaacaaaacaccccagggcccatgatggaagattccagtgggtgatggattcctggaggaaggaggaggccggcctgaggtgggagatgcacagtacgtcactccctccttacccttttaggaggcagagggagagaactgagcctggatcatgggtattgttagcacaacagcactggaatccggacatatgggctctagttctagcctcaccacttcctgctttgtgaccttacaaaagtcccttcttccttagagcctcaggttccttatctgtaaaatggggcagtattagtgtctattttactgagctggtttgaggataaagtaggggagagagtgtggaaacactttgtaaacagccagagaggtgcaaatgtaaagtggtggtagtgttattaattgccattcacacctaacttggagctagttcttcagagtatggctgaaactgacagcaagtccctgcctggctctctggaaatgcttgttggaggctgcatatgtgatagctctgcctatgcctttcagctggacagaagaaagccactgaagaaagccatcagcattctctgtctctggaatcccattcttgtttcagcttggcatagaatccagggtgagctgggagtggaaaccccttttctttctggctgactcaataacgggagaggaggcaggcaaaagagcaagacaggccagtggacaattgatgtggcaattaaaacccctaagggaggaaggagagctgaggatttccatgattgtaaactcatcagggcagcttgctcagccagaagccactcctgaggaagctggtgggttaaggttaagagtcggaacaaagacccctgtggattaggctgcaactgggaaatcaccactaaggccaattgctgagcaaaaggttggcctgcaggattgggtctaatggtatcaactcatcctctgatcatccttttctcttctcattcgccccaagctcctactcagtcagcacactggaagacttcaaaacttatttgctgaacaaaaggggagtgggctcaatcctctaactctttaccactcaaaatgtggtccagggaccagctgtagcctcatcacctatgaatctgtaaaatgtgtggaatctcaggccttgccccaacccactgaatcagaatctgcatttttaagaggctcccctagtgactcctgtgcaccttaaatctggagaagcactgttctaaccaacccccttcttgggctgtagccagttatttcattggctggatggccaaatcgcgctgtgggtaggtcaatcaatcctgcaacatttggcaattatgacacctgattccactctaagagagacaaattggtacagtcatggagctgtgacctcagcagcagctgtgggagctgccaagtataaactccaggccaaatgacactacttcttttccttcctgcgtgacaactctgttaacatttttgataaatatgtgctatacattttcttgaaaatatagagtcatgggaaaaatgctagaagaaatacatcaaaatattacagttatctctgaatgtttgagagggaggattatgggcgatagttattttctcttgtgtacatttctagattttctgtattttacaaccagtatgttttatcttacaataaagaaatacacttttaaaacactgtttttgcctggcaggaagagtatccccagcacacagatgagattatcaagtccatgggggaaaagtgatctgtctgcaatacctagtgaatcactgacccatctaggggatgaaatgggaacatctggcccctttctagggagccacatgccatcgaggccattggtcagaacgcagagagagtcacgaagacccccttcagtgcattacagcatctgggatgtctcacttggatttggcgatgtttaattagaaatgcaggagtggctgtattggagaggggaccgagagtactgtgttggagtgtgggtttggaggagagagtacagtggacatatgaggatcatgattggctagaaaaaggcaagggaatgtcacctccatctcaggccctccactcatcctggacaactgttagaatttttaagggctccaaagagatccagttacgttgcccagagtgagtctgataatctgtttgcagccccagcatgtgcggaggactccctctgggaaggtgtggggagttgaggctggcttttggtagggggagttgattaaatgcaacctactttccccttccaaattccaaccatggcagggtttggtcaactaccctggcccaagatgaaagaccctcaggaaggttctttagaggacctggccattcctaacagagctgcagtgtgaacacctgctcagaggaaacattttaacaggttccagaccacctggaaagagctggtgtagtcaagagtattttcctatgatgttggtgttgattctggaaaccatccccctgaagaaaataataacatgaataatactggctaacatttactgagcacttactttgtgccaggagctgctccaaacacttcctgcttgtttctcagacctcagagtgtcagtaggcatcactttacagatgaggaacccgagacccagagggggaggcccccagagaaaggcggtagcagggccctggacctccctgtctcttcctggccccttcatcctgggtgtgtctgtggctaggttcagtgcttatcatagctaagtgctggaagctcgtgaaacagagtttaccctgcagtggtttgagtgtggctctgaagtcagactgagcctgaatcactgctcagcttctggctatcagtttgatcgtggacaaccacttaaactccgtgagcttcagcttccttgtctctaacaaagatgggtacaatagcatcacacaggatgttgtaaggatgaagcaagttcctacatgaaaagtgttgagaacagctcctgcctcatagagtaaaggctcaacaggtaagctggtgttgttgctgttgttatcttcatgggaatggttttcagagtcaacattagtgtgatggggaacacagcaaaaatgccggaaaggatagggcacacaaataagaaaaaggatattttctaagagttttgctaagatctgagtgggaataactctcctgaattgaacttccctcccagcaactgctttctgtagccaagaacacagtgggggtgttctccagggtggaggggttactctgacagcttgtcagagccgcttttcaaatgtggctgaaaaagcctctgggccccaggttcttgccctcagtgcctgaagtagactgccctgaagcttggagctggccaggaaaccagtagtggtaagctttggagtggtgggaaatgccctgagcccatagtaatggactggatcctgaaggttcagggctctaatctgtccctgacatgctgtgtgaccctgaacaagtcaattgccttatctgtgccttcattttcccaattgtcaatcagggcatggcctgcccgacctgtgtcccagctgggaagtaggtatcaaaaaacttgaaaaaggcaatcgcgaaatcacagagttcagaggcactgctggaaacactgcagacacaaataaatagagacacacacacaggcccctgaacagggcactgtgggcaggactggcttcactttgggccatgtgtgtagtgagaactatacgagaaaggccaggagcggaacagaacagggtaagcaaagcccttccctgtaactctttgctgagttttatctaaaaacatacaactattccattatcattggaaaacttcacttgaaagttttgtatagaaatgaagttttaaaaatgggaaaatgaatgtctttattgcttaatttaaatgagaataaatgaaaccttctccaccccccacaaagggtccagatgactgggggcagagggccctgttttaaaacgtattttggaaacttccttgcaggccactggggtctgcatatctgggaggtgaggcatttgctccgggtctgggccccaccccaggcaccattctgcctcctccttccccagtccaggctccatttcactcccgcccctgtgtgaagctttcagtgctttgagggaagatgccaagttattcatctctgctccaggatctggcacattttccagctgcctgtaggtattctggaagcgttggtggtttcagtggcaaaaacatcaagggctctgcggtgattacttctggagaggcagctgcggggagcaccatgttcaagtgcaggagcaccagctgggagtctactccgccccgactgccagtggggcctcggcaatttgttttcccctatggagtccaagtttcccaactcattctttcctctcatcaatgaagagtcagtaagcacagacgctgtgccaggaatcatgagaggtattgctatgggaaagatgaccagactcaaaccacccacagagaggaagagagacatggaaatcacctccataaaacataatggatgcatgcccactaggatggctaaaattaaaaagacagataatatgacgtgttggcaaagatatggagaaagtgggcccctcgtaggatgctaaatgcccagaataggcaaatctatagaaacaaagattagtggttggttcaggctaatggcagggggtttggagcaaaatggggagagatactacaggttccttttcggggtgataaaaatgttctaaaataaaattgtgatgatggttgaacaaccctgtgactatatggaaaacagggaattgtacacttgaagtgggtgaattgtatgtgaattgtatctcaaaactattcataaaaagtaatggcaatgatgatatttggatggatccactggattgtgggggaaggatccagagggagaagaaccagtggtacttgtgggggatggccagggaggctttctgaaagaatcgactcagggcgagtcttgaagtagatgtgactcgagaaaggaaaggggagaccatgtgagcaaagccatggaggcatgaaggatctgtaaggtggttccatacagccggagctggggtgcatggaggagggagaggatgaggggcaggtggggaatgggacttggaaggcgagggaagtctgggcatagaggacttccaatgtcacattagagctgggctttatcctgcacattttctctgtgccttgaggatgctgatagcatcacttacaagatcttgtttggttcttgacttatatgactacggaccaggctatttctagaccacaaatcttagctctgcctcttgaagactgtgtggctttgccatgagaggagtcacaagtgtcagtggatatcaggaaggctgtccatgctctcatgcctgggataatggggacaacggggttatgagcatgggctgggctcaggcagggtggggcagccccatctactcacggcacatctggctctcatcttctccctgggcacagtcctggtggaagtcacaggcctgcccaagctggaggactgtcccattccaacaagtgaaggagctctgcagggccatcttggagcctggggatgttcctggagagcacacagacacacaaccatggtaagtttgcatggccccaggcagcagctggcctgatgggttggtcccatgggcaggctgcagggacagcattatcctgccctgccattcacactccaaggcctgattgagacatctgcatctccatctggccaacccagggccaacatcagcagggagaggggtcaaaacccctcacgctcatccatggcctgctggggtatctcactttctaggaaggtgagcagcagagtggtccatgttccctccatgacattcctcctcgggggtcctcaaacccatgactttagtgtgccaagtggatggcctccaggtggagtctcacctgcacagatagctccaccctcaaggtcaaatttggggtaccaagaggtggatctggtctagtgcatgtcccccatgttcttgaccccaggttctaccactggagtgacttattgagaagatattagaaagatgcagcactttctgttctggaatgcaaagaacaccatcatgcaagcctgggcctcagatctggacttggatcctcctgcctggctgtatgaggctgaccatgtcccttctctgtgtggcccctgtcccatcctctatcaaaggagggatttctattagattgctaaggtttgctctagtctgaaattcctagataattaattttatccagagggggaagggatgggggcagtttataatgaacatacagagttatcagtttctggattaagaacaatgcattttgataatgaattaacctgtgaccactcacatctttgcaggccccagagattcagacaacaggaaggagaaggctggtctggcttagcctccctgaccaaatggagggctttgcctggggaccacctcacaaggcctggctggtgcctcctgctactcagttcttggctgatgtcagatggggagactctggcccctgtggagatgagcaggtagggctcacctgggtcaacaccccgagtgagcctgccttactctctgccttgttttctagctctatcctggtcatagctggtgctaaacccatctcagtgctcagggcagtgggggaagatgaactaggaccccacttggctaagtcccccagcctctctgagcctcacatgggggtggggcctttccaactctggctgcaaatcaaactcaactgattctgatgaggtactctccaggttaggtgatctttaatatctaaaagtccatgatttcctggttcaaaggactcttcctaatagcactgaaactaacatgaagcccagcttgtttacttctggaatttctccatctactttagcacatctggccctgtgaggaaactagacaggtcttaatgatgtccatttcctaagtgggaaaactgaggtcagagaggttcagtgacttatctcaggccccacacctggtatgtgggattcacacccagcttctctgactgtaaaggtgccctctccatctcacggaaggagatgctggaggtggccttgtgccctcttttctagggtagtccagataaggcagagtttgtcagatgacagcacacggccacccagcattgtccaccctgcctcctactgggcattctctgcaaatactagtaatgggaaaacagatcccacctccttccagggaatcatatctgagccctttcacctgctcttcaaggtccctgtgatctgggcctaagttgctttgcctctccctctgcctctgctcatggactctgtgctgcaggctcccagagggcgatgaacatggtcatgtgatggttgtgtgatgatgcaccccatactctgctgattgaaatcctgccgtccgtccaggtccagctcacagacactgcctggcacaatcctcacaccttcctccccacctccatttggggagctgctgcttccatgcaacctgcctccagaacgcttgtgcacaatcccatcatcttcatcaagttgtgtgagcttggcgttcaccccaggcctagccagtgcctggcccctaggagggttcatgaatgcctgcacattaggttacctatcttcagtaggcggaatagcagacccccaaatagacacatccgaatccctggggcccgtgaaaatgttacctatgtggtaaaagaggctttgctgctgtgattaagaatctttagctggagatattaacctggaatatctagggttggggggtatgggcaatgtgatcaccagacaagacagtcaaagtaagaagtaggggactatgagggtggaagcaagcgtttggagtagtgggaggaaggggtcacaagccaaagggtgctggcagcctctgaaagctggaaaagtcaaggaagcgattctcctaaagcctccaggaggaacctggcctgcctgacatgactttagtccagtgaaactaatttcatacttctgccctccagaactgtaaaagaacaaattcatgttgctctattacgttcgtggtagtttttacagcagcaatagagaatgaacactccatcgaaacctgactcccgctgaaatcccagacagccgaggctcccatcactgggagcccagagtagatttagatccacttctcagtgctctaatttgtttttgtgactagacctttgtggtcccctggactattcatctctacctttttcttactcacacagaaggaaaaacaccactccattcgttcctgggcctcaagatagcctaagcaaggtttccccagataacttatagattctaagtgcaggaaaatgcacaacaaaaaattacccttgaacaatacaggtttggacccacttatacatggatctcacccaacacggatggaaaatacaatatttttgggtttggcagggctgactgggcctgtgcagatttgggggtcctggaatcaatcccccactgtatggaggccatattctcagacaaacacacaggatcaaagtacagagggaacaggagaacgagatacaatgctcattttaggatgtaaaatgtcaaattcattttgcagctttaattttgggcatcaattctttacctatcattcatgtcctcttggaagctagaaggtaaaacgcctttctgcacacactggtgctggtcccacggaaggtgtggtctccctaaaacagtgggagaagatgcccccttgcctggggagctgacggggctgtgtcccaggagtcgagagcaccccagaagcagcacctgcttgctcactaaacttgtaacaaccaggacagggagttctattctttctacttagtaggagaaaatggggaaggccagtgtcctctttgcccctctttcaaggcacaggtatttaggataacaagaaaagttctcacatttgcttggtgattttgtttccaaatcactttttcttatgccttaccacaggagaccattaaatatagttaagaccttattaccctcactcccagccctgccacagaaaacataagtgaacttaaaaatcagccaggcgtggtagctcacacctgtaatcccaggactttgggaggctgaggtgggcagatcacaaggtcaggagatcaagaccatctgggctaacatggtgaaaccccgtctctactaaaaatacaaaaaattagccgggtgtgatggcacgtgcctgtagtcccagctactttggagactgaggcaggagaaccgcttgaaccagggaggcggaggttgcagtgagccaagaccgcaccattgtactccagcctaggagacagagtgagactccatctcaaaaaaaaaaaaaaaaaaaaaaaaaaaaaaaaaaaaaaagtctatgaggtctccctcaacctcctgaacaaatctaggctatgtctgtttcatccacaccttatgtcccaatgggcatgggtgtttcacacaccaatcacctgtcattcctcaaagaggtcttacagcttcttttactttccttcattctaaaaacagaatccaattgtctgaagttcaaaagcagggtcaaaagaaacaaagaaaatgcccagaatcccaccacccagaggccaccatttttaacatcttggtagatttctctttggtttagtttcttctgcccatgctttataagtatgtatagttgtgtcatacatataggccttaaaataatttaggttgtatcacaagcttttccaaaggttttaaaattttcccataaaaatcctttttaatggctacaatattgtgcaatatgtcccatcatttatttaaacattattcaatgattgggctgctagtctgtttatgatgacgctttgaagaatatctttgagcgtaaacctttgcctgcactgcagattattttcataggatagattcccagaagtggaattactgaatcaaaaggtataaacattttaaaggctcttaatacagattgccaaattgctttctagaagttaatccaatttacactcttcaccagctgtgttcatacaggcacatccctcatactacctcctggccaaccctgagttttaccagaatttttatttttaactaaaggtatccctctgctgttttattttggatttctttgatagccagtgaagttgggtttttttgtttttttgtttttttttgaggcagagtctcactctgtggcctaggctggagtgccgtggtgcaatctcagctcacggcaacctccgcctcctgggttgaagtgattctcctgcctcagcctcccaggcagctgggattacaggtgcctgccaccatgcctggctaatttttgtatttttagtagagacgaggtttcgccatgttggccaggctggtcttgaactcctggcttcaagtgatccgcccaccttggcctcccaaatacaggcataagctatcgtgcccagcctcgaggttgaattttttctcacattactagcttttttttctttccaaatttattttttagggaattgccaacgtatcgattaggttcttcctgttttcatactgagttgtatgaggtcattaataaggatgcaaaactatttatcatatgcgtgacaatttttcccagtattttatgtatattttcattctgtttataatgtattttgataaacaggcattttaaattttctgagacagggtctctgtcacctaggttggagcgtcatggcgcaaccttggctcgtcctagccttgaccttcccgacctcgggtgattcttccacctcagccttttaaatagctgggaatagaggtgtgcagcaccatgcctggctgccttttttttggagagatggggtttcaccatgttgctcaggctggtctcgaattcctgatctcaagcaatcctcctgcctcagcctcctgaagtgctgggattagaggtgtgagccactgcacccagcctgaaattttcatgtgatgcctccctattcatattttccttggtgatttcctcttctgtatggatgcttactgagtttgttccatgtgggatcagtaggtcacatgtgggttatcctttggaatctttggcttcccctctcctctggggacaccttccaccaactcttcctctttcggccctggggatctagatctcaccacctcatctgtgccattttcatggattctcccctccatgaatgtccctttcccttgggtacattacttcttcttacaattaatgtggtagacactgctacatatcattactatggcttgtatgcctgacttcctcatccagctgcaagtgacttgaagggggaggtgtcaagtctcaccttcaagagcctcagacagtgtctggtataaagatctaaattctccctatttgggaattgaactcatcctgtgtattagctggggaaggtctcattatgtccatttgatagttgagaataccaaagctccgagtggttagtggctggctgagagactgatggaaacccactgatttagatcccttgttctctattctttatgcggcctccaaggagtggtaatggtgggcatggaaggtcaggctgtcagcatccctgcccttcacccacacaccttgacaaaggaggaggtccaggagcaggagccagtgtggcttccactctctgatgccctggattttgtccccaggacctgtcttcctgggtggaagcacagcagcagcccagaggtgcctacgttttcagcactgctaccaactccgcccagtctccttccccgaatggagatttccaggctccctggcacggccttctctgtcccacagggagctttgtgcttgcagaagagtcaattagatggacgcctggtactgtgatctctactgccagcccaagccccaaactaacgaggcacaacaaaaaacaacgctctgtcttctcaagttctgttttttatggggcccataaattccaagaaggaatgtatccttggtgaatgattttaatcaagggcctgagttcccaaacagcatcttctctgtggttataaaatgattgttctggcctgcggtgtagagtatcctgaggccccggctggccacagcctgcagagcaacgaggaagggcagtggcttagacgtgaaaagccagctcctgtttcccattgacacttctgatgccttctgcccatgtggttcctggtaaccactgaaacacctaaatgccctaataggcaaaagtaagggagatctgagatcaagccactctgggaagagtcggtgcttggggatcttttattagtgagggtcctttctacgggaatttacatattagcctttgaaatggcacttcccccagactaacaatgtaaatcacagggggttacctttatatagcattttaatagcttacaatgtgttttctttacccttcgtttgaatctcataaaaactggaaggaccgttagtaatatgctcatttgattaatcagaagactgaggatgtgagagcctacacaatgcacagagaaatgatttttagacaacaaagaactacagaaggtaaccagtgacttactgggtactttgcaagtggtctcacagctagtaaaccacagataggggcccaagacctggtgagatgatccgagctcgagttcctctcccatgactcagattaaattgtcttctaggagaggctccctgactgcccatgggagtcacttgggaagtaaggaatatttttgatgttcaggccaatgaaatcagtatctctggaggatagactcttggcactggtggttttaaaatttctgggtgccgtggcttacacctgtaatcgcagcactttggtgggctgaggtaggtggattgcttgtggtcaggagttcaagaccagcctgaccaacatagtgaaaccccatctctactaaaaatacaaaaattagctgggcgtggtcatggacacctgtaatcacagctacttgggagggctgaggcaggagatcccttgaacctgggaggcggaggttgcagtgagccgagatcatgccattgcactacagcctggtgacaaagtgagactgtctcaaaaaacaaacaaacaaacaacaacaacaacaacaaactgttcctcaggcaattctcaggggcatatggttgagtatcatttccttggaggcctggagatcttgggctgagatgcctctgtatcagggatgggttcttcacctttactatcttcactgttgatctcaaatcctgcctcgaaggtcccttccttctctgatgtcctgttctgggcagtagctgttggtggttgcatgtttatgaggttgattggatagagttagtgtcgactttattaatgctggctgttgttaatgactctcccctgaagccttctcccttccagggcatctttccaaagccacacacccagcaaacttgcctctcagtgggatttcctgtctcagtcatctgtcacttgcatcctggaacatctctcctgaagcagcaggccacatttgtttgcccatttatctcctctctggatatagtagaaattagttcagatttgcactggagacacatgtggcccaggtcaggttacatgaattcctgttctacaccacaggtgatttattgggttcactcactgagaatgatgcctcttccctaattatgcattcgaaacagaaacccatgcatcctctgctctttcaatcgtgttttagagatttgatgctacaaaacctacacaactctcctaacgcaaatttctttttttaaacgaatgccacattttagggcgcttaatttttaattagggtgatttatgtgtcattttaaaaaggcacatttctatcagctttctggccatctcctacctgcttgctcttgcctaactaatgacactcgttaaaggaggaaatttgagtgctgcttcagtgagaagggggtcttgctcttcaattaaagtgaggggagacgacacgtgggggaacctggtgtctaggggactcaggtcaaacctggggctggagctggagtctaggggactgggccatgatctggactaggaaaatcaggctctcaacagcctcaagacatgaaaatggatggtgacatgatgagaatgtagtcgagtgcacagactaacagctgcagattcctttctgacgttaatgggggtattagaaggcctgagaactgtgtaaattaagcctggcagagaccagtcctgctgagggctttgggcctcctcagttgtagtgtggacaacctcattaaagagctggcatcttgggtttctatgactcaaaatgtaaatcagcgaggagcgggtcttgctatggatggctgctggtgggctgggtaagaaatcatgattccgggaagtgggagagttagtttgaggcctagccttgccatcagccctctgggaccatgaacaagtctctttctctctgggcctcagtttccttgtttgtaaaccctctaaagccagccattcatagttgccatgggcttaggctgttgcattaatggtgtgtccacacacgcctatatcagaaccacgcaggagcttcctgggcctgacttcagtcctatagaatcagaggatctgggtggggagcttggaaaaagcaggtgccacaggctctctgggtgataattgagtacagccaagtctgagaacctctggtgcctgagaaatggatctttagttccttctcctcgcagaggaattccaagacctccagcacttctcaccacccccaccgtctcattgcaaggattttctccttggtccagtattctcaagagcgcctttcgcccctagtttccatgtctgtgaatactcttgcaggcccaaggacccactttgttcagtttgtgttgatgagctgcctaaggtatagagaaaataatactaggctccagcccccatcttctactagctagtggggtgaatgctgacatagcttgcagttttctataaattggggatgctgcctaatgtacaagatttatgtgaggatgaaacgaaatcatgtggacataacagaatacatgggttcttattatgggctaacttcagagactatcctaaggactttgagaggaccagctatggagggtggatgggaagggggtcagtgagggggttacagaggccagatcttgggacagagagaacctttgggtgtcctcatgtcacacagtagagataaggctctgttagatccttgcagcaaaacaataactgaaacaaatgcaagagtcatttccaacataaataatagctatgaaaaattatacttgcaatgatgggttttcagcattagttgtctctggagtcacctcaccaccagagtcagctttctgaggtcagctcctttttggtcctaatcttaccataaacctttgctggtttctgtagcattcagtccaaatcccagctctgccatgtcccttcacatctttagctaaacatcgggatgtgcagttccttacagcctttgtgtaactttgttccgttgtctagaatcatcttgatctcaacaattcctgctaatttggatgccactttccccaactgcttgctcttctctcttgaagaaagacacgcatctccctctggggtgctgatgcatacctttggctgtgccttgcctcactttattgtgtgtttatatctgcattgccagcttctcccactaaattctaaattccttgaggcagggagtccatgtcacttattcagtctcctcaagagtgcctgtcacatagcaagtgctaatgtatgtagtcaaataatacaaaccagatcaccgagtttcagtagaagaatgtcgtgaggtggggtttccttgcattctgctaggaattactcattcctttgggttgcactgcagaaattgcacccaccttccccagtctccatttcaatctttgagcttctacaatgtgcccagcactggggtgacagtggtgaagaaagagcaacatggcaggtgtggtgtctcacacctgtaatcccagcactttgggaggctgaggcgggcggatcacctgaggtggggagttcaagaccagcctggccaacatggcgaaaccctgtctctactaaaaatacaataattagccagatgtggtggcatgtacctgtagtcccagctacttgtgaggctgaggcaggagaatagcttgaacccaggaggcggaggttgcagtgaactcagatcacgccactgcactccagcctgggtgacagggcgagactctatctcaaaaaaaaaaaaaagtgatgtgtcttctctgtggaggtgatatgtgagctgatagtgaaggatgagagagaatcagccatgaaaaaggctgtggaggagcggaaactgcaaggctgggggtgtgaaaggatgttcctgatctagaagcagagctgaggccagtacgtctcaagagggtcacagatggtcacagagggttatgaggggtggctgcggagggaggccaaggcccaaccaggcaggaccctgtgggccgtggcaaggagcatggaccttatttaaggagtttagacaagaaactgaaaaaaatctaagtctttagaaagatcattctgagtgattccggaagaatggatggagagaaaatggaagtgggcaaaccacttggcaggctgctgttgtaaccgaccaagcaagtcacggaggcagcttgaatgaggctggtgacatagagatggagggaggtgagtggatacgaaggagaccctgataggactggcagggggcccgaggtgatggtgagagaggacaacataaaggatggcactagggtgggaccagggctgtctgacatgacagagcctatgagggctggtttccaacttccaaatcctaggacaaagtcagtctccgtatagatttactgagaaccgccaagattcctgtaggccacccgcaggaaggcagagtgcgtttcatttttgtggtcgggttctccgaaggaattaaaaattttcttattcttttgtagtctccatagcccctttattttgttgtgtgatcctttcctaaggttttcctattcaacatttatcttcattgctttgctgaaaacacacaccaataatttcatctgtaatattataaatgacctctgtgtctattttgccattaatctccctgcaaaggggttgcatgtaaccattctgcaccatacctccccgtaaaatatgtcattttctcctcttgtttgttcagtaaacaatgcaatttcaactgtaccttggagaactagtactaatcataaacaaattatagctactactgagactactgcagggaccaggctttagattctgcagcagagaaagctgcttggaatgagagcaaagggaaggagggctcattcaggctggaggaataaagacaggagcacctgatcatgggtagtggccccttgagacacctccaatgaagggagccgggtggattcagccctcttaaagctacgcaggaggtcatcctgcccccatgacatccacggtagccacagtagaagggctggctactttctaaagagacaagatagccaccgggtgctgatgccactgtcaatcatcatagcaatagcttccaccctcaccactgattgagtgcttacaatgttctaggtcctgtactcaaggctttatgagcgttattttatttggaaagtactttgtaaaccacctagtgctagaaaatgattaagatttcatttttaatattaaccatctgacatttacacatgataaacccataagaggcttccacacctccatctttactgaaacgttaccttctcagcaaggccttccctggtggctttatctaaaatctctgccttggcctctaatccaaatcacagatacatcgtctctcctttccttgctacctgtataactgagcaatatacacctttcttattagtgttgttggtagtctgtctgcctgactagcactcaggggatggagaacttagcgtgtgtttcactgctgaatccccagtgcctagaacaacacctagcacctgggaatcacaataaaagtttcttgaaagaataagtgaataatgctttttaataaataattttgggtaatggattcagaagcagggtttatgctttgttcataatataaaattagtatttcagaggacttccacatagccccaactcctgtggctatgtgtgtacaaagctggcatttgttcacataaaaagcaaatcatgtagaaggctccttgtagtgatcatgtccttctctgtgtctaaagaacttgctcagtgctgccaactccattcaggatgatggctgcccactcatacctgcaatgggtcatggactgggaagctgatgaaactgcaactggcatgggctgctgggagccaccatacatggaggagagtgatggctgattcacagtgagtagcgagaggctgggagacagtcagcaagggcttcccagctgggcccagtggcatgtgcctgtagtattagctacttggaaggctaaggagggaggatcgctttagccttcactgcaggaggttgagtctgcagtgagctatgattgtgcttttgcattccagcctggacaacagagcaagactccatctctcaaaaaaaaagtgcttcccattctaggcacaaagccaagtgcaaaacagactccaacctagcagtgtgcagtggatgggccattcttccagctaggggggagaggaagcagggtgtccttggaggaaatgtaagaaggtttggtgttatcaaatttgataggtacagttcaggcaaagaaacctggaaacgggtagagtcccctatgaaaagatgaagatcacttgctatggctaggagtcaagaacctctttgtattttttagtttttagttcttttctaagcctctcatgtgagggtctgaacttctcagaaccacaagattgggagaaacctaatgaagaaggaaaactggatgataggcaggcaggaaggataaataacaacaacgaaaataatattcagcctactatgtattgggcattttttgaatgtgttatctttcacttgattccttcaatgaatatgaccgaaatatacaagaagatgactgatttggtatggttactataaaaaaatagaaatagaaaataatgagtgttggcaaagatatagagaaatttgaacccttgtgtgttgttggtgggaatgtaaaatggtgtggctgatatggaaaacaatatagttgttcctcaattcagctttgaaaaggaaataaattctaacacatgcttccatatggatgaaccttgaagacactatgctaagtgaaataagccagtttcaaaaagacaaatgtgccatttcacttacatgagataccttgtgtagtgaaatccatacagacagcaggtagaatggtggttacagggtctggggagagggaggaatagggagctgtttaatgggtatgaaatttcagtttgggaagttaaaaaagttctgaaaattggttgcacagtaatgttgaatatacttaaacattactgaactgcacacatagatatggttaagatggtaaattttatgttatattttagagcaatttgaaagatgactgattatcctggccttgaaaataagccctaatgaagactgtaggacagggggaagtcagtgtggcctactgagaaaagcctgtggctgaggccccatgcagagttcaggctcttctctttcttcttttaaatcccctttctgtttggtttccagtggaatctaccggtgtgtgaggcactggatatagctggaactacagtgccctggcagtgacgaagcctctgagctaacccgacacggctgtgtgctcagtgatctttttttttttttttttttttttgatatggagtctcgctctgttgcccaggctggagtgcagtggcgcgatctctgcccgctgcaagctctgcctcctgggttcgtgccattctcctgcctcagcctcccgagtagctggaactacaggctcctgccaccatgcccagctaatttttcttatttttttttagtagagatggggtttcaccatgttagccaggatggtctcgatctcctgacctcgtgatccacccaccttggcctccctaagggctgagattacaggcatgagccaccgtgcctggccgatcttttttttaaaatttaaaaatttttttttttttttttgagacagggtctcattctgtcatccaggctggagtgcagtggcacgatcatggctcacagcagcttcagcctcctgggctcaagtgatcctcccatctcagtctcccaagtagcctggatcacaggtgtgtgtcactgcatctggctaagtaaaaaaaaaaaaaaaaatttagagatggggtctccctattttgcccagtctgatcttgaactcctgggctcaagcaatcctcctgctttagcctcccaaagtgttgagatgataggcatgagccaccgcaccaggccacctgagtgatcttaaacctggcattagcctctcagcctcagtccgcttatttatgaaatgatggggttggaccaggtgagctctgagggatgtttctccctgcgctgtggttcaaggtctcagccagcagcagggaacaatggagatgagtttccatgtgcaggaagaaagtgttaggggagggtctggtaatggtgatacatgtggatgacaatttggaaagcatatggggagactctcagctcagctagaatcctctcagccctcaatcttgctacgaagtacaggcagatggcacaaagggctgcttcagactggcaggtccccaggtacacaggactccatttccacttttacaagtctttctcaaacaccagggggattctgccaggtactatattctctagagtgaagagctactaagcagagtctacaatttcatttagggaaaaaaggtgagaaaacagacaagacttgatgggaaaaatctctgaggacacctagaggaaacattcatgcccacaggtcttggactgactggccaagtgacaggggcacaagtgtctcctacatagtaggtattcaataaatagtagacaatgaggaaaatgtggatgacaatcttcaggccatcctgtatactaggacagatattttggcaattaataataaaaatacaataagtgctaaaataggtgtgtgttttggctgtttcaaaacttaactgcaaattctttaaaaatcctctcgagaggactatggagagatggagactttggtattcttctcatgagtcgggcaggctcatgactgcttggactaacagcatatgatggaagccaccacataacttttgaggctagatcataaagactgtgcagcgtcctccttggtcatggatacatctggccttggagcctggggcatgcatgtaagaagtttgactccctcaaggctaccatgctagagaggtcaggtgtaggcactctggcgatagtcccagttgagctcagccctcctgccatcattttcaaggcagcagacatgcaagcaaagccatcctggagcccacacacctcttgatctgccagctgaatccaatgcatgacctgtcaatgccatgtggcatgaaaaagttacctgcccaaattcttgtcccacacaattgtgaaaaatgataaaatggttgttgtttttgctactatgctctggagtatttgttgctcagaaatagataactgggatgtctgaatgataggcacacagagaaggagtgtccagccagggggcaaaagaaggctctaggaaagagataacacttgagttatcctcaaagagtgggtaagaattctaaacaaaagagaaaagataagggaactccaggaacagatgatgccatgctcagggaatagtgacttgtctgtgtgactttagtatgagctgtgtgaagtgatggtcagattcaaacattttattaggttggtgcaaaagctattttggtttttgccattatttttacttttaatggcagaaactgaaatagcttttgcacaaaatagcttcatcaaattagcaaagacttgaaaataatacccaggccgggcgcagtggctcacatctgtaatcccagcactttggaagtcctaggcaggcagatgtcttgtgcctaggagtttgagaccagcctgggcaacatagtaaaaccttgtctctactaaaaatacaaaaaaattagctgggcatggtggcacacgtctgtagtcctagctacctgggaggctgaggtgggaggatcacctgagcctgggagttctcctcagaaggtcgagcctgtagtgagttgtgatctcagcactgcaatccagcctgggtgactgagtgtgagaccctgtcttaatttaaataaataaataaataaataaataaataaataaataaataaaaataatactcagtcctagcaaggatgtagtgagttagggactcttacatactgctggtgagaaggtgaactgggagaacttttctagaaaagtttggcagtatgttttaagaaccttaaaaactttgtatttaagacctttgaaccccaaggttccacttttaggaaacttccttgaggaaatagagttatcagacgcttagatctaaaaaaactcatagcagattataataccatgaaagcaaaaacaaagaaacaacatccccacagacagggaaacagtaataaaagctcgtacccctgtgtcacacaagggtgtttttgaagaacccttattaacatgagaaaattttcataataaattaactaaaaagaaaaccaaccagccaaccaaacaagcccaatgcacctgtatctaagactgttggaacagcatagcaaaatccatttatatacacagaaaggaaaactagaaggaatgtatgtcaaattgttaaccatagttatctctaagggagaggattatgaatgctttgagctctcttttctaaacctttctgaatttctgtgtcctataatggacatatataacttttacaatcaaaaaaaggaagtaaatttctctaaaagaagcatgagtgagtcagtccttctttttccttcctaggctgatgcttacattctgacgaccccaattcaccctgtttctattccaatacatgacctgtatttctattcacaaaactcttccaagccctttcatgtccactatctcattagtttctctcaatcaatccaggaagcaggcagggtgaggattgcgtctattttcagaggggaaaaaaagatccacaggaaggtaccaattgaatgcagtctgctttattttcagagatccacagctcattcacacccctgacccactccctacagcatcctgcagaatcagggctggtccaagtgtggacagccatggggatggggagacagaccttacccaggcctgggccaccaagctgttggcatctctcagggccaccagcatccccgaaatgcccaccaggctggggcgaggtttctgaatcacactgtagacccatatttctgacagaggcacaaattgctacttcgtttcacagtgaatctcaacatctgatttccattgacagttaaattaacaaatcaactaaataccgatatgttttatgtcccgtcttatgccagatttattgtgatcccggcatgacacaatgcagaagagtttggatttactggctcaggggtaaactgtagattattcactgcgtccatttcactggctgaaccaggaagcaattcctgggtccatctgtcagaatctctgaactgggaggaggagaagaatgaagcacggacagctgaccagccaggcagtccccagagctgccatgcactctgcagcacgcttcctgggtcttcattccaatcagtgggacagtttcacgcataaatccttacccgatggtcagatgtggtctccatctgctttcctgacctcacttgtcttctttaaagagcagcgactcagaataataaagatctttatttgcatagcactctccgttttttgtagttcaaggtacatgatttcagttaatactgaaaacaactctatgacatggaactgtcacccccatttatagatgagaaaactggctcaaggtcacatgggtggtaagaggtagagaggaactagaaccgtggtctcctggctgccagttcagggcttctcctagaacattctaagagtggggtctctggccctgcctgaggagagagatcctggccattcctctgaaactctgacaccctctttctgcctagaatctggttttccaggtgggctactgggctgatggaggaggtgaaccaactcatttccatgagcacttggaggaacactgcacaggaccactaaatgccgtcctttggtttggatggggtggggtgtgaatggtcaggaagtggcagggctcatactctgagctgctgggagcagtctgccgttgagaccttggtctctttcatagaggacataggggagatttagctccaactttgtgtcatcaagcaaagaatttgggaagtctgtgtcctttcacttctttttaattataaaataactggctgtatggtcccatccactcctaagatgcagggaatacttgggcagtaaaatgaaatgatagagatgtattaggtggggactctccagcctgggaatattgactgctcagtaaataagcagctgccgatctagctctttccatctgaagaaagtgcctttcaggaggcacagataacctttgcaactataactgggatttactctaagaaagtagttctcaaactttagcatgcatcaaagtcatgcttcttaacacccccggagtttccgattcagtagatctaggatagagcttgataatttgcatttttaattatgcaaattacattggtgctggttctgggactacaccttaagaacctctgccatgagggttttgctgcaagggacagctgtaggggtttgctgtgtcttattaaaacctttcccatcaacttgatacaggctgagaactggtcttcaaggacaacagggctgaaggagttgcttcttctcagagacaacatgatctgtgtcaggctgggcaggggtggaatgcatgagttgtaggattctgcccctaccctagtgagcccaagttgctccatctctcctaggctgacttggcatactcgacccagccagattgtcccccagggtggtccatctgggtctgcttatgagaatgaatgaactgtgtctgtaaagtgctcacagctctctggagagggtatcttagcacaattaccataataataaatgctttctgttcatttggtatttgtgcatcctcggggcacccaggggctcagctcattaaggctctacaacttggacaaacaggttggtaggaagcgaggtgagaagctggccttgtatcaatagtgtcattccatgtttaaaaagccaaagcttagaaataccaattcacaaggtcagttgggccatttcagttagctagtgagtagcaggacgagggcaggacactgattgtttataggaaagcaacaaatgctcacagctcgtatggtaagcatcatagtttaagaaacactttgacacatgttatgaaattcaatctttataatagtcctgtgaggtagagatgaagtcagtttggttcttgtgcagatcacatagaaggaatgaggcagaactgaaggcagctcacattctgctatttacagctcccatcgtaaggacggactcctaattcaatgctctattatgttatcagtgttcactgagtactctccattaaagggacccagattcaatcaggacctttcagtggctctgacgacacgctgtctgagtttaactgttggctccatcacctacttgctccgtaagattgggaagtggtttatcctaagactcagtttctcgaatgtacaacggggataataagagtaccttcttcatgtggcctttgtgaagagcaaatgaattactgtccatcaagttcttagtggtgcctaacacagagtaagtcttgatgaatgttggctgcattactagctcagtccccactccagctgaaaggggttgcagggtcgccctctccatcggctcagggaagacagtagagtctgccttattctatgggctcactgggtcctaattactgggaagcagtggtttccctggcctgtgttgcagcctgccactttgttcttgaccctgctctgactggtgttcttgacaataggccacaggctgggttttggcctctgtttgtttgtagcctcatcaggggaaagtcatttcaaactgcttgtttgtgattgctgcctcataggctgagattcgtggggcaacactggcttaatagtccattgctagtcacagtggggaaatcagagtgcattatgctaaggcagttggcatggcggtagggggcaatggctgaagagagacgctcatctagacacaaaacaactccgcttccaggaagcagggatcctctgtacctgggctgttttaaatactctagtgcaaaaatcagggcagcttgctctggccaaaggcctcccctttcattatttccagctctggaggagcaccctgcaggtggtatgaaggatgtgcagagtggacaggtgacagctcataggcaggagctatgtctgtcagctggaagaaggatggagatgtggtttacacaccaaacctaggatgtgccctgctcagggaagagcagcctgcaatgtacagtgcgactgtggggaagactccaaactggatgagtagaaccaggacctgctgggtcctgtcaccatggctacagtgagggctggtcaggagacacctggctgggaagttcagcctgcacaaggcaggaatcactgaaacaggaatgttacccactcaaggtagagggaggcagctcagagcctggagagcaatggataatcagcaagaaccatctctagcaagcagggctgataaactgctgctctcagggtgaaggtttgggcaactggcttagtctttccaagtcttactttatgtatgtgtaaaatgggcataaataatcccggtcctgtctatcctacagggtttctgggattagaactatcctgatacataactccagagcattctatgtgaggtctatcgggactggttgaagggataagatggaagccacaaagaaaatcttgtgaatgtgaaggaattgggccattgtaagtgactgtattattttattctgcatgctgcatgagaatagccttgggccaccagacatttgttgtggccagtgaaaggctagtggccccttggtgatccctatggccattggatctggagaggggactggcagatgtggagatcctgggaagatccttccattgacctgagcacctgagtcagcctgccccacctctgtgggacagagacagctgccactggctctggtcttgctcagtttctgttggctctcaggggccttctaggcttctcagtggtgctgtgcttctgaaccagaacctcctgagtacctgctgtagagtaaactcagtaatgacagagtcccaagaaaccagcagcgaccatttacggagcacctgctcacaggcagtcactgagcaagtcccactggacccactgtttgtcattttatcctcctaccaaccctgtgagtaggtattatcatctttgtttaacagataaagacactcaggcccagagaggttaagcaacttgtccaaggttgcagagccaaatttgaactatagcttgcctgcacctgagtctaaggaatttctgctacatgtgtatctcccaaactgttttctgcaaaaacactggttctgggaactgtttttggtgcttcatgaaaagattattttgtgggaataagtttgggaaggctgcatattctattttactcttggagattcatattgtacattagcaaattaaaggctctgagaaaccctggactggagaaatttgggcaacatttaaaaacccaacattcattgctcctatttgaacatgggacacgttttcaccacaacagtgttgggaaacactgagttatattgtggcttctattttgaattaacatatagagttattaaagatagatgaaaaatacttctgttcttttgggatcttatatttttgtgggggtgaagacatatctgaaactgaggagagatgtatggaagcttagagagaggactggctcattctccctgaaggcttcacaaagcagtgaagcctttgtgcttcacttgggctgggccatgacaggtcagcagggatcacccgataatgacacaggggaggcatcccagacaaaagcgttaactgcatgctcactcctcctcccttcattgtccagggaccagtcctctgctcagagttcctgcatcctgggggccacttctgaaccagaccatgcccactccagccaccacagatcgagccacgggcaaccaattactagactggccacacctgtgacttgtgtggttccgccttaagagatagactggagcaatcagattctcagtttgagaaatctgatcaaacacatggaaagacttgctgatttatggtgatgattgcagctgcaaagtcttgaggtaaggctggagaggctaatgtgggccaggtataattcagttaactccatgggaggctggtggtagggtgggagaggcagacccagactcctaagcagagtaccctagttggaagaagaagcaccagagagagaagtggcacttaactggggctgagacaggtgaagagcagaatgctggctttaagatcccaggactctcctgtttgggggtccctgcagctctaggtatgcagaaccttctcagctctggccacagtgaaaccaatcctatcatcagccctagccctggcagccactctctcttcttccagctgccccgtcataaggagtaggagatgatgaccatcttggaggagggagatgctgtatcctggagaggccactggggtaggaatcggccatctgtgctccgcttcaagttgtgctaccgattagtcacatcacttcacatctgtgctgcaccctcaccctcactgctaaactggtgacaataaagattgtggggaagagcacatgagatgtatatgtgaaagccctttgtaaactgtcaggagtggcatagatttattactgttactggttgtggaaatgtatgtagagaggacaggcagaaatgcctttaaaatctgtgtggggcctgtaatacttgccggagccaagcaggctggtctccagctgctagggccacgtggtcacgaaagaagtgccctgtgtaggccacggcttgaggccctccccaaccttgctctcctacatcacgcccagaatgttccatgcctgccttgtggctgtggtgagtatgctaaagcaaagatacagaggacagaatctcaggctcagaggtcttttagacaggcaacatccaattatctgggaaaagagaggtccagagagggttatgtgatattgtgacgttgaccgatcaatcagtggtcagtgagcaggcacttccagatccatctgcagaggaattgtcccaagacacctaggctgtagtggtagagaggcaggagaggccacaagatagaggctgtggggtagtgaggaataagagggtttgtgggaagtgggcagagtccagaaagggttgagggatgggagtgaaactgcctttgcaaaaatcataactgataaaattatgacagtgaaagagatctgacctgattccattttgcttctaacctacaagctgtcattgttcattcctgggtgcaggagaaactaacttcgggaagaactcagtttgtagtttaactttgaaacaaagacagtaacagccctttcccaaaacaaacctccttcttgcctggggaccagactgcctttgtaggactaacagactagctacaagattagaaattattgtttaggagtcatgcagctggaggctgcaagattctgaacctcctcaaattgctcctggggacaacatcactattgtaaaacctaaaatcaatgcttgagatatttgcagaccctctactcaatggatcatctggcaccacccagatcagtaaactggcccatctgttcttgtggccccatgtcctccatcaggccctgcctgtgcttagaagagcttcaggtctggctgtgtgctactccaggggaagataatgagcttgatgcattattccttcctatcaatcaatcaccaatttttttcactttttgtgtatttacattttgcaattactccaattttcagggaagagagcaaaaaaatgacatgattaaacagaagactcatctctggaattttccaacctgagaacacagagcttttattgctttgccgagtctgggtctggctccatgcacagcaaacctccatctctagagagcagagggcagggaatttacaaggtggtgttggagctaaagcctgctcctgtctgtacaccagggagaggtgttttgttcattacacacttgtgttgaactgtaaatgacccaaaggcagtgtgttgaggtttcaatattttctagtggagaaggtcatgatgaagtgaggatctaaaaaaaaaaaaagcatttattgaaggcttcctattaggttgaaccagatgaaactggtgacattgtactgttctgggcacataaaagtggcagtttcacatgattcaacctaatgcattcagactctgctgaattcttcatggacatcccataaggaaaaccttggtactttgttttgcctgattaggatgttgagactcaaaggtaggaagataaatggacatagctgacacttttaacaaaggacagcctttggtccttaagcacaagagagcctgaggctggggcatttctgtcacttggcagctcaaacacctgagaccagcctttcactgacttttatagcttttgtatgaccttcagtgtagtctcatgtgctggccataaggtctttcagaatttcatttctttgtctttaaggggctaagaaaagactgtagaagtgtctgaggagcacaggatgttccagagaggccaactgtggctgtttcctgtcctgactcctcacagagtcttccctgtcttaggtggccctgtggtctctgcgctgcgtgactccttcctggctgtgatagaagggaagcgctttcacaagctggccaacaacctaagatgcatgtggccttgctcaaaagccagatctgggcccatcagattcctttcttcagaattcaagactgggatagtgctgggtgtctgtgagggttgagctgaatgatcctggggtggatctggggccaaggcagcccttctgggccatgctcatcagagaaggcaggagagcagagcagcacccaatgggagccatggcatcgtgcaccggagaccatccttcttcatccttcttctcaatgtcccagttttagagagagagagagagagagagagagaagctaaaacccagaggctttggcatgatacctaagagatgctctcacctcttttgaggagcaagatgaagagctgctttcctggcacatgtagctttctggttccagtcccaggccatgactactcttaccacatgcccacttttctttttctttttttttttttttttgagatggagtctcgctctgtcacccaggctggagtgcagtggcacgaccttggctcactgcaagctccacctcccaggttcacaccattctcctgcctcagcctcccaagtagctaggactacaggtgcctgccaccgcgcctggctaattttttgtatttttagtagagacggggtttcactgtgttagccaggatggtctcagtctcctgacctcgtgatccacctgtctcggcctcccaaagtgctgggattataggcgtgagccactacgcccggccagcccacttttctttgtgacaagaatggatacctgataccttccctagcaactgattggtttccaaggtgtttggccgactcatgagcatttagctacttcacagttgagtagagattaacctcttccatttgtgtggtgcattcacagatgagatgtcttttgattctacaacacccctgtgaagaaggcatggtgggcatcctgattctcctattttcagctgggaaaacaaagtcatgcagcactgggcctaaaacccaggtccccacattcccactccagtgctgtttttatgtaatttctctggttctcaggtcactttctacgagggtaattcctgagtttctaagcccaagactttcagtccatcctggcctatgctccctgctaacacacacaccacatacacacccaccacacacagacacacacacacacacaccacttgtccttgaaggtctctgcaatgcatgtccttatgccactatcccatccctcggctgaggcgtgttgcccaatgggccctagcagtaactgaatggctgcactggaagggaaagacttttagctacaggaagcagttctgctgattcgatctcatctaattaaaagtcactgaactgtcagaagtgctgccttttaggtcaggcattaaaacctaacaccctgaactctccaaactcttttctgcttgctccacactctgtccatttcctcacatctgccaaacattggtggggagcttaactccaatgtttaggctaccctgagttaggatatacaaagccagagctgacaaggacacctaagactctctggcttccacctaggctcccagagtagcacgctggagccaattgtgtgcatctcttcccaattccacatctggagacctcacagtggtatcttataatcagccatcatgggaatatttacactacagaaattggcaaatggtaaaatcaaggctccctcctgaagaggcacttgttagacacctgcccaaggcccctcgaggtccaaggagcctgcatgggagcatgggtggaatctgaaggcccctctgtcctgatgcagcctgggcccttctgattgtgtctgttccgcagagcaataatagctgacgtttcctgaggactatatatgtgccaggttgtatgctgacattttgcaagtattaactcattttatctccttaaaatcctaagagtaaatagtattattaacttcttttttgcagatgaggaaaatgaggctcagagaggttacataacttactctatagcttacacggctagtgagggtggtacctggatttgaattcaggcagtctgactcttaacccacattcttaacctctatgctatactccttctccacatcagatttaatttggaaaaaaaaaagtcccagggaagaaactgttagaaaattaagtaatattctcactacagtacaatggaatgccctgagtgtacccttctccgcactttgctgcctctggttctagattttagtaaaagctgcttagtcagagttggcccaattaataaataagtatctttcagaaacctcaaacttgttccactcctgcctgattttgggatgggagactgagcagacccactggggtggtggaatcactcaatcacactgaaaatgacatccaaataaataaagaaaatcaagcgtgccatctgggccctgcacacagcagggctcttgtgcagctgcagggtgctgtttattctgagctgtcttggacagagaaggagacacctgagttcagccagggttaaagaattctccaggttcctgggcatgagctaaaccctcagtaaatgaagcttccccatccagcccatgactgctccacatcttcagagacccccaagtcccaccctctggggcttcagccacaacaaactactcacaggtagtttgtgagtaaaccacaggctttttcccatccaactgagtgcgaagattcaaccaggccatggtactcacttctgctcttacatatcagctataacgaacgcctctgagttttaggttctctgtctccaaaattgggatgagctaccacatgggttatagtgaggaatacgagctaacccatttaaatgctgaatgcaaagcttggtccttcactaggactaaatatgagtcagcaatgattagtggtgacaatgcagacactagttagttctttgccctcatctcctcctcatgaccactatcactgtcctggcatctggaataccctgcacatctcactgtcccaattttctcccccgctggcagggctcagctcacgctgatctttgaagacatctgtgactcttccagggagaagtgggctctttattccttgacacagcacatcataccaccgcttctagcttctagaaaggccagttatattattcctgaaatctcagcagtcatggcaaactttcacggcagatgcctttgttatttagggtcaaaccacagccagagttaattctcattctgtcctcctggtcatagtgggggtgctgtggcaaacctgaggccccatctcccccacctgtctgtccattggaatattcctggtctcccatgtcaaatgccaagctccaggtgggatttgacctagcatctctttcatgtcaatgctccccctgcagaatctgcaggctgaccttgcaggaggtaggggccctgaactaagctatgatcttcctggaggggtaggaggaaaggattattcccttgcatatggtagatgaggttgtatctcaaaaactatactctcgatttcagagatgcttaataatatctcactggcttggccctttcctgggtcaaaagtaaaatctccctgtgtactaatcactttgataaacataatgtgcaatatcccatttggtccactattttacagattaacaagaggctaagagaagaagcaaaagacttgaccaagttttcacagatggtaaacagcagaaaggagactcgagcccagaacgtcagcttgcagaaccagagtccataaccaatatggtactgagtttgtcaggagtacctataaagttgctttgtgtgtcatgaacatttcatgcaagaaaatctgcaaatgtattaaaacaataactgaaccaagacaggccttccactctttggaaaaggcaatgctgtcctcttaagatattttaccttctttatttagaaatttaaatctctgaatgatgactgaaaaaggtgatcaaattgtgtaatttttaataaatgttctggccttagctgaaaagtaaagatggagaaaacatcaggtagaagtaaatatggagaaaatctcacataaatatttaagcctcacacagagtgttagtgattgggcctatggttcagtctaaggctctccatcttgtttgtctccaaataagaacaaaagtttcccagcatgtggcccccaggaagcagactgattgacagcaagttctcccaagtgctgtagaggaggcttgtcaatcttaagtttgctccagtgtcagggaatttgattgtttgccagttctacttggacatggatttactctgcctgcaaatgcccacctttctgtacagcatctcatctgcacctccagaaaataaactgtggtctcagtgaggggcaggcactgatatattttctcccatttggaatcacatgctcacttctctgcttccacagcttcccccatgagggtacttaatttccttataatgagttgtcatagatccttcctccttactaccttaccagctctgtgaggaccaacaattccctattatatacgttcgtaaatgattaataaatgtttggggagtaataaatggttcagcacaggatttttccactaagagttgtacaattaagaatattctaggtatatctagagatcagctgtacaacattatgcctatagttaaaaataccgtgttgtgcattacaacaattgttaagaaggtagatctcatgtgaagtgttcttgctatggtaattaaaaaaaaaaactaaaaaagagaatcttctaggtatatctaaaaggatgacccaaaccagaatgtaaaggagcctttagaaaaactaacactgcagcatccacacacaaaccagctgggactagtgtcattcctggatggagtcaaggtttgcattgcggccaatgcccctcccttgaagagggtattattcagggtggcccaggtctcctccatacttctgggtccacacctccacccactttaagttccatcaaatctgtgtgatttggcttccagattgtctcccacacagaggagggttcctggcagggttggtgtccaggacttctcagtgaggacttgagtccattagctcagaaatcctgttccttcttcactgggtgctttcttaagactgggccaagtcatggtatttcattaggataataaaaaaggagaaagtcaggcttagaatttgaaaatctctcacataataaaagctgactggtaatttatggctgttccacttgaaggtgactttgggatcaatagacactctagctggacttccagagattcgattcataaaggctcccaaagcctttgaatgggctgcttcagccactcatctcccagaaggcggccagcaccatgcagcttgttcccgggctggcagtcttgttagctgggtggtggtctgctgcctgcttccctcctgtctctgtcttgaagataattccacctaacacagttaagcagcacggccctttggtggtgcctaagactttttgggctttgtccagatgcttcctcatcactgagaagaagaagacctgacctgcattccaatttccttctcacatccagaccatgacgtttccacagtctgaaagctgttcctctctccaggggtactcagtagaagtgggcaggcctcagtttccctctcataatggctatctagaacctttttctaagaatgtgggtctcagggatctctcttcttctcaggcagagcctgaggtgtgcactaaaataaatcaatggctctgagaatgtctcttctctgggaccacagaacccactttggtttccttcttcctaagggccaagattgcaagccatgattcatggcttttctggcacagttggccttcccagtcctggcccttccctctctgggaagagtcttcacagccatgagtgaggcttctgggtcccaggtcttatttagtctgagtggactccatttcctttctttttggataatgcactgctgtcctgcccttggtcagctaatcctctcctgtccctggtctagcctctgtgtagccttctgacctctggagacaggaagtgcagagatagcacattgcccagagctcctgacacaaggctcgtcctgcccacgatggattctttcctctgaagccatgtgtttgtcaatgacttcatgttgagatttgatttattgggcatctttcccgtgtacagctctgtggtaggtgttaggtgatgtgagaatacagaaatgattcatggactcttatcctcaaagagttgcagtcttagggcagatatgacaggagcacaaataactaggaattgtggtgaagcataagggccataatggtggtaaaaaataaaagcccacagacatttagaagagaagttatttctaggttgatgagatgaattaattatacttaatttatgtgctttctagttggtatttatctatgaggtttgtgcaaagatgagtggtcagaagcttacttgttctgggttctcctaagaatggggtatttctctaaatcttcactttggattggaccctcccaccacccctggtcatgggcctgaaaccacataaactgctagggctcagctagatgcagagatgcagagatgcagagaagcatgggcatatttgagggaggccccgaggccatgctgtcagaagtccagcagcaaagtccccctggatcttcctttttggggcgtctctctcaggaagctgatgaatccacgagcagatcgccgacgcagtctcaaatcaatacccctgactggcaagacaggtccctgtgctattaggagtggtgacagctttcagatggggcataaaccaattgttaaagaccgtccacattattcaccagggtgggagaattcattttagtatccgggaaaaacagccgtttgggtaattacattctgtttcccctcgtctctgctaatgcattagcaggagataatattccacattccaagtccagaaccatcccacagagctgctattaaacagctgtcaccttcctccccataactggatgcatttctcagcaggaagaatgactccctgtatgctggctgcatcaatcctggcgcgtaggaaatgcatttgctggagctacaggcaatgcgttatagtgggaaaacactgggccagcagtggagaagctgagctgtggttctgactcagctgtgacttgctatgtaaccttgggtaagtcacttaatctctctggtgctagggcttcccaagttgtaaggctgggacaggcgatccctgtggggtctgcaatttggggtcaccatgtagggtctttttcagtggggcacaggctctcccaggacttctgctttgggctggaaaccctcaaaactggttggccacgtgatccttgtatattgtggcctatatctacaaccgctatctggttggaggtcctggttctttgtttattgactgaaggcttaacttggtttatgccccatttgaaagctgtcaccattccttcgactgtctttgaaacaaataatctttagcccatcctttttcatcacttcattgttcctcatgagccatagcagacctctgaccctgccccaagtaatgggaaattagggagagaaggatggagaaaggacacaaaggcttagggggtcagacaagaagtggaaaaagggaaggacctggaggagaaacagagaaaggaagacaaaggatggaaagtgaaagggagggctccggaatggattgatgggtggtgggcaggaagaatcgaagagaacagggggaaagaaggagttactggatggaacaaaaaaggagccaaatacaggagaaggacgggaggtaatgggaagaagttctggaagttggagaaattcatttccttccttctctttttccttccttccttctttctttcctgccaacaaacactagcaactcacaatctggcacatagtattcagcttcaatattctaggtgctaaagaggcaaacatgaagaaaacatggttcttgcatacaaggagctgacagtatattagaaggaggcagagggttaaatgtgtgacaaggtgtggaaagaccctcctaagaggggtgtgtccacagttacgggaatctatcagtgctcctggggagagggaaggagagtttggagaggtgtcatggagctggatggatcccaggagatgagtagaatgtctgtgctcttctgttctgcactcactctgtggctttgttgtattatcatccttcacacagtcactgcatcctcccccatttccacagcactgcgtctcattcacctcactatattgtagtcccttctttatctgtcttatccactgtactgagctctttaaggccagaaaacttggtttaattgccttcatatttatattgcccggcacctagtttgatgccagcaaatagcaggtacaatccccactcccaaacaaacaaatgaacaaacaaacaaacagaaaaaacattgaatgaaatgcaaggcatatataatttctcttccattggttcccatttacatgggttgctacaacagtaactccccatctagtatttccatcacatcaccaccattgtgtgtggaaggaaggggaagatgtttctgggaatgttttcatcaacatccatgacttgcctggctgcttttccctttccattttccttcccttccctttgtacttgcctcttcctctctccaggagtcctcagtaaaagtgggcaagccccagtttctctctcataatggctatctagaacctttttctaagaatgtgggtttcagggatctcttctcttctcaggcagagcctggggtatgcactaacataaatcaatggctctgggaatgtctcttctctggaaccacagaacccactttggcttccttcttcctaggggccttcaccgatgacagctgggctgtttcttggataacagcatatctagggaactggaggcatagccttctccatggagtggcgcctttctgagctcacagccctcagccccagagaggtctgtctcctgacttgaaagtgtaggtagaaatcacctggcctcatctctcacaccctcatgagagctctgcttctactgagacatgtcttctagctgggtgagcttgctggagtaccaccacttctggatctgtaggccaggactgtatggctacctagactgtagttgtcttggcatgtatacaggtgattcagtctatcttcctgggggaatagtaccttttaatctttgtacacaagcccaggggcctcagtgatggacacattttaaaaatccaagtaagtaactctttaattcatcattctcacctctgaaagcaagattcttggaaagctgatacaatttgagtcaacaattcagactcagccatctcttcagaaaagttattaaaaacacatcgaggaacccagatttcattctgtttgagagcattgagagaatatataataatactatagctggaaactgaagtaacatgggcatgaggtggcatccccttttctaggagacttctttcttcctcccatttgggagtgagatcacaaaacccttcaatgctctcaccaaactaaatctaagtccttaaagtgtcacccaacctcacagttccttattattatgggctataaacacagattcaaaatggggaaaatctgaatattactgtactaatattctacattgaattagaatccttcatggttagagattaacgaaagggaggctattcagatacatgtgtctaagacagccacccaagttctacggcagatacctggtgttttcagacccagaaaataaatgcccagcttgggtcatgataacacctggaatggctgagaggctttggttgctgttgtttctctgtcccctcctggaaggggaaatggagtatggtgagttgctatggtgacttctctgcatcatgggtcggaggtggagctggggaaggaccagctaaccaagtcagctcaccatggacttcatgtcactgcttagaaaggccagaagaccctggcacacttgcagcagaagggaatggggttctgatagaaatcctgccagttccttctgaaggacacaccatccttgagcatggagccaactatccttccttacatacatcctggatttcactatcaagaaaactgaagcccagtgtagggtccttgctaagcgtttcttagaaaaatggccaaagaagagtcagggctccagacagtggtcaggaggcttcccaaggctgggtgaggccatccttgtagagaccaaatgtggaacagggaacaggcgtgggtgacggagcaatccttacatttcatttagtcttattaattaattcatccattcatcatccaacactgagcccatctttatgatgcacatattattttgagcattgtaccatcatgtgagttagcaggacccattttggtgaatgaaggctgagaagaggaagaggaggaaatagagaacttgatgggaaagaaggaagagaattagcttgttttgaacatttcttgtgccagtgtgttacataggttgtctcactgagtctaaacccatccctataaggttggcattataatgattcctattttgcaatgagaaataccaatgctcagagaggttgagttcggtggatgctgtttgtggctccaaaatttttttcaccgaggtgtgctgtcctcagggaatttaccatctagattagcaggaacacattctcatgtgtgttggctgaagcaagagttgctagactctgcccaaaacatagacttttacttaaaataaaattgttttacatgagaagtcatgagcagcaggtaatttaaggccagttagtgccaaatgtgcagtttaaacataggaagcactcacagatgcctcagggagatgaaatgagatttgtgatggtgcttgatgaacagatgggattagggcagggtgatggccatctctggcccattcagaggacaggttatggatctggttgagcccagttgttggacttagaggctgggcaggcaggttggggccagagaaagagggtccagctccaaggtctccaaactttattctacagatgatggggaccttgtgcaggaaaaagacacaagtggtgctttccaaaaatgaatcagaacacactctgcatcctgtcttcagtcatcatcttttgccaggagataatttggtgtaaaactaaaggatttacctagagttctacaagctctgaatctgactcaggactacaatcgataccaaaaagggttgggtatttaatggaacatcagaattttaaaatattttgagttctttatctcccatcataactgtcatggaaattttctccataaagacctttataaaagggcactgatacctctctctggtgattattttagctagagacagctggacaactagagtctggggatgtggcactacaatgagctcattattatgacaattacgactcaaaatatggtgatgctttgcaacatcgcctgaggtttctttttcctgagctttgcagacccaatccttcatttccctccatttagagagccgctagtgctttttctgcacactactttgggttggggagggcagatacacttgaaaatacagatttttagcagtaagatatggactatttgagagtgaaattacatccttgagtctaaaaagctaaactttgaatatctggaaccaagaattgataggccccaaaacctagatttgtagtcaaaagtcacagagtgaggcagaatgtgcagtgatgtggaacagaccctgtgggctgggagcagagagaaatagacaaggagagcatgagaggggccctgcaggagcaacaaggtgggtgcattccctacctgagactttaccagaaaggttgagggagcttgggaaccagatgacctgtgtgccccaagttagcactggaccgctttggtagtcaggggagttgaggagggcagtggggagcccttggcagatagggcctgggaacccagagaagcataggagagctttgagggtctcagtgtcgccctgagaggggcccagaggtggtcgagagggtgtgggcagacctggaggtcctgtggatggagacagagtgatctgtgtggacctaatgacctgccagcaaggactccttcagtcacactcaggctgggcccatgaccagagaccaacatggagtgagtctcagtggagaagggagtagatggctcttccaatactaggatgatacagaagccttcccatgtttacttacacttcagaggaatgatatggagaatgagagaagaacaattctgaattatctgattatctatccaaaagggaggaaaaaattgccaagtgtcagagtttactctaaattagttagattaagctgtttgccattgacggaaatgggttttccaaagagctaagtttaatttttaatttttgcatatagaatgtaagatttatattctctatatgctcctgaaggtcctttccaattggtcagttctttcatattccagctggtctggcttttcttcctcccgtcattactctcttttcaaacacgccgcttccctgggctgagcttgggccgtcctctttttgaaaatacaagccgagatataaggttctagtgtgcctattatccatttaataatttatctggatgccatgtgttccatttatttcagtgtgtgcatccagtatgtgccaggctctgtgctggagggtgactgagcaaccagtgtgtgccaggctctgtgctggagggtaaggattcgggacaaaggttccagtgtattgagaaacataaacacagagactttaaagtcattttctaatattttcaagattaagaagggcagggagcagtcaaagaaacaacagaataggaggttaaaaactcatgacttggccacttggtagctgtagaaccataatgtctttgggattcaatctgctaatctgtaaaatgagggaggaaggaagacaaagaaatcctttagatcctttccagatgttaaattatatgactcttgtgagtttcaacagtacaaaattgtatagtcaactgaaaccccagggggcaagagaggtgacaggatatagcaaattcttctgttccattgtaagatcctcagagcagtggcaaggttacaccttaagcaactcatgctggggtgcgtacataattgatcagctccctgagtagtgctggcagtgctcgggacctagggaaggagtttctagatgttgtgtattgaagggcccattcttgcaatttattattattgttattattgtcattgctgttattatattggcaggggagaatctagaatctaagcttatgctacttggcttatttgtctttgcctataattacaaagttgaatgcctatgtaaagtgattaaatgaatctctgaaatcatctgaaatattaatatatttgccttatttacattttctagctactgatctcaatttcctactcagctttgtgtttatagtttcccgtgccgcaccattttgactcactttttcattcactctttcaacattttacaaaaattcatggagcctccattttgtcccaggctttgagccaaacaccagggatgtggagataaaggggatggcttagtgtttagcaggagggaaaaataacagacgctaaagtcaaataggctgtggcacatggatgacccacctgggtaatgggaagccttgcttgagcttgccagagctttgcagacagaacactgggctgctcctcatatcatatggaatgagattgcctgtgtgccagaaccaagggctgggatggtggtacagtgggaggaattctacaccccacaaaataacttgtcaaatggtggctgtgtgacttcctttccaatttttttcatctctgaaaagcaacactcagtgatgagagacagtggcccctcatacgtcagcggaatttctggtgatgttgcaacaggtaatataataacatgagtatgcaaataaaattttcaaaaatccaaagaatttgaattctctagtaaagtctcctgccttggttctagaagtagggcttcttgttgcaaaatcaaattaccaggtggtggggaaatggacagaccagtttatatgtctgatagggaatataccaggtagggaaatttcactttccttaatacaagctcagaacttccaggttgggcacaaaaggagaacttcatagagtgggaagtggtaagacctcatagcctttttctccctttctctctcttttcttccctgtcttcctcctcctttttctgagacttggcatttgtttggagtatcccatggatcactactgccatcatccatctgttctcaggggtgatatttaaaccctttaaaaccctggcaaaagcctagtcaaaactctgggagtacaaccaagataagctggaacgttcaatatgattttactgaagactaggaaaagacaagggcaaaacaaataaacaaacatacatcaaaaaaccgccagcactcgccatgaatttaaggctctgtgctttgctgaccccagaagagaaaagactcttctcaagaccctgctttccagtgtcttcccatgcagagactgcaatcttagctccaatgtaacttcttgacactcacaggaaaatgctggaccttcttatctacctagagccttgcttttgccatgtgactggcactagggaagacctcagccttggataagacctcaatctctaattaaagacctcagccttgcccctgaggtcctctttaggatcaccacattcaaatgcctccttgctggttgtgtgtgtgtgcacacgtgcatatttgtgtgtgtgtgtgtgtgtgtgtgtgttggtctcctaatgagaaaatgacaggcacttgaaggaaaaggaggagaaatagcagaaggggaaagggaagagagatcatcagaggatctttgcttagagtaaggatgaaaagagaagaatattccatctgtgtatgccctggagctgggctccagtgtagccgatccaaccatttcagccaccttgtccatggatatacagcctcaggcctgtgcctggagcaagagcacagcaggcttcactgatgacggagctggacacatggatcagacaggcaattccacggcccaggtttcttcccttcacaaaaggaaaggaagaaagtcgagaagtgagaatgaattaatagacaagcaaaaagacaaagatatccggagtgtggagaggcacacagaagaggctgaggctggggagatgcaggggaaggctgtccatgagctgccaaacagttgagatggaaaatgatctgtctgcatttatttatttatgatcacacggaataaataaatgatatggttctgagtcgagcacctgcttttgcattacatacagccacagataaggaacaggaagaatagaatggagaaaaaggccacatcagtggaagaatggcaggggatggacaagaagacagccctcgtgcattagttgacacacgtgcacagtggatctcttggggagagagagtgtgcagggagcgagcatgagtttgtgtccgtgcactaacaagaaagaaagacatcgatcctgtgatggtaagacaaggaggaaaacagagaccacttcttcctgtcactttctgctttctcttctaattcaaatcatgtagttcaagaaattttgcaccccaccttcatacactcataagcccaagtcctcaggacagaggctttgagctattcacttgttctcctggatctctgggtagtggtgtgcagagggcttgttccctgtctagtcctccccgagacaaactggccccctctaagggagagttctgtggttggtcccagccatggcagcttattcacacacgtgtggtgtgtttctgaatcataaatcttacagacagcctaggatgggaagaaaacaggctgccttcctgaccttacacttgggctgcccgtccctgtagcaaggaggagataatcagggcccttgtccagagccaatgtttccattatatttaaatttcacaaacgattgaaaggatcagctcataaaagcaaaagagagttgaggcattcaacctctctgggccttttaagaccacagacttattatgaccatgtgagtttccaggaagaagcttctaattaaagcttattgcctcttagctaccattggctggccatgtggctggcccttcctgttaattagagcagaaaggcatcctagtggggttgtagcctcacagagcccgtgcccaccttctggcccacttcccctgtgagctcaggaggatccagggctgccatgttggcccatcatcccctagacgtgagacttgggatccagacaggatattgcacctgtcttgaaggaaatgttcttgaaggaaatgataagactctgagctaccagtgatataaatgattaatggggggaattagttaatgtttgttaatcgttttgtagatacgaaatgctggctaagagctaaaggaagaagcagaagcagcaaaagctgaaagactttatatccacccaaatgctgatcatagaactccataatgttggagctgagggaaggagggatctccgagaccatttgctctatggtttgcaaattgtgcattgaggggccttctgggccgctgcccagcaactgtctgccaatgtttcctccccaaacaaatctcaaccagaagggcaaaataaagttccacaaaaaccgtgctctcagcataacttgaagacagaaaatgccagaactttaaaataaccagaataaaaagagaaccatcatcaaatcccagcagtacactttctggtactcctaggctatgcccctcggctagcaaaaggctccctcactccctgcacaaagcccttcactctggaagacttcagcgtgagcttcccacagatcctggtgtgaggagctctgtccaggggtctgggtagggaggaagtaaaatgtctccaggatcttcagctaaaggttcagtccttgcttacctctccccacctcacccttccccaccctaccccaccaaacaaacaaaacaaatcaacagatcaattctgtccttggggacatttatgatactttaggccaatcacaggagacttttatatctaatgtttggtgggtttggttctgacttggtacgtcagtttagaaactgagcacttctctgcctgatttgggagattggaccccctgctagtctctggtgtcacctcaggatcctgcccactgttgcacctgccaatggcttgcactgagaagacacactactccctggctctcctctccagctggtgatcccaggcctggctgcacctcctcctcatgttcctctgtccaccctggagtgatgccttactattgtcccctctgatgtgtcccaaatggcaaagaagagtaaagccaccactcagagtgtgggtaatcactatgagcagggaaggtcttcgatgctttatcttaacatttgcgtgcagtttgcattggaactcaatacatagccatgctagtttaaattaaaaaatattcctccactccaatcttttggtaaaactgaagctcttgaaagatgagccacactgattctttgggtttgcatgctttgggagcattgctacacatcctgcaggtgcaaacatctaagtgtgagtgctggccccactttaccccaacccacctgttggtacctctcaacctgtccatagccaaatgcctttagcctcctgtatggagaggctctggaagtactacagtgagctgaatctcagacctacagggtaaggtgctgagagctgagtcatctagtccttcttccaggggatgccatttcacttcaccgatcctgagttgtactagttcactgttggtccagtttttcttgatgactcataccaattgtttgtatcaattgttagttaatgaagagccgccaaggccactgggccaacaataccatgatctgcaatttggacacagggaatggtagagctaacccagtttgattttccactaggttccaggcactgtgtcaggtgaggcacacagtatcccatttaatcctcacatggacccagggataggtgtcactgtcttcatttcgcacgtgaattatctggtaccacaggatgtaatggacatgtagcacccaaatgactcaggattcaagtccacgtttttcttctccaagtcctatatcttctttccactgtccatgatgctgtatcccttgcttttctttctgttgcatctttttggccatttcactccttatgacctctaatgttggagaataaaacagagatagaggtgaggttggaaagtttgaatcctgctgtcagttgtttcaggaagacggagatggtgtgggacaggtggtgaactggaaccaatgtctaaagtgacatttctctgatcacatctggaattaatttatctgggtccaccctgtttgcttcacagccacattttttttaaggaacgattccagagagctcttagcgacctaaagagaaaacatcttcccaagccccttccccatcaccagctggagcatccgtctcattaataactggagcctaatccttcacattcaaagggagtcccattacccaaaacaataatatttttaattacccaggcagagtggcaattgcacattgaatactaaggatgatgtaaaactaataaatacttttggaaattcattgaacattttaatgaattaaaagttatgaaatatttataagcggtaacaacaccatttattaccattaataaaataaatacattagttagagaatgaaattcattactattttactaccagacattgatgtcaatgactgagtattgctccaaattacttgtaaaatagaccaattattttagtgtgattaatcttttcaattatttcctttatgtagttgtaatttgaaagtaattttcttctgggagtacaatgacctcggcacactcattctttatttatttatatttaaaaacctttgtgtctgcccccatttctgggcaagttccaatgatcgaatatttaaaatagttgcccaagcaggcattgtttctaagcacttcatggggcattttaaaattggctttattaataattatggataagccattccaaagtaagaacttctttgccaacagtagctaggcactggtagagaaaggaaagaccagcgaatttccttcctggttccacctgctttggcctgactgttttggattccagtcttcctcaagggaggcagtgtgacaggcatttgaaaagacctctctcctgcctccaactacctctacagaattaagcaggattactcctttgtgtggcacaaaggactctgtgcacccagtgaccaaggtaaaaaaatgactttatcaggcataagagcataggtcttaggaggcaagagaagcagctgcctttgcaatcagaaagcaagtctgggctgtcagaatctctgctggaaaagaggtaaattttccctttgcataatggctcaggcaaggcgcagatggaaaggcaaaaggcagatgtgaacctgtaaacataccccaggatagttgtgcagaattattcagctctggttccagaattaggagattcagcttagtcaagggatgccagagagaggatgagaatacgtattgtgccaagcattgtgctaggagctctgcacgcaacatctgttttaatttcccaaaaaacctataattatgtatttcctgatgagaaaatgaaaactcatagatttaggaaacttttccaagctcaaaaaggtggtgagcgatggagctggcatccaaatacattcagtctgattctaaagcctctaatctctctcctacattggaataagcaaacctttattgagtgcttgccatgaaaaaaaaaaaagcacttcactgctaattgagatacagagattttaaaaaaagacagtctttgattttaggaacttagcatctattgagtgagacacataaataactggagagaagtagacggttctaaaatagatatacatggaaacaattctgagtggagacttagagaaaatactatttaagctgggatttgaaagatgtgcaggtctttgaaaggtggagggtgcgctgcagggggcgcagatggaaccaaagcttgagctggggagggacatttgagaaatgcaagcagatctcagtggctgatgaaatcataattttcatgcttatcttttaaatggttcagtccacggtaagttaagggcaggagattttggaaatagggagtttagaaggagagcgtttttaaaatggagttgaacatccacctggagataggcactagaactaagtgaggatactaaggtcgtgactgcgatttctccttggtgatcacttccaagcaatagagctcaccattgcacggctgattgagtgccctgaagtgactgctccaggtggtggcacctccccaggttggcagtgtgtggctctcatcaccctcttggcattaggtcaataattaacatcacaaagctctgcaggaggcctcagaggagccagtttgtttctgtgaatggtaatttcttcatgagaaacagcagcagcaaggaagcaggttagttctcaaaagcttcaggcgaggtgaggcccagagaggttaagtagctcatggcatcatttacaaggcacctccacagccaccttctcactgaccctcagcatgaggtcaattttgagacaactactgacatgttgttatccctattttattttatttttatttttatttatttatttttttgagacggagtctcgctgtctcccaggctggagtgcagtggcaccacctcggctcactgcaagctctgcctcccaggttcatgccattctcctgcctcagccccccaagtagctgggactacaggcgcccaccaccatgcttagctaattctttgtatttcagtagagacagggtttcaccatgttggccaggatggtcttgatctcctgacctcgtgatctgcccgcctcggcctcccaaagtgctgggattacaggtgtgagccactgcgcctggcctatctctattttaaatgacaaaaaaaccccacaaaaacccaatctatgttccagttatgagggaaatctttaatgatttgaagtgtgatggctagtctatggcaagtaagaggtaggaaggagacttaaatccaggttttctgattctggttcagtgctcattctgtggtctttctgagaaaggaatgttggaactgctttggaggaagacatttccaggaatggaacacctattcagtactgacagaggaggagcactgccatcttggacaagcacctcatcctaaagttcatcttaatcaaaaaccacctaaatccaaaggacatcagcctaatggccaaggtcagcatgaccataaaccacaaataacatctctgaccagaaacattccaaactcctccccaaccagagacatgctagccccgagatagtctccctctggccggaaagatgtcagccccaagataacctctcctccgtccagagaaattccaaccccccataaacttctcccccacacagaaacattccaagcttgtgataagcctgctcactgtaaaaccaatatatactcttagtctgtaagagaaagctctcctgaccaaaattggccagaagcccctctcaggtttattttctctaaaataaatctgtttttaaccattgagccgcattttgtgtttctttcctctttctttaactcttacaaactcttcgtaagatttgcacttactttgcacaaacccttacaacccttagggttagggttagggtgcaaattaaatataactcaaagatgccctttaagaaagagttctatgtgaagtagaatggaaatgttaaaggaaccacaccaaaattcagtcctaagacagaaacaactattttatattaatgttagcatgtacccagtttagtacttgctcagaaactgtctgtggcatagatgagtggatgcatggatggatggatagctgagcctgctacatacagagtttgctgctggcagccccaagacagagtgccactgtgatctacattttacaagcacagactgaggatcctgctgaggcgttgcttgctgttggaagagaaaatgcccagtttgggccaggctgctaggagcccatgaagtaatccctcatttacccagctggattttggagcctactctagatgttgattggttccacatggctggccaaagatttgaatctatttgttcagcttctttcgtttcctcttgtcccctttcaggctaagaaagacatcttccattgcccaacattgtctttggtggagaagaaggagagagagggggacaaggttacaggatgctacccattttttcctggaaatatttatactagctacatatccagcacctcaaagccagaacccacctggacaagaacttgccttgtgaaaatggcccatattcaaagtctaatagccttgtgctaagccctaattttttaaataagatacagttaatatacctatttttggttttcatattttaaataagtgtaacatctaggaccagaccataaaaactggagttaataggagagctgaggccgggcgtggtggctcacacctgtaatcccagcacttgggaagccagggtgggcggatcacgaggtcaggagttcgagaccagcctgaccaacatggtgaaaccccgtctctactgaaaatacaaaaattagccaggcgtggtggcttgcgcctgtaatcccagctactcaggagcctgaggcaggagaattccttgaacccaggaggtggaggttgcagtgagctgagatggcgccactgtactccagcctgggcaacagagtgagactacatctcaaaaaaaaaaaaaaaaaagagagagcttagaatcagactgtccaatggttcttaaaatgtatttcatgaagccccattgagggggaatgtcaagggctctggaacaggtgggttctaggcgcccccaaagacagctgtacttgtatcattttatatactgggcttccatataagactttgttttaattaaggcttcaggctctagaaaaggtttgaagagagttcaaacaccctcattttagccccggagaagttaaaaaatggtatttgtgcatctcagactctttggggacatgtgtttcaaggtatccataataatgggactgcatttgactttggataccttcaccttcctgagccagagaagttagagaaataacttctcacgggtaaggtgaaggttatgacatcctctctaatgaatgaatcagaagcaatgtgtatgaaattatctcagtagagtaaggaaccaagaagattacttcttttgagaaatctgttagtgagctgaatgtggctgtggcctgggaaacctcagatgtgtttttgtaggttcctgaaagagaagaggagatatagtggcctgctataaaatgtatgtaggctcacacaggagctatctacatttccttgtttttcatgggggagctcctttgcagctctttgtcttcatattgactagtggcagtggtccatttcaactgcctctgaacaatctgagctgggaaagggaaatactgaattgatttcttagaaaaattgagaacttgacaaccataaggtggaggcagaaagcaccttgggctggtcagtaatttagtgtatcacatttcaaggaaaatcattgggtctttgttcattcaatttctacatggcaagggagacagattagatatttctggtgtcccttccagcagagatcttctgtgcaaactgcaaggtgtggtagctaagaacatggattttggagccagatggcctccatttcaataccagctgtgtgactttgaggaaattacttaggtctccgtgccttgatttctctatccataataatgggaataataatgataagaataatattacatacttcatagcattgttgtaaggattgaatgagttaatatatgtaccatgcttagaacagggcctagtgcatggaagagctagatgagggtttgcaatgctgtgcatttttaggagctgttcagggccatgctgatcctcccctcccctcccctccctccctctctttctttttgacagagtcttgctctgtcacccaggctggagtgcagtggtgccatctcagctcactgcaacctctgcctcccgggttcaagcttctgcctcagcctcccgagtagctgagaccacaggtgcatgccaccatgcctggctactttttttgtattttcagtaaagatggggtttcgcgacgttggccaggctggtctcgaactcctgacctcaggtgatccacccaccttggcctcccaaagtgctggaattacaggcatgagccaccacgcctggcacactggtccttttcaaatccctttcaagaagctagtctttcccattctgacgtatgtgttgctgtaggcacctctgaacctgaggggtcccggtgagtgtcctgcgtgatcctattgctctgggttgtctgctcaagaaaggtttttgtgaatgggctaagggttccctgggagcccaggcatgggtgtctctgggggctgatgtctctcttgcctgtgctgattgtgtaagctgctctttcactggcctttcagtgaaaaatctcttccaagccatttctacttacagctactttcttttggaagtagtagggtaatagcccaaagctataaaagaaggtgcagcatttatcaattgattgattaaccaatcagtcaacatgtattcgtgtggtgttttctgtgtgtttagcaccatgctagctgctccctggagaaataaaagaaatgtaagacaaggtcttgaacttcaagttaggatcccaaaatgattaaattggaaacaattataaaacacctactaaatttagatgtagagtataaagtcttccaaggagaatttctgtggctgcaaatgacatttcctggccccaggaaatgagtaaggtggtccagtataggcccctttttctattattttctgatgtgggaggcaataagaaatgacctatgtcacatgaaagcgccacaaaagaaggagtaatattgaggagatttatctggcaacgtgtggaagatggaatggtatcagggagaccagttggctgctgccaaaattcaagtctgcgtatatgaagaatatagaaagaataagacacacagctgggaatatgaagtcagaagggtatatccaagagacagcaacagtagtattgtgttagtccattctcacactgctgtaaagaaatacctgagactgggtaatttataaagaaaagaggattaattggctcatggttccacaggctgtacaggaagcatggctggggaggccttaggaaacttgcaatcatggtagaaggcaaaagggaagcaggcacatcctacacggctaaagcaggaggaaaagagcaatgaggaaggtgctgcacactttttttttttttttttttaagacagagtctcactctgtcaccaggctggagtgcactggcacgatctcagcttactgtaacctctgcctcctgggttcaagtgattctcctgcctcagcctcccggggagctgggactacagccgcccacaaccatgcccagctaatttttgtatttttagtagagacggggtttcaccatgttggccaggatggtcttgatctcttgacctcgtgatccacctgcctcagcctcccaaagtgctgggattacaggcatgagccaccttgcctggctgctgcacacttttgtttttgtttttgtcttttgagacggagtttcactcttgttgcccaggctggagtgcaatggtgccatcttggctcaccgcaacctccgcctcccaggttcaagcgattctcctgcctcagcctcctgagtagttgggattacaggcatgtgccaccacgcctggctaatttttgtttgtttgttttttgtttttttagtagagacggggtttctccatgttggtcaggctggtctcgaactcccgacctcaggtaatccgcccacctcagcctcacaaagtgttgggattataggcattagccaccgtgcctggcccactgcacacttttaaacatccagatcttatgagaactcactcactatcacgagaatagcaagagggagatcctcctccatgatccaattacccaccagccccctcctccaacactgaggattataattcaacatgaaatttggtgggaaggggaagacacaaatccaaaccatatcaagtatctagacagagacagatagaatacaggcaaaagcaagtctagaggtaaaggttctggcaatttgggtgtagtggtaaaaggaacaggaagagtcaaagatgatgctaaggttttcaggaaataaatgaaacctcagcctcttccacaaaggcagcagaggctagtggacagaaacactggctttgtcatcagatcaacttgggatcgagtttgactctacttttcactaactgaatgaccctggcaagttttgaaacttctgtgagcttcagtttccccatctgtaaaatgaggatattagtccctgctttacagcattatcgtaaagcttgcatgatgtaacacataaaggcattgacacttggctttgcgcatggcgagtgctctgtcaatgttagctttttgctattagtccatatcaactgagatgaactgagcacctacctagtgtcacacactgtgataagtgtaaggatgtagagaggatacaggcatggcctctgtcttgatgacacccacagatagatattgtctccaatgcggggagaattgtcccatgtctccttgagccttctccagatgaactaaaatggcacgtctctgctgtgggccaaggaagagctgtggagttctacagttgtgtttccccttgtgctccatctgtgcctcatcatgaagggaccaagttcttatcagaaatatagaccaggcatcctgcagaccttcctacagtcctggccagtaatgttgccagccctattcacctccttcaaagacaccatttttctccttttatcccctcttcttctggcttaaccaaagcaatgaccccagaaaacatagacatttgcctacatcgaatagacattgagtatgcctttaaagtaaccccttccctttaaatatgagtgtaattttaggatgattcttatgtctgcaatttgtctatgcctactgatgcgcacctgaatttgtcttctatgggaaggaaatttagaagttctaagcaaacactgagatcaccttgttcttcactattctctgccttacacatccgtatcaatcaatccctccccatcccttgttgaccacaggcggtctgacccagagaagaatcacagagaacatttgcctcctcatggagaccatctgttcttggagctagagccactgaaagaaggaagctggaccatgagaacttccccaggtatctgggccaagccactttctctagggaatcagaggaagactcatcttctccctcctctaagagggtgccctgccagcggagactttctgagattagaaagattagaaaaaattagagagattttagggaggtcaactctattggttttgtaaagatagaaaagcagacaggaacgggtctctggaacagactcactgcgaatgcaacacaggctatgggggatgaatgtttttaggtgagagggagttgcagggcaagggagaaaacatctatagcttgagatccttgattttaacatgcaaagaatttttttcaggtcaagaaatttttgcaggagtatttgttgtgggcctgatatctggacttttgcagtttcttattcctttttcctaatgatgatcaaatgagaacattctgggaattgatactttctccctgccacattcttgttaactggttccatttcaacagatggcctcttttgtatggtacatagatccttgacatctgtgaggactgatgatgtccagagacattcacaaatcttcaagttcatgagtgcggaaacatttgtacaagctcctggcttgctcccaagccacatgtttcttatacattgcctcatatcataggttaaccaccttttcaacttgaactgtggttcaatctatcacattatggtgatttttcttttccccacacataaaccagttttgattaaacaacgaaaacaaaatacactataaaatttcctgcaaagccagcaataaatgaagagccacaggggcaaaagaagctgggttggtgaggggtcagtagggcttcctccctaagagaatccctttcacacaccacttcccagaggcacaaagttcaaatccaggcctgtacatggaacagatgactgtgggacatgggccttcaaagttattcaggaatagcctaaattgagaatttaggtctgggagtgcctcaggcttcctctgggtccacgcttcattcttgggcccctgatcctctccctcctcccacccttccctctccaccctccgttaggccccaatgtctgctgttcccttctatgtgcctatgtgttctcaaggtagatatcattttataccagctctttgaaattgattatctgggatatggatcacctggtatcattcagaactagcccctaaaacactctagactttttttttttttgagactgggtttcgctctgttgcccaggctggagtgcaacggcacaatcttggctcgctgtgacctctgtctcccaggttcaagcaattctcctgcctcagactcccaagtagttgggattacagacgcacatcaccacaccaggctaatttttgtaattttagtagagacagggttttgccatgttggccaggctggtcttgaactcttgacctcaagtgatccacccgtctcggcctcccaaagtgctgggattacaggtgtgagccacagcacccagcccactctagacttttcttcataagtgtgcacattcccagccaaacatggttgcaggttattgacacatctaacacaataggctaccaaggagcgtgggaaagccagattcagataccttcactgcagttcttcagggcaaagaagtccactgcagacaagctgcggtttccactggagatgtattccagggccactcgaaatgggttgtctggacgcccgattcttccctggagcactgtccaactggttgcattggaaaacagaggagaaaagcatagagaaacagatatgagaattaggcctaacatgtggacagggtcatgtccttgcagggacttcaggactcacattcttcatgggcaccaagagatgggactcgaagtggcactgaggacagtgattctgacagcaacatgcaaatacttatttccttttagtccaacaaacttagagatccaattcacgaacccagtctcaccactggcattccttttgtcatattctgtttaaggcaaatgcagctctttggactatttgagtagctagtatcacaagaaagaatatatatagttgagaaaacctgccagtaagtagactcaaggaaatgtcttcaaaacatgtatcactctattcaaaattatctctagaaagaatgattggttttcagaattttatctgatagaaagtctcggaaccctcaggtttgctctacagttacttaagacggaagctagtaagaactatttatttactgcaggaaaattaaagtgcaccgaagcatgtattttggggtaaaaggtacctaagactgacgtggactttgcaaaaagtgccaacagaaaaagatggaagcaggtgaaatggcgagctcggcacccacctataatcaaggatactgacactgtcagagaatagagaataaattaaatgaacacttttacaccttgctcatgctattaacctcttgaaatagcctcctgtcactgattggaccatcgaatttactttccagcattgattcataaatgtctgcgagtgtgtgtgtgtgtgtggatttatttacttacttattttgagtggtttgtgtgtaaaataaaaattacctagattatttgatattttctttccttaaaaacaattttattgaggtataattgatgtataataaattacatgtacaaaaagtgtcactttgggaggccaaggtgggcggatcatgaggtcaagagattgaaaccatcctgcccaacatggtgaaaccctgtctctactaaaaatacaaaaaatagctgggtatggtggtgcacacctgaggtcccagctactagggaggctgaggcaggagaatcacttgaaccagggaggtggaggttgcagtgagcagagatcgccactgcattccagcctggcgatacagactcttgtctcaaaaaaaaaagtgtatgatttgatggtgggttttggcttatttatacatctatgaaatcatcacaatatttcacattttttttttttttaccagtaggttgggctttggtatggcagtacaagtggtaaaggattaagggaaaaactagctttccattaaataaatttttttaaatatttccaccccctaaatataaagtgatgctcactgtaaaaaataaaaagcattgaaaatccaactattcagaaaggctgataatggaaagtaaaagtcacctagaataccattgtccagcaataaccatagtcaccacctaaggaaacaacctgtcaggttgtttttttttttttttttctgtcttgagacagggtcttgctgtatggtccagactggagtgcagtggtgtgatcacagctcattgcaggcttaacctccccaggtttaggtgatcctcctacctcagcctcctgagtagctgggactacagctgtgagccaccacacctggataatttttgcatttttttgcagagacagggtctcactgtcttacccaggctggtctccaattcctggattcaagccatccacctgcctcagcctcccaaagtgctgagattgcaggtgtgagccactgcatcaagcccaacctgtccattttaatccattttaatttttcatgaatgagaccatagtacatatactctgtggttgcactttctcacttgatggtatgtcacaagacaatatagattacagtatcattttaatgattgcatttttaatgacctgtgcattgcttctgattttttcttgatcatgattatgccaaagctaactctgtgtacttatctaaatacggcctaaggacaaattcttagaatcagagtcaaaatgtgtgcacatttaggcatatcgtcaatcctgccacagtaaatcgggggcccatttctgcatgcgcttgctaacactaattcccaccaaatcttttctgcctttgctaacttttggtgatgaaggcatcgcctaagaccatccaccatctctttcagcgcggtgctcctggatggtagctttatgtctctggtctctggcatgcggtgggtgtctgctgaatgaaggaggtagtcttcttccctatcttttctctctgtagttaattcaggtcactgaagctaattcttcagccatttaataaaagtgtattgagtttccccacaatagatgctgtagaagggattattgctgctgtaaagtttgttctctgttaccgtacccagcaggatttccatccacaataaaactggtgcaattgaaggaaaaggagggctttcggtttaaatgagggactgtcaaagatagcaatatttgagaagaacatgtaaacaagtggttcttaaggagataaacaaaaagacaaaaagagccgaatttgtcttgttcttctgaaaaataaaggacctatttttgaggaaagatagtggtgaaaggcaggagtattcatattctgccaaaatcatagctctctgctctgagaaatgatggattttaattccaggtacacagcggcccttgacaatgatttccatttctatattggcactagccctctggataaatgtgtcaagagttttaggaattagtttctgagttaccgatgcaataacttttgtctgaaattctctggcctcccatagtttactgctgcaactttaataactttcagagcagttgccaaacatgtattttatatccagggaagttgggactagaaaagggcaagcttatatctagggtcagatttgtttaagagaacgccaaaaacccagtgaaaaacaaatctaaactctcttcttggtctgcctccattttctttgcttacacccaagtggtcacagaatgagcctattagggtcctgcttttgtcccttcggctggtggcaattctacttaggcttgcagaagggaaggttatgttctgacctagagcctcctggagacaaacgtacagctggttccatgtgttggggatttgtgactgtcttatcactggtgcttccatcaatcaatgtgacagtgtggggtgtccatctggactttaggaagtcaggggactgtatggacagcttgtcacaatccattatcttccctgtgtctctctggagctctccggttccagttctggctctgcccctcatttgcctgatgactttgaataaggcacttctctccaaaaatgcctgaaatgttggatgttttctgatcaattgtattctgcctccaactttgcatgaattttttgagaaaaacacggaccagccatttttgcagagtgcctatattataatgagtatgttagagtccatcaaaaaaggcaggagggttggcttgtgaatatcaaggtccatttctgacctacaggctagaagagatatgtagaaaagccactgaattgggagctgagtcctggattccggtcgtggatttgcgtgggcttgggcaagtccctgcacctctttgggttttagtttcctcattagcaaaatgcaggcattgaattaaaagttccctaagggcccttattgatctgatatctatacttccctagctgattgcaggagtcctagtaacaaaacattttatgaaagccctgaaatctccaatggacaaataatatcccacagaggtgggaggagaatgattaatcacagaatcgcagatttatttctgcaaaaagactcagtttcaccctccttggagaagtgaagtcttgctcaaggtcacacattgagttacctgcagacttaggattaaaataaagcatattattgctccaagactgcaagcacaagaggcaatgcaacctatggatcagtctatacagtcaattgcatttcatttccctaaaatctcagagacagagaagaatatgtctacttagcattgctggaggcatcatcaatttgggttatcaggatagacacactggccagatagtgaaatactttgtcagaaaaatctacaaaaaaatcacaagaagctctgacatggaaacaaaaagaatttctaagcctcccacagctccctaccagcttagctctatatgtttaaagaaaactgtctggcacatctgatacaaggcaagccgctgatgagtttgaaaggttggcagctgtgactcaggagggcaaaggcaccaagttattttaagcccagaatgaagggacactttatgacaacacgtgaggaccatgagtggcagttgacaagacagggaacatcatactttgcttctgtgcaatatcccagtgggcatcatgttgacatagggctggcttccttaagtgtgccctcaaacccaccctacatacttttcaaaggaatgcctttctgagatggttttagctgctgcagtgtagcaaggcaaggcctagattcagctctcagctccaccatccaccaccctaagctacgaccttaggcaaatgatttaattcctctgagctccagtttccctatttttaagatggaggtcataatgcctaacttgctggattgttgtaaggatttttgagaaggatgcatgcagagtaataattcttagcacacggtaggagctccataagcggagctattcctatggaaaccactgctttcttcatggaatgacactggtccttgcaaatatctgcatctcaattcatttatgagcgtcaaaggagaaaggaatatagtaaaagagggtgagaaaggtattgcaatttatgagtagcagccatcacgtttgtttaaataaagaaaaacttggttaaatgcatctttatacgttaaatacaaccccaagaaattatgttagaacatccctacaagatgtattaggatttgactatgatagcagatcaccactcctctcagaatcctccaaaggcctccatctcacttagagtaaaagcttcttctttacctttgcatcttcctgtaggacatgaaaagatgcttggtgtctagttcttggttagcatttgttgagtcgcattccatttctcagatatttactggtgcattgttgcacactagctaaagtattggatgctctagggatgcgaagtgtttaggatgtagccttgttctcaaggagcttacagactggtgagaaagaataaacataggtaccaagatttttagtgaatggtagcatacgagaggtgagtgagaggtgtaggcaccatatgctattaaagccgaggccaaagtgatgtctccaaatggatggtcaggataggagtatcttgaggacgggttgtgaagaggggtcaggaattaggaaaagggcaatgcagaaatgcagaaagagagactggcatgagcacatgagcagaggccacatagacagtgtgtgtttggagaacaggtggtccaatcttgcaggtgccaatgtttttcattggcctctacaggaaggatgacttctgtgtcttgccttcccacctccttaatgccagaatggtggatcattcatcacatgtctccaatgccttatacatcgtagacactcaaaaaatatttgttgactgagaggacaaatgaacatatttctgttaaatcagacgagtttctgacactcttggtcaaaatttatattgcagtggagctgagttaatccaaacgttcgtgtcaattcatgaacactagctgtcatctattcacatgataatgacgccttccctgttaggagaaatgcaaagactggggaactttggcggttgcattattactacatagctcatcacataactcttggcctccatttgccaagagcgaatcagaaggaaccggagaattatgtaattgagacctggaggatacctgagttctcaactatgacagttaccatctgttgcataaatgttctctccaatgcaggtcaggcttggaccaagtcaatatgaatactacctacagcagcattaataatatgaccaacaagagttaaaacttattaaaggtctactatatgcgctgcttataactgagtttaaaatgcaggttggcatgcctctataatctttagaacaccattttattctgccatttaagctccctgaggttagaaactgtttttccgaggctttattcctatttctggctctgatgaacatggctggggacctgaagctacaagatgtggctatcctcatgtcctgtgctggtcatgagcgccaagtcattcggatggtgactgagctcctagctgggatgcccaaactcacgggtgagatcgacaatgacaaaagccacataaactagataaccagccaagtccctgtcacatagaacacagtcacgtggtgatgattattatcaagcataacactgtcaggactcaagccacactgctggcattcctccacatgtgtctttgctaagaatctctcttgacaagtgtctggacgaggtgtgaaggtgtaaagatttgttagaaacaaagaactgagcctgtgggagtttgtctggatcaatacagaaagaaagagaaaaaaaaaaaacatttgaacctctctctctaatcttatcctacagggaaaaaaaacacacaactttcaaattttccttaaaatatactttgtagtaattctgtagcaaatataaaccattcagcacaattttttactgtttccattaaatcagcctgcatttaaagcatttttatgggagatagcaggggaaaaatgctagatcaatgtaaattttagtgtgaggtcctttgttgcttattaattttctgtaataataattacacatggcgtgtggcatggagtcttttatccaagtagccttggctttattattcacttgcccttcatactttcccacaagttagatgaatgtgctctgaagaggatcagctgtgaaaggaagaggtttcaggtcgaaaggggatctggcttccaatggcccagcgtggagaagagctgctctgaggctaagggggctccaggctctgtagggggggccaaggcagggctgggttccctggggctgcaggcctgcttgttgagaccttagcattgtcagctgtaaagcagttttcatttcatcagagatgttatgtgggtgacggggatctggaaggtaggctggccttcctggggtagaggcatagaagatgttccaaactgcatttccttaattattttctcatgtttcggaacaaagacaacataaatggtcctgagctccttttcctagcctcttttttttggggggggggtggtggtgtggagtgtcactctgtcacccaggctggagtgcagtggcacgatcttggctcactgcaacgtccgcctcctggctcaagcgattctcatgcctcaacctcccaagtagctgggattataggtgtgcgccatcatgcccagctaatttttgtatttttagtcaagatggggtttccccgtgttggccaggttggtcttaaactcctgacctcaggtgatccgcccaccttggcctcccaaagtgcctcctttggggttacagccatgagccaccgcaccggcctcctagcttcttttgagcttcttctaacttcccctttttttctctcctcccttgttccctccctccctgtctccctcctctctttcttgcttctattcctccctcacttttcctttccttctttcaagagaaatataataattaagcagccagacttttattggctgtgtgacctcaggcccctggacctcctgctctcatcacttgagttccacacctactgagagttttatagtctcacttctgccttttattggctgtgtgaccttaggccagctacctaacctaacctctctgtgcctgaattttgtaattaagaagtgggaatactaattgactcataaaggggtattgtgaagatcacatgggttgagatatgtgggcatgtagtttgcactcaataagcattagcggatgctgttgttattattatgctagtgtttcttttctctcctaaatccagtgtggctgatgatcttataagaaggtgaaataagagattgactgtgtggtgggatttgggggttttggagaagagcctcccattccagacataaaggtttcaggactccttccattaaatatgaaaatcttatttaattttcctaacaaatgcatgaaacatatcatcatcctcattttataagagagaaatttgaggcttagagagctgacacagctggttcatgtagtaagtactaggaggcaacgtgaacccaagactatcttcaaaactctggcacttcctactataatgcacataggtttagatgtatgccaaatgcaagtaactcattttttagaagagcttttggtgggtcagaggtgggttgtgcttgaagaacagcatactagcaaagggtgcatcctgtagatattttggcccctttcattgttgcctcaggctaccttattccttttctactcgacctctgcatcttcagaatctggactggaatatgcaggcttgttgggggctgatgtccaccctggccctggctgagcattttttcttcattctgtgtaccaggccagaaggtaggagacgaagagtctacctctacagacttagcctctaaatcattgcaatcgggatggggaggagtaggagtagactgatcataaccacagttgtaagaaaaacatagtagtagaaatgttcttaactggacttcgtgtgactaatttgcttgctggattagcacaagctctacattttacatgccgtgaaataccctgtgccctctgaatgttcaaggttgctgactggtcaaggttactgagtgttaaaggtcagtgaatgttcaatgttactgaggttcaatgttcaaggttactgagtatttaaggttactgtgtttaagatcactcaaagttcaaggtcactgaatgctcaaggtcactgagtgttcaaggtcactgaatgttcaaggtcactgaatgcccaaggttactaagtgttcaaggttactgagtgctcaaggttattctttagtacccctagaccccctactcccatcatttgagttccacacccactgagagtcagttatgcttattctgtcagactcggaacatgatacccaaaagtatggccccttggcatgctgagtcctttgaattgaaggaccttggaagggcctcagaagcaagttctgtctgaccttctcttcccctcctgtctctcgcccctctttctcccttgaagtgagttgtagaaaccagaagtcctcttccccaaaatcagtcataggaactagcacccctctcccctggagcaagccataaaactagaatggttattctctccctgctgccttgaagaccttcattccataggggtcctgctccacacccaggaggaagaaatgttagacagggaggccaaggagaatctgaacccacaggcttgctaggtttccccctcagtccgtcaccactggatcatcccctttctgtcccatccccttctgcaatggctcactcttcatcaaaccaaacaaagacattgggtcttcatttctgaaggctcccaagtaacgtaaaactttaattaaacaaatttgttttgctttcctcttgctttcctgtcttttgtcctaggagtgtccagagtgacccttgtgatgggtaaggaaaagtgacacatctttctgcccctacagtttctaaaacagtttatgccagctgtactcattaagtggatgaaataggcaggagaacatttgaatactttggaaagactggtagctggtgagtcaccacaaataattactgttgaattaggtgtgaatggggcaacagaaagatcaggaaacaaatcttaaaaacccggaaagtctccagagagccttcagattacttcacaagtatttaaaaattatttccattttaaggaaatggatactgaacatcatggatgaggtgttatgaatgtaatttatgagaaagacaatgaggaactctaatcaacagaccacaccacactaatttggccctacatcaagcactggtggattaacatgcatttagaagttgcaaattaaaataaaatatataaggatctaagttgattcccaaacaacaattggtcccagtagtattgtctaagagggattcttctttgctctggtttgtataaaaaatatatagaagatgcatcagtggtttttttcttctttttaaaggaaaaaacactgattatccagaccagaaaaaaaaaaaagaaagaaagaaagaaaaaaatcaagcaagagaagacttctaatcaagagtagtgaccctgagaatcctgaatttcctctttctgtttctctaaattttggattaggtcccatgcaagccacctcctcctccagcatctgctgagcatccctcaccagggagctgtggggagggacccagctgaattctgggcaggggaagtgagaggggagagagtgtggatggtgctggcattccaggaatcacttagaattagagaagagaccacaggaggggattccagtgggggttttccactccacaaacttgccagacaatctttctggcagggtgggtggtagattttctgtgattagagtcccaggtgatcattttgcctttctaactctttctgtaaggagatgtgggcacatcacccaccagcagccagtgggaatctggaatttggtttcctaactctctctttcttccaataactttttagcaccatctgttcttttcaaatacaatcttttctttcaagccaagtcaatgcagtaggttttttttttttcttcaatacatcatccccatggagaaggataaagacaacattgaaactgaaatgtggccgtttctgtgggatccctccttcagtccagtctgcctccagcttgaggcctgagtcttgagcagggctggagttggggcattcatccagggcccccacttcagagctcccgggatttcccagtcctagaagcatcctccctgcccatgctcaaatgattccagcagcccatcctgttccctagagaggcagcctaaataccacttaatgcctgcatgtattgattggttcaaatgcgaatgcaagcctctgagccaagcaaaatgctgacacccaagcccaaaggctccatttcagccataaatctctggccaagtcaagccactgtgctgaaactttatacagtagggtgaaacttgccataaactgtggtcctgtaagcaaattctggggctgggataagtggtcagccagaaaagcctggaggagcctggtgaggtggggtaagaatagctcacagacttgtatctgctagagagggtcccccacccacaccttgctatgccctgccccttcactggggtggtcatggttggaactcagaacatgaccccaaggtatggcaccttagcatgatggggactttaaactgaaggacattggagggtcttcagaagcaagttctctctgaccctctcctgcctttctatcccctgctcccctttctcccccaaggcaagccatagaaatgagaattgttgctctaaccttccccctgcctttctgtatagagctgtccataacagaattctctgaactaccttgttggatagcagatcttaagaccctagttccagagggtcctgccctgtaccagggaggagtgaggaaggagtgctagacaagagaccaagaagaatccaacagccaggcctttttggggtcccccttctgtctattagccttagctcatacccttttgcctaatcatatttctacacagctatctgttcttcattgaacctaagcataaaaacagaaaatttcccctgggtctttgggttttcatttctgaagcctcccatgtcatggaaaactttgactaaatacgtttgttttgctttttctctcgttaacctgttttttgttataggtgtgtcagctgtggttgttgtgatgagtgaggagagggatcacacctttccacctccacactaggaatgggaaggtaattgtcagaggctttgatggatggtgctctgagccctcttggtacaaaaaaggctcacaagccctcccgtgctgcttatactccatggtggcaagtatcctggataataacgctgttgcaggcttgatagatgttaagaggggtctgagccttggaaatcactgtgtctaatcctctaatatggcagagaagaactgagacccaaggacacatccaccttcagcccgaggaggggtccattctacaccccgtgtcaggaataatctctttaaaactcaaacatggccgggtgcagtggctcatgcctgtaatcccagcactttaggaggccgaggtgggcggatcacgaggtcaggagttcgagaccagcctgaccaacatggtgaaaccctgtctctactaaaaatacaaaaatcagctggacatggtggcgtgtgcctgtaatcccagctactctggaggctgaggcaggagaatcgcttgaacccaggaggctgagagttacagtgagctgagattgtgctactgtactccagcctagatgacagagcgagactccatctcaaaaacaaaaacaaaaacaaacaaaaaaaaccctcaaacatgaccacagttctccaatggcctcgggacctgcctctggctccctgcacataccagggctccttcatcctccacattttgctcatgatgttctctgtacccagaggccctttgttactatggttttttttttttttttttttttttgctacttggctactcctcattgatcaaggctcatcttggtgtttttcaggaatacacctcccaggttggaccaggcaactggtataggggacaagggcaaggagtgccaaaccctgtctgagaagtttttggaaaagctttttggagaaggtggcatgtgccactattggctggcttccttcggtcctagtagggtgggcaggaaaggcagtatcattgtttgaattgtgactcactcaaaaaggtatgtttaagtcttaaccccccatgcctcagaatgtgactttatgtgataacaggatctttataaaggtaatcaagttaaaattagatcattagggtgggcacccatccaatatgactatattcttataaaacagaggggaatttggacacagagacagatacacacacagggagaatgccgtgtgaatatgaaggcagggattagggtgatgtataccaaggaatgccaaagattgccagaaaaccactagaagcacagtggcatggaagagattcttcctcacaggcctcagaaggaaccaaccctgctgacaccttgatcttggacttctagcctccagaactgtgagacaatgaagttctgttatttaagccaccagtttctggtactttgttatggcagtccttgcaaactaatacaggtcgatcattcaaaaccatccccactaactggagaaacaaactttaaaagtatttttgcagacttcggatgaatggtatcattttctatgtgatgaccagcctggtggacagaccagctgagaaaacaacttatttcttgcaaagcagccctattttccttgtggccagaaattgtacagaacatttttctacacgtttacctctgcctcccagatgaatactatcaccatacccttcagggaggcccctctgtagaatgatactaggaagtgtttgctaacaatgcaggaatcaagggcccattagatttgcccaggctcatgctcacacctttaagccatgcttgaggaaactaatggaatttggaattcagaattcaggcctctgctgtatcagccatatgggagctttcccgaacataacaaacagaactgcttgaggccctgagattgtgccaacgatatgttcacttgggagtcaatttctgggctgggactgccactgccaattttcatgactttcgagggtcagctcaaaattgtgacctggaacttttaagggatgctgagcctgcatgagaggcaggggcacatgcaggagccagaaagatgggggctagggctagagggggcaggaatccctgggcacaggccagcgtttcctcccatcttctcatttctctcagactttgaatcaatacagtaagaaagccccaaaccctcaggatcatttgacatggtccctggcctaatacactggaagctgtaattttctggaaaggacaggctgctcccagtttttggctggttcagtccttcagtgatatatttaattgataagggctcggccatctccaaaacaggaatagcccacttcctttacctgtctcccaagagatgtatgcaaagtgtcttaatacagagcttcctggacacccactgttttataagtgtcactatagccactggtgagctggcaatgcagttttcttaaaagcaaaccaagcagaaacctccaaagagtccataaaaactggctcctggggatgaggctgtaaaacccatgtcttcacccaggcctttttgtgataggtcacagaagctggcatcttttcagttgctcggcatgtttcttatggagctgggcaggagagcaggacccccctcctccttcccagtttccagcattctccgaggtcagaggactctggaatagaccgtgacaaaggctggaaagatggaatctggcatgtgagctcccacctcctgtgaattctgtgggtggttgcaaagttctgctgacagctcagagcaggttcagagacagcattcaaaacagctctgagcctctgattcaaagcgctggtggcctctgctccaaggcagttaatggacactcaggctcttcatggctacagggtgaggcttgtgtggcaggagctgctgcaggggtatctgaaaatggtcgagactgtggtctgcaagagtctctggctttggaaacctgccaatgatgtcatccaagtggtgacggtggtgcttgttacactgacattagataatagttacattagcgcctgccatccttggacactaactctgtgtcagacgctgggcaggaattcttcacagttatctcatttaatctcttaggagctctaagaggtaggaattgttgttcccattgcacagattaaaaaactgagattctagcaagtgaattatcttgttctaggtttggtaaataacagagatgaggttccaacctagatctgtcaaattccgagtccacagcaagggtgagtccttgggacagccaggggaccctcagctcagtacactctttaccatctaagagggctccctgtttccacacatacaacccccaccgcccaactaatctgattcttacagccaccctgggcaaaaggcacgagggtgcccgtgtctcctttgtagcatagccaggcaatgcggaatgaagagctacagggcatgctcagaagattagctagtgtgtgcctgagcttgggcttgggattgggatttctaggctggcactcccttatccaccccttgaagactcctgcaagtgggaagtgcctcagagcatggggcttggccaccatggtgtctgcctgctgtgtgtgcctgtggagcctgaccggtgatgtctcttccgtttatgaggtcttcctttggtaggggcatgagaggggcttatatgtgtggaggagcctgggacaaaccggacctgggagtctccttcttccttgcattttcacatgggtgaaaatgaacattggttcttgtggtactgggataatgcaagactcttcccattttacagatgagaaaacaggcatggaaagcagaaggaaataaaagcccattttttcgataggaaaagacacagacactaggatcctagagcaagagtctggtgctgatcctcatggcatcttaccaactgagttaggataactgggaccttgaggcctcatccatgatgacttggctccgtgtatgtttgtgggcatgggctcggtgacaggccaggggctggagccccatgttgagttaaatcatatgccactgagtcttctggtgtcaggtacatcatctcatttaaaagattttttttcgttcattttcatgtattataaaaatcttttgagcatgcgcatatactcctgtcagtctgatattaagtattagtaaaattcaatatcttattttaaaattagtgataaatataagaagccatgttaatagtaccgcaggtaatcattttgaatatcctggggtgacagcactctgttttgggacacaatagcttagcccattgctgtattgggagatccatgctcttgagtgacccttctcgctttggtccaacccattaatggcctccagtgcagacatcccttatgttaccatgcaaggctgctgaccgaggtcccaggggacccctccttaccaaggctggggagtctcattccctcttgtctgctgccacccaagaacaagactttgatcacaatgtgcgagaccctgaatcctagattttctttgttgcccttgcctcttttatgaagtccccttttcccagcctgagtgctgcctctcattcagtccactatctcccaataaaagcagatgttggctgggtgtggtggctcacgcctgtggtccgggtaccttgggatgctgagatcggcagatcatctgaggttgggagttcgagaccagcctgaccaacatggagaaaccctgtctctactaaaaatacaaagattagccaggcatggtggcacatgcctgtagccccagctacttgggaggctgaggcaggagaatcacttaaacctgggaggcagaggttgcggtgagccgaagtcgcaccattgcactccagcctgggcaaacagagtgagactctgtctcaaaaaaaaaaaaagcagatgtttttggcccacaattaaaccttctttcagcacttagtggctctggttacagagttatgcatttaccccttacaaattgctgtcatcagatacaaagcactaaatggcatcctggaggtggctcctttagctactcccaccctcagctcctgtctcagcccccttcactacacctgatcaagttgggccttcgaggagcaagctgctcttctctcctctcctgacgtggccgctgtttgcaggctgtggctgatcctgtgtcctctttctgtccttggtggaggtggtggtgagagtctctttcgaatactccacaaccccctcaggtagtgtctgctgttactttcccaaaagcaccacaggactctccagagctcagctgaaagatctctaactgccttgaccctcccagccaaccccctgtatcatattcctttaagcaatttcccatggaaggattcccagtatatgcatttgcctgttcatagaattgtacagctttcaaaacaagcctcagtgagcatatacatcctaacacatctggtacttgcttccagttggggagtggaagaacagaggtgggtggggtatgatccctgaactcacgactcctggagagaggagactcctttcccaaaaatcccaaggccctttgggacagcacatcagacctagtaccttcagaccaagttcctgtctagcgcctcccacgcaggcctccataataaggaggtgacatgggttgggtattcaaattggccgtctcatgggccacagtgtggaaataattgaagtcttttaacagaggtgtctaagagagcgattaaaagggaattgcaattattgagcccagaggtaaaatttcagaactggcctataaatcctggtctgacacgaaatttaaaactccccagtggtcttcaatgccatattaaaaggattttaatactaagaagtagaaataatgaatgataatcagggtattgtttctgggagccggggcagctctgagggccgggctggtgggaaccgcaggttagagttgggctgtgttttacatccctcccttcacaagagatcagtggaggaagggaaggcagactttggcagcgggtgttgagtgaaagcctggcagagccattcccaggtgaactccagcccaaactctgctgaaagccagaggcacaaacagcccgtgcctgttacacagctgctctgggtcagattgtgtggggggccaggggctggctaagggctgggagtttatgggctgtgggaacctctggcctcctgtgagccttgcagaacaacttccccacaggcctgtgcctactcggcgtctggcccagcgtgagcagatgcttgtgcatagagacacagcatggtccagaggaagaatacccgagtgatggtctggagatcccaactcaagagccagactcttcactggctggctgtgggcgagtcactccacttctttccttgtggtttctttattttattaaccctttcacaggactgttgaaggattaaatggtagaatgaatagaagagtgctttgaagatacaccgtataataggtttctattttttggtttctagtgcccattttgatatggtcattctcttctggatttaagtctgttcccttcaaatctgatgaccaaaatacagctagatgactcttgaagctttgttcagctacagaagtctaggacaatggtggtaccttgtactggtctggcaggtgcagggaatcctagggccagttctccctgaggtctgggctatgcatctgtagcctcttggagggttctctcgccaagcagctccagcacaccatcgctttctgttcacatgtgatcaccacaaatccctcctcctccctaccccctctttgttacccccaattcttttcccacaaatgattaccgaaccagatctcctagattctgtaggttgtggctcaaagcagctggttgttttgaacctgagtgtgggggcatggtgctttctgcagcaaattttaactacttggttgccagaatttagtctgtcatctgtgaagttggctttgctcctgagctttgaatcatcagcagaccaggccactcataaaatgagatgataaccacacagcttctagcaccgtacctagaaggtggtaagtgctgaacaaatgttaaattctgtttctgccaccctctcagtcacgcatcaaaaacacagaaaagccaaaggccaaagcggaatcctttggcacttttatctgagatgccttccagatgggcaagacttactcactatgcctctttggataaaagtgttcaatttgccacagactcacctaccagaatatcaggaaagcattgtccagtgggttgcctaaatcaagttattctgtgtctgttccattcctctaccctactaagctcatgacgctcctgaagagggtctttttattctaagtgagcctgtgttgacacttggaattaccatattctcctccaaaggttccaaaatcacttcttcaacaactgtttagaatgttactgcggttaatctttttaaattaaaacaattggtgggagggtgggggcgctggcatgcttgttcacacctataatcccagcactttgggaggctgagtcaggaggatcatttgaacccaggagtttgagaccaccccaggcaacagtgagacaggtctctacaaaaaaaaaaaaaaaaaaaaaaaaaaaaaggaagaaaagaaaaggaaagaaaattagccaggcatgatagtgtatgcttgtaataccagctactggggaggctgaggtaggaggatcatttgagccagggaagttgaggctgcagtgagcaatgatcgtgccactgcaccccaacttgagcaacagagagagaccctgtctcaaaaaaaaaatttttttattgactcctgaagtaaacacaatcttaaaaatacagcactgacatccttgcatttcaatctaaaaataaaattgtctataaaaggagttgtaggccgggcatgttagctcacgcctgtaatcccagcactttgggaggctgaggtgggtggatcgtctgaggttaagagtttgagaccagcctggccaacatggtgaaaccccatctctactaaaaatacaaaaattagccaggcatggtggcacatggctgaaatcccagctactcggaaggtggaggtgggagaatcacttgaacccaggaggcggaggttgcagtgagcccagatcatgccactgaactccagcctgcgtgacccacggagcaagactccgtctcaaaaaaaaaaaaaaaaaaagagctctaatcaaacttgcctagtttcctcttaaataaataacatataaatatttactcaaacagaacaccttacagtgcatgcagagttgatatacaagatgactttaaacaacaattaacaaggccatccagcatgtggagaacctgttacatcaatgtgtagcaactgttctagaggtagggcaaaaaaagaataagacaagaattctaccttcaaggaatctttagtggtgaaaactgcagagtagtatgaaataaaaagcaaataagcccaaggcacctataagcaatttcattgaattcaacaaacatttattgagtatagtgtgcgccaggcattgtagtaagtactggacagagatgatgagacagtctctgccctggaggaacttgtgttcaagagttttcatactaaaactgtctaaatgctgagaaaaatcaaagaaagtgagagcccagtgcagcatgggacaggatgaatgaattaactggggaaagagaaaactgaagaaagatgttccaggtaggtatcatgccacgaggaaaagcagcactcaagtcttcccacccagccccaaggaggaggactgagaatttcttgtaggggacgaatatgggattccatcacctgattgctcaagacttttaaagctcaaatgccctagacggagacaatgatcaaaatgttgagagaaaagtagttcaagtttaaaagaatagataatgctacaggtcagggaagccatttcaaaataagattctttttgacaatgtctctttaaatgacgtgactctggggacttttcctcgctaagcatctgccaccctacacaataattagccagctacacattttctttgttgttcattaaagattaatgagaggcagagcttaaggtctagttagatggagaaacactgaaggggtcatttgaacctttcatatctgttcctttcgaaactctgatgagcaggttttcaatacaacagcagctgtctgtgtcttctaacctacaatatgcctttggtggaaactcagatgtttctggcatgctgtctcccaccatcagctaaaaagcacatgcatgaaaggaggcagaacagctgtttggagctctgcggtgggtggaacatgtttcatgctggggtgacggggcattttcagcaaagcgtgtctccccactttgtgttgagttcctacggcaccatcaaagagaaatgccaggtatcaaggtgccactgtgcaaacacagcaaggtctggccaatttggaagctagccctcctttacctatttattttgttctaactgttagagtttttctaattcttcactctgcagacagccaccacactgggagaggcagagaggtgataaagagagggtttacttaacaaaagggataaaaggaaaactaatggaaatttaaatacttctagttaaaaataggcagctgaaataatgaagatagaaatgatagaagaccctggaataattaatgcccttctggtacttagcaggtcctggccctttaagattagctcacatgaatggatttcggctggtttagatctttctactcagaatgatgcctgggttggtccacttcctgctctttttcctctttcggtttctgagtctgtgtttggcatcttttagcatcttgtacaatgccatgtacccagaggagctcaaaggccattaatagatgatgttgatgatgccaataatcagagctaggagctgtgattgtattataagcaaagcatttgaataattgcagagccgacaaggcccagagtgacatttctccatccctattactgatgagcacgaccttgggacaagtcaacacctattgttcccccaggatggaatgtagggaagtctggggcggcctctatagcaaaggctgaaggaatgcatcattccaccaaatcagcctccctggatcatctctagtcctccctaggaactctgatctcccaaatccctccctcacctcctgtttccatttcttcctccaggaacccttttgtataaggacttgttaggatttgaggtggaatgagaatctacgaggctatgagctgagatattcccagcctgtctccaagtttgccttcagtaaacaggttcctcttaggctcagaagcctcattctgagaggcctcatagaaatgaatagaagctgaccgattgctgattgtacctgtgttcctttgcagagcctgcatggagctgggagggtacccaattcatggattttctgtattagaaagttaaaacaaggccaggtgcggtggatcacgcctgtaattccagcactttgggaggccgaggtgggccaatcatgagatcaggagatcgagaccatcctggccaacatggtgaaacctcatctctactgaaaatacaaaaatcagctgggcatggtggtgcactcctgtaatcccgctacttcggaggctgaggcaggagaatggcttgaacccgggaggtggaggttgcagtgagctgagatcgcgccactgcactccagcctgggagccagagtgagactccatctcaaaaaaaaaaaaaaaagttacaacagaattttcatgaaagatctggcctgtataatgatcctgcttcccatcctggcacagtctgttctttttcttcttctgcacattctggttttgtccatgtatcagctgtcctgattagcagcacatcttattttgtgcatgaagtccgcgtgctgcatcacttgtggttcatcctcagtcctggaccggtagacctgtccttcaactctccagcaaacgtgtctaactgcctacgattcaactttctgatctgaagcagctctttatcttcttagaagagcatgttttctgccaggttcaaccataaataaacctatgaatcaaatttgtctcctttgggtgagatatacaacatccagatgaaggatccagaagacctgactttctaattccacctttgtcattattcacagttaacatttattgaactcttattaagtggcagacattgtgttaagcacttctaagccattatctcatttaacattcgcccctaccatatgaagtaggtttattatgatgaagaaacagaaattcaggaaagtcagatgacttgctcaagatcacacagctcgtaatagaggctgagtttgaattcagggcccaggcctgtccaacttcaaaaccactgctcttaactgttaccttttatggtctcctaacccacgaggaaccaagcaaggctctttggatctctgggactgtctttatatgcaaagtaagggagtaggtctagggctttccttggtccattcagttctcacatgctgtggatcaattccctacacaccctttgacccctgcagccttttctaccctaccttccattcagagcttcccagggctatgccctcttcctatggacccctaacatttcaccgatgtgtcatgtcatgatggcctagctgctcatcgcatcacctggtagactcctccacctttttctacctcatctctgggtgagtgtggagctgaaaaaaggaattaagccaaataaagaccaattactaggagagtagctttggaaaccaagaagtcccagagactgtataactagaggcagagaaagatatcccaccatgatcaaaggagaaagagtgagtaggctacaggtgggcctgggaagattcttataggcaaaggtactcagggaaagttctttttctttttttttttttgagatggagtctcgctctgtcacccaggctgaagtgcagtggtgccatcttggctcactgcaaactctgcctcccgggttcaagcgattctcctgcctcagcctctcgagtacctgggactacaggtacgtgccaccacacctggctatttttttttttttgtatttttagtagagacagggttccactgtgttagccaggatggtctcgatctcctgacctcatgatccgcctgcctcggcctccccacaaagtgctgggattacaggtgtgagccaccatgcccggctggaaagccctttttataaggcctgccaggagctcaggatggagtggaccatgaggggtaacaagcccgatggagctcaggataggagccagtgggcagggagcacatgacacagctcagtcaccctgaaccaatctgcgaattgttaacctgaagtcagtgttcaatcgaggtatatgcatatattatagggacttataaaatatttttatttctcttttaaaagaggcttatgtagtactctgatttgagaaatactatctaatccatgatatgcgctgatgatcttgatcaaactattttttctctctggacttattctttacatttttagaaaagtggggaatgggcagatgagaatttttagttctatgagtttcaggctgagaagggaggcattctggaggcgggcagacctttctgagattgctgccccagctgacagcctcaaggtcaccaggcttgagaatgctcaggtagaaaaccagatcaagaaaagaacagaacttgctgatttttccttggaatgcaatttcccagggagaaaggaacatacaagcatttgtttctaggggctgatttatttccgtggctttcatatctcaatccacacctatctctgaaggcaaagaacaccagggacttgttttgttgtactttgcatcctggagacaatggagatgccatctcatcagtgaatagtaatgtaagcgaaggagagacacagatgggcgaatctgataacgtgcaacccaaggagtgagccatatttattcttgtcacctctaaaatgccactcgtcttgtttcccacctgtcctcaatatatgcttcactattagcctctagtaagggaagagaataggtcaccttttagtgtatttacccagcgagaagagagtgttctctaagatcatctttgaccttcctttttctccttctactgtctctgcagagagcttgttcattctcacagtctcagtgctgctttctgtggggaggactctcaaatcttcagctcctgctctggtcaggctcacgggaccattggcactgtttcctgccactcggaaccatttctgcctggatgccaaaaattacacggagcccccttcaatccatcagcccatccctctatccattattctactttcctccagaggggaggacacaattcacaagcccagagcttccttaatctcctttaatcagagaagatgccattggacctccagccttataatgatcaccactggctgagccagtggctcccgtcaagcctcatcctcttcctctatgacctgggaccgtggtgcagtatttttgctgagttttgcctttctttactaagactcttatctgtgtccttgattcctagtgggcttcccacctgccttcttgctcccttggtgaccccagacttattctgctccttgagctcagggttcaagggttcatttctctaccccattacccatttctgtcttctctgattgcctgcactctgtgtgccctgttggctgttcatcttttctctgcttggaccttgaactgggtcaagtacttccagtttcactctttcttgagcctttatcttaatcatatacatcattaaacatatgttcaaccttcataatttatagcctatgaacccttagaaggttcagtcacgcattgcttaacaacaaggatacatccaagagctgcatctttaggtgattttgtcgtcatgggaacctcatagagtgtacttacacaaacctagacggtgtgaaaggaggacccccaaatcactaaggaaagctcaagctggaagctgcttagggcaaccctgcctcccattctattcaaagtcactcctctgctcactgagatagatgcatatgtgatttgcctcctttggaaaggctaatcagaaactcaaaagaatataaccctttgtgtatcacctaattgtgacctggaagctcctgcccaccttctgcctttgcttcaagttgtcccgcctttctagactgaacctatgtactttttacgtatattgattgatgtgtcatgtctccctaaatgtgtaaaatggagctgtgccctgaccaccttgggcatatgtcatcaggacttcctgaggctgtgtcacgggcacgtcctcaaccttggcaaaataaactttctactacacacctaggctatatagtatggcctattgctcctaggtggcaaacatctacagcatgttactgtactgaatactgtaggcaaaggtaacacacggtatttgtgtatctaaacacatctaaacatagaaaaagtatggtaaaaatatagcataaaagatttaaaatggtacacctatgtaaggcacttgccatgaatgaaccttggaggagtggaagttggtgagtcagtgaggagtggtgagtgagggtgaaggcctaggacatcactgtacactcctgtagactttagcaacactggacacttaggctacactgaattaataaaaaatatttttcttcaataatagattagccttagcttactgtaactttgttactttataaacttttaattttttgactttttgattcttgtagtaacacttagcttaaaacataaatacgttgctcaggtatacagaaatattttcttctttatatccttattctgtatgcctttttctatttttcataaattttaattatttttgtattactttttaaacttttttgttaaaaactaagacacgaacatgcacattagcctaggcctacacatggtcaggatcatcagtatcacagttttccacctccacatcttgtcccactggaaggtcttcaggggcaataacatgaatggagctgtcatctgtgataacaatgccttcttctggatatctcctgagggccctgcctgaggctgttctagaggagctgtcactcttttcagaaatatgttcagggtggatttcttgctttgtttcctctcttcatcacagagttgcttgtaagcagataatgcacgatgaacattcctctctattaaaaaaaaaaaaccttttggtattggaatccatgttttcaaacctttttcttttttaagaaaaaaagagatgggggtcttgctatgttgctcaggctggcctctaactcctagcctcaagtgatcctcctgcctcagtctcccaagtagctgggagatgtcttcaaactttttgaggaccttgttgaggtctggaaaagcttctgctaaacccttcactatgaattttcttgggagttcttcttttccttctcatgcagtttccttttctcttgcctcttcttcagttttgcattcctcttccagttccaacaactcattagtcaattcctcaggaaccacctctaggagctcctcaatgtcattctcatccacacccacgttaaacttatttgccatctcagcttacagccttgttgatttttgcaacctcctcatccttggcaaatcctttgaagtcatggatgagcctcttgagtgtctttgagatgtcactcatacactctttggtgacaccagcccaagcgcaagcaagtttcttgatgcagtcttagatgttgtaatccttccagaattgcatcagtgtcatctcagtgtcttcctcagcttcagcaatagcctgtccaggtagtagatacaaatgttatgtccaggtagtaggcctgaagagctgctataactctttgatccattggttggaccaaaaaggtgctatttgaagggagagacaccactttgatcttgggatgaaaatcaccagtaaaaggaggatgtgtgggagcattatcaatagtgaacaaaatcttgaaaggtatgttactctccaaatagcacttctccatttcactgagacagcaattcaggaaggcatcttggaggaggagctgggtcatccatgacttctaattgctcctgtagtacagtggcgctgcatgcttatagatatgcctgaaagccctggggttttcactgtgccagatcatgaagggtttccagctctagtctgcaccattgcttccaagcaaaactgttgtcctgtccttaaaaaccttgaaacctgacattgacttagtcaccttatggatggaagtcctttcaggcatccatttccagaatagggaggtttcaaccatattgaagattttctctggcaaataatttttccccacaatcagcttatctagtttgaaaatttttttcagctgccttcacatcagcatatgcagagtcaccactcacacatgcagactcaccactcactttcatattatgtgatgaataatgattcttgaataatttaaaccatctagagctagcagtaaattcaacatcacagtcaggtccagccttgttttttcaacattgcaaacaagctttttgctttggccatggttgccatggtgctgagagggatacacttctgtatctggtctttaatccaagttgtgaggagtttctccataactgctatagacccttctagaatttttgtttgtctccttgccttcaatgaagtagatcctttaatagcttccatcactttgttcttgttcttcaagatcgtagctatggtggcatgtgacatgcttgacgggcaagcaataaccatcactgatttccaccttcgtagtccttaatcacttttaattttgtttccaggtcaatcacttgatgcggcctgttactggcaacatcagcagtggattttgtgtgcttagggaccatgatgaacaaaacaacatgagactaaatcaagcacaagagaaaacgacaccatcaagagacatggtaaacacaagatggatgaggctgctgttggggtaacatggcgtatgttttacagtaaactcttttctttataagtagaaagagcacactctaaaataataataaaagtatagtatagtaaacacatacttgttatcttttttttttttgagatggagcctcactctgttgcccaggctgaagtgcagtggcacgatcttgactcactgcaacctccgcctcccaggttcaattgattctactgcctcagcctcccaagtaactgggactacaggtgcacaccaccacatctggctgatttttacttatttattgtttatttatttatttttttaagacagagcgtcactcttttgcccaggctggagtgcagtggtgcaatctcagctcactgcaacctccacctcccaggttcaagcaagtctcctgcctcagcctcccaagtagctgggactacaggcaccctccaccatgcccggctaattttttatatatttagtagagacagggtttcaccatgttggccaggctggtctcgaactcctgacctcaggtgacccacctgcctcagcctcctatagtgctaggattacaggcttgaggcacctcacccagcctaatttttatattttagtcgagacggggtttcgccatgttggccactctgccgaactcctgacctcaggtgacccacccacctcgacctcccaaagtgctgggattacaggcgtgagccatcgtgcccaggcctgtttattatcattatcaagtactatgtactgaacataattgtatgtgctatacttttatccaactggcagtgaaataggtttatttacaccagcatcatcacatacacatgagcaatgcattgtgttatgaggttaggatggctacaacggcactaggtgattgataggaagtttttaacttcattatagtcttatgggacaatggttgataggtggtctgctgttgaccaaaattttatgtggcacgtgactatattgaaagaaccccttactatcttcacattttaatgaaaggagttaaattggatgatctctaggatctcttacagttctgaaatagtgtgacttaaaaatgctagaagaccacttagctaaactctttcatttacaggcaaaacggacccagaaattgaatgtaacctgacagcctggagactgaactgggattaggactttggtcttttgagtccccattcttgccaaaaccctctgctttgccttcattgtttctttctctccctgcgagtaggtcatagtaggcccctggccatctgtcagatggttgtgttatttggaaataagaaagaaaataaaagaccccttgctcccagcccattccttgcattagcggcttcaagatgacattgggaatgtgcaacccacttacgagaacaaactatttttaagtacttgagcacattgattgtttgtgtgtgagtggcaccactaattacaagtaagtcctgtctatttatcaaagcaggtccctttcagacagttcctgcatgcaaacgatccttccccacaattaggataaattagcaaggttttactgaactaatgagacaatgtttgtgagacttgtctttatgtcttccaggctgttttgagacaagagtctataattgggatcctcaaactgccatatttaaggaagcctgcacaagaagggaggtttatcaaatcttctagtcattccagaggatgtcacgtggaggtgtggctccaggcccaggagcatacaaatgcatgcatggatacataggacatgtgtgcacacacatgcacagatatgcagacaccccacacacatgtatacacacacatcaaatacagtcacaggctctagtttgcaattaagcttcttcttccctcactataagtgaccatctagaatgccatggtctgaaatcttacatgattcatgagggataatacattaataaataaagcaaaaataacatcaggtactctttattgcaaaacaggtttttgctttgtgttagcaactatcttcacgatcttccaaaagaagtattattatcctcattcaatagaggaagacactgatgctagagtcccaggtacacagctagtaggctgggttggcattcaaactcattagttttctactgtacccccaaagcacattctttatctctaatccactgtcttctgctgaagctctatttggtcacctagcctggtatgctctccttaagaactctttctatccttctagcataagatggagaccgtgagcaaggagttaccttaggaccacacagtgctgcttcaatccattaggtttggaaaacacaggctccccaatcagaactacccagttaaaagctatgacgattaattttatgcaccagcatgactgggctaagggatacccagatggctggtataaatattatttctgggtatgtctatgagggtgtttcataagagattagcatttgaatcagtagactgagtaaagaaggcctgctctcaccaatgtgggcgggcatctcctaatcgttgactgcctgaataaaacaaaaaggtggaggaagatcacattctccttctctcttcttgaactaaaatatccaccttttcttgcccttggacatcagagcttttggttttcaggccttttgggttctgagacttacaccagcagcaactcccacccctaccccggctgtatttctcaggccttcagccttgcactgggagtcaccatcagctcccctggatctctggccttcagaccccgactacattaaaccaccagttttcctgcttctccagtttgcaggcgacatactgtgggacttatcagcctctataatcacgtgagccaatttccataatagatatgctttcatatgtctatatataccctcctggttctgtttctctggagaaccctgagtgaatacaaggacacaggcccgaaggctacatgtcaggagtggctggagggttggatgggcacagagacatctctctgggtcttcccagtctctgcaaggtctatgaatacttgtatgcaaattcaacaagaagccaggggctttggggaacaagattagggaaagaaactccaatttgcaggagaaccatcttttagctatttcttcaagtgcctcactcatgatttcagatatcatgaagtccccttcttgtttctagaaatatcaaatgtggcatctaagggccaggcttcagggatctagttctgaggttgtcaaaggcaattttctaagagtttagtatgattaacagaagatgtttccataaaaatcattaaggaaagcgagaattttcagataccattagactttggggatagtgtcaggaagcacaaaaatctcattttagtggctcttgtagaaagaatacccaggatattagatcaaggcttgggccccagatactactccttttggctctgtagactcacttcgcaggatgcaacatgaggtactacagtagtcagagggatatgggttcaaatccagactccccaaccaatagctacatgaggttgtgctgattacttaaccaagctctctgaacttcaacttttccatctgtaaaatgggattagacaaaagcttcttatgtatcaccagcatctggctcaatgcctgcctcatatatggcatgtagtcaataaatatttgctcattaaaaaaaaaatgagtgaacttttgttttatagatgtttgatgcttttttttttttttttttttttttttgagatggagtcttgctctgtcacccaggctggagtgcagtggcgggatctcagctcactgcaagctctgccttctgggttcacgccattctcctacctcagcctcccgggtagctgggactacaggtgcctgccaccatgcccggctaatttttttgtagttttagtagaaacgggatttcaccatgttagccagggtggtcttgatctcctgaccttgtgatccacccgcctcaggctcccaaagtgctgggattacaggcgtgagcatttgaagcattttaaacattcaagcaggtcaataaatgtgagtatcctttctttgctttgctaatcaacttttgaaacattttctccttcctttcctcaacatgaatgaatctgttcttgagctatcctgagagccaaacttgtattgtaaaatgagttctgtagaagctacaaagaacacagattcatagacccatagaatttcatccatcagagaaagccctagtgtggaaaggagacccagagatcctctgttctaatcacttagttccccagataaagagacccgtggagaggaaaatgacttgcccgagatcacatggctagtgagtgaaaggatatgtttattccaaggcaagcctatttttactgataaaatagcttctaacctacatcctgtgatcaccaagtggacggtttcctaccgaaataaaaaacccagatattacatcaggaagagagacttcctcagggctatcccatcctttgtaccttacgtacataaggaggagtggaatagctgtgctctattcttgcatctgctaagtataatatgactgtcccaagtactgtattgtagcataacagcatgctttagacccgaacgcatttaccctagtggctgagcttgtaaattgtatgctacaggacatgtttattatcatagttattttctgcgaatacagttattattctatttgtgaaaattgacataagaggcctctaagcttcacacccctggggcatggcacccctttaaggtcatgcttcctggcttgcttcccttatgctttacttacagcccataagaagtttgcttttactaattggattcgattcgtcctttaacattttgatttgagtaaaaccaacaagagctagatttcccagtccatgacctttgagggctaactctgcagttaaaacatattcagccagaccagaaagcagtcaaccttttacatgctctgtctggtgtaactcctgatgttttccaacccctactccccagcactccttggggatcctgggactagaaaacctagccccgaggtccaagtttttatgctctctactctcttgtttttacaattaaggagtccagaggaaaacacagactttataacggatatgtataatctttctttttctcctatatatttatttttaaaacatttttaaagatgtagggggtaccagtgcagatttcttacatgcatatattaagactgtacccacgatgtaatttttcagtccttacccctcttaccctcccaccttttggggtctccaatgtctattattccactctgtgtatctatgtgtacccactgtttagctcccacgtataagtgacaacatgtggtatatgactttctgtttctgagttatctcacttaggataatggcctccagttccatccatcttgccacaaaagacttgatttcatttttcttatggctgaatagtagatattttagtctttctttttaaattatgctactaagaggtgagtatctttgcattgggtggtataggaaaatagagataaaggctaagaaaatgtacatccagaattaatacattaatttgttgatcactcattcacttatatattcattcatcattgaaaaattatttttaaagtgtgcataatatgcaaagcagtgggctttataagtgagagggtatggtagaaatataaaaaatacatagtctgtgctctcaataatcctatattcttgtgcggaagacaaggtattttattttattttttattttactttattttattgtgagacagtgtctcactctgttgcccaggcttgggtgcagtagtgcaaactcagcttactgcaacctccgcctcccgtgttcaagtgattctcctgactcagcctcccgagtagctgggattacaggtacatgccaccatgcccggctaatttttgtatttttagtagagacagggtttcaccatgttggccagtctggtctcgaactcctgacctcaagtgaccacccacctcggcttcccaaagcgctgggattacaggcatgagccaccgcaactggccaagatggtcatttccccatgtgcttataatacaaggagttcccaaacaagagttaccagtaaagccttcatgaccttgcagcatgacttggaatgtgttaaacagagatgggaggtgaggtccttctgggtggaggaacaagcatatagaaaggttacagaattggggaggcctgaagattggctaaaaatgtggtatgaacctgcctggctggaatggagatcaggggtagaggatgagtatgatacaaaatgagaatggtcatttgtaaggaccttaactgctctatgaagaagtttggttttcataagggaatgaatgagaagcttataaggtttatcatcgggaaagttatataaacaaaatagtccataggaaaaatattttggcattagaatatttaggggtgagaggactgtgaagaatggagacaccttgggaagctactgcaggaatcaaactttgagaggagaaagtttgaaccaaaatgcatgctgacagtttctctagaaatgcagggactggctgggtgaggtggcccatgcctgcaaacctagcgctttgggaggccaaggtaggcaaatcacttgagctaaggagtttgagaccagcctgggcaacatggcaaaaccctgcctatactgaaaatacaaaaattagctgggcaagatggcccacctgtagtcccagctactcaggaggctgaggcaggaggatcgcttgaatttgggaggttgaggctgctgtgagttgggatggtgccactgcactccagcctgggtgacaaagtgagaccctgtcttaaaaaaaaaaaaaaaaaaaaaaggtagggaccacaactgcaagctccaatgcatcatacaaatccaacttttgatttttaatgaacaattaggttcagatcttctccaactcctgttatgtagggactaaagctagtcagtagacagaagtgaagctatctgaaatagaacaaacttttacagatatttgaaggttttaaatgctacttagaattggtcggagaatacctgagcaccttgaggcatcagtttcatgctgaggagcctcttcaaagttcattaccatctttattcagcggttattcacatttgaggaacgcattctggttgaggactgatttttccttccagcctcccccaccctgagtttgtgaaactggagcctcctaacacagctggttcaaaggagggaaaaatcctttcctgcttaacattctgcaaacggcatgggcatatctccgaagtcaatcatcatgaatgaagccatttaagagtggggcccgcgactcctctgtgcggatgaataagcaggcagagtggatcgtatgcagaggagactgcaggcaactctctttctgctttgtcaccctttacgacccgctttgcagtcccagcacccttcatggaatgtcttgctttgcaaaaagaaacagataataaccacacggaggagaaatgctagccctgcagcctgttatttaaaaagtctggagaaagagaatgctagccagaccttacttttgctcgacatagcttgccctctccactttgtgattacatgctcggggaggtcgcatgttctccccatcacagaacttgtcaggaaaagcaatggccaggagctactggtggctcttgacctctctgtctccatgccatcattccacgttcatcccagggcagctgtggcgaaacagtgtcgttggttctgtaagtcctagcttccaaaggggagattggctccaatctgttctctaagacaacggacatcctctgctggtactggaagctgcagatccttcaatccacaaggccaacatagcagtgagtggcaaatctgtccagattgagtgcaggcaggaggccgcctttggtgagccttagtttagctccaagtgccaatgcttgactgtgcagagaaagtaatactgagtgttgacttgagagatcggggtagaaaagagagtcttggtactcatttcagctccgttattgagtcagcagcacaatgtgtactcattcattccacatttgttgagcacctatcacgtgtcaggaagcatgctgacagctgagaacattgagaggaatgagactcctgagggacgtgctagtagaggaggcatttggaaagccatttgatctctctgagcctgtttcctttaaaagcacaggcacggacaatatttctaaggcctctttccactctaacagtctgcaacagcaattctgtgattgacctctgactccctactcccaccagataaacaccagattagagatgtgactcccagctcactgtctcacgttcagcctgtctgcgtcctgtatctcagagagaccagagtgtctgcttcaggcatgagactcctaagtgccagccactggtcaggcatcctgtgtacctctgcccagatcgcagccgcagtggggataaagaagaacccttgaatttaaaccttcctccagagccccattctgcaaatcggaaactctacagaacaccccactgtaatatcttgaggaagaacttttgtttgctagaaattctagaaaagcaattcattttacagctaacctctctttttcttaacctccaagagtgcttggaagtagcagttaggttgtttccattctggaattcacccagacaactccattttgataaagcctctccagtgaggctccctgagctttttccacgaggggaggcaaaggaatcagagtctgaagaccaaagccaggtagtctttttggagcttgtaggtaaggtaggtgtgactccacctttctaagtcagaattacagaattaaaagtcttcaaagaactttaatgatatcaaagtcatttttggaagaacctaacagttcccagcaaaatcaagtgagttccaggagggtttcttgggtctcctgactttcttactaatagaaaacacagtctccttggccagggaaagaggcttgtgaatgactgactacatgtacctaattggtggggttctactcactcagatgaaacctcatccctgatcctatgggggagcctctctagtccaggcttcttttattaggttggtgcaaaataatggcaaaagccacaattacttttgcaccaacctaataccaacaatgaggagtgccttggccttagtacattgggtgcttcctgaggtgctagtctgactctctattttctgtcttctctaacactttctgaagaaatgcttaagaatttttgtttagttttttttctttttgaaactagttaggcacctttacatcaagcttatcatatggaaataagaaatgccggtgacatctcttgccagctgctatttcttcatgagagtcctcatctaaagaaaggaagcatttggcatggcctagggttattgttccttaaggggtccaggttttactcttcctacagatattagaaatctttcatcttaaaagctttttcaggaactgcttgaggaacagtgcctgagtctatgaaaacttcaagcctcaatcctaataacacttgatatgttttttttttttttttcccagcatcaattatttgttcagcctaagagatcttacctggaaatgtcatcaacaatgccaggggagatgagcgtgggtaaggactgctctccatagttttaagaaagagaaatagagggcatattcctgccagaagaaggagaaagaattatttttttctctcttagcagaaagaaagaaaagtggcagtcaatcataaaacacctcttgtgtgccttagctataacggaactaagttctttcatatcttccatatgtcatttcatttaattctaaaagaaaaatgaggaagaggaggagaaacaagggggaggaggaggaacctgagacttgaaagaaactggaacttgcctgtgagccctttgactggtaagagataaaactagaatttgtaccaagattgaaaccccaaagcccttgcgttttccaccacattgcattgacctggccaacaatgtgggcccttcagtgactaatctcattgcagcagacagtgtccactggggagcgaaggcttagatcacgccacaggtggccttagcttgaatcactaatcaaggaggcaacttgctattggtaacaggatgtgtctttagaagtacctcttcaattttctctgcttcttcgtgaccaagctggtgtttactgggcaaataatcggagcaataaaactgccataaactgcagcagcacaagctaatagaaaaatgtacattgcagaggaaaaaggcacaggcaagaataatgataccccttttctcctacttaagacagaaaaattaagaaggggtgaataactccttaggacactgggggaccctcctaggaggaggttttggctgcatttaccttatatacatgggcacataaacacattctcatatgtttgcactaagaatgacaaatgaacagagggaacacagaaaggaggaggctatgctctccttataaaatattaaaacaatacagataagcctagcattttctttgaccagcagactccctccttcccctttccctttctatccctagaggtagccattgtaaaagtttggaatatatcttttcaggcctttttttcatgtatcgcacataaatatgtattcacagaaatgttcacaaggagaataaattcacgttacatgggtaatgaaaaggtaattctaagcaagaaagagaaagagagaaaggtaaagtggaacttaaaagataaagctcagttttggaatgaagttattgattccaaacttttggggtgtccaatagatcaatgtatgtgtcaaaaacagactcaggtacaatcatgatatgaatggcttatctaacctgactttcttaacaatacaatatcaaagatgaccaacctaaaaatagccaaactgacaaattatgcaaaaatcaagtagcacaaaagaatactactataatctggcactaaaataaactcaaagggaagactttttgcaaattccagagaccttagcactacattttctgaatatcgtggctacataatagccactgatctaatttaatgaatttaggattaaagttgttcttgtatattatgattaccattaaggcaaaagaactaattagcaaagtcaagaaggttgccatggaggtacatcaatcagcctgaaagcaaaatgcaaaaggagtgagagtagcagtatgcttatattcttaagcttctggtccctaagagcttaattatttgtatattcaatgatagttcattcatttagccagaacctgtgtcctaagcactatgctaggtgctagagacacaacggcagcctgatggagtgggaagaccatggagttgagagaaagacacttggtttgtgttcttggaaccaacatttactaatggtaagattttaggcaaatcacttaacctcgtaagccttggttttctcaccagtggaatggtgataataattaactttccattgagggtaccataaataaaattcacagacctccaggcagagagtaaatgtaggcagaaattattatttgaatacagaccctattctaaaggcattcactgtctggtatcagagagagaaaaataaagaattgcagagggattctacttttgaatgggggaatgaggagccctgcagatctgctctccagtgaaacaagcataactggtaaaaattattttttagaaacacaatcacttaaagtctttggaaattgtcccaagggaatatagcaaatgaaaaaaaattaagagaagctactaaaactcattaaggacagtgagaatttgtaacattgggaccatgacctgctctctcttttcccctcccggctcaatataatggaaattccattccaggaaggtttagccaagagaggctttcccccggcccctaattccctatctagtgtctggtacctcctggtacccaggagggacaggctatgagcatttctaattttccccagctacacaaggcagaggctaaactccaggtaagcatggccaagaagttggggatcccttactctatccagttctccctcatagagtggagtctctacctcaggcatgtcatgctgataatgctggggctccagttgccctcaccacagctcatgtgtaggatggatgttctaagctgcaagagacatgttgagaagaagagaggctacttaccctgctcagcactctgaccataatgtagggtgtcactctaagaaaagtgggccacaatctcttgctccctgcctcagacctgtggctcagagattttgcccagggagagaagaaggccataagaatagagatcttcaaagttctccccaaagcaacagaatttatttatatcagattgtgagggagttcaagcctaagaatgctcttacaaacaattatgatttttgtggcaaacaactgagaggagactggcagtttcatgactatctacaacaagctaaacagttggttagctatttctccagagagaaccatggaaatagatagctaagaagaacctgctggagtgagaaaaaaccttcaaagagtggcctcaaaaattatgtctgtaaagggactcacatttaattggatcagactgtggcgcaacatttaccccagagctttgccaaaaacaatggaataatcagctgacaattagtaagtgcctacagctggatgtgatgccagcagaagcagttggtttaacagagatcagggaaataaacagtcaaagagaaacttgttaaaagcagtgtcatcctaggatgatcacacacaccatgccctctggagaatgacatgaaaggcttcccactgcagggaaatagactacactaaagccaaataaggccacatttacaggtaggagggggtcaggaattcaacatgtctttttgggagacaaaattcaacccatacatccacacacagactcatggtaaaaaagctgaaagacaaagagaaaatcttgaaagcagcaagagaaaaatgacttatcacttacaaagcaacctcaaaaagattaatagctgccttctcatcagaaacaatggaggccagaaggcagtggggtggcatgttcaaagtgctgaaagaaaaactctgtcaatataaaaaattcccagatcagcaaaaactgagatttgttactgacaggacacactaaaggaatttcttcaggctgaaagtaacaccagacaataattagacaccccctacccacacacacaccaaagaacatcaagaaaggtaactatgtaattataaaagacttttttaatacatagttcttgtccttctttctcttaatggatttaaaaagcagttataggccgggcacggtggctcacgcctgtaatcccagcactttgggaggccgaggtgggtagatcacaaattcaagagatcgagaccatactggccaacatggtaaaaccctatctctactaaaaatacaaaacttaactgagcatagtggggtgcgcctgtagtcccagctactcagaaggctgaggcaggagaatcgcttaaacccagggaggcagaggtttcagtgagccaagatcacgccactgcactccagcctggcaaaagagcaagactccgtctcaaaaaaaaaaaaaaaaaaaaaaaaaaagctgttacataaaaaataggtatataattgtattgctgggcctaaaataaatagaaatgtattatatatttgataataaccgcacaaaggattggggggggcagaaaaggcatacttgagtaaggaaagcacacctgatagtaattttaacatacaaaaaaatttaagagaaatggtaaatacgaaggttagtatcactaccactataaatatatacttgctcttcttttttcctgcaagcttaaaggacataaaattatataaagtagcaattataacaatgtatttgtggtaaagtttataacatgtatagttgtaatatgtatgagaataatagcattaaaaagtggaggggaatagagctatatgagagcaatgtttctgtatctcactggaattaagttaatataaatctaaaatcaattctaataagttaagatgtatatggtaagccctagagaaactactaagaaaaaaactcaatagaatgtcgagaaaaaaatcattaaacaaattaaaatgttactctagaagatattcacttaataaaaaaagaaaacagtatgagataaaaagaacaaaagacatgagacatatagaaaaaaatgagataaaatggcagataaaaatccatgcatgtcaataataacattaaacgcaaatggactaaacaatccaataaaaaggtagagattgtcagaatgggggaaacagaaacccaaaatctgtctatatgctttctacagcaggtatgaataaaaaatcttcttaaatgcacaggaaactttctctgggatagaccatacgctaggtcacaaaacaaggctcaatacatttaaaagaattaaaatcatacaaattattttctctgaccataatagaataaaattagaaatcaatgcagaaaggtatttgggaaattcacaaataagtgaaaattaaacaacactcttctaaataaccagtgggtcaaaggagaaatcataagaaaacttagagcatactttgagataaatgaaaacaaagatgcaacataccaaaacatatggtaagcagctaaaacagtgcttaaagagaaatttatagctgtaaatgtctacgttaaaaaagaagatagttgtcaagtgaataacctcaccacccaccttaagataccagaaaaataagagcaaactaaaacatgcagagactgtaaataacaaagagcagaaattaataaaacagagaatagaaaaaatagagaaaatcaataaaacttaaatttgttctttgcaaaaatcaacaaaactcataaatcttcacctagggtgaccaagaataaaagagaaaatacttgaatcattaatatcagaaatggaagaggggacattactatcaaacttacaaaaataaaaaggattataaaggaatactgtttaaaaaaagctatgtgccaataaagtagatgacttagatgaaatagatacattcctagatagacacaaactactgaaactgactcaagaagaaatagaaaatctgaatcaatacataacaaataaaaagattaaattagtaattaaagaaattacctacaaagaaaatcttaggcccagatatcttcactactgaattatgtcatttaaaaaataataccaattattacaaactctttcaaacaatagaagaagaggaaacacttcccaacgcattctacgatgtcagtattattttgataccagaaccagacaaagttattacaggaaaagaaatctacagatcaatatgtctcttatagatataaacacacatatcctcaacaaaatactagcaaactcaatcaagcaacgtataaaaagacttgtactccatgaccaattaggctttattacaagattgacttaatatgcaaaaatcaatggatgtaataaaccacatcagtagagtagaaaacaaaaccacagcatcatctcaacagacgcagaaagaagattcaacaaacttgaacaccgtatcatgacagaacagtcaacaagcaagtaatagtaagaaatgttcctaagctaataaagggcatctacaaaaaatcccacagctaactttatactttaattattaaagactgaatgctttcctttaagatcaggaataagacaagaatatcagctcatgccacttctattgaacattatactggagattctagccagggaaattaggcaaaaatataaataaataaaaagcaaccagactgaaaagaaagaaggataactatctctatttgcaaatgacataaccttgtgtatagaaaattctaagaaatcactaaaaaatattagaactaataagttcagcaaggttgcagtataccaaaaatcaattatatttctataaagtggcaatgtacaattcaaaaatgatattacaaattctttttagaatagtagcataaagaataaaatggaaataaattttacaaaagaagtacaaaacttacactctgaaaaactacaaaacattgttgaaggaaatcaaataagatttaaataaatgaaaaaacatcccagacatggagcagaagacttaatattgttaggatgatgataatccctaaatagatcaatagattaaatataatccctatcagaatcccaggtaactttttggtataaattgacaaactgatcctaaaattcatataaaattttcgagggaccccaaatagccaaaagagtttttaataagaagaaccaagtaggagattttctgatttcaaaacttactgcagtgtaattgcatctacaacaatgttatgctggcataatgatagacacacagatccatgaaatagaattgaaataaaccctcaaatttgtggttgagtcttgagagggtaccaagacaattccatgggggaaagaatagtctataaaaaaatttttcagggaaatggcatatccaatgcaaaatgaagttgaacccctacctcatataagatataaaacttaaagttgtcaaagacttcaatataaaggctaaaactataaaactcttagaaggaaatataggagtgaatctttatgacctcaaatttggcaatggattcttagatataacacaaaaaagcataagcagcaataaaaaaatagaaaaattagaatttatcaaaattttaaaccttgttgcttcaaagcataccatcaggaaactgaaaagataattcacagatggggagaaaatatttgcaagtcatatatctgatgagacttgtatctagaatacataaagaattcttataactcaataataaaaagacaaccaactaaaaatatacaaaggatgctgtaaaccaatgatagggaaactttttctgtaaaaggccacatagtcaatgttttaggcttgagggccatacagtctttaacacaactactcagctttgccatggtagcataaaaacaaccatagaaaatacgtaacagataagcatggctgtgttccaacaaaattttatttataaaaccaggtggctggcctgagagtcagtttgcccactcatgccctagagcaactcttaaaaaacagaacaatgacatacagctagtaagtcaattctggagataaaatggaatctatgggcatacccagactgtgataggtacttattgcctggtataaagagagcaattaatgaatactgtttaatgaatgaacaaagaaatgaatggggcaggcagaggccaaatactgtgtatgctttcctatgtactcactttgatttgaacaaatttcctaacaccctgtgtttttggacaccttgatcgggaacttcagaaggcaaacagccgagcaagagcaagcctggtacagtatgtcagcattccagattgactgcagctgggctgaaatgcaaggtgaggacaaagaggctgcactagaaggcaaggcgaggctttttttttttttttcttctgtatctcagggataagagtaagagttcttagaaacataatcacttccaccaaagacagacctggagatgccagacacaagagaatcagtataagctaagagctacaaaggacaacagtaagctacctgaaagtaaaggaaaattgatttaggtgattcaatcaaatgatttctgatataagacacaaagggacctaggaggtttgaaaatctaaccaaatgataaatatgggaagataacgtgctctcaggttgtatctcccaagagtcattaatgttaatgtgtatttaaggctgtgtctacaagacagaggaccacagtgtgcaagacagaacattcaggctaatgggttaaggaggagatgggaatcaatcctcttgactcctgtagccaactgattcgaattttagctaaaattaagtcccaaataaaaatccctgaagtgatttatttttttccatttataatgacttattctaggcacatggagactgacaaatcaaggaggtcaaacctttctttttgcccaggcttctatgcaaaccgcctgcttgtcccttgactcagcagaggtcaggatatgaaatatgtataccattgccactgcaagcaagaactgcaacagggactgtgtaagtgttcatgtaggtctgtctataacctcagatttgtatgataactaggtcatggtgatggtgctggcagatatggggttccacaaagctcctgcagtcattgtgatggaagctgaatcaatctgtgaactatgaaagcttctcccaaaaggttccacaaaacaaataggattgagggcctactaggtaataggcactttggggacccagatacaagtcagatgtgtactctatctttaggagctcccaggacagtagaggagagaatatcctgtcccgtcccgtcccgtccagtcccgtcccatcccatcccatcccatcccagtatttcagctgacccttgaaggatagggcttgagggagtgtatcctagcacagaagaaactttgaggagaatgcccctgccctgctaccacctcaacccctgaagcctaggttacaggtaggcctctctctgataactatttcttggatatcagaaaagaatatactttggatgttttgtcccctccaaatgccatgttgaaatgtggcctccaatgttggaggtggtcgtagtggaaggtgtttgggtcatgagggtggatccctcatgaatggttttgtgctgtccttgtgataacaattgagttctcactttattagttcccatgagatctggttatttaaaagagcctggcaccatcttcccattgctctctcccttgccatgtgatacgcaggctcccccgccccttctgctatgactgtaagcttcctgaggcctcatcagaagccgaacagatgctggttccatgttcgtacagcctgcagacccttgagccaaataaagcccttttctttataaattaccgtcttaggtatcacttatagcaatgcaaatggacaatcaacctcagatttgtatgataacgaggtcatttatttaatgattaaacttggtcagtctccacattgtccctgactcatgctatggcactaattgtggtacaaactggccatgttcctataattccattttctccccttgacaacttgaccctaagcaatggataacccaatggtaaactagatgtagccttttcctttttttttttttttttaaaccgatggatccattgcgcatcaattgatctggagtgattcatctaaacatttgtctaaacatgtgcttcaccccctgtcttcactgctcagtgaagtgggggtgagtaagcactagataatacattcagaaaccttagttctaactccagctctcatacttactagctatgagctattgatcatttccctgctctgggtttccttatctgtatgagcaggaaatagatagtcaataagatccttcccagctgtaccatctatgatttcacacaattaacaaaaaagtcctctttataggacccttagagataatccctatttatttccaaagtgaccaggcaaagtttaacaataactaggggctgttatgacactattgaacccatagtagggacttcaggatgccccctgtgaatactctttgatcagccaagtgattgtttctcaggcccttttggtctgcagcagtgcttctcaaactttagcatgcatagaagtggacaggagaattttgttaaaatgcagattctgattcattagtgtagggtggggctggagagtctgtatttctaacaagctcccagacaagacggatgttgaccacactttaggtggcaagtttctagagggttttgaggaggaaacatgaggccattaggaggcttgatactatatctgagagaataccaaattgttccccccaagtgcttacctcgaggccttgctgaagtgcctaataagtgtttgctcactgattgataaactttgctcttttgctaaaggctggaagaaaatgtatctctttcctctttaatcactgagggcaatatagcccaaatagcatcccctgctagactttgccattgcagcatgaaaatatgtaacaggtaagcatggctgtgttccaataaaatttacaaaaccaggtggctggcctgggagtcatagtttgtcaacttaaaaaaaaaaaaatgaaatgatgaggtacagctaataagtcaattctggaaggaaaatggaatctatgggtatgggtatacccagactataataggaacttatttcctggcataaaaaggcaattaatggatactgtttaatgaatgaacaaataaatgaacaaaagaaatatcacatccatcctgtctgcaattaagactttctggatctcttaggcccggcttaatggaatatctacaagatattttaaaactcagagtttttttgcaccaatctctcaagagttggaaccagtcaatgtgctttgtaaagtactgaaaaggcaaagcatggagaaggggatgcttgcttgtgcctggagttttatacaggatgctttccatatcatttcaccacttgcacctgtaccagaatatttacggtattatccttggttggaaagggaatgcataaaatttttaactgaatattttaagaaactaactcctaatctcaatcttatatatctatatgatacactccaagtgggcatattgtcctttggatggaagagcataatgacctaatgcaaatgagacggaggctagggtagtatgttgaggatagttcattccttttctgaaagatgagaaagtagaattagtcccggggcccactcccacgcctgctttgtctcctgggaatatcaaattcatattgattgttctctgatgcataatttgcatggctaaaatggaaacacgttcatcaatttaagccctggcttgccataatgtgttcctttttgaatacagtgtacattacttggaagcaacactagttgcatcataaatatttcagctgccagtgtttgggacttgtttctttgacctggctgtaagtcagtcaataagtaataacaatggtttggtctttagagtttgaggagtactgacaatctacatgattaaaattcataagataagtttttatcaaaataacacttcaccaacaaaggaaaggcattgatcagcccccaacatgtataataaccactttcaatggaggctcgcctttcaattctaatggacattgctgagctcagggttgaatgatgaggccattgtgcctttttccattaggtccatggggaatccatttgcaagagaacagtcaattttggatcacagatcattagaactggaaggaataatagaaatcttctagctcaaagctgtcatttcatagataaggaaactgaaattcagagaattgaactgatttgcccaaggttacacaattatttaaagcactcagatctcctggttgttaggtcagggctgttcatgaatgcagctgacccatatcaagcaaagcccttgggacctctcagtttagcagtccattacccctcctaccagtgtatttttgggtctttacccaaaacgcggtggaaatgagctaaccaaacgaaggaagcaaagagtctctactacttgtcattcattcattaaacaaaacagacattgagcctactatgtggcaagtatttaaataattaaattccccaggaaccatgaaccctcctactggaacttcaaaactcatctctcaacagtctcctaggagtcttcagcaccatccaggttgttctctgctgagtctacctcaagagtaatgcctatatgcctctgtcagaggcagccctgccagatgccaccaacaagaggataaaactgagcacttcgtaagattaaaaaaaaagtttgaacatgcaggtgcaatgccaggtgctttcatatccacgttctcatctagttttggcagcaacacagtcaaatattaccccctctcccaatctttttcctgaaaacataaaaatacagaagtttgggaaaattttatgaagtcaattcaaggtcacggtggtttaaaaaaaaaaaaagctagagctaagatttgaatacaggtatgtttaacaccaaaagcaacacaagcttctcccttatgccaatatgactgaggaactgtgacaagagcagccagctagacagacctgggtaactctgacccttaaagaagtaacagtggagtccatttggtcaccttacctcccacttgttaactacgtaattttccacctttgtcttaaggatttttatttttctgtataagacatggctttcataatgctaagatttggtttgagtataactttggtcgaaaaaatgataggaagaagcaaagaaggcactgtaagcacatctggagaacttttcctggaaatgaaagaaaaaggcaagatacaaatattataaaaccattgggaagactggaactccttagaaattccagtatcaagcaaatgatactggaatttaagtatcattccagtatcattttaagatttgggtctttacccaaaacacagtggaaatgagctaaccaataaaggaaacaaagagtctctactacttggcattcattcattaaataaaatagatattgagcctaccgtgtgccatgtattcaaatacttcaattccccaggaaccttactgataaaattcttactgataaatgtcagctgatattgccacatgctcctgtctgagaaaggcacggtgcactggcagaggggaggcaagaacccttgagagcgggaaccccctgcttcctaatcacttcccagttctctctgcctattccccaggggactggttttataacgtcatcatctttaagccaatacctttgcatcaaattattacctccaaactcttctcctacatcattttcattagcccctttaaattaatctgattcaactgaagctattaacagagagacagcaggtatcaagagttcatcttctactgggtatcatgaggcctttgagaaaagcccctttcaacagaggccagtttttttgctatcatattgatgttcgctcatcagctgataactctctcttagcccatcaagtttggcttttaatggcccaatcgtatctgtgaccacaattcaatttccactctgcacttgtggttccttgatacctcggaattctttaaacctgcttgattagccaccagagataaatggcttagtcattttaaagttttatggaacatctgtgcactgtgatcacagaccagccagaggagaaaatggctctggaatccttcccctcaaaccacttagggagcacaggcccgaagatctgtatgacatggaactcagcaggagtgacagaggtagtgaggggtgccaaaagaggtcaaatctacaaccagtcccaggatttgattcaagtggtgccctttaagggaatcaaatggtgttggtgttttctcggccaaccatgtgatgctgccttctaatggtggcctcttagaagcggaaatcactcgatccattttagttcttccagagctcttggggagtcttggaggacatgtgaacactctacagcctcccaacttctttccccctttatgtttctccttccttcctcatttttctccctcccttctttcttctgtctcttagatatgctgagtacatctatttttgaacccccacgtgggcccatgtttctccagagaatctgttggtttgaacatacgtaatgtgagaaataaaagagcagcttctgacattcagaagctggcctgactcacaggtaggccatgtgattctcccattagacacagaatgcagaataccaagttcagacaaggcttgtctgagatcttgataaaatgagacaaagcgaggccacttctaagtacagacaaagataagatcactgtgttacctccaaaatgccaaacatcttctcttgaccaaaatgagttactcctgcttctttaccaaatacagctttatcctcattctagtctttcttctcaatggaggtttattgagataaacaattatagaattgctgctacctaatgacaccatccaattcagagcaaagtcctgcttccctaagccccacctcaaattacccaacaaagcccaaattccataataggttctttctaacaccctcttactgagacactctacatgtttattcttcatgctacaattagtaatcaaccaaacttgtttaactatagattatctttggtggtctctggctgaagggcatagacaagcggcaaaactaactcagattcaaacagtcatttatattttgaaaagcttttatacccattattttattcaatcttcataacaccaccaatgaggaagacctgcaggtattattatattaatactcattttccagattaggaatttgctgcaaatggttgaaggctattctcccagattccacctgaccttcagagggctgcctttaggaatatgtaggcggagctaagaagttccactagtgtctgccatccatttctgatcaaagaacacgaagcaaataccttagactgacattattttattcaatcttcataacaccaccaatgaggaagacctgcaggtattatcatattaatactcattttccagattaggaaactgaggctcagtgtagttagatgtaagttcaaagttcaaacatcttataagtattagagtttgaaccaggtcatcttgttccatatacagtgttttgttcacatgagctggtcatagaagaaaaatgtcccatagctatttgttatttagtgctgcactaattggagattgcaggtgagaagggaataagactggtagcaggcaccatgacataggaaaaacctggaatatctttcagaagcatcaattttaatcaaattattttgagaagacaagtttaatatttttttaaagcatgagattcaaacattttaaaattcaaacaaaactcaaagaaatgttcaaatagaaagcaaagaaatttgcagtaatttgctgccaatggttgaaggctactctcccagatcccacctgaccttcagagggctgccttcaggaatatgtaggtggagctaagaagttccactagtgtctgccatccatttctgatcaaagaacatgaagcaaataccttagactgacattctggctgtcttgctggggtgctgagagcaaacctgtcctcagggccatgagggtcaatggagtaggttacaatatcccccagcgctcctactgatttggggaggagagcactgtgggcttgttctattatagatgccagttcttccctagggctccaggggccacccatctttctggagcttggctatctccagaccagccctgcctgtgggactccaagccagaatctgactcctctgtagcccagatattgttgctgagagaactggtgttggctccaggtcatttcaaaattcaacatttacctcgaggacatctgcaagtcctgagagtacacaggtccttaggaacttgaaatctgaccacctatcaagcttagaaaaggcacagtctcttctcacatctggaattcatctggactccagggtttctagtactgaaacaacatgtagctgctttaaatagaacaggtgacaattgtcaaggactgcctgagctgacaaattatgtattctcatattattttaaaatgtaaagcacaaacgtgggtataaactccttatgcttatagctcttacttgactattaaaaccaaacaaaaataattcaataattaataaaaaataaatataaatgtataaaaccatactgtttaaattaacacatcaattcaatgcgatggaaggtgctatttgctgaaacaatatcgctgctcacaggacagacagatagagaatagacggctcctactcaggttctataatggattatattatgtcctccaaaaagatgtgttgaaatcctaactcctggcacctgtgaatgtgaccacatatagggtctctgcagatgtaatcaaattaaggtgaggtcattagggtgggccctgatccaacgggactggtgttcttgttaaaaaaaaaaaaaaaaaaaaggatgggagatacgtgcagagagaaggccatgtcaggccagaagcagaagtgggagggatgtggctgcaaggaatgccaaagactgacggccaccaccagaagctaggaagtggtaaggattctacccagagtctcagagagaacatggcctggctgacaccttgattttgaatgtctagcctccagaactttgagtgaataagccatccattctagcaatcatggaaaactaatacacatctttggccgggcatggtggctcacgcctgtaatcccagcactttgggaggccaaggcaggaggatcacctgagatcaggagttcgagaccagcctggccaacatggtgaaaccccgtctctactaaagaaaaaaaaaaattagccggacgtactggtgagtgtctgtaatcccagctattcgggaggctgaggcaggagaatcacttgaacctgggaggtggaggttgcagtgagccgagatcgtgccattgcactccagcctgggtgacagatcaagactccatctcaaaaacaaaaacaaaaaaaaccactaatacacatcttttcagatgattgatatgcccatgttacgtaggttacgtgatgaatcaattttttttttttttttttgagacggagtctctgttgccaagtagctggagtgcagtggtgcgatctccgctcactataatctctgcctcctgggttcaagcaattctcctgcctcagcctcctgagtagctgggattacaggcatctgccaccacacccagctaatttttgtatttttagtagagacagggtttcaccatgttggccaggctggtctcaaacacccaacctcaggtgatccgcctgccttggcctcccaaagtgctgggattacaggcataagccacagtgcctggctgatgaatcaattcttctaagagtttttggtatgcaactgctgcaaacccttctcttgtcagggtcccctgcaatcatttgaccttcaagggcatgaacccttgacaagtctaccttgcttctgtctttaagtctgataactattaaagcaccactctttgatgccaaagtgatccagaacacaagcgcaaaggtagaggcaaaaatgactttcttttagattatcatcaatatgagatcatttaaattatcatagagaactcacagatccttgtgtatggactctgatttgaggggcaagaacatcagattttgtccatttctcgctccctcttgcctttcctgactcctgtgtgcctccaggctctggctggccaagtctccggcttcaatagccaacttggacttggacttcccatcacactcaacccagtttgtccctgcaggccgggtctggccatcaggctccagcattgctcacctgaacactgtaagaggtagtgctggcacgccctgctcaggggcagaacctactctagatctgtctatgtcaacttcagagccaacaagaatacagcacatctgcttgggcccctgtgaagagcatagagcaggggtctccctgtgtacctcacaaaggaactcaaaggcagagtgccattaaaaccatttggcaatcaatcactttaggtgcctctgggggaatcacagagtgggcattagcctgctagggctcggtgtcactgtaagggatggtgtctcccttagcagggcagggcccgccctggctgggggacatgtaggaatggggcaggcatgcaggggccatgaaggcctgactggcaggttgtgggtgcctgggtaccagggaagctcttgatcagtgctcatctgggatccctgagtctggggaagctgaagaggtgatggagcacttgtagggcttggagaaatggctatttttcaattgatctggaaatatgtcaatgttttaataaccagcatgattgtagctgtgtataccaccttaacatctgccctggggtaacaaccataaaagggccaattacctgcttccaagaagtgctttggaaggggctggacatttctcaagactttgatttgggcattacagttgcattgagactaaggagcaacaatgtctttccaaattggcaggaacaggactatccactgttcctctgcagcccaggaatgttcctctgcagcccaggaatgcccctctgctgcattcatctggcccattgtgagaagagtaaaaagttatgatcataggaaagaaaacaactttcagttatgttgtcttgtagaggcacaaatcatttccaaacaagctaaattaacactaattgagaagcagatgtccaaatccttctctagagctcgctggtttcatcattaaaatcttcacaggaagcaggctcataggtgcaccgaagtgcacccaagaccactaatgacaaacccatatcctgcctaccctctggtctccggcagccattctcttccactccattataatcctcgtgataatgacacttgaccggtaaaaagagcatctgttgggagaatgcactgaatccaaaaaccttatggtactaggagatttggggtgttaattacacaaattgcccatcaactctattgttactttctttcctctgataaattaaaaaaaaaaaaatgttgagacttctgagcatgaatgcggttgggccagaagtttgcctataaacatggatgggaatccttgctccttcacaatatccataaccacagagctctggacagtaggctttgaggcagtgtgggatggagggaagtgcactgtctgagagtattggtaagtgagactgggtttgattccagctctgccacaatgacctggcgatcttcaatattctcccttgagtcttgggtactctcccttagcctttctgagcctctgctttttcactggtaaaaatggggatgtagtacacgttttccaggcctggttggtgtcaggatgcataaaataatgagagtaaaagcacacctagatcctaagcatgtgggaagggtacgcacctaaaaaccttatgcttaacagtgaaatgaactttcgactgggcactaggagatctgggattttagtcctgatttctttgttgtgagaacttggacaagccccttaagtttctgggtttcaattttttaatttgtaaaaacatagtgttagacaaatgattctcaatgtcccttccaggtcgaagatctctgattctaacttgaaacctgaaagggacaaagcgtgactctaccactgggtaaggttaattgccacatggtggctacagtgtgatgaagttgcagggggtctgggagcacgtcctgtgtgtcctgctcaaaggatgactgtggaacagagaatgaaggcatcagccttgggtgacactagacatttgagggcgtcctttcccatccctgtggcatttttaactaaactttcgcttcttgcacttctcctctttctccttgtttgcctctgtagtgtcacaggttacttaagggtctatgcctgctgcctgaaccctgaagaccaggctgtgagccaaggccatggtgcctgccagggagcaggtgtccctgagaatgcaaacctcccagagagtatctgagaaccaatgaggaaaacagttccattgcatacatacagtaggcaaagagccagaaaattagcttaaaagcagcttagagatgggaggcgggctggatctttagagctgttctgctgccgcccaggagtgccccgtatgtaaggccaaataaactcatctacttgccaccgagtctttctttggtcttttggctcccttccagtttgggggaagggtttgtttgtttaatacaattctgggtttttctccttacagcctctgccctcctttgcccgctggctttgcttcttgctcccaatttctcaccccttagggtgcaggcctcctgggagactgactgaggccctcaggatggttggaaaggggctagtctcctgaaattaacccaccactggctcactcaccctttcacaggttgtgggcataaactgagaataactggagctcagggcccatttagtagtggtgaaagcaattgatggtgaatcaggaaggaagaggaggctgacgtgtagccttataaatacaggaagtccttatgccccaggcactctgagaggcttgagctcactgatagtcatgctaataataacttcaaacgtacctaggatgtttcttctgaagggcattctgcgttctccaggttgtaattttatttcttttcctactgtttctaccagattgctcttgttacgcccaatttgcaaaaggagaaactgagtcacagaaagtcatatgaattggcattggttctactgttttctcaaatgttcacataaaataaactacagtagagagcaacgtgattgccattggaatgtttatttagtctgccagaacagtcctacgtggggaggcttttgggggtaggacagagagtgaatcgggagctccatttatgaactctcccctcttctcttttattgcttggcttgaggtggttgagggttatgggcaggaacatgaaggaaactgaagaatgtggaatgatactggctggtgcaagatgcagggcaggcaggtggccaagtctgggcaaaccaaaggtcacactgatgtaaaggacctgccccgtgggtgctcactgggcatcatgaaatgttgggagctaggtcagcccaaggctgcctgatttggaagctcttttgcaaatgaacagatgaggattgaacaaaggaggagtgggtgcccaggagacaacagaggactgggcaagaactcccagggctgcgttatgacttttgggggccctgggtgcttttgccattatgggatcctttatacaaaaaaaattaaaaattctgttttacaattgcatcagtaattgagataaatatattaatagcatatattaatgcatacaaagtatattaatgtcatatatttaaaccattttattaaactcaaaagttcatttttttcttctgatttttcaagaaattaaaaagtttccttgggctcctaaaagtactgtggccctaggcactgtgcattcctctttctcatgaataagtcggccctggaagtctcctctgcatcctagggctgctggttatagtagctgactccttggtcctgcccatgcctgtccacatacaggcttacccaaatttacaggattagtcttagagcatcagtttgggcatctaggggttacaggtgcgtgactgaagacactcaatatcagagaggccaaggccaagttatcaaagataaaggagccaggatttgaactcagctctgactgcttccaaagcccatttggatttgactcctacttcccattgtgtgtctcccctgagcctctgctgaaaaggtcctgggtccttggtccaaaatctggcctgacctgcacttgaaccctttctatatagcttagcaaatatggaaattaataattaggcagaggtgggccagtgatagatcacagggagaaaagtctaaaaataaatttcacacaatgcaatgaaaaaggtcccatggagatgcacggagaagaaaagaaatcatccccagaggattaatgttctagtaaactataagctgcttatattttcaccccattaccataactttcaaataactgtctcaaactataaaaagacaattacttagggccagatgcatcacaggctgggtaacgctcttccagagccaatagggggttccctcacatcgcttcccagtggcagtgtggtgtctgaagaggagatgctggattaatagtaaataagggctgggcatggtggctcatgcttataatcccagcacttcgggaggccgaggggggtggatcacctgaggacctgagatcaggagtttgagaccagcctgaacaacatggtgaaactctgtctctactaaaaatacaaaaaattagccgggtgtggtggcagatgcctgtagtcccagttacttgggaggctgaggcagtagaatcacttgaaacggggaggtggaagtggcagtgagcagacactgcaccattgcactccagcgtgggcaacaagagtgaagcgctggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaagtgaagcgctgtctcaaaaaaacaaacaaaataaaacaaaacaaacaacaaaaaaaatgaagaaaacacaacaaccagcaaatagggacattttacctcttctcaaggcaactctggatcaattctcagagcaacaaggctctgaggtccatgaggcctggatttggaattgtcttaggtttgcatgttggcaggactatttaccaggctataactaggcaatccacttgacccctccgatccccttgtagaaaagttcttaacaatcctagccctaccaagtacacaggtttttgtgagacttaaataagagatataactgggatttgtcaactactagcactatccagacacttgaaacttgaccctgcccccaaagagttccctgttctcagactttactgtgtctattgacccctggatacactaaatctgggttgtcggagcttcttaaaaactgattcttggctcttccgccaccactgccaagatctccaagctgagctgctatacaatggcagtagattacactaatttgttttattttatttgacatacttggaattaaggctttttgaaagcactatgcaaatgtatgtaaatgaccacatttcatgaaaaatagtgtgcaaatagtgtccctgtgttggcttagaaaaatctggtggccaaaggctgtctgtatcttcacaagaatcaggaagaagagtttaaactttagttacccttccagctgttttataaaatgcagatgctggggaagctagagtttagtgtgtggtttatgagctgtgtgcttaatattcttttccagtcttcatcagggtatttgatatcatttaagcagagtgtttcattcattaatcacttaaaactgatggtgccaggcacttactcactggaagaggagtaaggaaccaaccctcccctaaggacctccttggcaatgtggccaccagagtcagctgtaaacgcagctggggcctcgtctcctggcaaacacgtgggtggaggtggatgccattttgaattaagtccagatacctgatggaggcactcaagaccctccacaatctacccccagctgaccttccagccagagtctcctcccctacccgtctccattattcattagcactgcccatcatgatttcttgcagaaatctctctggcaggtacagcagcacctgggcagggagagttgagactaaaccatcacagtatctgggtaagacgcggacagagagtccacgcagaacaggcctactggcatgtggtgcttttgtcagatggggaaattattttgagcagcacagcaaggagtggctttaggagggaaaaaaaaaatctcgtgtttattataactcagtccaagatgattgccccaatgtgcaaaatagaataaaattggtcctggacttctgagcacgcataaaagataagaacatggagtcaggccccatccttctctccacagtcagcttctattaggagatgacatgattcaatagcacctttcatagaaagagagtggctgggggagaggtggaggggtttcactttgagctcagatggccgcttcacacctcaggttcaatggcacaggccctccaggtagctcctggctttgtttcctaaccagaaacccacgcacacatcttgtctttgggatggggtggggtccttactactctcaacttttcccaatctctttgctgctcaaatatgtgtgagtttttcggcaaaatttattgcttaatgggggtggggtggggagaaagggatgttgcctttgttgcagtttcacaattggtgtagtgaaagggtgaacaaaaactgataaggagtcaaaactatctttttaaatgacaaaggacagtaacattcttggttttttgcattattgttttcttcataaatttaaggccagatgcagcaatttatggtctattattctttcctgtggcgcttgctaaaatatttcaaagctataccatactgactttttttccttttgtatttcactgctaacggacacagttcgaatcaaatctctaacaaagagagaagtctcagagcctgcttgtgtgctgaaactgctggaaacctttttgattttccagggagccacagatggtgcaggagtttctgcagcccacagacttaatatacgcagtaatttaggagggaggctggcttcgtttggccagtaatgtgagttcatttgcaattctcttctcttcttaatagacttgaacctgagtgttgaaattcagaaaagggggtgtgtgcctcatgggcgtgttaaaccagagggtgtgtgctctctctctacactctggggaagggaagcctggccatgcaacattttttacagctgcatttgcacaggttgggaaataacagtgtcatcctggaacagcagacactgatatatgtgtttggggacatctatagagcacagtgaatcatgcaacatacgagtcagccccactataagtcaatccaccgttcccaccaaaagctccatgggtaaacggagaggctgccttcagattactttggaagatgaaaaatatccccatatatattcagaccaataaagcagccatgcaggtgaataaaaacaaatcctgaaagtacagagtctcaaggttggaagaaaccttaaaagtgtccagaccggtcacccctccaaatgtctgcacctgaatcctcttagaaaatctttatttattctccttcagtttctggtttaaaccctgtccatgaaggggatctcgctgcttcccccaaggcagctgactcatctcaacctctcagtgactgggctgctaaaacaaaaacaaaacccctctactttacattattaaaatcatgacatccactgcttgattctcatttcatccagtattgcacaaaggccataaacaatctttctttgcatgacaatcttccaatagctgcaggtagctgtcttgccatgccatatcatatgatttatttatttgttcattcattaggtgaacatatattaagcagctactaagtgccagaaaccagagactagggatataagatggataagatatggaatgtgctctcacaatatagtatggtaccggacacaagtcaactaatctgaattttctatggtgagtgaaagcctaaacaatgtcctctgggggtctacaggaaagcacgttcattgcctagtgggtgggtaagtgagtggaagcagagaaggcttcccaaggtggtggcgttgatcttggacattgagggctgcatatttcctaacttttcttcaaactgcttggcaaattcatcactaggagacttgcatgttggtgtctgcccagctgctgtgttggggcctccattaatgtgggctctgacagtcacaacagtttggtgcatttccattcacagttcagatccatcttacttcacctgggcatgcaacttggaacaggaaagcccctgggaggggccagggcccccaagggtctgtctgtagaagctgagggcttacggatgtttgttctgtcccccatcgcctccctacaggaactgtctgtgcagaggaggctcttatctcagaacccccatctgttctgtagaggcatggattgccaaaggaaatgttgaggctcaagcattttgtctgaaatgtgacataattggagaaaggggctgtgttaaattgtaaaagctctttacttgtgtgaaattggaggaaaggtctgcaattatcactgtctggactccccagttacctgtgaattgggaacataggtcttgaagatgggctaatggaatggctgcttgtttgtgctgatcatgtgtgggcacatggcattggaggaataggaagacaaagtgtcaaagttggaagtggataatagcaagcaaaacacaaagggcaaaggggaaaatgctgtccccttcctgctccctccttgacagtagggctcctgtgaccgcagggaaagaacatcagtatcaccaaaccttccttcacctacctttacctaccttctctgagcccatgcagcgaacaatagaaacacatgggacgccaggttctgagaccgaggttcaaaaccgctcagatgttcatgtatgcttctgaggattccacataaacactctgagacttgctcatcttgtctgtcaagtggctttggtaatgatgccaattcagagggtttttagaacatttgcggtcccaattgggccagccctctaattgtaccagggctaactaggacaattccagggcacagggctgagccctgtagggttcagagaagtgactgcaacaaggtctttgccctcagagtttttggttgtgtggggcagacagggcaaagaaaaacaaacgccaatataagggatacatagacagagggtagatagattaagctctggaaatcagcacttggggaaaaagaaaaaatgaagggtaattctttaagcctattttaagtggataaaataaaaaattataaatggaaaaaatatgttacagttctcttaagtctactgattcatggaggtgagagaaaaaggcataatgagagaggaacaattttcatgtttgcaggactatggcctataaataatgagaagaggaacctgttagcttgaggttagaaagctgaaaaggaaaagaggttgggcattgtttctcaggcgcctttcctcagatcactgactaccctaatcatagtgcattcctgttaaaaaacagattcctaggccccatccctgacatatgaagtgagagtccgtgggggcggggctcaggactccacattttaataagctgctcgaggtgacttttatgagccctaaagtttacaaaaccctgatttgtgtaaataaacacacacaaagagtgcctgtttttcaacgagcttaattacatcctgtgggtctgatgtttgcttgctataaagagtaagtggtgtgttttctaatctcaggtttatttctgaatgttatatttcaagcagcctgtcttcttgtgcttgagaatgctttcaggtttcagaaaaatagatgctggaagaggaatgacctcacacctgctctactgcaaatagatttcccaccctttctctgcagtccatctccccagccatcatccacttcatatgctgcacactgaccaatctttcttaagcacaacttcaataatgttactcctttggtaagagccatccacagctcccccactgcctctgggataaagataaaactctttagcttggctccaaggcccttcacactctatcgccctccttcctgctaaaatctccctttcacattctcctacacacacacaaccaaactgcagccaacctacactacttgctatcctcatcttgtacttgctgtcttcgaaaacctcagctcatatcaaacttccattggacataacttcctcctctcaacccaaaagaatcttacctagacatttaacccctgcttctccaggaagcctcttttgatctcctgtcagtgccgcatccaaatccgacagcaatttttctgtgccatgcccgtgattcttaatatgagctgtctggtactatgtttatttgcatatttgtctcctaaacttgaagttcctggagaataagggccataactcattcaactttgcgtatcccctagaaactaacataataaatgacctccagaaaacacacgcagccacgctgtccagtggacgttattgccatgatgaatttgttctatagctgtgttgtcgaatagggcagccgctagcctcagagtgactagtggaccctcaaagtgtggctactgtgactgaggaaccgaactttaaaatgtttatttgatttcaatcaataacaatttaaatataagtagctgacatggctagtgactaccctattggacagcacagttgagaatatatttaacgaaggaggttgcactgtgcttcgaaaacgtccccactctctaccccacttacagacgtcacttgatttggttcttcctacttcctcctccttgtcttctacacttggccccttactccctgcactccagccatgcctggctgatttccttttctccaacaggcctggcttgttctggcttcaaggcttttgctgttgtatgctttgcctagagtgtgtttctcttagatctcactcaagttttttttgtttttttttttttttttttcttcattcaggactcagcttaaatgtcccgtctttagagaggacttccttgatgtgccctctaaagtagacctctttgctctcacttcaccctcttacactttctttataacgctttcattaaagtcatctcatttatttcgttacttcttcattgtctaactcctaataaaaggtaagcttcttgagtaaggaagtgctcaaaaacaatgcataataaaatcaatggaggaaagcatgatgagaaacaggatatttatatagtctcaaagtatctccccataagatactaattaattataatggagaaaacagaaactttagtacagaagagaaaaccatcagttgccacctctccacacgttaacttcaagtgtaaccgacgactaacatcaccagttacaagacattttgacatgagatgcccacttgatatgatgcactgagaaggatccatcacttctggggtctcctctccataatgtagaacctcagtctactcagaagaaaaggttagacacatgcaaattgagtgacgttgtaccaaatacctggcgattctattcagaagtgtcaaggtcatgaaagatgcattcagattgaagaactgtcatacatgggaggaaaataagcagatacgataattaaatgcaatgcaggaaacgggattggctcctgaactggaaaaatgagtaggaaaactggcaacaatctaataagatctgtaggatagctaagagaattgtatcaatgttgattttctgttttcagtaattatgttttagttagataagatgttggcataaggtgaagttaggtgatgggtttatagaaactctgtactgtttttgcaactcttatttaaatatcaaactatctcaaaacaattctttttttctgagacagagtctcagtctgttgcccagggtagagtgcaatggcatgagcatagctcactgcagcctcaatctcccaggctcaagccatcctcccacctcaccttttgagtagctgggactacaagtgtgcaccaacatgcctggcaatttttttttttaattttttggtagagacgagttctcactatgttgctcaggctggtcttgaactcctaaactcaagcagtcctcctgccttggtctcctaaagtgctggaattttaggcatgagccaccggacctggcctaaaataaaaagtttcttttttttgaaaaaaatacaagtttcttgagggcaagggcttatctgccttgtgctagaacagtacctgctacatagtagatattaaatatttatttgtgaatgacaggaagactgagaatgaagaaggaaagatggaataggagaaaagaggagctgataaaggaaaagagaaagaaaaagaggaagggaagacgatatggagcaagtgtgaggagaaggactgcacagttttgggaaaatttgaggtatcccttgaagaagatgtgaaacagaacaggcctgttaaggacctcagagaaaaggctcactcacagcatccagcataccccagggacacacaaaagcatggagatctcacattctagatgtttgattgagttcaatttaattcaagtagttaataacttggattaaatgcaatagttggattaacacacgcagtgctcccccaaaagagttctccagcttttggtgggcaggttaataactttggctaccggatggaactgtcacagtctaaggcctgggtcctgagggcttgcatatgtgagtctctacagactgctagaaattggagcaagactaattcagtaaaatagggcccattcttggatgacctatagaattgaatttattttcaactgtgggatatagaaaatcatacacatccctcagtatttctgggggattggttccaggacccccctgtggataccaaaattcaagaatgctcaagtcttttatatgaagtagtataatatttgcatataacctacacatatctttccatatactttaaatcatctccagattacttacaatacctaatacaatgtaagtgctaggtaaacagctgtgatgctatattttaatttgtattattttctatgttgtattgttactttttatttttttcctagtagttttgatcctcagttggttgaatccacaaatgcagaacccacagacacgaagatctgattgtatatgctgtgctgtcttccaaatctaaggagacaagaagggctcaaaatttggggtgtctttccagtagaaagaatgaaattgcattgatgaatattattttaattctatatatcaattgctaatcatatgcctatataataggcacaaaccaaaacaaaaaaccaaaaaccttaattttgagatagttttatatttaaataaaagttgcaaaaatagtacagagagttcctataaacccatcacctagtacataagtgcctatatactgggcacataattggcaattgatacatatagttaaaattatatactattaaagttatatactattaaaattaaagttctatactcccttagttgttcaaataaaagtcctatgcggttagtttcatgtacctgcttcacagatgaggaagcgggctcagagaagaaaatcactggccctaatttacacaatagggccatgaagccagaaactcaaatctagctctctctcattccgagctcttgaaaagggtcctagacgtcatctaatccagctcttcacttcttcgccccatctttcatgtctatttcataatagacatttgcagaagagagagacgagactttaagaggaaagggtcctggtcctggtctctttcacaaggtgtggcagcaggaggtggcgggaacagtgtgaagagagcccagagggactgtcagcagactggagtcctgcctttgtctcatattatttcagtggaatcaatgaaggcatttgccttttctgagccttagctgtgtcatctgtcagatgacgaagacatgaaaaccctctcctaccctgggagagcagcaaggtggggcctgtggtctgatcagcttggagacttctgctgtcctgtgtgcgggggacagaaatggatgttgtttaactggctgaaacgctgtgccatgctaattacatcaacctcacaatcctctcttttttccctccgtcttcttttcactgcttctatttctgtctctttttctctctttcactgtcagttttcaaataaggactgttttgttagctccacaatcaaaatgatctaattggctgcagaagggaacaagcacaatatccccagggggaaccttcctccggatgcaagaaagaaaaggtcaaaaaccacttgactgactaagagaagtaagagaaatgggaattcaaaagcttctatttataactgcacagactgaagttctgggctgtgcccttgactgggcaattatgttgcagagactgcctttccatctttgggtggctcttgaaaaagagaactgacacaaccaggctcttctcttacacagactctctactctgtggttttcccgaggtccctgcactcctagcattgtgggggtgcaaggaacacagccataagtttgaggccaaagagctctagattaaaactgagcctggtgggaataccactttatatccattaggatgcctattatcaataaacaacaacaacaatgtccagaaaataatgagagtagtgagtgggtaaggtggaggagaaattggaaccctcgtgcattgctgctgggaatgtaaaatggtgcaggggctgtggaaaacagtttggtggttcctcaaaaagttaaacatagaattgtcgtatgctccagcaattctactcctgggcatatactggagagaattgaaagcagggagtcaaatagatatttgtacacccacgttcatggcagccaaagtagccaaaaagtagaaacaacctgtgtccattgacagatgaatgattacacaaaatgtggcacgcacacacacaatgtaatattattcagccttaaagaggaaaaaaaatttgacacacactccgagatggataaacctttaagacatgagaagtgaaataagccagtcacaaaaagacaaatattgtatgataccacttacatgaggtatgtagagtagtcaaattcatagagatagaaagtagaatgctggttgccaggggctagagggagaatgaggacttattgctcaactggtacagaattacagttttcaagatgaaaaacattctggagttggatggcagtaatgattgcacaataatatgaatatacttaatgtccctgaactgtacccttaaaatggttaaatggtaaattttatgttatatgtattttaccataataaaaaatgggaatattaccacctagattgtggggttatttttgaggattaaattagatgtcacatgtgaaatatctagaataatgctccatctcctaatagttgctcaacgtgtactggtttctttctttacagagaatatacaatttatacagagtgtgcccttgccttctcagttaggggagaataactgaaaagtggccacgcacataaagacaaaatagaacgacatttctactgcaagatgaccacactcaaagaagaaagaaagtaatcacaagccagtctggagaccctgctttctccattgtatgccttaaaaacaaacagcttcttgcagcacactgaaagcagaaaggcaccgtggtaactttctcttgagtttaaaacagaaggggagatgtacctctctgggtctgaaaagtgaagggagtatccttccttacctacttagtccactaggccagctaacacttcagcattggctcgattgaaatgtaggagctggaatcttacccacctggctgaatggtgtttctgggtggtgagtcactgcatctgcccatctatgctcaggtgaacttcagaaataaggtgaagaagtaaaccggaagggatgagcctcggttaggagtagggagggcttcagctgctgctgggaaatgggctttcaggggataattccaaacagtacttctctaaggcttcttccagatcatttgcagtgcatctatggcctctgtgtatggacaggtttccatctgcaggtctcaggggaactcttcctgcaggagcccaggtgaggccctgaaccctattgtacacttgtctaggtctgggcgtgactctttgtcttcttacattgctccttctcagatggtgccttcaaacaacactatgaatcagggagcttgggttcagatcacgttttcaaacctgtcacatctacatatagagataaataaaaccaataacagtggtttatcaagagtctactatttgtcagactgtactgggtgttttacatacattatttcattcacttcccacaataatcctttgatgtcggtattatgatttccttctcatggatgaggaaactgatgtttagagaggttaggtgccttgtacaaggtactaaaacaaaaaaatccttcacacatacttttctcctgtccagccacagtctttcagcatcttgaaagtactatcatcaatactttaggaagtcaggaaggtctcagatgctactctcaccaatagcctttgtgaaagcttaccggtgtgcttagcttataggaaaaaaagactctaagaatgacaaatggagacatgtaatctactttttaaacctataatcgtgtttaacatgtgactcccacagtgttttacaatgtgtatacatatacatacatgcacacatacatgtacacacacatagctatgtaaacttaaacgtatatgcttgggtatacatttgtttacatttgacaatcatttcaggtacagttatgtaacttgggacacacagcctggaataatcatccataacttgattaatttgcttcaaaatcaaccaggaaaacatctgctcagtcacacccggggacttagcttcagagacgctatgttgtaatattacatagaactttgaagcattccattaagcgtttatagtaatttatcatctgcactttccaatgctctgggctaaggagatgtcgctaatcattacaccttgattgggctgtctttcatttgagggactccatgccctttatagatactgcatcaatcttgcaaatgccttcaacacaatcttgaggcttaacatttcttattgacctacagaatgcattgggaatttcctattgttccctgtggatcaaattaggagtttcaatgatgtctatcacaagcagacctgggtgatagtggcttcatttcacagacagtgactgaacaactgaaccatagctgaagcctccattaagattgaattctcctggtgctggagaaaattgtcagtaagaataaaagttgctgccatgattgagtgcttacactgtggaggggctgtgctaaacagaaggtacagctaccagtcagcaacctgcccttttgtttggtgttcccctttctgatactcccaaatgcccattgtaggtgcacatctacccaagaacacctgcttttgcctcactgagtggttcccagtcatacaggaccacacttttccattttaataggcttataggtcacttgggaaatgtttcaaaatataagttcctgggactcacctagaggtccaccttcagtaggactgaatttatattttaaattaacaatccttctgatgccatctaacatatgccttaaaaacaaacagcttcttgcagcacactgaaacttgcagactttgataactgctgacttaggacattcaaggtcattcttattctccattgaaattttcccctttgttcactccttaatttaccgagaggttaacataatgaatgatctcatttcattggtgcttttataggttgaaagtcactttctccaacatccacatttgaagcacatggcagccatctaaacttcaggcaggaatagggacagacatggcggacaccaatggacactcctctgctgctccctctcttctgtcagcaggacgctgatgttttcagaggttgggctggagattccttaaaacttgggaacataagtccctatctaatcctcaggcggaaatctttgattgttgcaaactcgttatttttggcaactgattggctaaggatgggcatgttctagctaatgattttttttttttaagtgtgctgagggagaatttttcttcctgaattaaaaacaaacaacttccagaggtagaggactttgcttcttctttcttcctggaacttataaatgaatagccatcttgtgacactgaagtaacaagcatacaaataaaagccaaaatgctaagtatgatgggacagaaagataaaaacagctgaggtccccaacaatatcactgaatgtctaaaaaacatttagtaactgcatacctctgaacttatttttaagtaagaaaagcgaatctctgtttagatcaccataaactgaattttatgttactttcagctaaaagcattcctgactgatatagaagtattataatgattaaaatccatgttttgtaaaaagcagcctcagaaaggttatgtgactcactccaaatctctaagcaagtacacagtggatcctcagctggaactcagcttgactcattgcaaatcttgacccatccaccctggagccttgctccacagtgaagaggttttagtgactaccttgcagtaggagtggaacgaacacagcaagatgtgggggctgagctcctgatctcacttcagccagaagaattcttgttaatatattttctaaattgggcttccatgtaaaatacaatttaaagaaagagttttgatgcatgaaaaaatcgtttgaaatacaatagcattatgccatgctgctttcttcttaaatgtaaggcattgtagatacaaagaatgcaatacttgatcattgttctaagcacatttgttacccagcggaggacataagtcatatacacatgcaggcacgccttgttttattgcacttcacagacattacattttttacaaactgaagatttgtggcagccctgcatagagtaagtctattggcaccatattttccagcagtgtgtgctcacttgtctctgtgtcacattttgatacttcttacaatatttcaaattttttcattattattatatctgttccagtgatctgggatcagtgatctttgatgttagtattgtaattggtttgggatgccaaaaaccacgccaaaataaaacagtgaatttaatcaataaatgttgtctgactgctccaccgacatgccattctccatttttctccctatcttcaggcctttctattccttgagacacatcatatttaaatgaggccaattactagccctacaatggcctctaagtgttcaagtgaaaggaagcgtcatatgtctttaactttaaatcaaaagttggaaatgattaagcttggtaaggaaggcatgttgaaagctgagacagaccaaaagctaggcctcttgcaccaaatagccaagttgtgaatgcaaaggaaaagttcttggaggacttttaataaaaagtgttactcaagggagcacacaaatgataagaaaagtgaaacagacttattgctgctgtgcagaaaagtttcggtgttctgaataggagatcaaatcagccaaaatattctcttcagccaaagcctaaccaagaacaaggctctaactctcttcagttccaggaaggctgagagaggcgaggaagctgcagaagaaaagtttgaagctagcagaggttggtttatgaggtttaaggcaacaagccatgtccataacataaaagtacaaagtgaagcagcaagtgctgatggagaagctgcagcaagttatctagagatctaggtaagatcactgatgaaagtggctacactacacaacagattttcaatatagattaaaacttccttctattgaaagatgccatctaggactttcatagctagagaagtcaatacctggcttcaaaacttaaaaggacagtctgactcttttgttaagggcaaatgcagctggtgacttgtaagttacaaacaatattcatttaccattctgaaaattgtggggcccttaagaattatgctaaatctactctgcctgtgccctataaatgtaacaacgaagtctggatcacaatacatggtttactaaatattttaagtccactgttcagacctattgctcagagaaaaagattcctttaaaaatatgcttgttgacaatgtacctggttacacaagggctctgatggagctgtataaggaagtcaatattgtattcattcctgctaacacaacatccattttgcagcccattgatcacgaagtaatttcaactttcagtcttattatttaataaatgcattcgttaggctgtaagtgccatagatagtgattcctctgatggatctgggcaaagcaaatggaaactcttctggaaaaaaaaaaggaccattctaggtgtcattaagaatatttttgatttgtagcagaggtcgaaatatcaacatggacaagagtttagaagaagttgattccatccctcacggatgactttgaggggtttaagacttcattggagaaagcaactgcaggtgtggtagaaacagccagagaagtagaattagaaggagactccaaagatgtgtctgaattgctgcaatctcatgataaaatttgaatggaagaggagttgctttttgtggaagaacaaagaaagtagtatcttgaaatcgaatctattcttggtgaagatattgttaacattgttgaaatgacaaaaaggatttaaaatatttcataaacttagctgataaagcagtagcagggtttgagaggattaactctaaatttgaaagaagttctactgtgggtaaaacgctatcaaacaacaacacatgctacagaaaactctttcataaaaggaagagttagttgatgcagcgaacttcattgctgtcatttttaaaattgccacagccatcccacccttcagcatccactaccctgattagtcaacagccaccaacattgaggtcagacctgccacgagctaagagattctgactcaccgaaggctcaaatgattgttagcatattttagcaataaaacattttcatattaaggtatgtacattttttagacataatgctattgcacacttagtaaacaaaactcatatgcactggaaaaaccaaacaatttgtgttacttgctttactgagatacttgctttatcgtggtggtctggaatatcttaatgaggtatgcctgtaccatactgagaagaaatgcaagagttaaactagagtccttttaaagcaatggctcctttttgctacaatgtgtccttgaaaacagtgttataaagcaaatcattataaaatgattcctattttccccataggaattatgtcataaaaagggttatgctgttaaccaaagacttaggatccaattaattataaatatagccaataacaaggcacaagagcaaaatgtaacatcatctgaaataataaaatgatgatccaaatcctataaaatgggaataaatatatagaacatattacagcacatttgggctgattgtataatcaaagtagtcttataacatataatcgtaaaaacctacaccataaatccgacctaagactaacatgctaacaataataaaccaaaaacatgtaatgaaggataattttatttccttcttttagaccttagatggatttttacaggatggtttagatgcccacttctcttaacatgtgaaatacccaaggaaattagtgcttacgtgctcccttgttttggattgactgttgcagcaagaagaaggattccagacattccattcacttgaaataccacagaaaatgatgactgctgttcacagtagatatggtatgtttcatactgaaaatatgttttaatatgaaagtctgttctttggtttattcagagctcctcaaaaacttctactttggctcatgaggattaactgctacagggattgctctcatgttacaaagaaatagaaagctggaaatctagaaaaaatggtgggtttcagccactgaacaacagacagcacaagacttgagagaagggaaacaagtgatccttgagagaaaggaaacaaatgaagtgacacttataatttttccagattattgcctggaggcagtttccaggttgccatgcagagagaataaaaccaaacacagcttggtgactaagtcaaggttgggatgggagatgtaggggagagagagaatatgagtgttctggaaatctgtaaaggcgtccccttgagtctttggctgagtactaattcatgcatgcatgagggaaaactaccaccgggcaaggaaagcagtaccagaaatcatcaggctgaacaattcctagatccaaggctatgaacagtctgtgtcccaaccagccaaagtaggtagatctagttactcatgggtcattcagtagagccctcagaaaagttacactttcccagtattaggattaaattagtcccacaataaaggctactctgagtctgacacagcaaaacttaacagcaatctttgaaactatcaaactgatttacaaattacttaactgcatgccagatcaaaatccaacactctttaagggaatattagcaaaattcagccttgatgatataaaatcacaatgtctagtatctaaccaaaagttaccaggcattcaaaaaagaagaaaattggacctataattaagaagataatcactcagtggaaacagagatagaagtcaaagcgataatagaatttgatgatcttagaacagcttattataaaccttataaatatacttactaatataaagcagggggccaaaaaccttttccataaagaactggagtataaatatgcaaatattttaggctttgcaggtcgtcaactattcaactctcctgttgagtcatgaaaacagccatcataatatactggcaaatgggcattattgtgttcaaacacaaatttatttataaaagcaagtggtagaacagaagcctgtgtgtgccttcatgtaaaggagacatgggcaaatcaggggaaaaatgaaagactgaaacaggcccagatggaaatttttgagataaaaaatataccggatgggactaaaagcagattagagagtgtagggcagtggttctcaacaggggcccgttttttactagggaacatttggtaatgtgaggacgtgatttttgttgtcagaaatgaggggaaggtgctattggcatccaatgggtacagacaaaggatattgctaagcatcctataattcacaggacagctcccccaacaaagtattaactagcaccaagtgttaatagtgacaaagttgagaaaccttgttgtagaggaacagatcattagacttgaagacaaagcaatagaaaccatccaaaatgaagctcagaaaaaaagactggaaaaaattaacagaatatcagtgacaatgtcagtcgaatatatgtgtaactggaatcccagaagggaggataactctttgaagaaataatagcacaaagatttccaaatttgttgaaaactttaagttcacagagccaagatgcttaacaaaccccaatctgaagaaacgtaaagaaaattacatcaagatccatcataatctaaatgcttaatatgagtgataagaagaaaatcttaaggtacctaaacaaaaagagatacaatatatgcagagaccaaatataagaatggcagcagactcattgtcagaagtcacacaggtcaaaagacaatagagcaatatctttaaagtgttaaaagaaaaaaagattgtcaatttaggattctatattcaacataaacatcctttcaaaatgaagaaaaatagttttttagacaaaattctatagggactttcactataaggaacgttaaaagtaggccaggcatggtggctcatgcttataatcccaacactttgggaggctgaggcaggtggatcacttgaggtcaggagtttgagaccagcctggccaacatggtgaaactctgtctctactaaaaatatgaaaattaactgggcgtagtggtgtgtgcctgtaatcccagctgctcaggaagctgaggcatgaaaatcacttgaacctgggaggtggaggttgcagtgagctgagattgtgccactaccctccaacctgggcaacagaacaaggcttcatttcaaaaaaaaacaaaaacaaaaaaagttaaaagtagttcttcaggcagaaggcaaatgatatcagatgaaaaactggatctacctaaagaaatgaagaacgtcagaaatggcaaatatttaggcaaattaaaaaacattttgtctcacttttaatccctttaaaagatttgaatgcttaatgaaaaaataatggcaatatattatgagtttataacatatgtagaattaaaatgtattacaataatagcacaaaggctgggggtagagattggaaatacaagaatgtaaagatcttatactatacatagtcatattatttgaaggcagcttgtcagaagtttaagataaacatgaaaaaccctagaacacccaccaaaattatattaaaaaagaaagatatagttaataaaacataggtaaactaaaatggaatcacaaacaaatacttcagtaaactgaagctcttcatggttccagggcttctggacatcatgtggcctgatttcttccttcttctttaaaaagccgtgaaaacactagtacagacctcagaaaagaatctcccaagcctctgtgttgacatcttagttcccgtcatctattgtttctatgtccagagtcatgggaaccacatacacacacacactaactcacacacatagacacacacacactctcacacactcacactcaccaagctttatctggagaacacatttcaaatatgcctcacaaatatatgcacaataattttcaaacacatatgggtgctatcacatggaaatctattctaaaatgtcattatgttttttaatcaatcaatatttatgactaacaattaggttctcattcatggaagtcattaaaaagggctcctcaattttaagaggctaggaaccatggaaccattgtgatgaattaaagggcttggccttgagggtttgagactgtttcttgtaagtaacaggcaattgctgatggcttctcaatggtgtgtcatatgataacagtgctctcacaagttttacatttgatgaaaatgaggtagaaaaaagctgaagagtttgttttgaggctgactaaaactaataaaataatcataaatcaatcactcagttggtaacttgtctgcaagacagttctctggatcattgaagtgattagagcacatattttacatctgataatttgtgtttacacttgattggataagccatttgttgatgggttattatgatatctttagtggacatctgtaattttgtgtgatgtgtgatcagtatttcttcttttttgggaactgccgcatctccagttgtttctggtaaggctgttaataatttcacccctcctccccttctaagctggcaatacccattcacctcacatacaatagttgatacagcttggacacatgatccaagaagggctgatactgacatgctgtgtgaaggaagggatgacttttgttttgggatcatgaggaccaagagccttgtttgaccagggcttccaatgagcaatcttatggagagtcttattgataacagaaaaaaaaaaaaaaatggcaagccaagttgaggataaagagtcctgaaaacagttactaatttattgtttaattaattaaaagatacatattgaatatttgctatgtttttggcactgttgctggccttgggaatatggcagtgaacaagccctcagagcctgaagcctagtttcactattttagatttttcagttacataagccaattagtcttccttttccacttagtttatcattttctgccatctgatggagtccaagtacattctctattaattctggttttaaaaggtacaaggatgattttaagaaatgagcctgctctaagaccagagcttggaatctgctcattctttctggtataaaagcctatccactagaccagttcctctcaaagtgtggctcgggggccctgagatcttttcagggaccctcaagattaaagctcttctcataataatactaaaatatcatttttcttttctacacacactctctcatgagtatattacagagttttccagaggctacctgacttctatcaagttagacattagagagatttgcaaaaatgtacaacaactcttctctctaaatttattttagttttggtaaatatggttactgtttattaaaataggttatttacaccaatattgttatgtaacatatttattattatttgtaaatgaataggtaaatatttttaaaatttctctgtttaatatccaacatgataagaatcgatatatataactcacatgaacaaaattctttggggtcctcaataattttttttttttttgagatagagtcttgctctgttgcccaggctggagtagtggcacgatctcagctcactgcaacctgcgcctaccgggttcaagtgattctcttgcttcagccttccaagtagctgggactacaggcacgtgccaccacacccagctaatttttgtattttcagtagagatggggtttcaccatgttggtcaggctggtcttgaactcctgacacagtgatccacccacctcggcctcccaaagtgctgggattacaggcgtgagccaatgcacctggccaataatttttaatagtgtaaaggagtcctgagataaaaattatgagaactgctgacctagaccaatgctgagcacttgggagattaataaatatattttagggtgaagttgaggagccatggagatacagatttgaagaatattggcttgctagcgatatgagcccataataagttcatgaacatacatttctcttttcaatccttctaaatgaaaagttcatggttcagaatgaatagccagctcagctcagtggctcatgcctgtaatccaacactctgggaggccaagaatggtgtattgtttgagcccaggggttcaggaccagactggccaaaatagtgagaccctttctctacaaaaaatttgaaaaaaaatgtagctgggtatggcagcatgtgcctgtggtcccagccactcaggaggctgaggtgggaggctggcttgagcctgggaggttgaggctgcagtaagctatgatcacaccactgcactctagcctgggcagtagagtgagaccctgcctcaaaaaaaaaaaaaaaaaaaaaaaaaaagaactagcacaccaaagaactacagtaactgccttaccaataacccatttatgcctgaggttgcaattttttgaacttttgcaatcagactttggcaatgaccttgagcagtaggatataaataacactcacatgcttggtgttccaataatggaacactaggcataaatgggctaatggcacaggctgaaggctgatatgtcttggaaatagtcaaccctaatgaggtctgagagggtaaagatcatactatgaagctttcctaaaggaagctgctcttatttgcagtctgagtggaggagtaggcacctggtcaatgagataatgaaaagatgagtttccagaaccattccacatctgtggacatgttgggtcaatgtaaggaattagccaaatcagtgatcaccagccactatcttgtgccaaattgccttctcaatacccagagcccctaatttgacaattgctgagaaccagtgacatcaacagtaatatctaacaggaaagtggcaggtggtcttcagatactagttttgataagggcccacttgcatttatttttaggtccatctttcagggtgttctctctcagaaagataaaaatcccattcagtcccagcatcttttcacaggcatgctgcacctctgtggtcatgaaatctctccttactctttcctaactttggccctttctgtagctctcttaatggcaccatccccctccttgacattgaagttcccagccacaaagggtttgacttcttctttcttgaaaattcccactcatcatcccccagcctcccaacgagtttttaataagttgtggatttctgccaattctatgcagtcatttagtcattcattgagacttcacagccctaaatcatcaaatcctgattggatcaaggtttctgcctgccaaaagaaaatgaaacttctctgaagaacaacaacctttagagcttctggaattcaataaaatattaccagaaaggacaggaaacagagccaaatgacccaaagccaatataaaaagcaatggaaaaaaataaaaacagaccttgaagtctgatattggagttatcaaatatagactttagaataattataatatgttcaagaagacagatgagcaataaagaatttcattagaaaacgggaatttataagaatcaaatggaaattctagaagtgaaaaatacaataacgaattaataattcaatagatgagtttaacagtagattagacacaagagaacagaaaattaggatactggaagagagactcacagaaaatgccctgattgaataataggaagaagaaaaaaaagacagaatatacagaaaagaattcaagagacacgtgagtcacaatgaaaaggtctaaaatacatataatttgaagtcccagacaagaggaaagagggaaaggacagaggcaatatgtgaagaaatactggctgacaatttttcaaaattaacaaaaacttcaaacttctctgtgagtcccacatagaataaatgtaaagaaaactatgcctagtcacatcataataaagctgctgaaaatcaaagacagaaaggaaatctttaaaatagccagagaggaaaagacacattacctccaaacaagcattgataaaactgacaactgacttcaacagaggcaaggaaggccgaaagagaacagagtgatgtctttaaagtgctagcagaaaatgactgccagccaagaattatttacccagtgagaatattcttcaaaaatcaaagtgaaataagacatttcagacaaaacagctgaatttttttttttttttgccagcagacccttactaaaagaaatattaacgcaagctcttgaagcaagaggaaatttttcccaaatggaggcaacagtcatagaagaaggaataaagagcaatggcaagggaaaatacgtggaaatatttaaatgaattttggctaattaatataataatagtgtcttcagatatgtaaaatatgtgtagctgtaaaatacatgacaacaaaaggataaaagaaaggatggtggctagtggagtttaagtaatcaggttcttgccttgttcaggagtggcaagcatactaatttaagatatactctaatggtcactagggtaaccatgaacagcatagtaaaataatatataactatattttaatggaatacacaattaagtaggatacacagttaacaggatgcaaaattaaatacttttaattatgttaataggatatataattaaatacttttctacagagaatattccaggccaagttggctttatcaatgagttcttccaaatatttaaagatgcagtaaaaccaatttcacacaaactcttagcagaagatagaaaaacaaagattttctgtcttgttttataaagttagcataactttgataacaaaatctaagaaggctacaagaaggaaaaattacaggtcaatctctcttattagcatagatgcaaaagttctagacaaagtattaacagatcggtatgaattatatatcaaataggtaatacatcacaaaaagttgagcttattccagtatataaggttggtttaattctcaaaactcaatccatataacccactatattaatagaaaaaagaataagcagtatacagttgtcttgataaatacagaaaaagcatttgatatcattcattacctattcgtgatgaaaaacctcagcacactaggaatagcagttgtggcagactgcattttccaaatatggtcacagcaatatttccgttcccacatgctctcacagaacttgcagagtagaatgcagtggcaatgatgctaaataactttcttttcttttttttttttttgagacagagtttcattcactcttgttgcccagactgaagtggaatggcacaatcttggctaactgcaacctccacctcctgggtttaagtgattctcctgccttagcttcctgagtagctgggattacaggtggtccccaccacatccaggtaattttttgtgtttttagtagagatggggttttaccatgttggccaggctggcctcaaactcctgacctcaggtgatccacccaccgtggcctcccaaagtgctgggattacaggcgtgagccactgcacccagccgatgttgatgactttcaaggcaagatcacaggtggcacctggctgtcttgcaggacggtcaccctgggaacccactcaccatggtatgagaaagcctgaattagcctctatggagagactatatgagaggcccaagtagtgatgccaccagtctactgttggcatcaaccaccagaagtgtgagtaaacaagctttcaaatgattccatgtcctcaacttcaagtcttccagctccccagtcattgtgaagcaggggcaagcctttcttactgtaccttgtctaaattcccaatccacaaaatctgtgagtgtagtaaatggttgttctttgccactgagttttgggaaaattttttatgccattgtaggaactggaacggaaggaaacttcctcaatctgacaaatggtatctctgaatatcctacagctaacttcatacttaatgatgaaatattgaaagctttccctttgaattaaggaagaagacaatgaggctccctgttaccacttctaacatacattttactagttctcttagccaatacaataaggcaagaaaaagaaataaaaggcacatttggaaaaaaaataaaatgatcaactagaatcaataggtgaatttaacatggtttttgaatacacagtcaatactgtatacaacaaaaattacatttttaaatactagtcacaaaagaaaaaatgaatctttaaaaataacttttataaaaacacttaaaagtcacaaaagagtaagtttaaagaaatattggcaagaatacaaagaaaactaaaaacaattacctggagaaattaaagaagatctgataaatgaaaatttatcatgtgttaaggactggaagactcactatagttagaatgtcaggtctcctcaaatctgtagattaaacttaatcccaatcaaaatctcagcagaattgtgtgtatttgtactgtgtgacaatttatgagatgattctaaaatacacgtagaaatgcaaaaggcaaagcatggcaaagatgatcttgaagaacaaagttggagcacttacagtaccagatatcaagacatattataaagctcctgtatttaaaacagtgtggtacttgtgcaaatatagacaaacagagaagtttgtcttctctgaatgaagtccaggaacaaacctattcttaaaaccacctgattcacagcaaagatgccattgcaatgcagtggagaaaggagaatcttttcaacataaatgagcctatacctctacttaatgctaaatgaattatagacctaaatgtgaaaggaaaaacaataaagtttctagaagatgacatagaagaatatatttatgatatcaaggtaagtaaagatttcttgaataggatataaaaagcagtaaatggaaaggcaagccacagatttggagaaaatatctgcaatattcacaatgtatacatcttaaggactgttgtctgtaatatataaagaagccctaaaatcattaagaaaaatacaaacaatacaacaaaaaagggtaaaaagacttgcacaggaccttcacaaaagaaatattcaataagcatatgaaaggtgttcaaaatcattactcatcagggaaatgcaggagtttgagaccagcctggccaacatggcaaagccccatctctactgaaaaaaaaaatacaaaaattagcctgtaatctcagctactcaggaggctgaggcaggagaatcgcttgaatctgggaggcagaagttgcagtgatccaaaattgcaccattgcactccagcctgggggacagagtgagactttgtcaaaacaaaaacaaaaacaaaaacaatacttcctatccaccagaatggctaaaaacaaacaaacgaacaaaaaatggaccctaccaagttgttgagactatggagcacattctcaatacattgctgggaggagttaagttggtacaattactttggcaaactgttccagaatatcttctaaagctgactagacacacatttttaccctcctaagtaaacatccaaaagaaatgtatatatgctccaaaagacaagtataaggataacctaattcactggatatattgtggtatgtttatacaatgaaatagtctgcaacaacaacaaaattgaattactgctacatacaactaaacaggaatatctcacagacacaaaatagttaatactatcaaataaagttacacaaaatttaaaaacaggaaaatctaatctatagggaaagaagtcaaatagtaatgatctttaagggactgtaatgactgggagggggcataagatggcttcttacctgccggtaagtgtttcacatcttggtccgagtggtaattccatgaatgatttccttttgtaaaaatgtatccactgacgtgtggttttagtgtatgtatgctctataacataaagctagcttaaaaaaaggaaaaatagcaacgacggctggttgtgctgatggtgacaaggatgacttcctaattctgaggtttgatatttttccaaacgccaaagttgtgtgctctatttaaaatcacatgtagatttccagttaccttgtgtaactaactctacagaaataatatctgaattttttgcctctaggaaaaaattgtggattcaggaatatgctgtgtttcacaagacagaactgcagtacagaaacgtattcgtgaattaattttttattctgttggatttggggaggtttagttcaggctgattttctagtgcgatataagtgggggagaggtggagcaaggggtggttcatcagatcaagttgaaaagccaagatagaagcacaaaagcctgaacaaattatctactgcgaggcctttgctggacggggcctggctgccacacctgctgctggtcagggcccaggcactggtgttcactttgaagagaggagttagggaaccccttgaagtttctgcagaagaaaccgccaggctcctgtgtaccccctgctcctgcattccttcttcttatctcctccactcactcatcttccctatgagtctctgagcccttccgctgacttcctgcagaagcatcagacaactcgagagggcggaaaatggagaagaaaggccaagcaaggcagtgggcgaggtcagaggccctgtagcctgtcctggagaaaccccttccttgctgaaccagagccaccatcgctggaagacctcaggcctcagggagctcaagggggcagcaaaagaggaagactgccctttacttaatgtctcctcccaactccacatcccctcaggtaacacagttaccatctgactgtggaagaaataggccccaagaggtgaactctcctgcccaaggtcacacggcgtaggtggcagaatccgcctctcccgccatcttttcccagaatccctccctccactaagggaatccttcaatctccaggtccacacactggagaacattcctgaacagtctcgggcccgccggacgaggctgcatctccaggccctcccagaccacactagagggaggcagctgtcgccatcctcattgttcccctgaagtgagtggctaagcccctgctagctctatgtagagatcggcgaccccctggggccaatctccctttggtcctggcctctcagtcaaaggtttggaaaatgtggctggaaatttaagacagcctagagcacagctggctcccactgagtgaacagcgctgaggccccgataaaggctcattcatctctgggagcttcatgcttggaagactctgagtgcctgaagaggaattgtgcaaactgccatcacaataaacagagagagagagcatgtctataaaatcccagacaggcggcaaatgagaacggtgacatcgagtctcacaactgcaatgaagtgaaagtctcttggtcctcccgtgtggggctgcttcggacagatggggcagggacagtggggcagagactcaggccagggagcagcctgctcctccagcgctgcctatgggcgggagtggtcaggagactccctctagaacaacttaggatgctgggaccaccagggtttgttgctcactttacagatgaggagacacaagctgcggctcagacccagcctttagctgccaacccaaatgctgccctctcctccccatgcctgcaggcatgcatctagtccttcatgcatctgacatacaatgagcgcattctaggttctaggcactgcactaagctctgaagatcaaaccaaggcctagtttctggcctggatgatcctacagtacagtagggacataaaattaccacaatcattttaaacaccaacattcttttccacttgtaaagataattgtaggaaagatacattatagaaaaatatagaaaatgaatcaaaatatcaagaaggaaataaaaaacacacagaatcccactctccagagacaatcatggtatgtgtttaggtatatggaaaaaaactccgtgtacccacaggccccgtgcctgcaagagacagggtgtcggtggtagaagcacagaagagggagtgagtagccctgagacccgggggagtttcccggtggagaaggagggctgtgcttccccgacaaggcacaggaggatgcagggaagtgtgctgcatgggctgagactcagagcgtgtgaggctgcccagggaagacagggagaagagaccagggagacagattaggtgtgtaaaagagccctgggctttgtggagagttcgattccatcctggagcatttcttgctgtgatgtcacactgcagaaattagttgtgagatgtatagctaggaatttgttactaatgactctctgggtattgatcaccttgcccttttatcgttggttgacactggagcagattcaaggagatcaccatgcacctcgcctcaccctcattcacatatgtcctgatagaccacacagagttgatgcgaaggggtggagcagcaggatctaggtgcagatgtagactagggacacccaggctagaaaggctgtggtgtgcaaaggaagaagtgaaccacgagggagagttgagctgagcagtgcaggctgggtaagatttgggcacgtgaataggagccaagagatacttcctggggtggaaggtctgagtgggtcctagagcctggaaaggacatcatcatcactaacatggccagtaccccctcatcccactacccagaggcagcatcatgctaaagagaaaggggctttgctatataccagctgtgtggtctgggacacatttacttaagctttctgagattccacattacaaaataaatggcaacacttggctctctagttgtggtgaggatttactgagattgaaaccatgaaattgcttagtggagttcttggcacacatatgtattcaagtgatgttgattttctttccttcccagctaagcaagtcaggaagtccccaccctcaggttcagaatgttttatcagaggtgctatatgattctttataacccagagttggtcccagattttaaagggcatggactaaacagatggcttctcagtggtcccagatcttcttgtcctgggacacagtggttcccaagctgatagatcctaaccggctgctggtttcagaggtacagtgacagcaggcagagggatggagagggatgcgagggaactggaggctctgtgtgggcaggggcaacaagaaatgtggggacttcagatatggctaaaagacttaggggaaattgcttccctggccagcaccaggtggcaatcaggaaatcagagctgaatgtgaatgtgatttagaatccgaaatcttgggttctagctggaggtgctgtgtaggagcctataggcgaagcaaggaaggcacttctgccagcagataacacgttgattttaagcaaaaaagaaaaagactattttcctgagtctgagttcagtattgatgagctgtgcaaagcactgtccttcttgatgtatgctcctccatccataaaaaatgaagagactgtctcactctcagcttctcaaagctccccaggtttgctgcctgtggctccagacccaacagatagaaatatgaggattgatataatcacacatatgaacaggaatacaaacacccatgtgaatggaaacatacatatgaatatggcccatgttgccctcctctcatctctagggggaggacaactctcactccatgttccagttagagtcaatcagcaaaccatgttttaccatacacaggactgtaatgatcctgctttcgtataaagggctttgcagccccagaacagccttcacatctattgtctgccatgagccacacaagccccttccaggaaaggtagggtgagtgctcccatcactgggcatatatggaaacagagccttggacaggcggaggacttgcctccctggtggccttctttccacgactcctccttctttccatgactcccttaccctgtacttaacttgagaagagctttgaagtaatgagctcatgctgtgctctcaaggctcctacagactgacgaggaataagtcatacgcatacgcaagtcagtttacactgccaggtgattgaggattgatgccgatctgtatcaacgatgagcatggacatattcaaagaaagcggtcactcaaaggctgggtggcctgagaagaggcttcaaagaggacctcagtgtttaagctgggttttgaagggcaggcaggatttggaaaggtcagggagaacaagtgtgtcccagcttgtgggaatggtaggggcaggtgcagagggtgggagcatagctggcttgtgaattcagttactgttaagacatgtccccagagactgactagcttcaggaacacagaaataaatctagtttctggccctgcaaagaataggaccctagacctaagtgaatgccgtctaatgaagccttgccatgacatcctgtgtcctcataaaagggtcctagactggtatgaaagaaaggatgtcttcgctattgtgagactgggcagcctgatcatcttggagagaaagggagtgtgttagagagagctctagagcctgggagcactcagggttccctgaacatctcccatctcctgtgatgtccccgaaatgatggctcaccctgaagcaggcagatctacactgccctggggaaagaccctatcctgagctttctgggatggcagcaggagatagtagtaggttctgagacctcaaccacagcctcagtctttcttcatacacagatctgttgccaagacctaggaggtagctaacaagcaggcccagaggacgcttgaacacacaggcctgaaactcattcttcacccgcttggtgattttggaattaattaaatatcctatcttaccaaagctttagggtgttttgctctagaaagcttcttttctcttaactaaattgaagcccataaatgagaaatacagtgcatgaaatctctggatgtcacaccataaatctcaagcatgtggctttgcaaatctcctttaggataaattgtagcaataaagtgtttgcattttcttcatgtattgctgggttcagggagttgagccttctctagtcacaggcaatttgattgaagaccacagggtcacacagggggacatggggcagcttggctgtgggtctggggatggctggtcctttgctctcctaccaccgcccccagatgagtgggtgccctctgctctggcagtgaccttggcaaaattaggaagatctggaagataacattcttctcaggggtggaaaggataggttcagactgggaaaaggacatgagagtcttgaaatctggtacaggaaatctttgacctaaaatataccagacacataactcaaagttgtttgttcttcctaaacagcccttctcactcccttcaactaaccgttcctgggcattttgttctttcagctaaatactaaacagcagctttaaaaatacatgtgactttgtatatttcagcacagaaaaatccccaaaacataatgtggagtgaaaaacacaagttgcaaaagagatatacagtgtgataaaaacaggaatatgcattgactatggtatggacacatagtatacaggaaaagtacagtctcatgtggaataacaccagcaacctcagcagagtgacgtgaggctgaaggaggatgaggcgaggctttagatttatttatttaaaaaaaggaaagaaaaacaaagcaaatagggtgaaatattaatatctgctaattctaagtggtggggatggagctgtttgtaatatttgtgatattattttctatgtctctaaaatatttcataactgaaagtaaaatattattttaaaaacaatgaaaattataatttcttctggcatttggagaggtgtgaatcttttcagagtttgctgagttaaatgggactgtttatctctaaactgtgtatggtcctaggtgattgtctgttatatttcttgtctctgctttttattgccccgttgccccagggatgagttgacacttcttgctgttgtcagtcaatctgcccactcacttcacacagcagtcaagagcagaggccagtcagacgcagggaggaaagcagaagtggggctggctggctcaggccgggggctacaggcactctccagcaacacgcaggcagatgcaaaagtgggaactcagaaagctcagggaacagacatcttaaaaaaaaaaaaaaaaaaaaaaaagccatcatttaagccagcacttctcaatgcttaaatgtgcacaggaatctcttagagaccttgcagattctgattcaccaggtctgggcaaggccaaagattctgcatttccaatgagctcccaggcaatgccgaggttgctggtccagggaccactggagcaaagtccctaacaaggaaaagagatccggcatgatcctttgaaccatctcatatatcacgtgggtgtattcctgtaatgggggcccatgctcctgtgtttgaggaccagcttcagatttagtgaacgcgagacctgagcgattattctcgaacagcaagggagtttcagtcattcacccaagccatgcagctggtaatggcagatctggactagcacttggaatcctggtttgtagttcagtgctttaactattttaccatttcatcattttcctcttagtaagaaaacaaacttgacggtaagaattcattaaattgccaatatatttggctttaagcaactcccctgtaaacaaatttagatttaaaatagaagagcaatgtggaagggaagacaattatttttcagtctttatcataagattcctggaaactacaagctcccataatacacttcacatttaatttgattttaccaaaactcaatttatacatattatgttatcagcacacattgcatagataaggcctaccttaactgattaatgtgcttctgtcagactctacatctctgtcttcattgaggtttctagaatctccgactttggcaaagcttcttccctaggcctcaagtttttcatctaaaaactggtgttgaacacatcatcactaaagtcttttcagttttaatggtttttgagtttaaagttttcctctttgtataccttaaatatggctttctgggacttctctctccagctgtcatttttctctttgcatggttcacagctctcctgctcagaaaagtgataagtgacaggaaggactattgatacagtggttactttacattcaggaaagagggtcaaggtgatatttaaaactcagcaacagaatgactttctgtttgattttcaaaggctcttaagcctcaattcttcccacaaagaaagaaggtgattaattggctgatgtcctgccttccttaaaagaaagaatatgatcagtgcagtggacctacgaggaaacctaatcaaaccagttgtggctgtcccttcttgccttgtgaccacagatctcaaatgggaaaagtgcaaacctgtagtatatccctctgaataaattctgcctcttccctcaagaaaggcctggtttgagaccagtaccgggaatgaaaaccctagtagcattggagccatcaaggctttctctgggcttgcagagatattgctaggggtaggatcaagctggtcaggatgggatacaccagtggacagtgtgccatgagcaggggagttattttactgtttagagccataatttcataaaatagagggttggcctgcaagaatttctggtgtctagttctaggattctgtgtatgaaagtggacttggagtgagggcataaatcccacttcttcaaggtgaaggagaactgagggggaaagatgcctatgcctacatctgagggaggaggtatcaaattaggtggcttagtatgcaagaacagaggttgaggttagcagagaggtgtgacagctggcaccacctgggaaaagtgacctgatgctttaaataggcaccaagctaatggtgtgaggtgaggtcaggtaggtagggtttcctcagttatttacggcatgtatcctatgggtcctcagcacagaagtgagtattgttggtacaatggaatgaactaaaagtgtcttgtattttagctgatgacagagcaggagagtgccgtaggagagcaaaaacaacaataacaacaacaacaacaacaacaacaaaaactgagaaactctgagacctggtctttggataagaaagttctttagtcttccatgacgactacatggattactaaaatccacagtaggaagctccccaagagagtgtgtgcatgaaggggcgataggaggcaaggagataatggagagtgccaatggcagcatgctttgatttacagccctgccttggatctgcctgcttttcttctactaggctattcctacgcagttattgggctgagaagactgaatgagcaacatgtgttctagaataggaaacccaaagggcaggaacttggaaaagactgtggtaaatatttgcacttgaaaagagagcaggaataggagttacaagattaggttctggtccccagcaagctgtatgacctgggtaagcatctccctctcccagagacttagttctcttaggtacgaaatgagaaaatatattatctcaatggtgttaaaccctgtctgtatactggtattgcttgaggagctttcaaaaaacaccaatgtctaggcactgcctcaggtcaactgaaccagaatctctggggataggacacaggcatcagggcctttttaaagccctcccagctaattccagtgtatgtctaagtttgagaaccactcctgctattcaaagtgtagtctgtgcaccagtaggcggtatctcctgggagctttttagaaatgcagaatctctagcttcagcttagagaatccacattttaacaggattctcaaatgattcatgtgcacatccaagtttgaaaagccccaagacagttcatctctaaataacgttttacttttaattgtgaaatatttttaacatacagaaatgcatagagaataatttaattagtactcacatacccaacctggctttatcaagtcattactttttactatttttcatttaggttttgtttaacataatgacatatattttaagttgaaccctccctgtgtattcctcttagatcttatgcttattgctttcttcatagatagagtcaatatcctgactttggtgtttctccatcttattaatgttttcatattatattagtccgttctcaaactgctaataaagacatacccgagactgggtaatttataaagaaaaacaggttttaatggattcacagttccacatggctggggaggcctcacaatcacggcggaaggcgaaggaggagcaaaggcatgtcttacatggtggcaggaaagagagcatgtgcagggggaactgcactttacaaaaccatcagatcttgtgatacttattcactatcatgagaacagcatgaaaaaaaccacacccatgattcagttactgcccactggatgcctcccacgggattatgggagttacaattcacgatgagatttgggtggggacacagccaaaccatatcatatactattattatataagtaggtaattagatggattgattgatagaatgactttgtcttcttaacatgatttctgttgatccattcttgcattcttgagacaaatcctaatgggtcattacacacacacacacatttttatatgtgtgtgtatatatctatatatacaagcacacacacatatataaacacactgctggatctgggtcctagcattttatttaggacttatggtattaaatcagatcagtttaaagtgttcctctattgtcagggaacttagcaagctttaagtatagactgaacaccacttccagttttgtttttttctagtgtttcagtttcataatttttagataccctaaatcatttcttgtaatcaatgcttaattgtaatgtttaaaaatttagcaaccaaatttattcattttagtgctacctattgtaccttgttttatataccctccctttaaatttgttttcttccttcaagaaatacatccttcaatagtcttttcatgagatctataaattttaaactctcttagtcctgataagtctgaaaacatctttatttgtacgttattccttaacactactttaaatgactgcaaaattctatgttgacaactcctttttgtcagcactttgaaagtactgatctactgttttctgttatttttgttgttgttgctaatgacaggttggatgtctttctgattataggtaatccctttaaaaaatattctactagcttttagtgttttttttctttacttttgataatctaaagtttcactataatttgtctaggagtagatgtatcttaatcctgctgcctagttggagtgaaccttttatctaaataattctgcccttcttcggttccagaaaatactcaaattattttcccaagtattgatcctcctccatctcttccaatctcctcttctgatgcccttttagactatgtctaagcacctatcttccatgtctctaaaccactttttcaaatatttagacaatctctctctgctgcattctgagtaaccaccaatggatattctaatcctctaattttccatttgaacaagaccatcccagagttcatcttatctgctgagctgacactttaagacttatttttaattcattttgattttattttagtgaccatcttttgtgtttctaatatgtataattggttcttttccatatctacctgttctcatttcatttcagcctgattctgtttcataacttctggctctttttaaacaaaagatttcctccctgtatctattcaagtatatcttaaatgtattcatttgaaagtttattcagactggtataaaaatttctattaatctgaagaggattcatatgcgaatgattggtttttggctttctttcttggcagggttttacattttagaattttgtacttgaaggctaggctccttttgcttgatgggtgtttgtttacaggtcctccccttccccagccaggctcaccccttcctgtctggctgtttatgttgcctctgtttggtcctccctcaaggtcagaaccagattcaatctctgggcagtctggttcgggtctgagtcataagacattgttcctaggactgcaacttgcgaaaaacagtggcctcagtggcattttttttaggatcctttttgtggttgtgggagctgatctcatgtgaaccctggctgcaagcactgattctggccctggcctttcatcttggctggtcatccttagaagtatttatcacacagaggccaaattcctggctgtatggactgcttcccgccccagagctcagctggcctgcaggctgatctgcttactactttccatttctgttctgggtttgagagatggaaacacggtgtctattgttcaggacagttatgtcattcccatgttatctctccttgtgctgcatttagagcagagtagtgcaaaatataccatcttgctcaaagtctagatttgcaaaataatggcctaggcacagttgccaaattaataatggagaatcttgttttcttggtggatgaggatcagtatatagtatattatctcttaccctttagaatacaagtaccagaaggacagagactatggttctctatcattcctgcatttccaggaccccagagactgtttggtatgaaatgagtgcttcataaatgttaaagagaaaatgaagtaagcttctctgggcatttttctgaacctttctgataatgttcttagacttaaattcaaacacctatcccctggaccataacttcagtgttgcacataaagtcagcacattttgaagatcaatgacgtcttgaagtcagccattaactgcaaaagtcagagctgcttaagagagatacgggcatgccctgttttataacaaaggagcaacatggaaaaatattcactgataaatatcctaccagtaaattaaaaacaagaagcaaataccttcaaattgctttcacagtgtgttttgtctttctctttgaatattatttatgagggataatttactgatattgtggttaccccaaattatataccaaagaaaattaaaagcactacagaggaggaaataatagtagcatttaattaaaaccaaagtgggcacaatcaatgcttgtctaatacaataatgagcttaatttaattttaatttaatggaaaaaaataaagcttaagtcaactgcctatgtaattaaatgacagcaattttaaaaaatgtaagcttttctaaagtggagtcctaaaagggtaacaatggcgaatacaatgccaactaactgacctatatcaatgtttccagaagagttagaggggatcattttcttcaggaagcaggactatgcattttcagcttctggaaagtagaattaattaacaagcgatactctaactttccgtcctttagagtcatcaaaaaagtagacaaaattggatttctaagaattgccagtttgggagtatggtccaaaagggactgaaataaacagatgaccatgtaggggagcttgaatggatgcttcctaccagagctgggctgcagagaggacagcgattgagcctgaggtgggagaacagtgtgaaagggaacccccatacccccagacagctgtctgtggccacagagctgaggaaataggattcactctagacaataaggagagactgtttttccaagtactagcttagagcttgtggaaaggtggtccaactttgatatcaaaaaaggattctttttgagttggttaatctgtcaaaatgtgaaatgagaagccacctggggtagtacccaaagcatcagattcaaggttgaagtcctatctctgtagcttaacaactgagtgactttgagcaactcagctgctttgaggctcagtttcctaatagaaatatagggttactggtatccattttgccctagctcacatgatttttagatgatgaggagaagacatttattcaatgcctgctatgtatcagtcaccttactaagtattaaacattacttcatttaatttaccacccatttactgagctagttgtcattttaccgagacagaaccaaggccatagatggcaccagatcgagaactcacagcttatgcatctccctctctccaaagcctgcccgctatcccgtgcttgttcctggagctcagctcaaattcaaagacagaggggcccagtgtgattggagttactttgggcttctctgctcagtttattttcttgggttgttattttttttttctgttggactcttttatactagttatacacatatgcacgtgcacacagaaaagcactaacatccctttacattcagtctgccttatctgacttaacttcatagcagctgggttcatctcatatgcagttctaggtaaccccagaacagttctctggacaaagcacgtgctatttatatatgcctatgtgaatgattacattatttgcattcttttagtttcacagcctgcttttcaggcaactgacaagttcctactatttacttcttaataatctgtcaccatgttccaccaggtgcttacttcttattacataagcagtgtttcatcacactgttgtatgcagcagaatggtggggtcattccctaacccccaaactgagactcaaacactggtgactcaccagctctcctaaacgtctaattaattacagcagcactggagcagaacagcgctagttcagggtatgtcaagcagtttccctggcatgactgatggcattggagtggtaggattgacttggaccagataatattggtaagaatccagatagctttcatggtcatatttcataaatttcactgaagttggttgaaaaaaatcaaagaatggaaaaatgatgtgtagcattctttttcttcaccatgtactcatgatcttcatctcttatttagtatggggagaacttcaaattactcagtcccagtggaactccataaccacggtgtatgttcaaagggagatgaggggatgggaagtgggaataccaggtaggcttagcagaaaatagagttagtcaaacacttgttatcacggcccggtcttcctccacctaggaaggctgttgtctttgtctaagtttgttactttggtttcgtagagcaaagaagtggtttatcactttattagccaactcagcaccagtaatcactgggggagggaatggggccacaagctctgaaaagaaagcaaaagaactaaaagattctgccaaaggagaaccccaaactgatcattgtcaggatctaaaaatagtccacttaaatcagaattagtgatgaacgactaactagagcagaactatgcaaatgaatacacagaggagatgaaaagagccctcaattacttacttatatgtttacgtctcatattagcctatgcatttcttaaaacaaggtctgtatcttagttttttgactttctatccctaaggcttggcatgatgtctagtacttaatagatgctcaataaatgattaatcgaattcagtatactacaagtataagctcatcctaggatgttacattattattattaccattactttagagacaaagtcttgctctgttgcccaggctggagtgcagtggtgtgatcacagtgagcctcgacttcctgggctcaagcaatctgcccacctcaaacttctgagtagctgggactacaggtgcacaccaccttgcccaactaagttttaatttttctgtagagccagcatctcccaatgttgcccaggctggtctcaaactcctgggctcaagtgattctcccacattggcctcccaaagtattgggattacaggtatgaaccactgtgcctggccctccaaagatgttatattaatctgatgttcaatactgccccaaatagcaaagcatgaaaaatgtgttatttaaggcatgaagcagtgttttacagtgaactccaccaggatgagacaccctggagcctggaccgaagaagcctattctagggatgaagagctgtctcaggtgctgagccctggaaaggcctaggatctggtgtctgaaggacatggcactagacacctggttatgcaggtgttatgaagggaaagtggccctgcaaaagaaagaagcatgtcaacaagaaagccaatagcaggcaatgctcacacatgcaggaaggtggaaaatctttaggtatcagaaacatggttgttgcaccacatgctggccgggactccaaacctggaacatggggacaggctcttgacttataggaactagggcatgggccagggattcatgtaccatggaataaagcagaagctaggtatcatccctggggacaagggacaaaggattagagctggctaggcagcgagtatgccttgatgctaaatcccagaatattcagtgcttctgaaattgtccgtgccaagtcagagctggagctagagatagggaagagctgaggccgcaagcagcccagcagggtcatatgaccttggccttgggcggaggaggggctaacactcagcgtggcctggctagcagagtcagatggtgtgttaatatgctgttctggatcatttagtagcattccaataatctgaaagtgttcacgtgccaggtcaatgttggggaaaaaggagtttaaatacttgtcatatacttaggccactggttctcaaagtgtggtccctagatcagcggcatcagcatcatctggggacttgttagaaatgcaaattattaggcctcgttccagcctagagtcagagacttgggaggtgatggtgggtgtggggagggggttttaacagacccctcagaggattccaacacatactcaactttgagaaccactgtgttcgacaacatctaaatcaggcccttggattttatggatgccacgggcctctttggcagactggtgaagtacatagattccccagagtaatgttttcaaatatgtaaaactacaaaggaaaccagttatactgaaatatagtcattaaaaagttatgctgcaataatgtatgtgtttgtttataaacacatgaaataaccatctcatggcagatctaataacatctgtaattttgatgtagtgatgagcttcagtagtatttcaagatgtctgcaacagctgtcatgtgatttctattactgacaaaatcacacagactcctattactatagtagtagtaaatttttacctgcatttacaatggaagaaatgctacatttcagtgagaagtaatcaaaataaaaatgtcattctttccatccatgttcataggcccctcaattctttccagggtcctctgaggatccatggtccccaaattaagaactacgctataagtccttaataaacattatcttattttattcttttaaaagttttactcctaatattcccattttatggatcaggaaactgaggctcagagaactgaagaaacatgtctaatgtctcatgtggttagtcagatatggagtgtgggctcaaagcccctgtagagacaggtttccgtggctgatccattagtgcctctcagagtgcctagaacagggccgagttcataatatgtactcagtaagtatgcgttgattgcatgaatgaatgaattgaattgaacgtcaagcctgtgtacctcaaaattccatgctgtctctactctccatctatcccatgcaactatgtatgaaaaggagacttttctccttattcatccagcaggtagggaagggtaagttcagttccctgatctactagacctgacaacggagctttgattctaaaattgatgttgaatacacatagcacgagcaacattattccgacaaaattggaaaacaattcaacaaattgaggagaggagtgtctcagcaaggaacgccagtccctctggtttctcttggaagcagctgagcttgttaatgaaacaggttgttactttcacttaacgtgtgtccttctttaactgacaaattagttagtgccagcaggagaggcaagaaggcagtgactaaaggggcagggagtgctgagaacccaggctcggagagaagcacaaaatgagagaagagaaacataccaggccttctcttcttctaagcaaaacaaatttttctcaggcacttttcacagatgtctaatgttcttaactaaccacacttaatttaattaccttaaagtgaattggatggctgaaaattcatttacataacagcaattctaatacttataaattgcacaatcaattaaatccttaagaacaaatgtatagactgtaaatgaaatatctatctagtaggattaatcaaaagctaatcatgaaaaatatcatcctgggtctggctcaaagaatatgccatggttaccattaccaattacagtattgtagggcctgctttaataggtaatcatattaattgacaacactatatttaatgtgtttccataatcctttctttctgaatcagagattcatttatctttaggctgtgtcttgctgcaacccatcatcaacattgtcatcaatgttacaagtgtgtatttgagtgtgttttccatggaagacatggagctagccactggggatgcactgagaaataaaatatagtgcctgaccttataagaagagagacaaggatgaaggcccttgatggctcgggtgaggattgcttaaaaagagtgagagaaagtcattaggagtgggaagagggaatcagggcctaaagggtagactccatatcgtcccacactggaccctattcagtgctggatatgtccagggcctagctgtttctgcacacggtcagtaggtgtttagcccaagtttgatgacttcagtttggtccagtagttctgcctgataagaaaaaagccaagaatatgggtgaggaacttcctcctgctgttcgtaaggattcttaaagatgatttttgagagcagatgtaaataacatcaagggtttgtttgtctaagctagggatggaacccatggctttccagctatgcagatgccagttgcagattagacgtaggtaactgttttgattcaaaaaatcaacttcatagtggtaatattggcaaagatccttgaacaaatttaaaaacagatttctaaccagatggtatgggagtatttagaaaagaatgcaggaatcattgaaaagccactgtgggtaaactcagaatcaagcagacaaaccaatctcgttttctcttctgataggcttggcacttggcaggtcaaggaatgcagtggagagcatgcatctcatttcagcttttgatgaaatctctcctgctgtccttttgagtaatatgatagatgtggattagttgataacagtattaagtggatttacacttacttgagcgtcaatagcaaggagtgtggattggtgtctctctgtcctctgccctgtcctgtctcacatttttttccaacactgggatgaagactggatggctatagcccattggattttcaaatggctccacctgggtaactcattcctgtgatctgggcatctccagttgccttaattactccgctgtttcaggtcctaatttcgcctcatccccaaactctgctccacaactcagccaaggccaaaggcgtacacatcagagagtcacgtatcgtgttttctccagatgtcccataacagaatgagctgtctgttccataacaaaacgagtccttgttaggatgtttctaggaggtccctgcatcactgagaggttgactaggatgctctgtctagccttcctgttttctcttttattctctgagggagtggcatgcagtgaaaagaacactggctttcaaaacaaaactgacttcactctttgctctttgggtaggtctcagtttcctcatctgtataatggggataataattcctacttcccgaggttgtgggaggattaagtgatgaggcctgtctagtgcagcaagcacataggtgtgccctctgtcaatgttagttcctttctgtcttctagagagcactttggaagcaggtgaacaggctccctggaggtaccatgcgaagcccttaggacttggttggtgaggcagcccagtgaggccctctttgcaaggccaggactgtcaggatgaaacggcctcaagcacaatgaaggagaaggctctttcacccttccatgtctaattctgacagagaggaggagacacagtggggtggatgcagaaagatatactggctctccactaacttgtcgtgggccctcaggcaggttgctcagtgtctgaggacctgtctaagggtcctcctatgggcaataagaagcagaatccaccaatgtgatgggaggcttagatgtgtggcttagatccaccaatgtgatgggtggcttagatgagattaggtatttggatttcctggctcagagcctgtcacccagaaggtgcagtataaatggcagttttgtttctattaagatttgtgataataatagtatcaagagaacagcttcaagctttgaggcctccagacctggtactggtctgctctgggtctctgttcatggtgagggagagcagaatttttaaaaatgaaacaggagctgcgggagaaatctgggatgagaggcagatgctaacactacagagagcttggtgaatgagggtctttagaaggcccactcagtttggggctctgagatctttaaaacagcaaactttcccacactcacgagggccatgatcctatgagagacagtgagtcttaaggggtgggtgggggagtgacagctgtagatggcttccacacaggtgctgccccttctgcgcggtgccaggcatgtccagcccctctgcagtttgaggtaacccagcctggaacataaaggggtgagttgtgctagctgctccctcaagtcattcccaggcctagaatccttgggttccaggtctgcctggcctttgaggtggcattacaataggaccctttggatgccttgatgggttttgcctcaaggttggagtcccaggactgacttcctgcctagtaaattccatgctattgtgagaagctcaaagctctttagagactcgtgtgtgtgtgtgtgtgtgtgtgtgtgtgtgtgcatgcatgtgtatgctgcacatagtctcttagttcctcactattagacctcagaagggactattttgtttgtttcatgtatttattcattcaaaacatagatatcgctcacctgcgatagcagactgtgctttatgatgctttcacccaagatgctagcatgttctctactcaaaaaaataataattctcctaagacatctaacatttggcatctggaagagaacaggatgtttaatgtgcatgaagtatgttcacagagccggggtggacttaggaagtgagccagctccctcctgcctaccccagctctgctccctgctccttccctgcctgcttcgtgctgcaggaggctgaaggggatgaagtgcatcctgcctccctggctctctggcttctggttgtgtttggccaatgggaacaccacagtagatcagagcaagggtggagggtggcattggagtgtttatttctctagttcctttcccgtggcactgcacggtatgttcccgagtcaaggtctcttcccctctcaagacaaccttctctacaaaactcttctccctttggattctagcaatcacgccttccccactgaggactgggctagtgatggttactagccctggcatactagtgctagttactagccctggtggttttcttaccctccccacacctttgtaaagaatctccctgattagactcacctcaaattatccaatttgaatgtgccatctctttcttcctgggaccttgagtgataaagatcatctattccttattttgacagaggaggaaacacaggaagtgacttacccaaagttactcaattagagagaaagccaggactcaagctgactaagactatcatgaatatgtagaacattgacccagatttttctgttttcttgtgtttcgtcttttcttcttggtccctggaagatgctgtcaggaggtttcagtgtaattaattatgctggcacatccaatgaatggagctatgatttagcaagtctacttgagatgctgataaattaaacaatgaaatgcacatttcagtttcagttaagagaatcctaacctagttgaggaaaagagcacaacctcacatttcctttctaaaagaggaacgttttacagaactcctatgttgagatccccctccctttgcggccgcctttttcccatgtcagttctctgctcaggaatagactatagccatgtagggatcaaatgaaataacttatctgaggtatttttaaacactgtaatgttctttataaaatgcaaaagattatagctattcaatctataaatatctgaatgtaggatagcatatgcttataaacagcttttttgctcattgtttattacatcagatccaagcttatttgtcaaaatgttaaggtcttataaaaatgtactgcctttcctccacaactcactcactttttcatcaggcagtgtgggctcgtggaactaatacagacaaactagattcacacttggttcagggtcactgcatatggcagtgcaggctgtgtcctgcacaggatgccacatctaaggtatttgcatcatcactgctatagatctttatgttttttaatgacagttttccagaggatagtagtagagtggctggctttgttaaacttagtatattatgacaattttacaataaataaaaaaaaatgccttgaggaagagataactttttctaatatgaccttctcctagcttcataataaagcaatcatatataagtttatgaaaatcacttacttcaggttgtataatctaatcaagggaaatctcttagaatagagatgacaaatatttgccatgtacaccaccacactttgcccatggaagaccccagtagccaccatggctcccttcctcaagtctggatgcaacttacaccatgtgccaagcaaccattgccaaccaaatggggctggcatactggctgatatccatttgctgtcactgctcaaaaaggttgttgtaaggatttcaggatagtgaatccacagcacctggaacaatgaccacaatcatcatcacattccgggcactatagattcaccatcttaaaatcctgatgaggccaggcatggtggctcacgcctgtaatcccagcactttgggtggctgaggcgggtttatcacctgaggtgaggagttcgagaccagcctagtcaacatggtgaaaccccgtctctactaaaaaatatgaaaattatccaggcatggtggtgggcgcctgtaatctcagctactagggaggatgaggcaggagaatcgcttgaacctgggagacggaggttgcagtgagccgaaatagtgccactgcactcctgcctgggcaacaagagtgaaactccatctcaaaaaagaaaaaaaaaaatctgatgattgtggtcatcacaggctctgccaccagagccctgtgaatgttctccaggtctgcgtaccactcccttggttggcaatacctggctccctccctaccaccggcctatgctcagcctcaattcattgctcaaatagaaacagaaccttggtctaggtcagcatggtgcttgctactgagtgcaccagggctcccagcagcacacacatccccactgacctcagctcactctctttcctcctctcctctctaaactccacacagacccatgctctgttgctgctaatcagcactcaatggtaatttgtaaatgtctgcaaaactcattataattcttttgtgtgtccaggcgctgcattcctatcaagagggcaaatcccttgaagacagaatctttttcttccttttaggttcaatattctgctcacatgggaactcaacaaatcatattgtttcggtcatgtagggtgccttgaaaaataaggcatgatcatttgttataactagtccctggtcaccttcttcatatgaggctaagaaaatgaatatagtcatgaaatgattattgctctcctggtccaaaaagtaaatttaaattcttttctttcttaagtccaaaagatacaaaactaattgagaactcctgatattgttataatactattacttataataagtaataatagtagaagtcaaaatacaatttctaatgccattactactaacttcattaggattcatttcttcctctcccccactctcatttggccaaatgcatttcagtaagtgcacatgggagctgagaggatgataaagaattatgagtctcagtatttattctatgctctcccaatattgcagctctattccttccagatgagatggcattttgactgtgggtgatatgattaatgcccaaatatgacctaaaaaattgaaagggaggcacagtgactgggtttgggggaggaggttgggagatatccttcattatttgtcaggctacttaggcaaggaaatacacttattgatgataaatatgcaaaaatgaaacaataaaattttgaactgtgattttttttttcaaaatctaaagcctgtagggtcttggtatgtgggtggagggcctatgagatatagaggaaattactgatgctttctctgtgtcgacctcatccgtaaaatgggagtaatggagccaccatcagtgccatgtctattgtcttgagggttgaaatcagggtcttgggtgcagttgtacaggttgggcctgctctggaacattctgctgaggggagcagaggggccccaatggagcggggctccacttgccaagccatggccttttgcttatgcatctttgctcatttgctcatttgtctgccaagagcagaggggctttttctaatttacaggaagaagctgtttgtgctcacagccgccctgattgagataagtatgtaatgacattattattcaaccaagggctttcactttttcctaatgagtgtctattcatcgcactagtgaggagagtgtggagttggatcatcactataattgagcacagtcagagacggtggcatgaaaaagccaaggacgcagattcacaggagtatagcatttggaagctagaagatcacctactccaaacactcccattttgcagaaaaggagtccaagactcagagtaaacttctcctccccatcaaaaagaaaaggcttgttagttaagttcatgaagctggctggtggtagttggaatgagacctgtggtggcctgcctggcagtcctacaaattagaaggcaggagttctccattcccaagatatacgttcctcaccccggttttgtggcatttgagaatccaacatctgagtatttcttgagggtccttctccagggtctcctttttttttgagacagggtcttgctgttacccaggctggagttcaatggtgtggtctcggctcactgtaacctctgcctctcaggttcaagtgattctcctgcctcagcctcccaagtagctggaattacaggtgtgcaccaccatgcccagttaattttttgtatttttagtaaacaaggtttcatcactttggtcaggttggttttgaacccctggcctcaagtgatccacctgccttggcctcccaaagtgttgggattacaggtatgagccactgcacccggctcctagggtcttctacgttcaggttgagggctgactagttttacaaatactcgaagttcagatacttttctcccacacatctccctggttccactctctagaccctctcgcctccctccagccaacctctttatcagattgttcatcattattgctcaggctgaaaatccaaaccccagctctcctcttccaaccctcatttctccccgggtggactcattttcaccaccgtgaaccaccttgcatggagttccctctgctgccagcccatgtcttcctgactgattgagtcttgcggtgcctccaggtgtcttcctagccatagatctgactccagcttcagcaggccctttctcttgtcacccttgccagccaagtataccttcccctctccttcccctgttcttccctccccagtggttgcttttcttattcatggaacacttgtccccatctcatcacccagtcaccaacactggggacattgtgacacccccatacacttgggtctcgctgttccttaaggttggatggtgcccactcctcctcaacacggctcctcaacatggctccttccccacagtggctccttggccatgatttccgatcccagagttccttgatggctgatatggtttggatctgtgtcccccacccaaatctcatgtggaattgtaatacccagtgttggaggtgggacctggtgggaggcaactggatcatgggggtggaatcctcatgaaaggtttcgcaccatcccctcggtactgttcttgtgatagtgagtgagtgagttatcacaaagtttggttgtttaaaagtgtgtggcacgtccctgctaccgctcttgctcttgctccaccgtgtaagatgcctgctccccctctgtcttcagccatgattctaagtttcctcaggcctcctgagaagccaagtggaagctactatacttcctgtgcagcctgcagaaccatgacctaattaaacctctttcctttataaattacctaatctcagaactaatacaatggccacctattctttttcttctacctggtctagcctcttctttttttttctggaaccatccctttatcctcatcatgtgctctagtccctgacttcacctcctccctgctccctgctttccttgtcatccaggaacttcatggacatcagcgccatccatggtcttgcctaccctagagaagcatgttcctctggcctgtgctgaccctgtctcatccatccccagctggttaaatcttcccttcgctcttctccttcaggctaccaggagcccaatgctgccatttctccaggctttctgggatccttgcatacacaggggctctggtctcagctggatctaatgctttgctcatctctgatttgctccctaccacattgacacaaccccagtccccaactccccacctcctttctggcatattcttgtcttcccactatcagcacttggtcttgcttcctgcattgctgagaagggagactgggctgtcccccaggagcccttaaataccctcttcttccccttgctttttcctgacacctctcttctctcatcttcttatactgacctctgatgcatggggagaagaactcccccagctcatccttccaagcccttctggatccttctagaacatctcttcagtccctctgtcccttgctaagtcttccttctgtcctctccactgattctttcaagtccccaccatcattccccttccttcactactgaatgtcaatgtcttattcctcatttacttggcattcatcctgtgagcctcacttccatgccgacaattctctggagatgctctaccagaggtcatctgttacctcttacttgtcaaagccaaaggcctttgcacactgctgaaatccttgaaagaactgtccttgaaactctccgacgcttcatttccatgtccttactggtttgctgctcctgcaaattctcaccactcttcccgtggcctcctttctttggaggatgcccagggggtgtccttagcactgcttcatgtcctcttcttcctccttccgggggaaagtacaggttcccctcaatagcctcatctctgtggaaagctccatttcatcccttgcctcaagctctctctggatttcttgctagcccttttgaaaacatttttttttattgtggtaaaatatccataacataaaatataccagctcaaccatttaaagtatacagtttagtggcatgaagttcatttgcactgtggtgcaatgatcactgccatccatctctagaacatttctcgttttgcaaaattgaaacttcgtaccagttaagcagtcactccccattccctcctactcccagccctgggtagctaccattctactttctgtccatatggtgcctcacatgagtggaattgtatagtatttgtctttatgtgtctggttagcataatgtcttcaaggttcacacacattgtagcaggtgtcagaatttccttcctttccaaggttgaataatattccattgtaccacattttgtttatccatttatctcttgatggacacttaccatttaacaaatttttaatgagctcctctttgccaggtcctgtaataggcacaggtacacgctggagaataaaacaggcatcatccctgctcttgcgaagcatatagtccatgcagcacccttagtaacgaatttgagtcacaacttctctaatgcgagtcccttgagggtacagaccattgctggcttctttggtggtccccaaacccctaacagagctttgtacagagttaatgcatagttaagatttgctgaatgaatggatgaatgaatgaacccaataagcacttgtaaaagatcagttttgtaaatgcataacttctcttgaaatccttctcttgaagtttcatccccagagagtgtttgcagtagaagtgacttccaaacagagcatggatcactcaacgttttattactcagaggttcttgttacttcataaatcttgagctcccccaatgtaaattgccatcaaacaagcagaacaatgactcaggcattctttttatcaagggcttggtattaagacagattaacttggaggaacagcaccggcctgggtatctgccccatccctcattcttattgtgattaatgagatggggcacatattttttttttactccgcctgaaagcatattgagtttatgcctcatcctacaatgttaaatattggcttagaattacattatctctttacacagatggatgggctgggtgctgtgtgtactgctgacagttttcttgaagtggaaccaggattggtgagggaatcattcagccgtgattacagctggaatgcatgcagagacctccagtaaaactagagtaaacaggtatgcagtgaatccaaaagcaaaagattaatgcaaagatgctgcagaccaagaactaagacagttcagggtagattgtctttatgcagggtgggcaactaactagtaatcatatgccagtatgaagacgtggaactcttcaagggatgatgtcttcgcagttgtaactcaagtgcctcagcactgagtaaggacttaatagatattgtttaaatgaatgaatttatagttttcaaactattttggtatttactattttattttcatcttaaactgacttatgagatagataggtaacaaattatgattcccattttacagttgaagaaactgagacacaagtggtattacgggtcactcaggttaccagggagctgggattagggatctggtctattggatttatatccagggactgctcttccacttaattcattcatcatttcaacaaatgtttgttgaacaactaatatgctccaggttctgtatttgattatgagtgaaggttggtggagatggaaaagccgtgatatctttcatcagggaaattagatctcacagaggatacagatatgaaaaagcatcattacaaccaagtttccaagagaaagaacaatgcatgggcaccgtaccatggcacatagagatctgggcaaatgactttgcttggggaacctggaaatgctttagagaggaggtaacatttccatcagtggagttttctggcttaagaatcccagcccaggggcatgagtgaaggcagagacctaaaacagctgcatcttcaggaatcccaggcaacatggctgggatgtgggcatggggtgaggcgtggcagaaggaacactggagaagcagcaggggctggatttatttggcattaaattaacaaaatttatcgagcttctactaagtgctatgaatggtgtttagtgctgtgttactgtggatataatgagatccataaagttcttgccctcatggagctttctttctataggttggtgcaaaagtaattgtggtttttaccattactttcagtggcaaaaactgcaattacttttgcaccaacctaatagtgaggtgatttggacaataaacaaggaaccaaatatattaattaattaccagttgttggtggtgctaaaaggagctaaacacaacactgagacagaggaaaacacagatcacagtgggaattcctgaggtggtggttttccagctgagctccaaaggatgagtgggaggtgacagtatagagccaagggaaggtgttgcatgctagggagcagtgagtacaaagggccagtggccaggagaaacagatgggcagccagtgtggggacgctgtgtgagagaaggtcagagaggtgggcagagccaggtcacacagggctttaggctgagatttttttctgagaccaatgggaagccatgcaaaggttttatagtgaggtggcctgctggcataacttgatctacatttttgatgtttattatgctggctgctgtgcagagaaagaagggagcaaaagtggagctagaaaggccagtcaggaggtactgctgtatcagttgaccaggtgagagattatggtggcttgggctaggatggtaggagggaggggcaagtgggtaagtgtatattttggagatggaattgacagggtttgctctcatgggggatatggggtgaagagtgaagaggagatgaggaagaatcgcagccttgggtaatgcttgaacaaggagagaggcagtgaagggtggagtaaaatggagaaatgagagagacctcgaggctcatcagcaaggctggacttgatcccatagcagatagggagccagtgactgatgctaagcagaagaataacacagtcaagctggcattttattaggttggtccaaatgttattgcggtttttgccattacttccaacgggaaaaaccacaattacctttgcaccatcctaatagaaggccactttgacggctgggtagagagggggaggcaaggagcctggaggcatggggtgagtccagggtgactgtgacagtgagcaagcaaggatgagggctggaggtggggcagagaccccagactacttgtggcctgtggtcactccaaggtccagtgtggttaggattgtgaaggaaaatgcagttattatctgggaggcattagtaattggaccagggtgagggaggcaagatgggctgagagtaaattgatagcctttgggctctcagtggagcagccagcctgctctgggttctcaggtgagaaggctgtgaattctctactgggtgggacaccctgatgggttgcctgggagccacacagcccccagcatgcctctgggggaggggaagggggtccagggacctgctgctgtgtagactgttgggtcatcaatggtgcctgagtgaatgtgctatctcaagatgattgaactatctttgggggcggtgagcttcctgttacaagagaagttcaagtggactgataagtacttggcaggggcttcaaatgccaggtggaagtcgtactagatgtcctgaatatctccttctgccagcactcctggttccatcaggttctggggagcttagggggagttctacgttaggccaggcactcctgagatgactgaaaccttgttgtgggtggaagaggttgaaaggaccctgaaactgggctcctggttgtcccaggccctgtttacagtggctgtaggcttcaggcacttgcttcataccaataaatgggtgcagggcagcccagggcagccacatcagataattcatggaatggcagagaaatcaccattctaaaaggccaacaccagcaccattcagctctttccataatctaaggcagctacactaattgaaaaaaaaaaaaaaagtcagtttggtttggttcagcagtcagcaacatccattcatggggtgaatgaatatagaagaaaactcaggcctgacataatgtaagtggctgcatatattgtaataaaacccacatggactcgtgcagcaatcccccgaaataatgagttcaggtttgctacagatttgcggctagctcttccagagccagtttttttctgagaggcatctcacctcacccgatgatctttagggccagtgatcccctaggtaactgtggccaggaaggaacggctgactaggtgggtacagaggctctacgtaagtctctgcgagagatagttttctggtggcaagaggacttgatttcctttgcccttgtacagagttctcagatcagggatcaaactttgggcatttaatccctttttccaattctgcatggttcttgcttttctttatattattctatcaaacaagctacaacaaataccaattgctttttactgctagatcaagccaaggagcatagaatatgatctctagtggggtaatagaaggcgattagagaatgagacactcatgatcaggtataaacagggtgagctcatcaggggataatgctttgcactttttagaaaatatgagacttagctttagaagttgagcaggattggctcatgtctgtaatcccagcactttgggaggccgaggcgggtggatcatgaggtcgggagattgagaccatcctggccaacacggtgaaaccccatctttactaaaaatacaaaaaattagccaggcctggtggtgggtgcctgtagtcccagctcctcaggaggctgaggcaggagaatggtgtgaacccaggaggcagagcttgcggtgagccgagattgtgccactgccctccagcctgggtgacggagcaagactccgtctcaaaaacaaaacaaaaaaaaaaagttaagcaggatttggatggggtaaagaagaccgaaacagtgttttgggtgggacactggggaatgacccagcttgtaactgacaaagacacttaaaggaagaggtgaaaatatcagtgaggatgtagagacattggaatccttgtgcactgctggtaggaatgtaaaatgatgcagccactatggaaacatcatggtaactccttagaaaattaaaagccaaattaccgtaggatccagcaattccacttctaggtatatatccaagaaaagggaaagcagggtcttgaagaggtatttgcacaaccatgattatagcagcattattcacaatagtcaaatgttgaaagcaactcaagtctccattgacagatgaatgaataaaccaaatgtggtatatacatacaatggaatattattcagcattaaaaaaggaagaaaactctgacacacgttacaatatgaatgaaccttgagcacattatgctaagtgaaatgtcaatcacaaaacgacaaataccatcgaattctacatttttgaggtacctagagtagtcaaattcatatagacagaaagtatagtggtggttgcctggggttggaggtagggggaagtggggaactattgtttattgggtacacagtttcagtttgggatgatgaaaaggttctagagatagatggtggtgatagttgcaaagcaatgtgaatgtactttaacactattgaactgtacatttaaagatgattaagatggtaaattttatgtgcattttaccactgttaaataattaaaaatggaaaaaactaagaggcagaaatgacttccaggccaggcccaaatcaggaggagcagggtttgactaaaattaacatttctatggcctctgtgctcaggatagcacctggggtttaggagggattaggatgcaataatgagttgaacacaaacaaatctagagaagcaagaacttcctagaataggagcaggaaaggcaggacaagctgactgagtcctgacttaagatggccctcatggtacagagaggggccatgatgtcaatgagttgatgtatctgaaggcctgttcaccaaaccacctactgatcataatcagttatcttggcccccagcgtggctctgccggcagtcagagaatgcactgattggtcaaggagtgaattcacaccaatcactgtatgttttattggacatttcaaaatcctattcatgacttacatgtcttgcgtgagtgtggttagcctgagtcctgagcatgtttggccccaccaaactgagggtctgatctagaacttggggagtgcactgagaaactgccaccctacagggtctggctggctttcttgagaggcttttccaccgtcactgatctgatgttcaaggcaagcagaaagtacacgtggaccctctgaaactgttctggcctctagcttcagttaacatctgcatgtggacacccaacgcatttcctttctgactcctgctactgaaagtggtctgttcagagcagtataggcgtcagcttgttagaaatgcagaaaatgtggcacatatacaccatggaatactatgcagccataaaaaatgatgagttcatgtcctttgtagggacatggatgaagctggaaaccatcattctcagcaaactatcgcagggacaaaaaaccaaacaccgcgtgttctcactcataggtgggaattgaacaatgagaacacatggacaccagaaggggaacatcacacactggtgcctgtcatggggtgtggggagcgggaagggatagcattaggagatatacctaatgttaaatgatgagttaatgggtgcagcacaccaacatggcacatgtatacatacgtaactaacctgcatgttgtgcacatgtaccctaaaacttagagtataataaaaaaaaaacccaaaaaaatcccatatctgcaactcaaaaaaaaaaaaaaaaaaaaaaaaagaaatccagacttccagcccatccctgacctattgaatcagaacatgcattttactagatccccaggtgattcacaggcacaacaaatgctgagaagttctgcttaagccatctaattcagcgtctcccaagcgtgcccagtcatggagatcatcaaggtgtgcattattaaaaagatgcccaggctcctttcttggtgattctaattcagtgtgtatttttattttaatagaaagggaaaaagaaatggatgtgagtagcgtgtgcaggtatgcccatctgtggacggaggggaacagtgatacataagccctgctatgagaagaccaggtgcccatggtcatgtgtggaggcttttctgtcatggaaacttctagagggaaaagagagtcaattttgtaaatgtttataagcaacttgtagtaaatttggggacactcaacatttaaataacaattctagctttgacctttttcagcattattgatttcggcttcatctctcacagaagcatcctcaacacatccctggtttcccctgatagattaaaagaagcttatttttcaaaaatgtagctgagatagaaaggcttaaggagaacaggggttccttcaaccatggagaaggctgttttaagagtaaattagatcagcgaaagctttctgtacttgcttgtacaatccctttcagtccctccttctctcatgcttttcagtgaatattaagtctgaaatctggaagaaaagagcctttctaccttccaggcaactatctctctctgagtcctcatgaatcctaggaacttttatacttttattcatgaatgaatccttacctcctctgccaactgcttcatcaaagaaccatgactcaccctaagttatgcaaaaatcaaagacacatagttggaatctatatttcttaacatgtctctcttcttttattccaatttatttctaatggaatgccttttacaacaactaaaataaccttttagatatgcaattatagtgcagactttggggacactggagaaccagaaagaataaaggtagggttggggagaagcatttaaaaagagaaagagagctagagagggggctttatttacaaggcaatcgaaaggtagtttttaggtttagcaattgtgatctgtttgtggttcaggtttgggacttggcactttgtaagaagaagaatgaccacccagtggctttagttaccactctctagtccaggattgcctatgggatcatgggtgtaaaggaagcttgacactgggtttgggccaaggtggccagtggaggtggccacagtccctgacattcttgtggcttctctcacagggaaggagaagaaatcctagaagaagtaaaaaggctgctgggtaagcagagaggaggaagctgactccatttctttcatcccacccaggcagtgacacaaaacctgtggctcctttaattccttcatctggtctggcaagtatgaaatgtccctagcaattggcattcttaagtccccttaagagtccctgatggcaggtgtttgctattttaaatcataaaaataatagttgaaggaattaatcaatgaataaaccaatatttgtttagcatcttgcaatggtgggccaacaaagcataaaacatggccccaaaatagaagaagcttgtttctacaatgattatgaataggctcagttcatcttttttgggaagttgcttaatttccttgagccttagttttatttgctgtaaatggaaattaatagtatttacttcataggctgctataagtatttattgtgtacaataattataatatgtttgcagcaaaaagaaatcaataactaatagtgaaacaacagtctctttggggaaaccagaaacacctatacaaaacaatttgcaaacaaagagagtattggatgtttatagactgaggaaacagagtatggttgaacaacttccaggtattacctgatcaggtgggacactggagttttattttgtggtctagacagttttacagagttgagagaggaagagaacagagtgggctgatgttttctgagaagtcttcatgaggaaggtgattcgtgaatcagaggcccaggaataccactcatgttctctagctgtgtctgcactgtgcaaggcagactgaagggtaggtaaggctaaataagtgggctctgatcctttgcctctctgctctgccaccatctctctcactagcccttcacccttacactcaatgcacttgtctgtacatacatgtatcacttcctcatctccttttcactaattttactctcacctcttttttctaggtatttttacaaaatgtcagctttattgaggcaaaacttatgtgcaataaatggtatccatttaaagtgtacaggttgatgagttttaatagttgttacactgagaaaccacaactacattccaaatatagaacatttccatcatctccaaccctctctctaccttccaaaaagttatcttgtccctttgcagtcaatcctgccctgcttcctggggaaccactgccttgctctctgtcattagagattagtagattagtttgcattttctggaattacatataaatggaagcacaaactatgtggtctttgtgcctggcttctttctcttagcataataattttgagattcatccatgttatcatatatatcagtattttatttatttttattgttggatagtgttccatagtatagataaaccacaatttctttatctattcacctgttgatacacatttgggtgcagttttaaactactgtgaataatgctgctcttaattttaatgcataaagttttgtggggacatacgttttcatcctcttgagtaaatgtccagacagggagtagaatggctgggttgtatggtaggcatatgtctagtttttaaagaaatgttccaattgtttttccaaagtgattataccatgttgtattctcaccagtagtatatgaaagttctagttcctttatatccttaacaacacttggtatggttagtctttctaattttagctattgtaattttactaatgactagcgatgttgagcatcttttcatatgtttcatggccatttgtatatcttctttagtgtaacgtctattaaaatattttgcccacttaattgggtgggtacaagttcttttcagatgtaagtatagctaatattttctcccacactgtggcttgtattttgatttttcaaatggaatcttttgaatatttaaaagttttaaattttgataaattcctattgatcaatattttgttttatagtttatgctttttgtatgctatctaaaaaagttttttcttacccaagtctgcaataattttctcttatgttttattccagaaatgttataatagctttagattttgtttaggtctagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaggcctttgacaaaattcaacaagacttcatgctaaaaactctcaataaattaggaattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggtgaaggaaataaagggtattcaattaggaaaagaggaagtcaaattgtccctgtttgcagacgacatgattgtatatctagaaaaccccactgtctcagcccaaaatctccttaagctgataagcaacttcagcaaagtctcaggatacaaaatcaatgtacaaaaatcacaagcattcttacacaccaacaacagacaaacagagagccaaatcatgagtgaactcccattcacaattgcttcaaagagaataaaaatacctaggaatccaccttacaagggacgtgaaggacctcttcaaggagaactacaaaccactgctcaatgaaataaaagaggatgcaaacaaatggaagaacattccatgctcatgggtaggaagaatcaatatcgtgaaaatggccatactgcccaaggtaatttatagattcaatgccgtccccatcaagctaccaatgactttcttcacataattggaaaaaactactttaaagttcatacggaaccaaaaaagagcccacatcgccaagtcaatcctaagccaaaagaacaaagttggaggcatcacactacctgacttcaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacttaggcacgggcaaggacttcatgtctaaaacaccaaaagcaatggcaacaaaagacaaaattgacaaatgggatctaattaaactaaacagcttctgcacagcaaaagaaactaccatcagagtgaacaggcaacccacaaaatgggagaaaattttcacaacctactcatctgacaaagggctaatatccagaatctacaatgaactcaaacaaatttacaagaaaaaaacaaacaaccccatcaaaaagtgggcaaaggaaatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagttaggaaacaacaggtgctggagaggatgtggagaaacaggaacacttttacactgttggtgagactgtaaactagttcaaccattgtggaagtcagtgtggcgattcctcagggatctagaactagaaataccatttgacccagccatcccattactgggtatatatccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaatttcctagaccttttaatacactcccagggcttgaagactactcctgcatgccaacaactcctggtttttggagtttggaaagatggtccacatctttcctccaaactccagacccttgtgtccacatgcgtttcctcttggatgtttataagtttcaaaaaactcaacatctcaaaactgaagtttgtacttttctctccacacatgtgcctccgtcatttttgcctgttttggtgaatggctctgtctacccagttggtcaagctaaaaatatcttctcctctttcccacctgtatccaacccatcactaatcctgcccattgtctcttgtacatatctgcaagtcattcacttttctctatgcctcactctgtattcaggactaccctccctttccttgtggtgctgcaaaggtctggggttcccatacccatccctaccctacctccaactgacttgcagttccatccttaaactctacatcagctttccttggctttgaagataaggattatgatcctaaatattcctgatcagtcctctgcctgtcctttcccctggccttctctccagccagtctcctcttttctttcagactcagatgcatgttttccctgatttcctaaaaaatatcctacctctttcccttcaggtccttcatatgctgttcccactcccagaaagggtcttgctacttgtcacttctactcatctttcacacttgagttcaaatgccacctcctgggggaaggctcccctgagcccctggcctagctcaggtccctacttgcaagagctcctgcaagcctgtacccctctgtcatgtatcactgtggcaatgacataattatacatataattgtaatgtagtatatatttcactctctagcatgtgagcttcctgaggatagtgactgtttctgcttgtcccctgttctattttcaccatctagctaatttccctgcacataatagaggaattcgtattgaaataagtatttaatgactgaatggatgaatgagtgaatgaaggcaaagagatgggtaatcctggataggatgaagggtaggggtgatccatggggtaagacctcaccaagatggtaggggtggggatagggggaggcataatgggatcatgtggttgtgggaaacacttttgtagatgtcctttttgaattggaaatcaataaacaattttctttccccaatcatgtagcagactatcaattatagcaaaactggtgggacttaacattactctcatcaaaatcaacctgtaaccaactttagaagcatacggtaaaatagtttcagcacggaagatgcagatgtaactaaattcttatcacactagcttcctgtttagaaacaattaagtataggcatcaaaaggcacaggcaagaggggaaagttcaattagaggaagatgttttcataagccaattagaaaacagggagatattttcacccttcctctggagattttggaaatcctatttacacagctgtgaaaggccagctcaagcttggccgagtgggctaaggtgagttctgggtccagtgacctgggtgagggctctgacagtgacagtgctggagtcgggtctgtgttcagagtgagctcctgcagggcagcagaatgcatgcagactcagtcaccctcatcttgcctcagtttacctaagaatacattatgtacatgtctctcctcttagtggttcattacccaattttacctatgaatagaatgaaacaactcctctgctaagtgcactgttggggtttggtgggagtatagatcagacactgcctttagtcccccacacctgtcctgaaacagggcacagcatgaaacatctctccagcttgcaatggttctgctctcagttttcccatacagataccatatgtggtgaggctttgcctaggatcctgcctcccaggtcctagtggtagctgaacgaagggggtccactgggtaggtggtggagatgctgttccatctggtacatgtcggggagatggtctcttctcacgggtacttttccctgtgcatctggcatgtcacctgccagggccactgtgaagtcccctgctaagggggaggaatagtggggagccacctctctacatctcttctggaggggtcacatcatatagtgcagtggtgtctgtgggatcaaatcccaactctgttcattactagctgtgtgactgaacaagttcagtctcttcatttgtgaaatggggataataatatgttacctcacaggcccattgtgaaaattaaatgggtaaagataggtaaaggcatttagaacaatgtccagcatatagtaagtgctataaacgtggtagctgttgttatttgacagcaatgagctgggttagcagtgagtatgttagcagtgagtatgtcttgttttctatctctggtcagggatgctactgtttcaggcctgcctggcacaaaatacatcagatatccttatcatcatctactttcactcacacattcgcatgacactaattttgagttttaatttggaaatactgcccagtcaacaaaaatttattgaatacttcttctgtgtcaggcactcttttggactttggggaccccacaatgaaagttcagtgtatgttttgatgaagttgaggctgtagtggaaaaaatggatagaaacacacacagccagtgaatttccatgggactggggctgtcacatacagagaggtttaggggcagcacagagagaagtgaccctcaggaacggggagtccaggttaatctcccccagaaggtgccatccttacgttgctgataatcatacatctcagagcttcaagatcttcattatacaactgtcattttatttctcttgtgtatctagtgggtcattatatctctgaacatatattaaaatagacggaatagattcaagcagcttttactggggcactgtgctaagagctttcatccacattaaatcatttaaccaatcctctatgaggacgtccagatttcttcagaaaccaggatgccagatagaataattttttgatggatggagtccattaccagtttaggccatgagcccaggtgattgaaaaagcattaatcaggctattgtcctggtgttgccactctctccaatttttaaacctcctgctactaatggagatattatctgactctcctgatgataaaagaattatctcatcaaatcaccacatgattatcaggattgcagccttgctttttcaccagttccagaacatcacttaatttttaaactacagcgttggctggtgtcctttgtgtttttgtgtatgctttgttttacctccaaagacttctggccgtatgatttgtatttaaagctagatgtcaagtgtgtgcatggtgtgtgacagacagagaaggagaacctcgcctccccttcatctcctccttcacctgtctttacttcactctgagaccaccaagtcaaactccgtttgtaaatttacttcccaaatctgagctcttagaagttctcacctagttcaagccctccctggagatatggagaataaaacagggttggtggtgggctgtagggctccccagttcccttctgtgcagtccaatagcagagaatgagtcagaataggcatgaggcagtctctctggcatgaactccaggcccattttaaataacgcatctaaatgttaatgcacacttaagacaacagtgcagctcatactcttcccaaattgattcattttgcagtgggcctgatgcaatttactcagtataaaaatgtctctggcaattaggggaacaaaggggcaaagctggcaggctacagggatgacaaacaaagcaagatgatgtgaaagctggggccagaattgaatttctttccgaatcagacatttttgggaatgtcaatagcaaacaagaaaggccttctttgcctgcaagaaaaacttgaggattctccattcagaaaaaagaatcaaatagtctaagaaatggttttagtgaaatgctacagcagctttcatggttcctaacggtgtcaactttaggtggctggggttcaaacgcagaataaagctagcgaaagggtgagccaggcttaagccacatcagcgggtggaggttccagatcactgaagaacaagtcccctgacccctttgctggtaagaatccctctgaacaatatggctgtggcaactatgctgtagaagagactaaaatcacttagcctgggaaaacaagtgaagaagagatataaaaactatcctcaaagggaagacagactgccttgttaggagaaagtaagcttcctctgtatgactctagaggacaaatagaggatcaaccagatcatggtgaaataggagaaggaactatcatgtgttgggtgctgatatgattctaggtgctttgtatgcattatcatagtactacttcatagggaaactgtagtattaaatgaaatcatatgtctttgtattaagaacatggtaaatactctatacacattggctatcgttgttaaaagcattattttcacaaagagcctacaaggtaagcaggtattactattgccattttgtgtataaaacacaagaggtttggagatattgaataactttttagagacagtcattacctttccaaagttacaaagccaaggggatatcagcaagttctacctgggagctaaagctgctgtacaatggggtgatctgttttgcaaggtggtgagcattctactgctggagtcaggcaagtcaaagccagatgggctttggaagagcctcttgcattgttttggggtaggggataaagaatttgaattcaattacttttaaggttcatttctggttcatgattccatgattgaaatatttttcaagttctgctagctagattatgcctttaacccacaaacagtcatgtaggattgtgaaattggagaggcagtcatgggtgaaggccaagaactaaggaccttgggtatatgatgaaatacaggagtttttatttccatctgatttctggctttgccaacaaccacattttctggctcacatcccacacacaatgtacctgctgccaccacctcctggaaccctggagactgtccgtaagttagacaaggtggcagaggttaaacaagaaagttgatagacaagtgaggctttttagaaatggaagtcatctggatctactgagaggatgagccaatggtcactaggaagctcccagggcaggtgaccaggccactgcgagaaaggctggaagactccagatagggaaatcactctgaggcctgcaggtgaacatccagcagactgccgattagaatttcatgcagtcacagagaaattttagtcctaagacagagaaacaaaatcatggagggaatatttaggaaacagttggacagaatgtaattggaattcatcttagattatctgaaaagataaaacactcaacagaagtcagtgtggttaagtggtgatgtaaagactagtaaactaaggagaaggaggaattgggggaaaattactaagtagaagtcctgactggaagaacaggaaatatgcaggaaatagctcaggaaattagaggaactaaaaggcacacacggacagggcaatcaccaagcatgggaaccacctcatttccaagactaacataggccagcatttgctcggcagtgtaggatggttaaggccacaaatggagataacccaggctgaagacagtccttcgattggaggttgagtagaaggaagtgagtcgttatgaagaacagagatggaattttggtcaagagcattatagatgcattcttaaaaccatgtcgcaagttttcaaagagtttctggtccaattaatttgggaatttgttcatttcataagcatttattgactgtgagacaagtactgtgctaggcattgcagatacagtgataaataatgcccatccctattcttggggtacctggttggtgaggaagacatgtgaaagaacaaatgtggcccagggctgtgagaacactcatagagatgtggaacaggcagcaaatggtggtgcaatcagctctgctcacagaaggtctggggtctcaagaaaggctttgtggaaaaggagctaagagattccttcttggaggagaagacctattgttcttgatggtcgggaaggtgagggaaggcaaaatggcttgaactggcttgcttcacttgggggcaactgtgggtagtttgatacaaacgaatcatgggtccagagaaatggggtgagccaggctcaggaggggtgaggcttgatcagtggctttgagtgccatactaataaacagctcagacttgatcctgggtttcacagggatcccctaaaggatttgaggctgaagattaacagcccgtgatattcacttgtcagttctctcatccgggtcttcatttattccaacatggggcttcctgatggccaggagaagtcactgagatgatcattctaggactgcaaggaacgtcccacagaatgaacagcacaatgcaaaataccaatttgactgtgggttctccttcacactccttttggtgaattgaaagcctggatcacacagtggggctaagaaaaaagcagcatggcccacaggtctttccttagactcccattatgtgtgcatcatttgagctaagttgccctatagggtggagcaaggtcctggatcctcaggtaacctggtgccctcaggtgagtgatctgaagaaacatcttcagcttctggcaatggtaggtctcatgccctgggctcagcctgctctcagtggcctcccctagggaccctcccttttctcaccaccacaagacttccccactggcagggggaacacaatcagtcattggaaaggagtgggaacactcattcactgagcttactgatgtaagattctcccaggaatagacattgcaccaaatctttgtgtagactttgtgaagccctttaaattcaaaatcccaaggctgctatggctcttcactaaggctctgaaccataagagaatgcatttctgtaaaagcaaggagtttagccaggcatatgtgtgtcgttccctaaataaaacaaagaggaaaaggcaaacttagaaacaggccaagtaatgagaaagaaggaggtttgctttgaggctgggcatgaatgcagaggggaactgggctactaagtgggtcatggtgtttcctcactcttgggccatcagctccagttgcctggacagtttccttatggctcaaagagctggcaattccatcacccgattccatctcctcaatgcagacttggtttttgaaggtgaaggcaactgggttggaatggagcttcagaagacaggagagcggaggccagcctttctggataggctctctatgaccttcggcagtgccagacataagtctcaggactgcctgctctctaaaacaggcctcttctgtgcatcaaagccttataactttgccatttattgcggacaggaaggactgtatgcacaccatagaaaaatgcagctgggatttataaacaataaataatggttaataatgataaataaataagactgcatccttaattatcagctggcaatagggtagttaccatccatagagtggtgattgggagcagggacagtggagctggattagctgggctcagatccagtctactccttacaagctgtgcaactctaggcaggttacttaacctcactgagcctcagcttccccactgtaaaagtagtagtgctagggcctccctcaccaagtggtggtacacataatattagatgagctgacacatgcaaagcacttagaacaatgctgagaccagagagtaagcatcaagtgattcttcctctttctcttcctcattatcatacaaattacggggaatgaaggaagggacgtgaattcctatctgggatgccaggtcctgtcccgtccccagccagcagcctcattctctccctgtctttcatgtgttggcacttatgagtcaacagggagaggaccctgggtccctgttgactgtagggagagacaagctggtaactgaatggtcacaaggctacatggtcaatgctatttgagaaaccctaaaagggcttctcagaggaggggacattgcatgtgtaggggtttttgtagtggaaaaggggttaagggcagtccacaaagaacccccaccccatctccatggctactcttcttgcaaagtggggactgaagggacaacaggccattcctggagtcctggctcatccactgaaacccacttgtgctggtgtaaaaaatagttgtatgcacagattgtccatataggtacttggagttttcgttagggaagaagatactaccagagagaaagtgaaagcgaggggagagcctgcactcagagggaggtcttctgggcatttgcagcaggacatttgctacaagaagaggtagtggtgattgtggggcttagggatgaggctttgctgtctgaggactgcttttgtggagagggatgggctttcttgctacataagccagtggccacaaacacatgaaagtgagcactcagagagccaggataaggaaccccgggcaggagggggaggaagaaaccaagagaatcacgtggccacagctcatcatctgtgtcctcaggcggtcctttgcacacgtgcactctctgtgtggaatgtcttcctctcatcatccacctgacaccccttgcccctgcagagccagctcaagtgtccttctcagggctagcttgcctgacagccacaagcattcccatagcacccaatgcacagcacccattacacccctttccttatggcctcataactgtgtctgtcgtccaactccaaaccttgttctgagcccctggaaggctgaatgagcttccagagtccaaccagtgcctgggactgagcatgactcatagacatttgttgacagaatgcatacatgaactatgagtgaatttcttgacaccagtgttctatcactaaaattcttgcacctatttttaccatctccctccccactgggaaacagtgaggctcagtaaacacttctgagatgagaagtgtctgtttctatgcattttgacttctctttgtatacaatatatatttatcattatgggattggccaagatgccattctgacaagcacggggttacaggtattcacagttctctcatcgtcctggtgttcaatccatcaaacatccagggcagagtgagaaagcaaaagcagcagctcaaaagagcctcactacaagccttcagctgtcaaatctcgaaggtcagaactggcagaagctgaaggtttttttttttttttttttttttttttttttttatgcccatcaatgaaagcaatcgtgagtaaaagttgtacctgccaggaaaggaattgtcctttgtacttcatgacaaccttcacagttgaggtgcattttgacagctgcttcctgagccccagggagggttgcacatttattcctgggtgtgggtggagggcagggagaaaatacttttcatcttttcatcgattggagactcttctgtgatcttgaacggggctttaatttttagacccagagcttaggctttagaagaggtgcatcctagaactagcttcaattgatatgttatccatccacctaatatagaacccctactatgtgctaggcagtgtgccagacattgctagcataaaaaggtgtgcaacccaaagtctccatcttcaagacttgtgggccagaattagatgaccaaatttcagaggagtcctcctgagaagagcttttcctgactggataagaacagctcttagtttcctcggagccaggcgtgacgccaaggttcaactgcaaggctttcttgggaaaacaacacaagaaaagaaatggacccagaagatctgtttccctgtgttacccatgactataagcaaattatggaagctctctgagattcggtttactcttctataaaggaggtgaataatatgaatggtacagatcatagtaaaggtgaaatgagttgatagaggttgactcacttggcaaactgaacatgcactgtacagatatttaccatgaatattaacaacatagtatctgtttcatgagaacaaaaaggagggctgtggctctgttgttaacctgggacctagatgagagtcaatatgtgaagtacaaagagaatggatggatgggtggatggatggatcaatggatgatagatggattaatggatgaatggattgatggatggatggatggatggatgaatggatggatggtagatggatgagtggatggatggatggatggatgaacggatggatggatgggtagatggatggatggataggtgggtagatgggatgtatggatggataatggatagatggttggtggatgaatggatggatggatggttagttaaatggaagaatgggatggagcttccttctggctttaagaggtttggcttctctagtccatctgtattcttctcattcccctgtggctttggaagccatagtccttctagagacagaataacagatgtgtcaggagtatatccacctgtggagaccagtgacattcatgaccttggataccctccagctacctcagctcagggactatgtaggcaggattaggccagggttggaaaccttgtcactagcctgtccacccataagtgggagaaaaatggctctccaccttaaacacaagtccctcccaagtctttaagctttcttttttacttttcttcctagtgcttagtaaatggttatataaagctacccgcttatgtgatcaaccaattcaagctgagatgttagagccatgattcttaacttttggtgcacacccagaatccctgcagagctttctaaacatacatatgctcatggcccactccaagacgagtaaaatcagaatagctcaagatgagactcgggccgggtgcggtggctcatgcctgtaatcccagcactttgggaggctgaggtgggtggatcacaaggtcaggagtttgagaccagcctggccaagatggtaaaaccctgtctctactaaaaatacaaaaattagccaggtgtggtggtgggggcctgtaatcccagctactcaggaggctgaggcaggaaaatcacttgaacccaggagacggaggctggcagtgagctgagatcacgccactacactccagcctgggtgacaagagcaagactccatctcaaaaaaaaaaaaaaaaaaaaaaaagatgagactcaattgtatgaagtttgtaaaatgtgtagttctcacttgtattactaaagcttgagacctactatgttaatcgctgaaggtccagttcctcttaagaggactagcattttagtagttgcttcaatattactacttaaagtggggaggaatatggtaaatccaggtatactcaatgggactggtactttgggatctatcttggagaacacaagtggttactctgagaaggaggggtttaagtgaaatctgtaaccctggctctcttcctgcccactctcccatgaccctgagcagcctgagaggagagtgtcccttagacagacagcctgggaggcagggggttaggcactatcagcacctgctctgcttgttgatctaatttaaacccacgacaaccccgtgagtggcacaattactaccatttgacaaagatgaggcttgtagagattctgagacttgtccaagctcatattgtgtgtgaagaatttcctccaagaatacttagagctcaagtctcctgcccactgtgtgctcagagaacttcgagctacgtgattgctcctgtaacaaggtgtctgagaaatatccccctgacaagcctgggtgtgagttttaaggcttttaaaaattacctttagagcctttgaatggctctctctttttagtgtaaatcacctagacattaaaggccttattgtatatttattagtgtgttattcagaccatgggggaaaagagagaagctgactctatgaatgactttgaaagtgagaaaaagctgggcctgaaatcattgtgacactgccacttgagggcatcagtttcaataaatgatcaccttttttatttctgatctcatttatcatgcaggcaagattcgaagagaacttttgaccatggaggctgaatgccacaggctctgatttcctcagctgtcaagacttgccacattgcactgggctgactgaagttcaacccagagcagcctgggaaaagcaatcaggtcccttttcagaagcaaatacctggtggcatctttccacaggtgccctgccctgagaccatctctcgcttggcctgtctactgacaggaacagccagggttctgtgcattagtggtgaaggtatcagtgggccagtagggaggttcctctttgtccagggagcaggagtctggggtggggagaattacttcctgctgccctagtcctggatggcatctgaggataggttgctggcattgccaggacagaagaggggagcagagggcaaccagagcttccactttagaaggtaagaagctacggctgggcaatactgtggttgtccataaccatgctgcaaattagcggtggaatcaggattgaaaccatacctcctgatggccacaaatcaatatctttttgagttaaattaccttggcacatttcctattaggattgctactggttttaaagctgggatctttggtcagaactgactgccttaagtaagcgcggcagctgtgtgggtacccagcatgaatgcaaatttttcttcacttggggagggtggctgcagattttaatctaagggcagtgagtttgagggtttcctgatgcagctgggcagctgggaaacagacctttccagggtgccactgtggagatgagtcctggctttgccacgagcaggcagttttgtttcttagtttgtttttttgagacagggtcttgctctgtcacccaggctggagtgcagtggcatgatcacagtttactgcagcctcaacctcttgggctcaagcaagcctcctgcctcagcctcatgaatagctgggattacaggcatgtaccaccatgcctggctaactaaaaatatattttttttgtagaggttgggggtctcgctatgttgcccaggctggtcttgaactcctggccccaagtgatcctcccgccttggtctcccaaagtgctgggattacaggtgtgagccattgtgccgggtctgagcctgcagtttgaccttcatcacgtcacattacatcacatcacccgcctgggcttcatgttccccatcaggaaaccaacatggaaaggggaggaggttagactcccgtatcttccgggtctaggggttgaggtcctgcagaaaggcaaggctttgtgctgagaatttcaattcaccaccaccctctggactgaggcttatttgtgctttaaaatgccctgacagcttatcttggctcaagcctgagtttcctcaacgacttccggtttaaaatatcttttcaagtattagtaatccaaatgattggcaacttctatccccttgaggcccaattcttccctccacacactgtgtagttctggtcatacataataaagtccccagatacccgctgctgtgggaaaaagtcatgtgcttcgaaaggaaacaagacacgaggtggccttctgggtaggagccctggagagtgtctcctatagccctacacgccacccaccatcaagcttgcgttcttgcatccgggagaggaccaattttacacagacaattgctgctggattgatcttctgagacacatcagaatggcagtgtggtgcagtgggtggctccctagccggctgcttctgctggatctgccactagcgatcttagctcagcctcttaataatacgagcctcaattttaaaacattcacataagcatgtgctgttgctattctgcttgtgtcttccttactggactagatgttccttgaaagctgtgaccttgttgtctttggctgtgtcatctttggcacctgccacacaagaggcactcaatccatgatggtgagatgaatgtttgaacccaaaaggacctagcacttattagtgccaatgatagccaggcactgtgcgagccattttccatatgccatttcacagctcaccattttacataagtattatcctattcattcagttcatggggactttatggccactaatttctagctaagatgtcctatgcctatgtgactctgtgatcagccgggcctaggctgtttggtagcccctatttctctgcttccttgcttctctggtcattctggccatgcagatgagcaggctgggcactcatctgtctgtcccctgcgagactccagccaaagcccggcagccttggccaacgtggccactcatgctctgtgattcattagacctcatatactctgctgctttccaggcaaccaggaaggcagcagctgctgtgcttctccaactgcctttcccctgccttctgcctccgggtgcttccaaccagtctgctgctcctgccccacccgtgcacgacagccggcaccacctgctcacgacacagtggtttccggggaacttggtggcgtctgacttgtcattcctcagcccactcctctgagtcaggctctccccagccgactttattattacaacttcctccctcgttactacaaacacggaatgttgttttccaaatagtggtccccaaaccaccgtctcctgttatgagaggaagccagccccattcgtaatcatcacattcaacatcaccaggatatcactgtgtccccctcgctgctctgagcactatgctagtgaggtcatctctgacattaaacagagcaagctttcggcaaggcaaactgctgagtactgcaaatccaaagattcttgagactagcagcgaccccataatcagagagcaggcaaatctccatcctttgtgatcccaaactctgaacagtgcaaagctgggcaagttttgatttgctgggcaaatgccctgttccttgcagctggccaaggcacccacaagagtagctctgcgctgcagtggatggtccattgattgtcctttctgctgccaccttctaccctcaccacacagatctcatgggaggtgaggaggctggtccaggcatctttaaatctggaatcactccagctcatcactaaactctgccccagacaaagccatcaagtcactgaatttgcctcagctcagtcccaattcctctctcctgctcaactcacaccctccagaggacagagcagctcctctggtgatggaggcattgccttgggaagaggataagttgggtggccaggtggacgttgaggcaggtgaccatggcatcatgtggagggaaggctgcccctgaaggcactgacatggcaagtcccagggctcatttgtcttgaaggatcaaataatcaaaataatcgctcttttttttttttttttttttttgcaagattctttcatatttccctttctctttcccaactccaccctttctccctaagaggcttcaggtctcctggaaagagtccagtttggaccacatcacttcctatttcctctctctgcctcagttttctcctcttttaaatgagaattgacttcctatatgagcatagaaaggtaaagagggaaaaactatttgcaaggccctatggccagtcatacccgaggagttattttcctgactatgctacacagggaaacaggccaggccacacaagaagtgctgaaacccctctggcaccttttctcacactcatgggtattctcagactccaactccacctctcccagccacatcagtgaatcctcccacccgccaccagcaccacaatggactgatgcctgagggctcagaagcctcaagcagcactccctggtctctgccagtcctggtagggaaggaaggaatgttgagagtgataagtcagaatatgcagctctcagaatatgaggctgggcaaatacctataggatggcacatagccctgccctcagataagaagtcttcccatccaggcttcttactggaaagagaagccgtgctggagggaggcttggtgccagaagatagctggtcccaaacaaggggcagcccagacacctgctatgccacactgatatctggtgaatagagcaagagtccttggtagctgggaccttctcagccagcccagagaggcatttcagaggcaagaagatggatatgagtttaggaatggggagagcattctttttgatgtcaagatttcattcctgatgagactgcagcagcttgtagtccttctaagtgcaactaaatacagatgggttaatggctgggagtggggagaagactttcaagaaattacgaaggaggccattcagccttattgccaaagcaacaggcaggatctctcccctgcacaccatggggatggacaatgggtaacagttatcgttcaggtgggacccttctgaaaaggtattctcttagaaggaagccaagtctaagcatagctagacagttgggctttttctcctgtaaacaagtcacaaagaaggatccttgttgctaaagtaatcagatctggggtccctcaacgctgaggtcataggatggtatttatacttatggaatggaaaaacaaaagccaggcacagaagtgccctagtttaagtttgctttccaatgtcactaccgcagaggcctgatggatcactgagtaagcaagtatctccagaaagcttagaggattccactgtcatatgtcttggtggttgtagcacaaagctctgttccaatctctactgaattacattggcgtagtatccatgactaatcctgctctggggtaccaaactcccatagaacccgcttggatggccaaagtactttgtcctttcccttcctgcccaacttctgctggtaaaacccagtttctaccatattaaattactttcattctggccttttaacatttctttgactgttttcttcttggctgtatctgaactttgggaaatgaacatctttaacacccactcatgaaatccccactctggcagctggtcctctggcttctggaagggccactagccagggaagtcagagggacccacaaatcagtacccaagacactacctaagggatattagtagtaattgctcaacctggacctaccgattaaaggacaatcatgagtttgtaagtagatgtcacagactctggaaatgtgtaaccaaaagccaaatcacctggtataaaatcaattttggacatggagaagtacttacccatgcttccctggagtgggcatcaggaggatctctcttgcagcctcgttgtggggcagcagctgggcaatgtaccttccagagggctgcaggtgcctgtgcaccgagacggccagtgtgcagtgctcactgctgctcctcatccacggactcaggatggtgtgcttggagtcagctgaggtgttgagaaggagaaaggagcctggaaagagacagggaaaacgaatctgcagatgtgttcaggtaagaccagcagtagctctgtggcaagacttagagacaaatggcatcaaaatcagagatactggaggccattatctccttctctgcatgcacccagccttcttcctccattcttagattttctttgtaaatagtatagcctgatgcaggtggacagtggctggagacataggccttataatcaggcagaccaaggttcgaaccttagctcccctacttcctacttctgtgtcctagagccttcgatttttcatctgcaaaacaggaataaaaacatctatttcaaaagactcttgttccttcccttactagttgaatgatctttggaaaagcattaactttcttaggtttcagtttcctcccttgtaaaatggggtgagagggttggctgaactcaataatctcttaatgttcatttcagctcttgagcctatgagtcatgtgaacttgcaactggtctccacagaaaaagccctacaaatctcccctgttgttgtgcccatggcagagtttccctctggagcaagccaatcttgattccagtagcacaggccaaatgacctgcgagaaacctacattcatggggattactgtcagtgtaaaagcacaccaccattatattgttccaggcattccttctgatacattaattttacttgctcacttctgctttgaagttttgggccattagatgctgctccttttgcagtagaaatctgtttcaacaagatccctgacttccacagtgggaagcagctaatgagtactcagtcttcttaaactactcctggcacttccaaggtctccttctgcagataacccagtttcccaaataggcaaataaactagcagcctgcaataaacaatggtgcagataaaagagggggattcctaccaaggcaaagcattactcaaaaggaaggtgttgttccaggaattggaggtttccaactttcttaaagtaagtaaaagcgacttctggttaaaatcaggatgaagcataagaccgtgtctgagctggatcgagaacgtgaaccctctgtacttgttgggaagcttcagcatggcatataagaaaagtgatctacaactgtcataaataatctacattatgacagtattttgcagcagaggaaatgttcttatcatgggcacagaggaaaagaaaagggattagaaccaaagacaaagaattgggaagatcatctaattcagtcctcttgctttcctagggaagcagactggagatccagatagggaaatgacttgtccaaagtcttagtttgaaagttaagaccatactccagatttctggacttctaagcagtactcttctccttgtttctttttcactggcccactgtgtacttcagcctaaaacatggccaaggtaacttgtggccaggatgtatagctttggaagtcagaggggcaggaaggggaatgagaggcacatggacaccagaccaaatccatttattcggtcccttccttactcctttctgccctcagattccatttaatggatgcctattttgagcaaacatccaagcactggctctgccctgaggacatagatgtgacagacacagttgtggccttcaaggaactccaggtctggcaggggtgcacagatgtctgcaagaactatcagcacaaatagaggtcataaagtcagacacacatccaggcaaaacatgttgggagccttcaggaaggaggagacaggaggtccaggtgggaagatccgtaaagaggaagacccttgagccaggtcttacagggagagaaaaacaaagatactggcagaatggactgtgcaaaagttgaagggaagaggagtcaggacaaaggtagatgatgtttggctgcagagtaggacactggagagaagactgagaaataaggagggccagggagataggaggtgtaaccagaccacagagagcattgcttcttggctgaagatttccagcttcattttgtggataatagagagccagatattttgagcaggtgagtggcaccatcagagtggtgcagcaggagaactgatctgttatggtgggggcaagagggaattaatattgacccaacctcatcttgcaccacaagtccacacaagggcaagaatgtgactaaatgcaaattcgaagtgtttgctatattactgttgtaagcaaaggcaatgtgttgagggtggatgactggggtttccagtactagggtagtgtgtatctgtgcagagcacgtgaggaccctggaagtatctctggggacagagtcttgctccagactctttgggggtatggcctggggttaggatgaagacagtcccatgtccaataataatttacacataagggagcagcagcaactgtgtcctggtctgagaccattctctgatgttctcaggttggcagaatgttgagtagaaaccaggagttttctgagctactgaagggaagaatgggggcaaaataaagaaagtatctccattcttctcaggaagattactgctatgcacatgtgcacatgcatgagaagctcaaaaatccagctgaaggtgttgaggtattggactaggggctctttctgtgtcactgctcctctccacccttgggtgtggccatgcatgtaaattctgtccccgaaatttggcacctcaataatggaaccctttcaaagctgactggaagatttttccagttctaatatgtgagatgatgtttatatgaatcttattttctgcaaccggactatcaataagcgactgagcttattttcactctcaatggaactctatagttgagagctatctcttcatcagcagctttcctctaccaaaaataagggaaaaaatacatttcataagctccttgggatattgtcagtataaatcttttaaagtcagtaagaatttatctctcctctctctctttttggtttctatttattttgctcaggatagcttggggctaggcaaagtctcctggggtcctttctaactaagaaggatggtctagcagcacacagaccttcacccagtgtggccatgggggtgtggagaggcagatcaaagagctctgctcatacagcgccacaaccatgtttcttttattatgcatcttgttgatatgtttaatgattaaatatgaaatgatttttatttttacctctggtcaccagtgtaggaatgtgctgctctcatctcaaccagcagggctcacattatgggccaaaacccaagggtcatgaacttagaggtcaaactcttttgtatctgttcagttattgaccttagacaaattatttaaacactttaaatattaatttgctcaaatttaatatgggcagagcctacctcatatggctgttgtgaagattaaattaaataacatgaatcaagtaggcagtactgtgcctgctcaaggtaggtatgtaataaaaatcagttccctgtgttgacaggtgtcttagtctggaattcctttgatctaggactaaacctggaatcagaaggactaaactggagtagctctgctactaccaaccttccttggtaaaatgaagtgttggatacagtctctctaaggattcttacagccccaaactgtcagtaattctatctgcctgcctagaatattattaatctaaagaaattgagtcaagtctccaagcccccaagtcctaaactcttcttctcataattcacctctctgagggttatataccaacagttttaatcgattggccaaatactccatgaactttcccgctaagatgtaaggaagtaagctgtggttccctgccctgccttcctctctcccgatttacacacatacatccctaggaagggctcctgtactagcatcatttgtttcttagatgcttctgctataaggctgctaccacctctaaatgtctggtatgcaacacaatgcttgccacatggtaggtactcaatgatcctaaaaatcaaattgatatgatggtaacatggtgatgtagtttggttgtgtttgttcctccaaatctcatgttcaaatatgattcccagtgttggaggtgaggcctggtgggaggtgactggatcatgggggcagatccctcatgaatggtttagctccatccccttggtatatgtgagttcttactcagttatgtgagatctggttatttaaaagagtctaggacctcccctcctttctctctcgctctcactctcaccatgtggcatgctggttccttgttgccttctgccatgattgcaagcttcctgaggccctcactagaaacagatgtcattgccatgcttccagtacagcctgcagaaccatgagccaattaaatctcttttctttataaattacccagccttaggtattcctttacagtgacacaagcatggactaatacagaaaattggcaccaatgagtggtgttttgctataaaaatacctgaaaatatagaagtaactttggaactgagtaacgggcaggggttggaggaatttgggcgggagaagctcacaagacaggaagacgagggaaagtttggaacttcttagagactaattaaatagttttgaccaaaatgctgatagaaatatggacagtgaagacaaagctaaggaagtatcaaatggaaataaaaaagttattgaaaactggaataaaggtaacctgtgttacacctcagcaaataattgggctgcattcatgttcatgccttagggatctgtggaaggttgaacttaagagtgataacttagggtatgtggcagaagaaatttctcagtagcagagtgttcatgagtggtctagctgcttctaacagtctatgatcagatatgggagcaaagaaatgacaaacttgaaacttatatttaaaaggaaagcagagcgtaagggtttggaaaatttgcagactactcaggtagtagaaaggaaaagaactttttcaggggaggaattcaagtggcctgtggagcaactcgctaagcgaatagcatgactaaaagggagccaagggctaatatccaagacaataaaaaaaagatcgcaagggcatttcaaaactatttgggacagcccctctgatcacaggctcagaggcctaagaggctaagaggcaagaatggtttcaggggccaggcccagggtgctgttgccctgctcagcctcatgacactgctccttacattctggctgtaccagctctagccatggctcaaaagggcccaggtacggctccagacaccactttggataacataagccatgcttccatgtggtattcagcctacagacacacagaatgcaagagtgaagaaggcttggcagctcccatctaaatgccataggaggcatgggcagaagtctaccactggggcagagccctggcaaagaaactctactaggtccatatcaagggaaaatgcggggttggagcctctacacagagtccccactggggcacttcctagtggagctgtgggaagggggctgctgccttctatatccaagaatggtagagacactggcagctagacactggcagcttgaagcctcagcatggaaaagctgcagacactcaactccaatctgtgggagcagccatggaggacgcacactgcaaagtcataggggtggagctgcctaaggccctgggagcctacccgttgcagcagcgtgccctggatgtgggacatggtgtcaaagaagattattttgaagctttaagatttaatgactgccctgctgtgttccacacttgtgtgatgcctattacccctttgttttggtcagtttctccactttggaacaagaatgtttacccaatgcctgtaccaccatcgtatcttagaagtaaattacttgttctgattttataggcacataggtgagtcccacatgaggctttggactgtggacatggaacatttgtgttaatattggaatgagttaatacttttgaggaactattgtgaaggcataatcatattttgaaatgtaaggacatgatatttggggggggcaggggtgaaataatatggtttggatgtgtttgtccctccaaatctcacgttgaaatgtgattcccaatgttggaggtggagtctggtgggaggtgattggatcatgggggcaaatccctcatgaatggtttaatacaacccccttggtgataagtgagttcttgctcagttagttatgtgagatctggttgtttaaaagagtctgggacctcctcattctctttcacttgctcttgctgtcactatgtgacatgctggctccttgttgccttctgtcatgattgtaagtttcctgaggccctcactcaggaaacagatgccattgccttgcttccagtacagcctgcagaaccatgagccaattacacctcttttctttataagttacccagactcaggtgttcctttacagtgacacaagcatgaactaatacacatgacaaggaatcaaatagtacagaattgcttataattttttttaaaacagcctctaacctctgctccacctgaccacattccacacactggaaaatttttttttaaggatttctaacttctttaggttgctgccttcataattctaaatattataatcatagttttccttgcaggtgtgacaactttagacatggataggacaataagaaaaataacaatatctctttcataattcttgatttttaaaatgttcttgattttaaaaattatcttctacaccttacgtttttaactttatgtgatatatttatgacttcttccaacagctccaggcagtatcacttgactcttctcactataaagatgaggctatttagtcttcctgccctttcctgtactttttctcttccacacccccctcccaaatcagctgtacttttcctttaccttgtcaagattgtgtaagaatgattaagtattttgtgttttgtttataggttgatgctaagtgtggaaaatcaataaacagatcttttatactgatggctatatatttctcactgcagtgaataagggttatatttataatcttctctatagatccaagaatgcattctactccaagcaggatatatttccagcatcaggatcaaatgaattctctctcttgcattgttacttgtcaaaattgtggcacattttaatttgtctcatatttgaaataagtcttggtatatgttatcagcaataattaagattattatgttaaattgtcgtgtgccacaaaaataaccaaatttcattgccagttgtgtctttaagtatagctatttctgtctttctttaatctacagacaattattgttttactttgattattctcaaaaaaaggtttgtaatcagctactgtccaaaatttgcttcctctttaaggtaattcattgaaaggactctgacaggttctcttgagcacagggtagatcatatcattcgactaggtaaaaaaagttcaagactctaattttaataatctgaagtgttcatgaaaattgccaacacaacatcaagtgggacaagaattaattacatgggactgaactaataaaggactaaaataatttctaatgacttctttttgtttgaaacattgttgattctttttatgctttattgtctaaagttaagaaaactttttcttttgagctacttagagcttacaacaacaactgggtaaagtatagttttgtgagcaaaattaaaacatttagttttttctttacctgatttctccagaattttgaaaagttgtgagtattcttaatttatggcaatatagttatttacgcaagttcagttagaatctgttttcttttgtaggacaaaatagtggatatagtagttaatagtggatatagtggttattggatatagtggttattttaccaaggccttgactgaaatggtatattttcaaatatgatcagactgctttgaggaatttagattggctttattgagctgataagaagccctttaaaaagtctgacctgatatcttttctacacagtttctttatagggttcctgacctgtggtaagtaaaagatgtcactttctgacaggcccagaaacctcaagatattttaagaccttgagaagggaaaaattcacccaatttgtacaggtattacagatatagataagtggcacatccttggcttggctttctagcctcgaggttttaaaaagtctaatcttagattccttgtaaaaaagttccaacaaagctaacttataagagcctctatgaccaatcaccgttcttgctatgctttatatgaataatcaggccaaatattatcaaactaatacttattttgcaaataagtttgtcataccattatttgtctttggtagaaataaaggactaaagagaagaattatgttttttttttttaaaaaaaaaaaaccctataggtttttctcctcataactctgttatgagattccagccttgtccattatttttgagtttttattattttctcacaatgtagactgaatcctgacttctttcttggctacaagtctccaaaaataacattttcaaattttcttccatttttctaacttgaaattattagaaattaaaactgtgcttttcttataaccctgcaaactaaagataggccacttaaataaccttcaagaaaaattaccacagcaaattatatataaacagccagtaatacatgaactcacaaagttcgtttaaacacccaattcaaactacaatccagaaatatgtgtcagattgtcactgaaatctgaagatgcttcagagactctaaaaaaaaagtagtttatagactattccagacattagccttttttccctgtttccatagaaataccttttatttatgatctgtttgcctgcatcatatatagagcctagcctacctgcaatgccacctcctggaatgggacacaactgtttaaccaaactgatctattctcaggactaaaagactgatttaaagagagatgggatggtatatttaaatgtattcttttctgcatatcccaatttgttttccactcttttgtctatctctaataatctctaacccaaacctctccaaagctatcaacttggcttttaatatgtgaaacattttttgttcgagacagagtcttgctctggagtgcagtggcaccatctcagttcactgtaacctctgccatgaaggttcaagcaattctcctgcctcagcctcctgagtaggtgggattacaggctcactaccacacccagctaatttttgtatttttactagagatggggtttcaccatgttgaacaggctggtcttgaactcctgacctcaagtgatccacctgccttagcttcccaaagtgctgggattacaggtgtgagccaccacacatggccaaacatgtgaaacttgttaaggcttcaaagtggggactgaaggaaataaaaatattttaccccaaactatatctatttgacatattttcaaatggctgcttggagagtcagaaaacaaaagtattcctgcaaagctgtcttttgtggggcagatttgcatctgtagaaaatctgcactgatgcaaccagctcttcccttgtccagagctaggaaaaattaacggagaggttgatacctttaaaagtctgaaaaatacatttattatttattctatttgaaagctgctaccgtgagatttcatctacataacaagaccaccattgctagccaagcctcctcttcccttcctcccataacctgtcttgcaactataacctgttttggccatactccaagtccccattctttttgtaacttcaagatggcaaataagcttctgcatcccactgaggggtgggttaatcactctgtgactttcctttgtgtgcacattaataaattggtgtgctttttctccaattaatctgccctttgtgggttaatttttccatgaaccttcagagggagggcaaagggaaagttttccctcggtccccacagaatcagtttttgttttgttttgttttttttcagtttgtctttccaggaatttctagctgatttttttctatttattttatatctgtcttctttaccatatcactaacacatccatatactccttgaaaaaattactcccttcgtcttgaagacactgatttcctcttttaatttgtatcagttgctttctgggcctacggtacagctattattctgaaatttcttttcactgggacttttatgttagtcccaccatcctcaggaaacttcttcagggggaaatttcttagtgaatcattgaatatttgaaatgtttatttcatctttacatttggttggtagcttttctggttatggtttgcagattagaaactttgcctcaaaaatttgaagacctagtttcagcgttttctagtgtcagtgttactaagaagaagtctaacgctggttttatttgtaatttctttgtaattgatctgtttttcctatttggaagcttttgggatctttctttaactttaaagttctaaaatttcaatacattgtatctaggtagggatctagataaaaattcatccgtggcattttgcaatgcatatagctacagatctgtacaaaaatttatccgtggcatttgctggcctctgtcaatcagaaaacacatgcctctttcatctctagcaaatcttgttttattatttctctgataatttaattaccccatgcttaatcttgaatctttcttaagagatttatctttcaagttagcttctgttagttatctgatttatctttgttttctctggggtcagctttttttatatatattgatctttctttttctcttttcttcttcttttaacagaagaaaaagcatataaatttatttatgtgcaaatgcatgggagccacacaaaatatgagacttgaaggaccagaggacagaagtttttatactatgcagaaatgaacagaggcttggagctcctggggagaggtggcagcagattatggaagggtgaggggaggaaacatatggcaagaaaaggctgtcttgctatgcatgatctttctttttcatgctgctggattattcacatgttgagtgatcattgatcagtccctcacatttaaacaggagagactagggaggctaacaggagctatatgtgtacagatggtgtttgtcctttatgcataatttgcctgatggacagtttcaggagcaagccattttgcaggtgactgcttcccagtgccagcccaaagggcacgtcaccctgagtatgaacactcccactagcagccataagtctatcactccacttgaagttttagaggctttttcctagccctatggttaagcatcctgctaccctctgctttgggaaaatgatattgaaaaaggaatgaaggccatctgggttaaccatagagaaatttccattcttcttctttaccttcatcctttctttcaggtgatcttttacctgcactctcagcagataggacacctcctctattctaaacctttttggcacattctgggctctggccactttgtttttccatggacagcttctgtctcctctatgtgctctagaaattgctcatgcctcccctcctgctctgtttgctattcagaatttgttcctccgttgatagttctctatttaatataacttcagtgggatcttaaaagaggagacaaatgttcaatccacttttctgaaccagaggcctcttaatcatattctctgagtgagaacataaatacacacatgcatggatggatggatttccatctcaatcaatcaaacaggatccaggcatcattggctaattgtccatagtacaataaactattaaatcattattatctgctattactctttcagttgatcacaatgccactcatgttaggtgggaactaaggaaaagcagaggtttaatgggttggaatctggacagaaggagtgcagtgtaatgcatgcaggcctcacccagatgcatgccccgagatatcagtgttggggaataatgctgtgccaactccagagtaccttccgcagaacaccagccccatggatgtcaacaggtattatgagaaggctctgtgggcgaatgagtctggggactcctgggtacaacaagaagtaaacaggctctttcactgaagacttctcagagccttgatatgccaataagagttgtggctcttcaagagtggaatataaaatgaaacatttcccaaactcctttgtgcacagaacccttttgttactgtgtataatgttctatggaacacactttggataccctcctctaatctatttctgctgcaaagaccgtttgcagaaaataggaaaggaagaaatcatggaaaaaaaggagaaacaacatatccttatccatatctatctatataaatatctatgtgtatgtctaatctatatctatatctgtatcatctctcaagtcttttctgcttgtctgactttcaaactgtcctttcataagacctcagctccttctggcagaatcacgctcctggaaacctcctctgagttactgcactggtctcgctacctgaggagacttaaaaatgctacattccatatctggctttcagaatgtcgtaactagacataaacatgattgtcacgtagcttaatcgcttgttgtactggggagaaaaccaagaagcaaagaagttcaggacttgcccaaggtcacacagcatattggtggtggatctgcaattagaagcaaggtttccagacttctgtccagtagaacactcactgggtatatgcctgtccatgatagaaatctacgaaggtgtttcagtcagatgccctgtggtttggtccccagatgcctgcagatgttcctttcacttttcagcactctcaccactctgtggatcaggcccagcagctggtctcaagctcttctttctgactgtccccagaggtcacagactaacgcatgggcaggtgggacccagacagtgggtcctccttttgaaatcactcacagggcttagatggcctcaccatggctgagcagtatttgagggtttcctttgttcatgtggtcttatgaattgttcaaagcaaactggggccactgaaagaggctccttattgtttatttttcaaacttgaattctactatcctgtgtagcctcaactcatgttttagttgttagagcagaattttgacatttagaataaagaggaggtgggaccgtgctcattggcatgctttgcctaatattgagataatggaaagacagaacttcaaagctctagaggctcttggaaatcatttggtccaacctgttcaccttgcagctgaggaaacagtccagtgggtgaagggctatgcctggcttccatagcagagctgagccatgtgggcactcagtccctgtgcacttttactgtctccctctgtctcgatgtcaaatatttggaattagctctgttactctccaccaccaggacttacatgtattgcttttctgcaccttcattcggaagcactttgaagagaaatggtattcgtttttgagactgaatcattagaaaaaccaagtgtgttcattaagagagagaaggggagtagagggagttgatttttcttgatagtattattaatcttaagataatgagttagttgtagcctagaagtagtagtacaatttgcacaattaggagcctctgcaaactgaaaaggcaaaacaacctttcgggtcctacttaactgaggcagaagttccctagaaataatatatatttatgctcatgtgtgtgtgtagtaaaatacgcgtatgtgtgtgtgcgtatatacgtgtacatcaatagatggatacacataaacatacacatatgtacggatgtatatgtatgtctatgtgtggaggagtacgtttttatatattcccttttagatctctgaccctgttaaaatctgaccctgttagatctcacctcatttttaggtgagacacaaaggtggtttttttcttttacatcaatggatttcatttagaaaaaaggggcagagccaataatctctacatactgcatgcgtgccctggggtgtcagcaaaaaaagataataaaaggcaaagcaaataaatagaaagaaacagaagacaaagtgctgagaaatcctttttccctaagagctcattttggtaatcctcaaggaaaatagaaaagcacttgatctgactagaaggagaaaggggaacaaaatgaaaactaaagaattgatttaattcaatgagaaacaggaggaaggagagataaaagcacctgctggaggaggaggacggaagggagggagctgggcgaccagggtgccttcagtggaacaaaacccactagagagagagagaagcacaaagtcaggttttccctttcccacgtgggttttttagctctggaatcggattgttcaatttttgctttaagtcccagatgtcaagggataaacatcttctatgttacttttaaaatttttgctaagaggtagcggcttttattgctttctctgggcattccattgatttttttaattaaatattttaaaaagcaattttttgcccatttccttgcaggagtctcataaaatctcaaccttattataacaagttctgatgttccatctactgtggttctcagatacccgctgctgaagaaggagcatggaacgtgggtggatgttaataaccaagccatgcagctgagaagcaaagggaagctgagaatgcatcactgtttgtcacctgctgccactctgggagagctgcatggagcacccatgggcctctcacccattcctcttcatttttcggaagagtcaatgcacatgcaggaagctgaggtatctgcatggcaagatggctaggctgagttctcaaaggttctagaatgttctaggcttctaacagatcttttcacttcaggtctaaacttcctcctcatacattctacacacagaagtcagaaccatcttcttacatttaatttaggttatccttcccttcttttaaactcttcaattccttctcactgaatacagattaaaacagaaattccataatacggggccaggcgaggtggctcatgcctgtaatcccagcattttgggaggccgaggtgggcagattgcctcagctcaggagttcgagatcagcctgggcaacatggtgaaaccccatctctactaaaatacaaaagattagccgggcatggtggcgtgcgcctgtagtcctaggtactcaggaggctgaggcaggagaatcgcttgaaccagggaggcggaggttgcagtgagcagagatcgtgccactgcactctagcctgggcaacagagtgagactctgtctcaaacaaaaacaaaaacaaattccataatatgatctataagaaaggccagaggggaactgaactgcggtggatttcataggctggctcactcaggtccccaaccaacttccttctctcttgcctccttcttttattgagactggaagtttaaaaaaaagacttgatttaaccaggcttccttgcagataggaacagccatgtgacacagttctggtggtgaaatgtgagcagaattatgctcgtatggttgccaggttcagcaaataaacatatagaacacccagttcaatgtgcatttcacattaataacgaacaattttattagtgaaaatatatcttaaatatcgcatgagacatgcttatgctaaaaaacaattttgttgttcatctgaaactcacatttaactggacatcctgtgttttatctggcagccctctggtgcggggaactgtggggaaagtttcccctttctgcttctttcttctttttcttgcctagaatatgaacataatgcctggaggtgtggcagctgtcttgtaaccagggattgacaacatgggatgtggactagtaaagtaataagagttaagtcacagccgagcgcggtggctcacgcctgtaatcccagcactttgggaggccaaggcagacggatcacgaggtcaggagactgggaccgtcctggctaacacggtgaaaccctgtctctactaaaaatacaaaaacttagccgggcgtggtggcgtgcacctgtaatcccagctactccggaggttgaggcaggagaatcgcttgaacccggaaggtggaagttgcagtgagccaagatcatgccactgcactccagcatgggcgacagagcaagactcggtctcaaaaaaaaaaaaaagagttaagtcactaatggtgtcattggatatctatgccagtgctgaactgcctgtctccgctcttcttgtgggaaacacacagcaaaacacccaagatccttatctggctaagtcatcgcagcgaaggcttctgttgttttggagctgaacttctataagcacagggatcccgcctgtcttgggccggggctcactagtacctggtgcaatgccaagtacagtgtttcttcaataaacatttgctgaatgaataaattaataatatttaacaaaaaagtgggcaactcacttattttcttatatcttatctaaagcagtgtcatatttcttatttaccttgggggggatgtttttcctttttgaacattatgacgagtggctacagagggttactctttgcaacataaaacaaatcaatttttaaaatgccttgaagtttggactcttaagatcagtgtttctcaacttgtggtttgtaacccattaatgggccatgaaatcaatttagtgggtcatgaccagcactaaacagagaggaggagaaggaggaggaggagaagaccagcaggaggaagaagcagaattaatttataaaatatcctcattgtaactctcttttgggaaataacagtggctgctgatctacaggtacacacacacacacacacacacacgcacacacacacggacacacacatgcacaggtgtatgtgtctttcattgtgatgtgaaatatatttcttactgtgaatcacagttttaaaaagattgaaagccaggttcaagatgagtagtgttcaaatttcaaatgtccatatgtggaaatcacattggcctgattcttgttcctgagccacctctcattagttgggtgaccttggaggagaagtaatttatttggacagcgttttatgatttgtaaaactctctcatgcaatcttagaacaacccagtgaaatagatgctatccccagttgtagttgtgtgtctaataatggcagccaatagccacatgtggtttttgagtatttgaaatgtggctgacgtgactgaagaactgaatttattttatttaattttaattaatttaagtttaagtactgaaacttaattcagttattggaaaaatatgtttggaacaacttgggtatgtgaatatgattttccaagaataaattttataaaatacatctcaagtatttcagatgaaaatttagtctctaaactgaaatggctatcagtataaaatgcatactggatttcaaagatttagtacagaagacatacaatgttttattaataatttttatattgagtacaagtcaaaatgaaaatattggatctcttgggttaaatgtttattaaaatgaagttctttttacttcttatgatgtggtttctagaaaatccaaaaggacatttttggctcatattgtatttctattagcactactttaaggattaagtatcttgccctaagcccctggataaaaaagtgcttcaattactattacaattcaggtccctttacaaatctatggctcttcccgctaaactaggacaagtcacatctccctaggccttgctgttcttatctttaacaacagcaagtaaactagtgtatgacgataataataataatggctaatgcttatccagtgcctattagtcccgagcaatatgttaacattttgcaaggtttactgcattttaatttgcaacaaccctgtaaggtagttatatgattattaaacctactttttagttgagaaaactgagactcggagatatcaattaacttgcctatcagctcaagatggtgtagactgaggggcccagagcccaggagctccatgaagatgactagacagctagagcctttccctggaccttggcctttatgaaagcagctggactctgtttgagagatggtatattgcttttatttctagagtctttttagattcatttcctttgagaaataatggctgtctgatcttgttgctgattccaacactatatggcagaaatctccaatctctacagtttttgaatacatagataaggctgaagaaggtgactttgtatctgaaaattttcaaccagaaaattgaaatttgggctttgttatcatgggtgcttatttaaagttctacttgcaatgtcagactacatctcaatgaaagctttcaaatatagggacaaataatactttcccaggaaaattatttttcctttgttatcaatcttgtttatgtgcattaaatataatttagaaaagaaatggtaagaaaaaatttatctgtagtcctaccaattaaccattccattttggttttttatttcaccacctgcataggattttaaaaatttaaaatatttttttctcttattctttcacttaacattgtcgtaagcatcctctatgtttttatgtaggacttgcaaacatatttataaatatttgtgtaatagtccaataactggacatcacatttaatctgttgttttaaacaattaggttgtttccagtttcttgctattgataaagttgttctcctgcttctgtgaatatcatactctttctggaagatagtccaccaaaatatgtacagtttaaaaaccttaaactgtgcatattcttttacccaataatttcctttctaggaattgctttaaagaaatggagttatttctaaagacatgtttgcaaagtttcccagcattatttacgggagtaaatatttagaaatggtaaatgttcaatacataagattagttatgtaaagtatggtgtatccacataataaagtacttcatggagtcattaaaattattctctggaagaataggtgaggatttttaaatattaataacaatagctttcttttactgagtaccagacactgtgcttatatatatatttaggatataatttaatcctgaactatgcatgtgcttggtattattattactgtctctttcacacagatgaagaaacaaatttagagggttaggtgacctcccatagccacaaagctgataactgagtaagcaatagaactaagacaaaaaaaccctggtggtttttctccaggacttacatccttaaccaccatgctgtataaacaactaggaagttcataagctctcattagaagagagaggcagttataaaacagcatggatagtgtgacctcagtctagcaaaatctaataaatatatgactctacacacagaacaacttgagaaaattcaccaaaatgtaaaatgggtaactctggaggttagaatatttttctttacactttcttgaattttccaaaacacctgctacttaaaaaaaaatactgtttacagtgataagatatacacagcacaaaatgtaccattttaaccatttttcagtataccattcagtggcattatgtacattcccaatgttgtgcaactatcatcacaacccaattttagatattttcaccatcccaaacaaaacctctgtactcacttaacaataactttccattaatccctcccctcagcacctggtaacctctattctactttctgtctctgtgaattggcctattctagataccttgtaaaattggagtcaaatgatgtttgccctttcaggtctggtttatttcatttaacacaatgttttcaagttcatctatttcacagcatgtatctgaatttccttcctttttaaggtcatggtatgtgtataccacatttcgtttatccattcatctgctgatggacatttgggttatttctatcttttgactaatgtaaatgatattgccatgaatgttggtgtacaagtatgtttgagtctctgttttgaatttttgggggtgtatatgcaggaatggaattgctgggtcatgtgatacttctatgtctaaccctgtgaggagccaccagactgttttccatggcaactacaccactttacattcccacgagcaatacacaaagattctaatttctctccatacatcctcaccaatatttgttgtattactttaaaaaaataatagacaaactaatggatgcgaagtggtatcccatggttgatttgatatgcatttccctaatgactaatgatgttgagcatatttttatgtgcttattggtcatttgcatatcttccctggagaaatgtctactcaagtcccttgcccattttttagttgggttgtttgcttttatctgtcacttcttgaattagaaaaacaaaccacagtgacttttgtgcagaattttaaaaagtaaacatcggattgtatccattccctgcttccgtatctcaatctgcctctgggataaaaagttcacactaccagagcatgggctgcctgggctccctctccagcctcccatcctgcctgtccacctcacacttgcttctgaagctgttctcaatgcccccacagttcttgtagacaccatgccttcatccatgctgtgccatatgctgagaaagcctcctcatcttctcttcctgttatttcccttctttattcagcgaaattctaatcatccttccagattcagctcaggatcatttcaaataaaactcttgctatggtgtaaatgtgtctcttccaaaactcatgttgaaactttatttccattgtggtggtattaagagaggccattttgggaagcgatttagtcatgagggctccaccctcatgaatgaattagtgccttgtaaaaaggctggagggaactagcttagcctcctttttcccttagccccttctgacatctgaagacacaacagcaaggcaccatcttgaagcagagagcagccctcaccagacactaacggtctcagtgccttgatgttgaactttgcagcttccagaactgcgagaaataaaatttcaattgtttataaaccattcagtctcaggtattttgttgtagcagcacaaatcgactaagataccttccaaactctttggctttactcctgcatttgccacatgtgtgaatgcttctgacatttacctcctaataatggagttacctgtgtctgtctctctcatgaaacatgctcactccttgacagcaggggtgggtttttgtcatttgcatacactcaatgcctagcgcatagaaaaagctcaatattgcctaatagaactgaactcttgatttatattagctaattgcttaccgatgaggctttatattttgtctatcagtaatgcacggcagtacctgtttcattgcacccctgtctgaactgggaattatatttgttgtttcaatttgcatgtctttaattactagtgaggttgagtcatttccccatatgttctttaattagttgcttctcatcttttgtgaattgtctgttttttttgttcagttatctattggaggcttagtgttttccttgttgatttgtaagaacttcttaaaactaggctcttaattaaccctttatctattatatttgctaaaagaaattattccatgtgtcctttgccatttagttttgtttttaatgtaaacaatttggacaattttatgctatcaaatcttatatatgaagtttactgatttgcctttttatatttatgaacttgagtgtctgtaatagctttccatagtattactttcattaatatgtgacaaaaatagtcactgtaaaggtataccttgctttatggatctttggctggaaattttaagcataattatattcatagatatcattaagtggggggaaaaagggaaaacctttgtaaagagtcactaactttgtgttgtaaattgagctttctttaggacttccttagctattagagctagagagagaaaaaagccctaaattttaagtgagatctaaattgcaaaacaatagcaaggctgggagaagaagatttagaaaagagcttgcaaattgtcagcctttcagagcacattgattgttcttggatgggttttcatttggccaaaggcttggtctgcactgacttttagatttggattggtcttcaatgcttaaaagtcaggaaacagtaaccacttgaatatctggagctgttctggatttggaaaagggaaggaagatctggcaatgttgggcctattgtttcttttttggtggcaataaatggctggatttgaatacctgctactgtcagaggtgtttgaaccagagcaactccatcttgaatagggtctgggtaaaatgaggctgagacctactgggctgcattcccagacagttcaggcattctatgccacaggatgagataggaggtcagtacaagatacaggtcataaagaccttgctgataaaacaggtttcatttcagtaaagaagccagcccaaccccaccaaaaccaagatggtgacgagagtggcctctggccatcctcactgctatactcccaccagcaccatgacagtttacaaatgccagggcaacatcaggaagttaccctatattgtctaaaaaggggaagcatgaataatctaccccttgtttagcatatcatcaagaaataaccttaaaaaagggcaacagcagccctcagggctgctctgtctatggagtaaccattcttttattcttctactttcttaataaacttgctttcactttactctatggactcaccctgaattcttcttgtatgagatctgagaaccctctcttgggttctgcatggggacccctttcctgtaacactaccccctcagatggccatgtctctccaattccccatagtccccacaatttcctaatgtccccctcactgaggctgagggtcagtggccatttatcatcttaccattggcccacttcactcatttactttacctgctaggctgctgtgggcatttgagttttttttgaggacctcaggctgggctgctgaaatttactgggtaatctccccagtcatggaaatatggggattaaatttaaatctagttctgactgtttaattgggaacagtcaatctgtgagtatttgctctgtccatttctgtaagtggaaattgatgtctgttctctccacccctgccctccacctttctctccttccccttcccttggtttggatttaatgaatatgatttatattgacttcaattcataaattctgtaacaaaagcccaactgaagaagcagatagtgaaatgacctcaattgaacgagcctgaagatacagctggtatcttgcatcttacatcctaatggctgcaggtagtgatggtaaataaataggggcagactcccaatttctttggaaagcagaaatgcttgaactttgaaaatcagaagagaaaacagagtgaaaaaaatggtcagttgtttaggactaaagaaaaggaaaaagataactgttaaatatttataaacatgacttagacaaaaattttggttgtggtagaaaaaatgtctttcagactgttaaaagtataatcttgtgtagaaagaaacaatctaaaatgccaggctcaaggatccgaacattcaagaggctggatttgaaatcctgagcatctgtatgccccctcagtgaggagatggtcaaaatgcaccccaagccaaacctggcatcaggaatttgtacctgtgatagcccaactagtatctgcagagcctatctgggagatgccgcagcctagggggttatttccccactgttcagagctctgaccacctatgccaagtcctggctctgccattacttgctgtgtgatcttactgtaggacaaggcatgtagcgtttctaaagtgtctatgaaatagggacagtgacaggactctcttgtagaactatggagaagtctcacggaggaaacccatgtaaaatgcttagcacactgtgtggcattcagcaagggttcaagaactgttcactcctgttattattgtcatcacagtccttactattgcaaacaagactgtcttgaggatttgtgttactgtcaagacaactttcaatgacgagggatacaagaaatgtagcaagaatcaattctcaaggttgtagtctctatataaggacttgaatggtggcaggtaaggcagggcaaatagaaaggtggccactgtgatttcatgaattcactctcatttaaatacagaagctattatcaagaagccttagggttttgctattgattttagtggggcctgtgagaaccatccaggtttcatttaaatgtggaagtgacatttagcttagggttttctgatcaatattctacctgcacaggtatatactgatgacattttctaggtttctcaaggcttattactagccctcaagggccatgaggtagcctccatttggtgtttataagcttacactattcagtctgtgtcataagctgtaaatatttctcctccagacaatttgtagtaaattatatttccaaattttgatttttctccttttattaataatactaacttgtgaaatcaaaaatatctctacaaatactttagcttcattatcagactcttttctacaatgtttcttaaagaaagtggtctgtctatgcatagaaacatttgtcacacaaatgtgtaataaaaccacatatattttgttctctagtactgtgtaggttctgaacaggcagatgttcactgactgactgatagatgaaaaaagcaaatgcaacaatttttaatggaaaaaataaaagaataagggaactaagcatcactctgaaattgagaccttgctctaaattctgttcttaagcagcctggagcagataatcaagtagcacatttagaaacactaaggcatattgaaagtgcttgattctcaggaaccaaatggtcatgagaaatgtatttccaacctagccaagaatgctgatactctcttagagaacgatttctgaaataattccagccagattctcagggctcagggctcagagctcactgatctcagatcctgggtcttttggcaagagatatgaaggttgccacactgggcataaatagcagaggtaggtcagtatcctttattttgaccttttaactaacaaatgggcatgagacaaaacttcacaccaagggtcctacatgaatgcattctctttcattggaaacacccattgataggtcaagaaatagactgtaagtacctccaagatatagcaatatattagtggggtgggggatgtataaagtggtatatataccctcctagtcctcagggaatatataatatagtgtgaaaacaagcaagaacaaaacaaaaggtatacataggtcctaagtgccacataatagtaataatggagattgagattttagggtgtgggttagggtggacatttgcatgtatctagtctcccgtcctctccctccaagttgactccagagagtctaagcttatactcatgcgctctttcgaagccctggcaaaggagtcctctagactgagagcccttaaatcctctattgagatgaaaggctgtctctttcctcctccaggtctggccagtgatgtctacactgcattccttgtttgattccttttgctttaaaaactcttctggtttctggaagactgacaccaactaaatcttctgtaaaaagtcctcccttctttctggcatctctacatactacaggattgtcctcaatcaagagctgatctttccttcatttgcaaacatacttgtttgtttatggcatgtgctataacacttgagattactcacagagacagaaaactttagacctggccagtactgttagaattggattaggctttctggtttcatgctgatatattcctgcttatctcagggttaggccttggcccagtgacttcattgcctctccttggagctttgtggctttttgttttgcctatagaatgaagtccaaactctttagcctggcccaacattatctttacagctccctgctttctgaccctttggtttactctgtggcccacctcccaacccacaagactggtcactgctacctgaggacgacattcttcttaaggccaccaagcctttgcacacacccctccctaccctctctgcccttcttcccctgctctaccttggaatctgctcacccttcaaggtccatttaagggtcacctcctctgggatgacttttccaacttcctcaagcagagttggccttattcccctttcctgtagccaaatctttgggtgcaatattttctaaaacttagtgcgttattatgaccgtatgcctgtgtttccagctatccatgttctttctccccaaggcatgaactaccatttgttcattcagcattcattcattctctgcaccatttattccagttctggcatacggtggacacccataaatgactcctgaattgaactgaaagggactataggggtttagaaatgtgaaataatctatcaattattttaagaagtcaaatatgaaaatttaagagggtagactataattttctgtccatatacactcctataaacatgcacaggtgggcaagttatctttctagtcaatatgcatccagtacctaacataccttgaagggttcagacagaagaaccttgaagggttcagacaagtctacccagatctgagggcaaaaagtgtttctggaagtgctggatggacttttgcttatctgcctgaaatggtacagagagcccccaactgagctttaacggcctttccaggaatctgtatattgaagggaatccatctgatggccttaggaccctcactctgtaggtggttttggggactcagaattacatccaagtctgtttattagaaatttagagagccaagagaccaagcatcttgggatctgagtaggactgattaaataggtaggagaagcagccccaaacgtctgcccagcagaggcgtatgggctgaattctgcatcactgacaaataatagagaactccagaattatgacacagtttttaatatgttcagctttctaatcttccttgtctctccacattcttaatatttgccatcaactcttaatgaggttctatatcttcattttggggggtatatttctgttaatttatcaccttcaatcccatgagaaatgtgtttcaagaagacatggatgaattattgtaaagcatatttatttagcacaatctaattattgcaacattctgtaaaggcaaatgaataaatcataaatgaagagtaatgagggtggagctgctgtgcctgtgttcatgatgtgtgtgggtcacaggggagcatgtacgtgtgtgtgtgtgtgtgtgtgtgtgtgtgtgtgtattagttcacacattatcctgacttggcttgggattctagataagatatctgggcagaaacactttcacttgctctgtgccatagtgacctcagccccacatggctattaaacatttaaaatgtggctagtcttaatatgaatgtattagaagtataatatacacaccagattttgaagccttgggttttttaaaaagatatataaaatatttcattatttggaaagcagttttgaagtttcctaaaatattaagcatgtggttaacatatatctagcaattccattcttagacagctacccaagtgcaatgaaaacatatgtctacataaagatttgtacatgactgtccatagcagctttatcagtacgtaatagccaaagagtggaaataactcaaatgttcagtaactggtgaatggataaacaatggtggtatatccatgcaatggaatattattcaacaatctaaaggaaccaaggactgatacatgatacaatatatatgaaggccaaaaacactaggctaaatgaaagaagctagacacaaaagaccatgtattttattattgtctttacagctgtagagacaagaaatagattaagggttgcctggggcttgggatgggaattgagaatgactgcaaatgagccgaaggcctttttttggggtgataaaaaatgttttaaaattagattgtggtgacagttgcacaactctgtaattttctttcttttcttttctcttctccttcttttcttccttccttctttctttttttctttttttggcaggatcttgctctgttgcccaggctggagtgcagtggcataatttcggctcactgcagccttgaccttccagattcaaactatcctcccacctcagcccgttgagtagctgggactacaggtgtacactaccatgcctggctaattttggtattttttatagagactgggttttggcatgttgcccaggctggtctcgaactcctggactcaagtgatccacctaacttggcctcccaaaatgctgggattacaagcatgagccacggcacccggcccaactctgtaaaatttactaaaaattattgattttttttttttacctaaaacaagtaaattttatagtatacaaattgtacctgaaatgtcattaatatgtaataaatttaaatgtgattttagtctaatattattctcattaatatgtaataattcttaatgtaattttaatgtagtaagttttaaattgtttacatgttgaaataatattttggctatattgagttaaataaaatgtattattaaaattaattttacttatttacttttacttttttaagtggctactagacaattttgaattaagtatgtagctcgcattatatttctattgggcagcacagctttagatgatcccacgatagctgttaaacaatccccatgcctccattccattccagagattgtgcttcctctcttcttggctcacaaccagccccatatggaaactgagtgcttgcatcatccagaagatgctaaaaaagggggaagttgcccagtttgtagctgtttaggcccctggctatacaacagtagcccggtgattggaggaggggtgttgggctgggcgtggaggaagctgctggccttttgcaagctgagggacaggagcacaagagaataccaagttcactgtcaatggcacatccatcgcgtctgaaaatggagcatgttcactgtccatccaaatgttcatataaccttcacatgtgttcataaatgttcatatacccttcaaagccagtgatctgtgctaaaataatgtaagcatggaagctactaaaaccatctaggaggatctaagcttaaatgctactaatttgagacaaaactgttttatttttaaaaatatcatacgatatgtttagaggagcgaggttgttatcacattctctttttgtctgaagcagttgttcccaaccctggctccccatgaaaatgaccggggccgggcatggggggtagtggtggtggttaaagcatgtggatgcctcagtcccacccctagatatattgatttaactattctggggtggggtctaagtagtgatgtttcaaaaggttttcaacagatactactgagaatcactgacccagggccttgctcagcaaggacttctagtgaactttggattaatagagagaggaggatggacaaggatgagccatcaaatccagcaggccaagcaaagtttataaccaatccccttcccaactaggtccagcatcccctttgctcttctaggcagacagccagtttctgctggacaaccatgggtgggtgccgtctgtggcttacgagacagcttctctgtgttggatgagctttaattgttagacatgtctttcccagtctaaactcaaccctgctgctctctaatgtccatttatgggtcctagtcctgccatctggacaaagactgattcagtctagccccttttcacatgagagtccttccactatttgaacacaattaccaggacttctctactcttttctacactatacatcccatttccttgatctgttcactgcatggcctcctttccaggcctgtaaccatctctcagctctagtttatcagttttctctctaagctgggaaacttccaaatgctcaccctccagatggtgtctgcccagggccagtacagcaggacaattacattccttgataaggccattacactcctagtaatgaaccaccacactgcattggctcaatagcagaacaattggaaagaagagagtgaagaagggggaaaaaaaatctgaaacttctcatccataaaccttttacatttgagtatgacacttcacaaaatactcatccagtgaatgtggacccaatttactggaatgcaaagactgtctacagagaaggaattctcattattacaacttatttcttaagtattagccttctgtcaagtgctccagtgaccaaagtttggggatgctggcaaaatgacaatactcaacagagggcttaacagattcgaaaggattgggtctatcttaagtagggtaccttctatttggggaaatgatttgtttcccaaaggtaagctaagatcaaatgcaaatcacatctcctgcatggagaggccatttaaactccaggctgtgaattgaagctgctccttatgtggctttactcacaaaaacatggtctcccaaagaggaggggctatgctggactcctctctgctggcgcagagcccagactgtggtaggatatatttgcttcttaggcagcctaactatccacatctctgtccaaagataattcatttcaaattcaatgtaggtatattgaatactcataatctgtgctagatacctgggtagggtgtctttacatatggttttgttttaaatttgttgcagcagggtttacttggattacagaacgggaacacctagcgctattcagaaaggatcactagattccacggggtggagagtctatataggaattgggagaggagcagggaagtaccagaaaaactcaggaatatcttcctgcctgattttgagaatattaataaaaaagaagcattttcaaaacctagcacatgcccttccacagtgaccttgctcatgtgggtcatggccttcacctgagatcagccaaattctgtagacagacatggcagaggctgaaagagatatcaaagggatggagaggaatttatggttttgtaacatacaaaccaagaggctctttctgatgtgggtataacagtgaaaaggaggcctaacatggctaactccatgttgctcctgacccccaactctcaccatctgcgatgatatcttttaggttaactgttcttgcttatctctgcacataggccaaatgaactatggggggagttaagtttatagtttaactctaagacaaggatgagaatagtcccttcctaaaactagccctcaaagagataaggagcatacacacaagtaataatgtttttctaatgatttacagaagcactgtggcctgaccaagggcaaagaagttatgcaacccttttagactcctgctgatgcccaaacatttgtggtcacctgccacctcctaacctcagccgcctcctttttcccccttcccaatataaaaagaagcttgagatttatgccctttaaggtggttctttaggacattagcccaccatcttctcagattgctggctccctgaaatattatggggacatcttccataatggggcatcttccttgccccaacaccttgtctcttgacttactggctgtcgtgcggtgagtggtgcgagctttggactcagctacatgggaagctaccttctcccaactccctgggataatacttggcaccccatgaacaaacaattctaacttggactctcaaaggccaatctcaaggggtgacaggtgcttcttcttacccaactatcctaactatcaaaatcaaaacaaaatcaaataatcagaaaaacagacactgtcaaatggatcttccaataaaaatgagtgaacatagaatattcaaccctgtgccttgcataaaggatccctaccaccacccccaccgccacccttgtaagagaagactctcttcctagctattttgagaccttgtggcaaaacgccatctcctagaagatttcctgtcgctactgttgtcattctgaggagctgcctcacactggactggtcaacctgccctctcatccactcctcttctttctccatttccctcttaaaaatagaaatgataaaaggcactcatatttgcagagtcttggaatagcataactcagagaaaccactgaggtcattatgcgtgaggaattgcaggcctcaggaagggagggggtatctcaggttccactcagaggtggagggaggctgagccactcttgtcatctttccgttgttgctttatttttagtgtgtttgtgtggccacaacttggttcctgcatggttattttctagggttcaatctgagaggacccctgtgttctcttgctttattacagagagactgggaacccaggcttgcaggccagttataaccagggcattcactagaatacccttaggggtaacagcacagcaagtgacttgaggtagctttcagaaaaaagcagaacaaaaaataatatcgacaataaccacagcttccatttgccaattgcctactctgtacagacacggagctggagaagggactaatgtacaactctaggtgacaacgtgatatggtgccctttggggtcatgaagtgacattgccctctgtggcagaagatttactatattctcacttaacccttccataaatgctaggaaagattactgtgccaatttttgcaaatgacaaaactgaagcaaagaagatctaagagcaaggacataaagaccctaactggtggaactgagatttgaactcgggtcttccggcgttagcttcctactggtgagcacggaagggcaggaagatggatacatatacatcccaagaccctgcttagtgtttagcaagcccaaaggaagctcacagttattgaggggaggccggtggaaaggaaaggggaacagaggagtgctagaaaccaggtatcaagcaggtggattatggaaaagcaatctcagatagccacagcagcagagaataacaacagcagagcctaaacaaacaagaagagcccttgggatccactttttcatgaggttcttcagtggagcactcctgaggtagtggccaagctctcctaatcaccagccaccacgttgccctgggcaaggcttgtcacaaagaagagcagggccacagacaaaggcagccagcctcacctcgcctcagcacactgcacagcagccatctaatagcaccctgcaaaactgacagattgttcctctcaacataaactctgcttcactcctaaaaggattttattacctctcgcataggagtttgatattggcgagattaaattaacacagttaaaaaagggaggaaagaaaaagaagagaaaagaaagagaaaccctatgggcaggtgaggggactgctattagcactcagagctttgtgggacagcacctgtcagctcttacttcttcgagtgactctcccagtgtgtcaagctgtggaaggtctccaggagatgctccgtatgagaggttaaggctggttgagtgacaaacttacagggacaaaagccgggacaggatgccatgtgaagtttggagccagggccacccacccagggtcaccctgcctggatcactttatgagcggtccaatttatttctgcatgttcgcgagggccattcaccatggccaaatcctagttagtcattaaagaggtccacatgatttgattggccacaacaggcttagtctaggcatcttgggtttacaccgagtttgccagaacttccaggaggggctgctagcctgcctcattttatttaagatgctaacaatagtagcaacatcaatttgctgcaccccaaaacaagaaataagaagctctgcatatactgattcgggtctgcatggaactttgatgatagttgggagtagggtatcccaagtacactcatgtgttgttaagaagtgaactctagacagtcaaaggaaccaaggcaagaatgtgggagaacaaattgtcacatacatggccggtaggaacatacattggttggagatttctggaggaaaatttggcaaaaaccttgagatttggcaaaaatcctagcctcagcaattaaaacccaaatttagtggaaatgattatggaagtgaataaaaatgtattttccaaaatattataggaaatattgattgtaatggcaaaagataattggaaacagcttaaaaaggagaatagttaaatgaactaattcatgcatataatgagaatgggagataaggttgaaggaaagtaattaatgacctgggagatgatcatcatatatatctacataataaataaagccacaaaacagaatgcaatatgatatataaaccatgtatgtaaatatatacaaagaaaaaaaactgaaagaataagcatcaaaacattaaatgtagaaatctttaagtcataagctatgagtaattttctgtttatcttcattttcttaattttctacaatgaatatgttagttttgtcaacttaaattatataattgattttttatttttttatgttttaagattcaaggaactctggggtggtgctctatgtaaatgaagaagtcacagtgcaggagggatctttaagaaaagccagctgttctcaacaaccaaaggcaacacagaccaggtaacaccttttggttgtcttactgggcgtcagcattcttgcagcatttaggatttgatagatactccatccttgttgacagattattaatgtcttctagaaagagtaagatcatatgactaggccccagaaatactggcctttccaagagccaagaagcagcttctgccagtgttttccatctcattccagtcgctcataaatgggcaggggtcaagtccatattctccacatccccagacctgtcctgtgcttggcacttagtacgtattcaagtattctcttgaattgacacagcttttgtctactctctgtttctagcaggggtaatatttggaagactcttgccttcagacaggaggttcacaatcacacaatatcattaacttattgcttcacctgaaaaagttttataaactttgcatgcttgctccttttggggtatcattgcacagactccccgaaaccattcccaaggtgcgtctggccacgtttccactctccaagagaagaaaaaaaataaagcaattatctggacagttcaggtaaaatgtaagctttcttctgaactccctttctagtctaaatcccattccgtttctaagaaagcattttcctgattcattctgctatattttctcaattccaagtttagtttcagagaaagctcagcctattagcgttaaatactaggcttggggatgtgtgtaccttgtgccatctcttggaggaatattttaccatgaaaaatggactttaataacagaacattgagagaaatgacacagagatgatttaccagcgtatatactgagatatattaaattgcagacagtttgggtgagactctgagccttaaatgaaacatccaatatctgtaccagcacacagcaaaagtgactgcagaaaagcaaaaacacagagacatccatatgtcactgggagcagcagggcccccgccctcttcagaaatggctctgcagtgggtttctgcctggctgcggagcactgaactgaaaaagtggttaattaatgaaaaacttaaaattcaagcaatgaaattaccttttgcagtgactgacaaaggcactataaataattcaatctctctcacagttgattgaacagagtgcctttcctcttttgacaacggcatagtgacattttttctttccattgccacattctgtagtggctacaacaagtgtcactgccgaaatctagctagggaactgacaaggggcagtgaaaacctaattgagagccggctgcagtcaggaattcaaatgtctagtgtgctttcaggtgggtgactcaaagtgtagggagggcaggcttttcaagtcgagagttctttaggggtccctggaactccacacccactccagaaggggaaaaacctgggtaccagattgtctcccttccctcccctgctctgtaagctcactaactgcagaacctccaaagtgcaggaaggaagagaaagcatgggtgtgggttcggttagcagaggtggtcaaagaaggggaaagaactaactggaatctgagagaagctcttctcccctttggggtcctgttttgtcatctataaagatgctgtgtgttgccagtgttttctcagtgggactaggtggaaaaacaatcgcttggcagtggtgtcgccatgggcaatgacagcactttgaactgacccttgtgtatggtctgtaggaggggctgacagtgcactccctaaagttatgctgggtctctccaccttttaccttgggtgggacagggcgggggatgagtctttcttttcagaccttagccttggctctctgcagtacccctgtttccatccaaagaggaaggccagagactgagcacccagagggcttccaatcacatgccacattgccccaccagcaagccctctgggcactgactgttaacttgaacctgcctatggcttaaactgcttgaatttatccaacctgtgaggctcatcatcctgcccgtctcaaggaattttgcaagtttcctttcattcacccttagagcatggggttggaaatcaaatagcctgactttctataattacagcaacagctgcagcaggagcagcagcagcagcagcaatgattaacacctagtgagcccttccagtgacattctgcatccttacatagccaagtaatcccatctgtatccctaataatgcattacttgggtaaatcacttaatctcagtttccttgtctatagaatgggttggatacttacatgtaccttgtaggtgggtaataatgaatgggaaagtacctaacacagaatatgactcaaagaacatgcccagtaaatgtgactttctttcccttttcttccccccccctagtgaggtccagagacagtgtctccttttacagatgaggacgtggcagcacatgaaaactgatagggtttcttggccatcactcaaacaatcaaagggcaccagagggctctggtggggtggtgctgattccaccatcaactgactaacatgattattctactagggtattcccttcagtccctagcacagatcctgggcaagcagggatccctgctttccagttgaaagttcttcaggggtccctggaaccccacatccactctaggaggggaagaacctgggttccaggttgtcccccttccctcctctgcattataagcttgctgatcacagagcctccagctcaggtcctgcttgcccaggctcagagctccagaggaaagggaacaccctagtaggataagaaatgataagaaatgaccccaggcctgaaggaaccacctgcttaattggggagtagcctaacactgtggaaacaactagcaaagtctccttaacaacagagcctctgggtagagtttatccttcattcctaagggaggctacttaggattatttatttctcattagactctctagggcatgctaagagctgcacaattaaactccttatatcaaggaaacaactattaaaacctaggattctaatggatttctaaaaagaaagagaagataaagaaataggagcgatcaatgctccggatgtcacaaagacactggacttggaagatgatgttttaggaaaagagttgataagtgtgtatgtagtcatctgtgcctatgaagttggcttaatttttagggcctgttttccaaggaagcttggcaggtgtgcccaggtaggaccgacagtgctcaagaatgttaaaattctgggagagctgcatgggaagagggaaacattagaacagaaagtgttcagagattctggattgtgagggattgtaaaggtcaaacagcctgagacacagggtctcaccctaagatagaaacagggtctgcaggagcaggctctgaggctgagtcctgggagaacatttctctctcttagaacttgttaaatgccagctccagggcaaggatcctcaaagcctctgacgggcatagcttatctcttttagacgtttcgctctctcgacagtaaagctggctggtcaggagtgattttgatgaaagcagggttccctggcagagggcttccttgtgcagagtgcagatggcgaacattttatccaaccagggctcatcagcaaagcaaaacttttatttacctgtttctgagaaaggaattagacactgttctctcagcagccttttaaactagaagcaggaaacacaaaatcttttcaaatacttataacaaataataaaatctgtttatattatggataattacagagcagagactcagggagaaaggaaggagaaaaaggagggggaagaaagagttggaggagagaaaaatagacataaagaaacataggaagagcccacagtcctggagggagatagtggagggggcaccttaccatgtgttctctctccctgtttgtgaaagatgaaaatgaacagctttgcagagagagctaaggacacctaaggggccacaaagaagtcagagataaactctcaggggcacctagagacctacagagaggggctcagccacacacagaggtagtttatagactagtgatgtggtttggttctgtgtccccacccaaatctcatctccaattgtaatccccacatgtcgagggagggacctgcaatccccacgtgtcaagggaggaggtgattggatcatgggggaagtttcccctgtgctgttcttgtgatagtgagttctcacaagatctgatggttttataagaatctggcatttcccctgctattgtgaagaacatccttgtttcccctttgctttctgccatgattctaagtttcctgaggcctccccagccatgtggaactgtgagtcaattaaacctctttcctttataaattacctagtcttggctcatatcttttttttttttttttttttttttttttttttgagatgttgtctcattttgtcgcccaggctagagtgcagtggcatgctcttggctcactgcaacctccgtctcctgggttcaagcgattcttctgcctcagcctcctgagtagctcagactacaggtgtgcaccaccgtgcctagctcatttttgtatttttagtagaaacgggtttcaccatattggccaggctggtctcgaactcctgacctcgtgatccacctgcctcggcctcccaaagtgctgggattacaggtgtgaactagagcaccccactggcaagtacctttatagcagtgtgagaacagactaataccatgagaatatctgcaaacacaaagaaagcccaggtgaagaatgggctgagccttgctagactgagggatgaaaagaccaagaaccaatgttagggaaaggagctcagctccctggaggcaacgcttaactttgtatcctgcaaggtgggaagtcaagtcacattttcaagaatctaaggcctgtgttgagtatcatttccaaattgtggcacttgagggtctctctgctgatgtcacttaaagccattttggatttgtttatcctgaattagttatgaagatttcttttcttggaaattgccaggtgaggcatatttgtggagaggtcttgagccctggaaggagacgtcagcgttgtgggccattcagaaacatggtcggccaccgtttaaatgaaacgtttcagacttcaggattgaactcaaactcctcagcttagtaagcaaggtcctagggaagcagcacacttcttgcagtctggtcatactgatggctcagttcctgagcacgcctggctctcttgtgccatggcgacttgtcacttgccctgcatgcctggtatgcccccctgaccttgtgtgccaggaaaatccatcccctttgtggcgcctatctgggtggttattatattctcatagcagcctctatttcttcaccagagcacctcccacaaatttaacacaataacctttagcgtctatgatcccctttctactgtcatcccttaaaggtgaggaccatgcctgcctgttcttcagctccaatccccacgcctctcaaaacatgggagctgaacagatgaatgaagacttctctcaaatattttgtcttgggaaaatgcccctcatccacccattccttcagtctgtaggaggggcctcttcctcccctccccactatgtccagtgcattccttcacgcagccctggacagcgggattgtggtggtccatgcatctctgtggcaagcattctgtggtgtctctctggagcaccaggcccccaagacaacactgtcctcctcaggccctggcttctgagctcaccatcccgtctctagttccaaagcagtttttaccaagggaactcaatttctgggtaagctgcagggaaactaggatatctgcctggcttctcttttcctgatgaacttctacagctccctcctttctctccctccccttacttgtaaaacaagactgtggctccctgagaactgggctggatctgacttctagagcatccctcagagcacccagctgctccataaacacctgatggctgattacctgttgcttgatgcaatttcatgatatagttatgcgttggtttggtcactccttcaacaattatttactaggcacctgctctgtgccagccactaatttggatcagaggtccgtctgcaaagtatggcatcaaggccaaatccagtctaacacctgtttttgtacagcccatgggtaagaatgttatatgcttatcttttgcatttgtaaatgggtttaaaagcaaacaaaagaagactatttcttaaaatgtaaaaaaaattttttgagacaggatctcactctattgcccaggtgacatgtaaaaattatatgaaattcaaacttcagtgtccaccaaaatttcactggaacaccgtcaggcccattcatacacgtatcattcatgtattattcgtactactatggcagagtttaacagctgcaacagagagcgtgcgggccacaaaacctaaaatatttactatcaggccttttacaaaaacagccaactcctaaccttgacagtgggaatagaacaacaaacatgacaaggtgtcagtgctcatgactacactcacaggaaggaaacagacagtatacaaataaagactgattcatgcaataagggaaaatggaatgtgatgggcatgggtgggtggtaagaaaagatctcactgaagaaaagatctcactgatgagctgacatttgagcagagacctgcacaataaaaaggagagagagatggatatatagtgggtagaatttcaggtagtgagaataccaagtacaaagacctcgagggaggagagtccttggccagaaccccctatctgaaaaaaataaaaaaaaaaatgtccttgcagcatttactgatgccggagcagaacaagtaagtcccactgcatgcaagctggtatggtgagggactgtggtgcagtggttagagcatggctctggtgtcagcagatctgtgtttggatcccagctgtgcaaaaaagatttgctcttaccactgcatctccctaagcctgggcttcttgctggctgagcagggccatgacaccacttctccatccaccttccaggacggcgagggagatcctgaataagaaggctctttctaaaccgaaacgtacatgagggggttaagtatcaccaacatgggcctcttcccacctgtctgtgctggtgttctctgcttttgattttaagcccccatgggttggctaccatttagcttgaattttctgggacagacttgattttatatgtttggtcctgccggccctataaaccgttgaaatgtctgagaaagactcatatttcagcttccaaacagcatctctctgactgcttctggtatgaagcgcctcttggcaggaccttgttaatgaagatttggtgagaaaagcttgacctctgggcgtgcaggcaggaatgggtacaagttccctagacttgctttgaggcagggcctcctgcgggttggtgtttctaccttttgctgatgaggaggggaggccgtgctgaactcttctctcagctactgcttaggtacttggggaggttcttctaagcccgcattttctgctctggaaaatgggacgcagcacagtcccacacacaccctttccaaaaaggatgaaggtgagcctgctgaagtgccctttgatgctggggagatgactgccagaaaaacacatgtgaaaccaggtgttacattattaatacctgcacggcaacttcagagaattcaggcaggcacaaccagcggcactccagctgcaaacacagccccgtttcctcctgcaagtccctgtgagagcctctctaaatcagactctatttctgattgcctcaacgttgtatgctgatgaactttgattcatgaagtggcctctctaggtgaaaattttcatagaactcaattaaaccaaattgattgtggttggttataagggtgaacggtgttgcggggggaggtggaaatccaagagaggacaccagcaatgtaaaaattaccctgaagaaaactgccaaaaataatacattttgcttcttgcgagattccattgacacggccttctacagacttattttatggaaagctgcgaatgttttcaccaggtttcatctgtttttattctctttagttatctaagttgcagctgaggcaggagaccaattgataggcttcctacccccactgcaacctccctcatccccacctgacccagtctcctaaaggatggctatagctctgtgacattttaatttgctagaatgagacagaataaagcacgaaggctcgggtcagtgcatttatcttgctagggggaaattagtgctggctctagcacacacccactatatacaccaatgaaaaaatacaattcaatttgtgttggcagctttaggagagcagggcaaccatttgttaagtgcagggtaattcagcgcctgattttgcagagaagcagtgctgaattcccaagctggcaattttgccggcagataagtgagttcccagtcctttggaaagtttctaagcagaagattgctcttctgcagtgctgtggccccagcatggtgtttcttttggtcaagtctgctggggttgccaaatgctccaacagagtggagtccagggggctttgcagcaggggtgtggctgatgggctcatgaaaggcatattctgaacaccagaggttgatgcagaggaaatgtgtttatatgagagcatactgtgcacctcctgagcctcccagttaagatgtgcctatgtgctcctgaagctggaataaggaagaacctgcaagagcctgcagttatcccatttcataattagccagtgggtgcacggggtgcagtcaggaactggggctgactgattggctgctctaggtcatttgaagtgaaacagagacacatttttgagactaagaaatgaatgaagcagagagctaggatgtgctgaaaagcaaatccctaaataatcacaaggcattaagaaatagtctggcttacaagtgtgcttgtcaacaactccactgcccattaagctcccagagatcaggagcagaaccatgagcctctccttcctgcctcctctagggccatgctgccggcccgtctgggtgttgctctacattttccttcctaccaccatgcacactgccttccaactgcaggctaacttggcaaatgccctcaactgtcaatgccaacttggtaagggcagggcccatgtcctcagcaggtgctctgttgacatttgtccctccctgttcagctcggttctctgcctgatgactgctctcagtgaagccccatgctgattgcagatgcctctgacagccatgctagcaggtcctctggagcacaggtccccaacccccagggccacagaccatccaggaggaggtgagtggtgggtgagtgagcgaagctacatctgtatttacagccagtccccattgctcacatcaccgcctgagctccacctcctgtcagatcagtggctgcattagattctcataggagtgcaaaccctacagtaaactgcacattcgggggatctaggttgcatgctccttatgagaatctaatgcctgatgatccatcactgtctcccaccacccccagatgggaccatctagttgcaggaaaacaagctcagggcttccaccaattctacattatggtgaattgtataattatttcattacatattatgatataatgataatagaaataaaatgcacaataattggaatgtgcatgaatcatcctgaaaccactctgcacccctggtctgtggaaaaatcatcttccacgaaaccagtccccagtgccaaaaaggttggagaccgctgctctggagaacttcttagatgcctgtcagcccatgcatggcacccgcctcgggagcccaagacttcacccacattctcgcaggaagtggcattggatgtttgtaaaataaactctggggtgtttgggttcagatctttggcctgcccttcactctctttgagtcattttacccttctgagcctcagtttcttcatatggaagtaaataaagatgcctacttcagatacgcttaaagcagatgacatctgtcatggtccttgtatgctctgctcagtcacttcctcccctccctcaggtgtgacaaaaggcaaaaagaaatttaacgagcagtctgaatggtgggaaggtggtaggaatgtgtctaattgccttaaataacagataataatagatgcatgggaagggatgggaccggtaagtctacacggaggagatctgtggccatgacgataaaggattagtaaaggtagaaaaaggagatgagggccctgccccaggggatgctacagttctaggcatcactgcccatcatgggaccatccttctagcaagtgcaacctcccccagctctgcaaacacaggagtgactggctcctcaccacatctttgtctcccagatggcctaaaacactgatgtgagacaaaagcacatgcttggtgaatctctgctctcgttctcacatgagctgacagttgatgaatcttttctggcaacctaaatggacactataagccaattcgtcagacacccaagacctgtctttttgcaggatatggtcttcaatcctcgaagccagactgtttcttaggtcaggggaaagttgaggggtggcggcactggcaggcccagggtggcaccccctagttgcattgggctctttcctctaggtaaagaggaagaagagtgaatcttgatctacactaactgatagggtttggctgtgtccccacccaaatcgcatcttgaattcccacgtgttatgggagggacccagtgggagataactgaatcatggggtgggcctttcccatgctgttctcatgatagtgaataagtctcacgagatctgatggttttaaaaacgagtttccctacacaagctctctttttgcctgctgctgttcatgtaagacatgacttgcccctccttgcctttcaccataattgtgaggcctccccagccatctggagctgtaagtccattaaacctctttcttttgtaaattgcccagtctcaggtatgtctttatcagcagcatgagaacagactaatactgtagctcagggagaggttgcagggtatggtgccctaatttacatagtctctgtctggacacctgactccaggctgttaatagaatcatgaagtgctgatgccgaaagggtctttgaggatggttattccagtgttttcctaactctgtggagtcctaagcttgaggagggccctcagggcctgtttgggggtaggggggctcccatgtgaaggcattctctggctttcttccttgtcttcaactagaaccaccataccctgtctctttctttcttgcaggggtatgtgatgatgaaggggtcacccggaataaagggttccactgcagcaaagcaaaaactgcctcaaaagccacagagatggttgatttcatgtccacgtttcagagtcaaaggagtctaagggccagagcagtgaagagacttgcccaaggtcacccgctggttagtgcagatcccagcctgggactgcatctaccctggagtccagctcttctccccacccctggacctgcccttcagacaatctgagcactgtctctgtgctttcctggctggtgatgccaggaagccaaggcatggactgctgaatggggagggagaaagtctaaaaagcaatgtcagcaggagaatgcacactcttgaagaagtactagctatctgcactttgatgttctggagagcacctggcttgccaggccctttcttcagcatctctaggtagccctgctgaatgggtctggaaatccacagggcaccaagtagcacaacagaaaatgcccaaagcccagggccatagccttgacactgtggccaatttgccgtgtgaccttgtgttagcaattttgtctttgacttgcctcacctatggatggtttatgcctaagttccgttccagctttagcgttccaggctctttctgatctttaaagatgaacttattcctgcaccaatagctgtctttctatcaacttgccatgaaaaatagtatccgctcttcctttgtatcccacaagcttcagaggccttaaagatccccatggcttatttaatttgaacttcaacaaaatgaaattcttatccacatgggaatgatgtgatagcaaatgttcagctagactttgatttttatgtgcattgttatatgcaaagaaatccctgacagcctcccagatgtcctcagcgatgtcctctatacactttggtgatattttgctcttttcctctacgctctgggaactaactcatcatatatgagccatcctgaggcttctccaagagcacccactacatgccagatttgaaaaactgtcaactcatcagattgagagctgtttcatttgcttcagatgccggatatgtagagggaaggttgaaagaccccctcagcaaaatacttcagtcttgacgaagctgggcacaccgatatacagctcccaaagagggcgtaattctaggagtcaacagcttaaggttctgcaccccccagaacccagactcattgtaggaaaagcaatgattcactctgaggcttcagaacagtattaaattacttgtccattattctgtgatttatgctggggttgggctgagaggtccctgcattgctttctcctcctcaacccactcaccccagtttcaaccactgcccaaacagccacagaatttataacgcagaaattggctctgagacccagcacagtggcattttctttctgccagggatttttgctactgtgtcggttttatgcatatgtccacatgattcttatattaagccacaggaaaaaaaatccaatttgttttttatgaaagtccaaccgctgccctgccagtcaaacccatttatctcacccagcatggattgctcatgtcaacccgtgattaccgtgcactaccttgataacagcctgctaattatcccaacatctgaaaagctgccttttgtaaattacattgccactaatgaagcccagatgcactcgcttcggtgtcctctcccgctccccctttctctgtaatgcacaggagccaaaccgcaaggccaccgctggcatctgagcaaccttataaccaaagcgtaggatttcaggcccagccacagcacacgtctccggttgacataacccccatttgattcaatctgctttctcccagtttgactgggtgtcagattagagccccgttattacagtccatgcagaaaacccagataccaggcaacactttaatttgggataataaggaagatgagcaacatgtggcaccgatcatgtaggtgcaagggctgtgatttctaaattacgctaaacagatgtggagcggaaaattgccatccagatgacagtttggttcagcttgaacaaaaacgggccctgacgtggtttggggctatttatgccatcctgctgcccaatggcggggagtcagaggggctgacgcttatgccacaggttcagcagtggtcagctctatggggttttgctgagggacggctcctatgcccttcctgttgtagtttccttatgtctcaggcaggcagaaagaagtgttgagggctaggaagcaaggatgagtcagtgtgggtggacatggggtgcctctttccacaaggtccgatcttctgcccatctctatggccataccatgtggttctgccaaagcctggcatcaagattcctttccaagaagttgtcacacatgtttcagagacagaaatagagacaaagtggccaggcatggtggctcatgcctataatcccagcactttgggaggccaaggtgggcggatcacgagatcaagagatcgagaccatcctggccaacatggtgaaaccccatctctactaaaaatacaaaaattagcttggtgtggtgacacgcgcctatagtcccagctgctcgggaggctgaggcaggagaatcgcttgaacccgggaggtggaggttgcagtgagccgagattgtgccactgcactccagcctgggcgacagagtgaggatccatctcaaataaaataaaataaaataaaagagtcaaagcatgagcagagcccgtgcagagcagctgctcaaagggagggccacacctggtggaacccgcccctagccccagagccaggggaacacctcctaggaccacttcgtcatatccacttcccaccagctctgctctcctctccctgctgtcagtgcactggagggaggaggctgggaaggtgaagtgtggcctgggcgccttgaggcctgtattgcccgtcttggctaaagaagtgggagttgcttgcaccaagacccagagctccaggagatggtgaccatcctagatgaccagggcagtgagggacctcagccctctggatccccaaaacaggaaggagttcctttcttctctcttcttacttctttctttccaaattggaaagactgggcatttgcctctgctgagtttttgctcagtgatggcttaaatgtccatcctgccttgtttccttacctcttaggcagagagaaacatgtagaaaggatgatactaagggaagactgggcatgggtggtgcctctgcagagtaggctgcaggaggtggccatggcacaatcctgcctccaccccttccttgcgtgcagactcaagtcgagcattcattcaacaagcatttattgggccttcactgtacaaagcatggggccagtgtatgaagacaaagaaatatctcccacttaagccctgaccttgagttgctcagtcttcatgagaagggagatctgcctagatagagccacttctggagggaagaagaggatgagtgcctatgagtgacagaaacagagcaccatgcaggtgcagcagagggaaacggccttcctgctcaggcagtcatagaggaggaagatatttgaatagtactcagaaaccccacccaaaatcctacaagaatgggtatctcacttccttctaactgcttctaaaggcacaatctcattttgttcagtatctcagtaacagggcctgggagggaatttgagccaggagctcataggaccagtctgataattgagaacctaaaattggggtctcgggattgggtgagtgccatggatgtgacagattgttcagataccatgtcctggacattcttacttgtcttacgcctgctaggcttctgcggggcatttgcagattaaaggcacactgtgatgtgacttcattttgttagtttctgtgttgatgctctaaagaacatttacctgcacagtcattccgaggaacaggatcttccaaagcctggcatcaagattcctttccaagaagttatcacacgtgtttcatagacagagaccaagtgtgagagagacagagagagtataaaatacagatgcagagaaagagacagagacggaaccagagagaactagaatttttttccagtgtcaacttcacacaaggaaaagaacaaaagtcagaattcaaacccagcactcctttttttttttttttctattgagatagagtcttgcttttttacccactctggagtgtggtagtatgatctcagctcactgcaacctccacctcctgggttcaagcctttagcctgcctcagcctcccaagtagctgggactacaggcatgtgccaccatgcctggctaacttttgttttttgtttttttgttttttttagtaaagatgggattttgccatgttggccaggctggtctcaaactcctaacctcaggtgatccacctgcctcagcctcccagagtgctgggactacaggtgtgagtcaccatgcccagcccaaacccagcactcttaatccagagaaactgttccttccactacactttgcttctgctgttatttacataatattactgtaaaactaaacattgcatcatgctttataatttgcaaggcatttcaaacctcataactgtttgacaatcctttcatcattattagtctctgttagtcatacagataccagatgatttgcccaagaccacaccactggtcaatggggaattttgcagcctgtctctgttaattcaagagagcttccccaatgcaaccgaactcctggctagacccctaagtcaaagcaaaacccttcacaaagaacacaatagatgcatcctcattctaattccaacctctcttgatctcagtttctggacttttaatatcaagataaacatgctccatctgttctcttcctgttccagttaccatgagatccctgcttctgccctccctaagagaactatctagaaggacagtcccctgtaccagtgacctctcttccttgctgtttgtcatttgtcccatctcttgcagtcacactcacctgatgaaccagataagctattctacacaaaacctgggatgttaacagggtaagtagccggcatatgcctctggggcaatgaccagtcttcagtggaaatctcattatctacctaaatttgtttactaaataaatgagacaacctatttatgtatcatgtaaatttaattagaggcctgatttatttactctgtgtctatcaacagtcaccactttctccagctctgcatcttgaacactctttccctggcataaaacaaaaacaattagcttctgtctttcttggatcttagccctggagcataagggagcagaaggctaaaggcaaaagccaaatggggtagggtaagtcagggggtgttcaagagagccccctgaaatacccaggctgctaaaaaaaaattaccagaactgaggggggcctctatgagaaggagaccctaggaaacatctttgagttaaatctagcaagatttactgaagggcaaggatgcagggagtccatgaacattccatgataggaaccctcctcatttattacttgttaaacgatgttcccctaattttaaaggcaatgcgtgttccttggacatttttcccaaataaaatctgagaaaagttaatggttggttcatctggatcttaacaggaattttgcagtgaaattagtcaaataaattggagcaggcctgtattgaacactgtctgatttggtaacataccctgtgactctcagacaggcacacagagtatgcaggcatccacacatccgtgtgaccatggaaacacttgcttgaataccaaacaagatatccaaaaaataggactattcaaggccctgcccttcacttcttcctccctcatcatcggcagtctcacactcacaggaatacttttcttcacagagaaactccaggacctgcagaactccttctatagaatggctggttcggtgttctggagtctagccctggattttgccaagtgatcagaatgcctttctggtttgcacctgagcatggtgacatcagttgtatttgaaaagtcattgtaagcaatgccacataaatgcattgttacaatgattgttcagatgctgttgagtattggtgtctctttaaggatccatataaaagatttctctctggtcatagtttcagaccacatacatttttgttaagcagctggtttgttttgctttagctaaactgtgaattttataatggaaagcacttcgtgtgctttgcttcgtgtgtgctgcttaggaggcccacagccaaacgtgtggcttcctctctcaggtaaattgcatggcatggttttttgtattaaggacattctaaggttcatagtaacttgcttatctatgttttctcctctatctttcttaattattttaaatttattttatgttgctcaattattgatagttttaaaccctatattcttttttagaataaggcaaaatataaatgtataattaaaaaatttttaacatttactttaggtgatgatgcaaagaagaaagtaaaagtcaattgcaattcaaacaccagagaaagttatgcagttaatatttcaatgtattttctgtcagctattattactatttttttgagacagagtcttgctcttgtcacccaagctggagtgcaatggcacaatttcggctcaccacaacctccacctcctgggttcaagtgattctcatgcctcagcttcccaagtagctgggaaaacaggtgcgtgccaccacacctggctatttttttatatttttagtagagatggtgtttcgccatgttggtcagactggtcttgaactcctgacctcaggtgatccacctgcctcggcctcccaaggtgctgagatcacccgcgtgagccactgtgcccaccctgtcaattgtttttacaaaattaaaataatataccatatacaaatttttatcttgatttttccacaaaatatcctgagcatttttctataatattaaatattctctatatttaccattttctcatttgggggcttttagcatcttctcagggttttgctttggtatttttttctattataaataatgttgtattaaaaaatctttctagaaattttttgttcaagtttttaattattatcctaagatacatatgtatcttaatacgtatcctaagatacataactactatgagaattagtagtttaaaatacataacatttttaatacttttgatgaatattatacaactgctttacagttgtaaaatatgtttatgttcttgctaacagcataaaaagcatgcctatttcatcacaacctcattggcattattgtgttattacagttaaaaccttcgccattttgtagtagagaatggtttgttttttaatttgcatctttgaataccagcaattgcaatcatttttcatccttttattaatcttttttaagtattcttctttgaattgttgcttcatatcagttgcccatttttttgggggggatattaacatttttttttttaatgtgaggctttcatacatatattaaatacgatgactattttcttatgtatttatggaaaatatgcttgtgtttccattttgttaagttttttaactataggatttttaattcttatgtaatcatctcgacagatttgttcaatttaattcttatctacatttgagaatgaaataactatccacatatattatcttttaggtctcaaaaaaatgctctgatcttttaaatttaactacatttagttaaaatctagaattaatcttggtgtattttgggcttctgttgcaggctcaaggcctaggcccatgacaatatattaatattggttatctccaagctcctctgggatagtggtcctgttatctacctgggaaataggaacactttcaacactcatttaggctggactctagagaaagtaaagtaggcgacaacttgtgcagtgtgattggaagtgaatcagaaagccccatctccccattgctacctaccaaaatatataaaacactttcaacatccaggaacaggactcaaatttcacctttatagatatatcccttttctttctaccagattccaattaataaaaaactaaagcctgagcagttaagtcctctagtcagttcccacaattaagggtgattatttttgaagatgtttagctgagattcccagactcctgggaccagttccaggacggaggagcactgagatgggggaatctagtaggatgaggtgggtgtacccttacctgcccctcaatgcaaatgaagcctgaatcacttccaccaacacctccctactcttgcctgaaagttagcctagggcctttctcttgggtgaccagttagactactccccagggcaactggagggatgctaatatatttccccttgggggaggggtaggatattctcatgttttagacttgggcacagacaccaagtccctggtcttctggtgcagcagatctgagattcctggctattgcctgatgtctttcaagcagcttcacttcttcctttgacttctttcagtcctgatctcccatacaaataacatctgtctttcatgactggcataggctgtaagcttatttttaagcacaactcaaaagcattgatttcacaaagaagtataaagctcaaggtgaaatagcctttgctattctgagagatcacttcttcttctgcccctacaagagtaaatcaaaatttttgttttcccccctgaggtgaactagttggaggatccaaaggtccaggcccctaaaaaacccttctctttttagttcaagtcacatgctaatgtgtcaactcattcgcctggagctaatacttagcattttgcatttggttttatagaaaatgcataactgtccatagcttcacttcttcctttgacttctttcgatcctgatctcccatacagataacaagagcccgggtgaggggagagttttagtaaacttccaaaaacaaataaagatgagagactgtgtttatgttgtattcaatattttatgagctaaaaataaaaattaaaaaaatgtagcttatccctctaaaagcaacaacatatagaaatatcaaaatattgatttaacagtgaaggcctggttcaggggaaagaggtgggtagagtagagctctgtagcatgtggaaggccaactttccctgcatctaaccctcctcttggttcttgggccaagacatgcctcttctagttcaggaagccagagaatgcatcatcagagtttgggccaacaggaatttctgtccccatcctggacagatttactttgctttgctatcactaaggattttaagtagattgatcttgcatcccagcttttctgggactgtgtccgtttatgcagtgacccctttcactctcaagaacgtctccactgagaccataaattatacattatcctagctattcatggaaaaagagatgagagaaaaattttttatttttatttttatttttgagatagagtctcactctgtcgcccaggctgaagtgaagtggcacatctcagctcattgcaacccccacccaccaggttcaagcgattcttgcgtctcagcctcccgagtagctgggattacaggcacccaccaccatgcctggctaatttttgtatttttagtagagatggggttttgccatgttggtcaggctggtttcgaactcctgacatcaagcgatccaccctccttggcctcccaaagtgttgagattacagacatgagccaccgcacctggccgagaaagaaattaagctctctttttgtctctagatttggggattgtggtaaggtgagtcacatgctatcccagaggttagcaaactttttctataaaggaccagatagtaaatattttatgctttgtgagacagacaggctttgttgcaactacttaactttgccattgtggagaaggtggccacagacaatatgtaagcaaatgagtttggctatttcctaactaaacttcatttatggtcacagacatttgaatttcatataatgttcatgtgtcacaaaatagttttcttcttttgactgtttttccaccatttaaaatgtaaaaaccattcttaacttgcgggccagacaaggcctgcaaattgtagctgccttgtgctgtttcagcaccttactgaatgcattgggtactggtgaacaagcccctcgctcccctccgggggctggttctctgcatacattgggtatcatcatcatcaacaacatttacatttatatagcctgaacacacacatgaggtctgagagctttagaggtgggagaaaccttatcatctctgcagcgttcaaccaccgagcaagcgatgataggtgagatgtatcataagtaatttgctactgataataaactaccaaagcttgcaggtgatttatgcctgtttataagttagagaagatttgatgctgttgctataataatgctattctccctcacttgcatttgccttctccaggtaggagatggggtctgctgcaagatgactaacaggtgagggtcacaggcaggacaaattgccgtgaatataccagagctgtgtgacccgtgacaggagaagttggaggatctctagtcctacctcatggggaaaaatcttcacaacaaccctgcaaggacaggttcaggaaaagtgtggtggtcctgagtttgtacagtgatgaaatcgagggcagagagaccaacaagcttcctcaagtttgtacagcttatgaacagcagagctagaaccataaggcaggtcttttgggtcccaaaatttgcagggtttgctatgacacactcagagaaacctcaaacactcacagcctgctgtctttaggctctgaccggacaacaatatccaaaatcattggctaactccactgctattgtatagagttggggccttctcgttcatggttacagctcgggaagttacactatccccattttatggatgagtaactgtattttcagaatgctattacctagatcaaaagaatctaatgaacatttagagacctggcataaagtactttcataagtcagaatcagctgccaagggagtgggtatccctgtgccaggtggaagcactttggcagaaaggaaagtaaacagtgaagtcccctctagcacgcttgtcaaattgccattctaaaagggctttggaggtcattgtgtcaagctctctgtgtgccagggaataagaaactattgagcatattaggggaaagtcacccctgggacactgcccacccacagccaaagctagtttgtctggcttgtcatcaaatgaacttctccaccagccaacacttgaatacatctccagggccatgggaacggatatgcataattcttccagaggcacactaagaagaacaaataaattcctaatcacgcaactatttaatttctctgaacattcttctgaacatagtgttattggtagctttattatattttaattgattgaaaacgggtcactaatttgtattgcattaattactctacaacggtctacccaaatcatgcatggttccgcggcttgttttcagttgaccatttttaaaggttaaaaaaattttttaccttcaaactcaagttcacgttcagttgacaaagattttttgccagattaaactttagtgaggttcctgaaccttctcctaggcacgtctgtgtcctcgtttataaaacccagtgttattaagaaacttgctaagtcagttcagcaaaaaccctccaccctagatatctgataaggtttctcatcttccaccaggccccaggtaataactgatcatcttggcctgtcttcagcaagaatcctgtgaggtcactttagccagaatccccccattacccgtgatgtttcctccttggaattttccatcctcttacccccatcctgcttcttggctatgtattcccacctgctcatgctatatttggagttgagcctcatctctctccctccctgcaaaaatcccactgcaggccgggcgcggtggctcacgcctgtaatcctagcactttgggaggccgagacgggcggatcacgaggtcaggagatcgagaccatcttggctaacacggtgaaaccccgtttctactaaaaatacaaaaaattagccgggcgtgttggcgggcgcctgtagtcccagctacttgggaggctgaggcaggagaatggcatgaacctgggaggcggagcttgcagtgagccgagatcgcgccaccgcactccaacctgggagacacagcgagactccgtctcaaaaaaaaaaaaaaaaaaaaaaaaaaaaaatcccactgcagtggcccctttccctatcatgatggtcctgaacgaagtcttaccatgcttcagcaagaatcatggaataatttttttttcttcaacacagtacccccatattaaaacaaaacaccagttctgtctaaaccaatttcatttatcaggtccttcagacttcctcattctgacgaactaaattcttcattctttccttttagtccctggaaagaagttcaaagatttaaagctgctcttgaatttgggatcttaaagactacttggcttttggaagcatccgggcagccacagccaggatggtaaacaagggaagcaccgaaagcaagacagagggctggacgtaggcaagtgggcatggccacctccccagtcacaccccagggccgtgaaacattaaggctgatgactaaaaagagggaagaatataaaacgtcagaggagcccaggtgaaggctgggctctgccagaatttaaagagatggaaataaacatagagctctaagatggcattttgaatttttctcactaaaggtcagagagaagagggaggcaaggagtgacagcagggctaacaacgagagagaaatgaaaggagagagggggcctggtaagacaaggaaggaaaaagaaagtttttacaaaaataatcaacgtatgaagtcctggtcacgtagattacatcatcatccctgagtggcagaagcgccctctaattctcggtgtcgtcagagctgagacagaccttctgggccgtcactggcatctttcagcacctgagttcattctgggttttactctttctgtcgtctttctcatgagtccgtctttattcttttcggcttgagatcccttgttgccaatcttaagatcactctctatctcaggtacaaagtcaaggctacccacattgaaggctgggggtattgtcactggagaaccagctccccaaaatccagatgacagtgcttccggaggggcctgggggatggagtgagagttgggcagtggcaggaccctgagtcgccagcagctgatggcttctggggtactcagcgggtcccagagcacctttctgctccctgcgggtctgactctcatattcctcttaatcctcatcctttgttcctggaataccaccaggcccaccctagcctgagacccagccacatcacctgactcattgccactccgaggagctggtcacaaagccctgtgtgctctggggtccagctctctgcttctctcagatcaggcctgagctgaccacaccagccctctctgctccttagtccatgctggctcaagcaggctgcttggagttgcaaagtatccctctcgcctgagctcttggggcacaaacttggtgggagaagggagtgaaagagttgtttattctttccctctacctgggaagagggatgctggaggccacaaagcctccttctcctcacttcctggctagttttcatgttgggaggtcagataagttgaataacttatgaaactagagaaataacccttctcctaatatccctatagtgtgttaaacagtgtccctcagaaagatatgtactagtcctaaccgctggtacctgcaagggagaccttgtgtggtaacagcgtctttgcagatgtaattaagcttacatggactgtaaatccaaagagaggcaggagaagagatttgagacccagggaagacatacatatgaggaaggagcttggagtccttctgcaagtcaaggagctccaggaaccaccagaactggaagaggcaagaatgaattctccctggagtcttgggagggagaatggccccgctgcaacttgacgctggcctccagagctgcgagataatacatttctgctgttttaagccacccagtttgcggtcatttgttgtggcagccctaagaaactagcacatggcctgaagcaaataccaccaatatcagaatatcttctgttgccatacattggacagaggggtatggactgggcctcacgagttcagacaaatgagtccacaggttacgttacgccagtgcctggctggcatgtggggtgagagctttggatgaagccaacgtaacattggtctgtgaaggggccttggggattttgtgggaacaaaggataaggatgtcaggaggtcagaaaagtcccagaagagggatggctggagatgatttccagtatcttaaaggctcgaccattgcctatggagaaacagggagtgaagagatgcaggcagactaggatttctcaccctaggacgtagtttccctgagaatgagggaattgacccctcttcaccgggatcactacctgacactgccttagagaccctgtcccctttcattctataccctgtatttcccactgcaaaacttgtttccagaaagctcctaaggacctacaggaggtccccaactctgacagagcagaaaatcacagtcaccttagagggaactctagggctatgcacctgagaagaatattggccgttagccaagcattctttaattcaaagaaaaccaaaacacagtgaaagaaagatgtcactctgcatttagggatgtgatgaacacagtcattaaatgtagaaaccaaaaagttcagaagtatagcagaatcttgctctttttacttcctctgatatcctatgtgactatggcaaaccagtgtattcttaggacaagcttctctatagtcaatgctgtgagtgttgagctgaagctgacagtaccagcttttaaagttgattgtgacattttcaggaactttgaaagaagattgttaaatacagccattattaaaatatgcgaacttacaattaaatcagtgcttctcactgggggtgattttgtactccatgggacatttggcaatatctggagaggttttcttggtttttacaactgaggattttactagtatctagtgggtagaggccagagattctgctaaacatcctataatcacaaggcagaccccccaaaacaaagaattatcctgcccaaaatgtcaacagtagtaatgttgaaaaattctgaattaactacattatattttataaaggtaataaatcactcaaaactcatcactttccaactatttactagtatctatgtttttgaggttaggtatttacatgcatattgtgtctgtatggtggaaatactatataagggtgtgagctgtgtatctcttcccaactccacattcggtaaaatcacgtcagtagcttaaagtggccatggtggcaacatttacactatgagtatagacaaacagtacaaataaggtctcctcacttttttttttttttttttttgagatggagttttgctctgtcacccaggctggagtgtagtggcacaatctcggctcactgcaatctctgcctcccgggttcaagcgattctcctgcctccgcctcctgagtagctagaattacaggtgtgcactaccatgcttggctaatttttgtgtttttagtagacacggggtttcaccatgttggtcaggctggtctcgaattcctgacctcatgatccatccacctgggcctccgaaagtgctgggattacaggtgtgagccactgcacccagccaagtctcctcacttttttgaagagccagttgttaaacatgccctagctcactactggagaaatgggtatagtgtggctataggggtgtgtgtgggggttctcttctctttctcacttctttcaaaagaatgcagtgaagctgagacctctatttttctaaacaaaaatggggggtggggggcggggggcaaagaaggttgaaataaatgaagtatctgataaaaatgcaaaaggaaggaacagaaggaatagattatttacaagaaataattttaaatggaaaggaagtcatgcgtctaaatatctttttacacgattaaaaacatctgaatgaaaagtgaaaatcaatcctcctcccagatgtcttttcattgtgatgccaagtagacgaatatttgaatatttgcattacacacagcttaatatctcaatattaggaaatattaagattattttctactttttttcttcttcttcagatatttgaaaacaaacacacttttgctaaagtcgcacatggtttcagagtgatcccaggtggaagcagagacacagacagtggtttcttcactgagatctgctgtcttactggatttttttttttttttttttttgagacagagtctcgctgtcacccaggctggggtccagctgcacgatctcggctcactgcaagctctgcctcccgggttcacgccattgtcctgcctcagcctcccgagtaactgggactacaggcgcccaccaccacgcccggctaattttttgtatttttagtatagacggggtttcaccgtgttaggcaggatggtctcgatttcctgacctcatgatccgcccgcctcggcctcccaaagtgctgaaattacaggcgtgagccgccgcgcccagccgtcttattggagtttgagattgatctgtgatgtggtcacattcttaaagagctcctctcaataaaaacacatgggagtagggggaacagagaggaagacggagagagaaaacaaaacattttcaatgaaaggaagaattttacaaattttaaaactaagtaagccaatgaaacaagtctgttgggataaagtggtagctcagaaggggaggcacagggaataagttttctgaagctgagagaattccaggactgaagggaaaaagcagaagaaccctggacactgataggaatgaactctggacgaagataaggtgtcgtgctccagtagcggcaagctggcttgataatgagaaaatgaggctggggccatgtttaagaagtgagagtaaacgagtgtccacttagatcccaggagcccagaccacatgtacatacatcacctaatacagggctggtgcctactccacactcaacaaatgttagctcctctccctaactttcaattgcacacgtttgtgacttacctctcacctctgatctccttcagttaaacctacctctaccatatcctttggccagatttttctttccctaacccaaatagaggctctgtttttaggtcctgcacacttctccctatattcctattgacagcttcaattgccctgtctgtgaaaatgactctggggttcacagcttaagtcccaatatcttgtttctcccatatcctatcttctaagtagtatacagacatcctaaatgtgttgctgccaccttcactcaacatgtccaaaacaaatcaccctctctttccccaaaccatctttccttccctgatagtgttccctgaagagagagtgatttgtcagaagactagaaggtgaggagagtaaagacaccttaagaaacaatagagattcagaatggctgcaaggggcaggtaggggtgtgtggagagaggaaaggggaagctagagaggtgagcagggccagattctgagggccttgagtggcactgaggatttatgacttgatcataaaacccagtggagagtcctaactgaaagggactggaagcaaaatagcctttgataaaatagactctacaagagcgttggcatggtggcaagggctctggccacttgagaattcccctggcaggccagggcacgtccctacttctataagaagaactgagaccatgtggggagcctcctggtaactctgtggactgcagactgcttgctatgtcttgaatgaggtctgccctcttaaagtggtccatgaagtctttcatcattgccctttgtggaggggtccaaccaaactttgcctgatactgaattcctccccagaggggatattctagtctcggctgctgggtctttagttggtgtgactgtgggccagtcaatacctagatctctaagcatcccccactttgaaacagacacaaaaaaaatagcactccctcagaggctgagaataagacaaaggcaaccgcattctttaaggccacaggaaagtacctgggaaatatgagcctattattaaaagtgggtggaggagattggaaggaaagggaaagtctgttggaaatccaatcccctgacgggcagtgacagaggtgggcagcaggcctggtcagcctcacaaatcaggcttctcttaaatagctactgtcaacagagtagcgagggagtggagatttagtgctcactctcaaacccatcatatctgttgtgcttcaaagcatggaaaagatgataaatcaaagaagaatatgaaccaacgccactaatttggtgccgagttgttccatttgccatggagtcctcagaaattcctccacaaagcccagtgcccttttcttaaaatcacataaccaatcaaatattaataaatgtattaattcctaacaggaaaggtgactcatatggattttgcattagggaagaaaaaacctgacaactaagaggtctcaactggttttggtgatctaaccagcaattttgtccatttaggaaagatgtggcttcctgattaatgtggaaccttagccatgattttaataaaagttttaatatgtacagctgcttagctggagtcatgtttaattaaaaccttgaagactcctggagcgttctctcctcttcaccaagggaggagacacagaatggccccagggtaatagggagatagcggggcaggtggagggatattggggtgtggtgcagggctgcagaggggtacagaggagaggagcagagcacccatgtgcctgaggagagtgtgggccactgccagcatctgccaagggaggctggccaatgtggctgttcttcatttgggttttgtcacctgctctagctcctcactttgtggaggggaaaacagaggttcagagagtactgttattttttggagtcagagtatcactcggtcacccagactggagtgcaatggtgcgatcttggctcactgcaacctctgcctcctcggttcaagcgattctcctgcctcacctcctgcgtagctgggattacaggtgtgcgccaccacgccagctaatttttgtatttttagtagagacgaggtttcaccatgttggccaggctgctctcaaactcctgacctcaggtgatccacccacctcggcctcccaaagtgctgggattacaggcgtgagccaccatgcccggtacagagagtacttctaaaaagagaacactagttgtttgttttttgtttgtttgtttgtttgtttgtttgttttgacatggactagtgtaacagaacccagcatagaaacctagaggtgacactaaggcatggcatgatcctaaaacagcttgttcttatcctaacagtttttattagggacatcatgaaagctcatggcttcacagtcttgcaagtaggaatagggcagccatgggtctagagagcaaagggcatcaggctctggttttaatagtacatgacatttagtgaaaaatggtggtctacaaagctatgtataatcagatttcaattacagaatatatactataatgtatactgatgggcatagaaaaaagaatggaaggaaatgctctaaaatattaatattgattaaaagccttgagatgatgggagcatgagaaatttttattttcttatttcatacattagtatatttgatgaatattctataatgggcatgaattgcttttatgactgagagaaataaatattataaacatataatttgtattacaaaataaatattacaaggcaccttaagccatctcttttgttccctgttacaaaatatatggacacttaaaagtacatgtaaaaggacacataaaaaagcatgaaccaaaaaaaaaatttttttcctctactttaaaataacgatgtccaggcacttaagctatgtggtatggaaccctgtaaaatgatatagctgtgtcatcaatagataagttaccctctgaggtagcttaagaaacagtggctggttttaaaatgactacaaagcaaacctgacaataaaattcacttaaatatctgactctgcaaaaaaaaaaaaaacacattacactctgtcctagaggagtactatgtaattggaaggcctgtgctgtaccaagaacatccttagtataaggcacaatcccagatgtgataaaataaaaatgtgagctcttaagtactttttaatgtttcaaagtcaacgaggaactaactgccaggagtaggatggcaactctctcacttcataacatgtttttaagcagaaaaattccttaatagaggacgtggagtcatatttaaggaagggaggaggcttgaattgtgaagcaccaagggggcttttaaatgaagctgttgaatgagttggcttttggggtacaagaatgtgtgtgaccagggctttgtttgcagggcctgcagtacaatgcagattttcagggacctgcctggaccagaagggaagaatttgaacttgaagacacttgagtttcttcttgaagatagaaaattgagcataagctgacacttcatttttccacaccaaacactggcaaaggtagaaaactatttaagtgtaaaaagagttaatagatatatatccatacttgaaagcaagaaagagacatctcatgagaccaaaatggggattccttaaaccctaaaacatgaaaacaaaaggaacatcaaatgggcaatacgccaatgctctttgcctgtagtaaggacaagaccaccctcatgaggctgggggctgggtcaccatgctcactggtgttgaaaagctaagctgtgtggttcccacccctaccatctccctaagattgggggtgatgtgattacccatggcgaggtgaggaaattgctactcacgtgacacaagggcccagagctcactccggtgaggacagagctcagatccacatcacccatccacacgtggggcagaccagtggccagcacaagcctgaatgggaaccacttcccctcaagtctagggctaagaccccccaagactgtttttcctgggataccacccagaacattcagaatggtggcttctggcagaagatgagctcataaaccaaaaattctcaagcctgtgggagagtaacaccacaaaaggcagacaacaaacagaagtcacatggggaaacagagctgatagagtaacattaaattggctcttaaacaagtatctttactcaaagagataaaggacgtaataacatccatggaaaagaataggtgattatggaatgagaggaggtggttatcaaagagaaaacacatagaaattttggaaatgaaggctgaagaagtagaggaagacattaaatcatagtttatgtgggaaacaaaatgctgaggttaaagaagtagctcctggcattggagaagaagcaaatgagagaaacagatcctaagcctgctgggagatgggcaatgcaagtgtttcaggctgatatcgtgggggctgctcacgtgctcaggactgtttgtgtacagtgtcgattgcatggtgggggtggccctgagagctcagaggattcaggccagattgaactttgtgggagccaaagataggttgagatgattcaaaaggacagtctggggacacgttaagagttggggcataaacagtagaagaggtatggtgttggttggtgggtggaggagtaggaaggaacccaggccgtatttctggaaataggcagcttaacttggaggaccatgaaagggctcagtatttctactgggggttagcagcaaatttcttaacagcccagctcagagggacacccacctaggtggaaaggtgaggactgctgggtcaccaactacactgggttaaaggtttcagaattgggttggtagtctattttatgattcctttctggaagtccaaataaccagaactgcattttcacacagctctgcctacatgcagagaaatttgctctctgattcccattctagaagaagtttcaaactagccaattcacagcttggcaaatggcctctgaaagcaatacagaaatatcagggagtgaaggggcaagagagcaggagcctagtgttgcagcaagcccctagacaggttctaatactttacaaatattaatttaatacttatcaagacattgggcacgagttctagctccagtcctatttaatgacttgattctggtgcctcggtttccccatgtgttcacaggggataatcatgtgtcctctgcctatcctaaagtattagggttatcttgagtatcaaatgcaaggatatgaatggaagactttgtgagctgtggcatgattccaggggaggggccggggctgtaacaaagggaagcaggtgcacactgtggcctggatactaacggctccattaatcttggtggaagcatcaagagtaccagtggattttttcttcagtgtcatggccacccagagaggacagggcagaattatggtgctcactcagcttctctgagtgttccatagagtgaagtgagccgtgggaagagttctctgaaaaaacaaaagcaggcaggaaagtcatgcaaatgggtacagcgtgtatccagaggagtgatgccgggttcaagcaactcagaaacagcacctgggcagattcagcagagggtccagacctcgtcctggcattcattgtcaggatgccccttaccagactcagaggccgaagctcattggcctatctggattaggggagatagaaactctgagagaagcatgttcaagctggacagagatagagagccccaggcatgcctctgaggacacctgaaggtgggggcgggggacaggaactctaccagctcagtgtcctgagggtgtgagtgcctcaagggttggatgcagatttactgggaggttaaaaggctaacacctagtttatattactaattgcctgtggcactactgaggcaacggaaagctgagcaaactcgatatgaatcatatatttttgtttttttcttgatattttgccagcaggatgggatttatcattttcctggggaaaatggcttgacttgtccttattctcacagaacaagcttggatggtcactcttatggctcatttgccccagggaggccccagacatattcaggatccaacatggacaggcttggagaagagattctgctcatagaatcccagcagggtcaggcctggggaggacccaaaaaccatcaagtccagtgagctttttatgaaatcctattttgaatgaactctttaatatataagacagacatgagtagggctgatctggttaaagaggcttggagtcccaccaggccacctgcttggagactcttaatatataaaatctcttaattttccagtttagcaaggattaagtgatgtgtctagcattacctaacaaggtggtggtagaacaagatctggaaaccacaatgcctgactaccagacacagagggtcctgtttgcttgataatgtcaccacccctcacctgcctccctcaggggaggtacaacaatgacaaagatcaggttaaagagtcctgaacctctgcaaaaatacataatgatgctaaagaaggtggaaggactatagctggacaatagaggctaccacatttggaggtgagtttgttgatgaaaaagccaagttctataaaaatatttgaaactgtattccgagccagatgtgaagaccatgacctgtgacacagcctcaggagatcctgagaacatgtgcccaaggtggttggctacagcttagttggcatacatattaaggggacataagacatcaatcaatacacgtaagatatacattgattctgtctggaaaggcaggacaacttgaagtgggggcttgcaggtcagaggtagattcaaagattttctgattggcaatttgtcgacagagttaagttatttattatccaaagacttggaatcaatagaaaggcacgtctgggttaagataaggggttacagagaccaaggttcttattatgaagatgaagtctcataggtggccactcatagaagcaatagatcgcaaatgtttcctattcagacctttaaaaggtacctgagtttcagctaatcttgtcaggatcagaaaaatacgtagacagggaaggggattctctaccaaatgtaaatttcccccacaagagacagctctgcaggtccatttcaaaatatgtcacagaaatatattttggggtaaaatacttggatttctttcagggcctgctctctgtcatgtgatgctacactagagtcaggctggaagttagtatcttattactacaaagagtctgttttgtcagccttcaggtctctgttttcatgttaatgccagttagttgtgcctgcattccaaaggaaggagagtatcatgaggcatgactgaccccctccttcccatcatggtctgaactagttttttttaggcttccttggaagcccccttggccaaggggaggggtgcattcagtcggttgggtggctcagaattttgtttttggtttaccagttcatccctcacacttggcccagcaagctcagcaccattcagtctctctggaaacatcctgaagcactggtaggtcagtgatgaaggatagaaaccatccctcagtttatcagtttgagcttatgattccccctatgcctgggatacttccttttctatccactctttcctggctaaatccttaaatctttgcacccacttgacttgccaattctccaatttaaacgatgttttcctgtaatgattcctaatgagacccttttttttccttcctatgcaattggtgattacatgaaaaactcttcaaattatttagtatccacttctcccataagtaagtaccacaaggctaggatcaagttaaatgtggtcacctctgtatactcagggtctagcacagggtgggcaaattacaatctgtagatcaaatctggcccactacctatttttgtataactcaagagctgagaatagagaagttttttttttttttttttacagtttttaactgttggaaagaaatcaaaaagagaatattttatgacgtgaggattacgtgaaattcaaatttcggtgttcataagtaaggttttgttggatgacaggcatgttcattcatttacgtatggtctatggccctttcgtgttacaatggcagagtcgagtagttacaacagaaaaaagaagcagagaagggccatgctgaagttcacacatgtgtcagggattacactcagatctttcaaactcctgcagagtttttacttattgaatttctccaaactggcaacaaagacagcaaaactcatggcccagaatctaacctggtcccctcagcaggttttctaggtatctgggataggtaaatatcctgaggacatgggataaaagatgctttgttaaaagccactttgaacacctccctgagaaaagacatttaaaagataaaagggaaaagaggtctgatgtgtcctgtttgtgccaaagttgagtttggtttccattccattataaaatgcaacaaccctaggagtttcatgttctggcaccacattgctctttcagatcttgctttgttctgctcacatctctgacacaggaacaaagccacaagcctatgcagacagttgtctctggattagagtgccttgtttcagctcaccctgctcaaaccagagctatacaaaggtggcattggtgttaactcttgtctcttaaaagttggtgaatcctctcttcaatcattcctgttgggatattctgacatatttcactccagccaataaatataggtgatatttaatgacagtgggggccagcgcaatagtaggacactatgtgaaagcaataatctacagtctaaagaaaaccatgcttgagtggattacttcagtttcaaaagtcagtagtcccctacctttttggcatcaggaaccggtttcgtggaagacagtttttccacggacaggggggtgggtagcgattacgttctcataaggagtgtgcaactaaatcccctgaatgtgcggtgcacgatagggttcacgcttctatgagaatttaatgccaccactgatctgacaggaggtggagctcaggtggtaacgcttccttgctcgctactcacctcctgctgctgcggcccgattcctaacaggaaccagtatcggtccatggccttggggttgtggaggcctgtcataaatgaccaggattgaaaggggccttaaaaagttatcccactgctatagactaaatgttcaaaattcataggttgaaattctaacccccagtgtgatagcatttggaggcggggcctttgggagatagatgacttagatgaagtcacgaaaggtggggccctcataatgggattagtgtttttataagaagacaaagggagaccagagctttgtctctttcttccacgtgatcacctggcaagaaggtggccgtctacgagccaggaagaaggccctcaccagaaaccggccatgtgagcaccctgatcttgaatgtctttgcctccagaactatgagaaatcaatgtatgttgtttaagccacccagtatatgatacttggttggagcagacccagtgaaggcaccagcttactggcacatctgaattgtgagtgttccttctgtagcctctacctgaaggctcacatggaatgctgcctccccacccctctgacaaaatcaaagtgactcctgcttatcagctgaaatttgctccctgtaagttcaacctgatggtcttggttccatcccttgggtcccaaagaaaaaaatcttcatttcctttccatgaaaaagccccactaccatccttccacctcccacccccactgccacctccccataacctcacaagtgctcttttattcagatccaataggcaaatattttctaatcactcttcatgtgctatggttccaagactcattttttcacaaaagctttcaacagggacaataagcagccaacatggcaggcattcacttcatttcccctcccctgtctccctcacagaaatcaggaaatgaggaggtacacttaagcaaaaggcctactggataagccacaatctggatgattcagagttattttcagtttggacccaaacagttttataaaaatggcaaagaagctggatacctctggtgtgaatcatgaggaaaagggcagggccccagaaaagaaatgggatctacatgggccattctaggtctcagacctttgtgctaaattgcaaagaatttaagcgtatttgagagtgctcctaagtgaaaggtaaagaaaaatagcccctgccaaagagaggtaagtaggaacttggcatccctgtggacagacctgggtgtctctgcaggaagatgagctcatctcttcaggcagattatctggttcaatggttggcaaactactatggctttcaggcctaatctggcccattgcctgtttttgtaaataaagttttattgaaacaaagccatgcccatctgttcacctattgtctatggttgtttttgtgctagaatggcaggcttcagtagttgcaacagagacaatggctcacaaaatctaagatatttgtatctgactctacagaaaagtctgccaacccctgatcttgttcactctttcctgtattgtatgccttgcaacactagtcccctgtcatacttccccaaatgtggtgggaaaaatcctcacactagttgcccctcttagaaatacacagtgctcaccagcctttaaagcctccaagaagtcttgcagccatgcatctgctttcctttttttaactcagcagtccttaaactcacctgacctatcagcattccacagagcatggggagcacaggcagtgaaacaccaatcttgttgcttattactgttctttgaattgattttctattgttttttctaagcctgtagacaggccttacttagattttcaagtttagtgacagttttgctgatgatatctgagggagggctgtggtttccccttaagccagggtaggagaggcgagtagtgctttcctccttgacgggcgtggtaataacagaagtggggagaactgcagcgggcagaggattttccctccaatgtcatcatactttctctccttactggatcatctctctaagcatagaaatagagcatcttttactttaagaaaatcacattcctatccagctacctcccacccatttctgctgacatttgcaatagaactcctctaaagcactgtcaatatacatttcctccaatctccttcccatcctctcttgaacccactctagtcaggctttctccctcaccactcccccgaaatggctcttgtcaaggtcattatgacctccagatagctaaaaccaatagtcaaggctcagcttctgctgcagtcaaaatatctgcagcattctacacagaaaatgaccttcctcttccaagcatctcttctcttggcttctgggaccccactctctcagttctccttctacctccctctcagccactgtacgggttcctctcacctccttgacctatgactgttggatgcctcaaagccttcttggaatgatttttttcttacctacactttctctggtcatctcatcctgtctcgtggctttaataccaagcacctgctagcaactcccacatttctttcttttttttttcaatctcagtagaccttcacctgtagtaagtcttataaaaataattacagcaatttgccaacataatcgtgattgcatctcttttttacaaaggcttttattttaagtttaggggtatgtgtgcaagtttgttacacaggtaaaccacatttctattgctttgtctggaatgctctctccccagaaatccatgtggcttacttctttcatgtttctgctcaaatatcacattagtgaggttctctctgacaactctctataaatatatgtataaagaacacccgcatgccacacctgcctcccagtgctcccttgccatgctttcttttcttcctaccacctattaccatttgatatattctctacatctgcttatatttgttagctgtctgtcttccctcactagaacatatgcttcatgaaggcagggaatattttgttcttggctgcaattccagggcctacagtcctgcaagacacatagtagacactcagcaaatattttaggatggatgaacagaggtgtgagttgtctgacatagggttctagagttcatcatgatttcatagctgatggatctaagattgtgtcttcttgtcctaaatcacatggcttgttagtggcagagctgacatcagacacctggtcatttgttgagtctctcctaagttccaggcactgtaatgaaccgtgtggacataggcgccatttctgctgtcatggagattttcagtgaagactgactttgaatggacgatgcttgctccttgacctctagaccaggctctttctatcataatgtttccaccgtcctaatgaccagttgtgaccaagaagatgtttgtccttaaatagccaccattccctcctgaggcataaatcttagacagaggacttctgcagcaggaaagaaatttacccttcacatttaaggcaactttctcagctctccacagtatgactgttaagagctgggtatcttgggtggtttgtgaggtgtcccagtacctactggctggtctctcataattccatttccagttttgttttgttttgttttgagacagagtcttgctctgtcattcaggctgggtgcagtggcatgatcttggctcactgcaacctccacctgctgggttccagtgattcttgtgcctcagcctctcaagtagctgagatgacaggcacacaccaccatgcctggctaagttttgtatttttagtagagatagagtttcaccatattggccagcctggtcttgaactcctggcctcaaacaatctgcctgcctcggcctcccagagtgctgggattacaggtgtgagccaccatgcccagactatttccagtttttaatgcctgtgccttatctgggtgaatagttgtttttttgtgtgtggttttttttcttttgtccactctctctggtgcccattccaaagtgttgcaagcctgcccttccatgctgagaagatttcattatgtgatagcaagtcgggagaggcaggggctctgtgacaactctacccaatcctggtggcccacagaagagaaatattaagagcttttgtttagaggtcttctctcactcatctacacatccaaaattaataaaattttagaatccagaatattagatttggatgggatctcaaatggcatattgtctcaccatgttgcaccaatgcagtgatccctgaaacatctgtgacatgtgagtcaccttcacttggtgctttttatcaacagaacatatttacatttttttttttttttcagatacagggtcttgctctgtcacccaggttgaagtgcaatagcacaataacagctcactatagctttgaacttctgggctcaagcaattctcccacctcagcctcctgagtagctgggactacaggcacaagccaccacacttggctagttttaatcttttgtagggatgagatctcactgtgttgcccaggctggtcttgaactcctggcctcaagtgaccttcccaatgcagtcccaccaagtgctgggattatgagcatgagccactgcacctggcctagatttactctcatacaattttccttaggttgagataaaaccaacctccctaaagcttccacacattggccctggttttgtccttgacacctattttgagtaaatctcatcgttcacttaattatcaggtcttccagtaggcctgtgaacccagaaaagagcatttagtccattcatgttggatataagtaccagcataactttgttggctattaaagcaaacagatgtttgtaaatctttgttatttcacatgctgcaacaggagtaccaagcgacagttgccattaccagcgtatggatggggaaaccaaggcatatggatggctgatgacttgctgttggctcagtggacaaatgattcccggctgcttgtcctttgctctgacttggactccttaatgtattgcatactccagagaaagctattataataatggctccaagaacattagaatttctattattgagaaagatgcactttcatttaaagggtttcattcgtcttaaatgagttctactttctgctttcctttcattcgaatcccatgtttattatttctgctccacggctggcctgataaatctgaaattccactcacaccagccagcaaactcgattccaagcagcggcagataggagaacttggtctgttggagacaaaggtttctctccagtttggtcagcaagttggatttaaactgacaagatcatagctctacaaaaataagatctattaattgtcctgtgaaaggaaaaggtcactggacaaatgttactctgtatctcattttacagctagagtctgggcatccgcatcaaatcatttctctgtaactagattctgcttctcaacaataattaaaaaaatgactccggataagatcatgtcctagttctgcttgtgagttttgtcacttgaatacatttcacttatgctgaaatcagcctggagttgctgacactgtacttcctctaggaccccactgaaaaatgtatgagaggtgtctgggatcattaattgattctcccagatcccctttgttgcctacttctcagactttggctccaaaagtagaacagaagtttctctaatgtgacctaggtcactaacaccaaaagagtgtgggagagggacaggcatgggaatgttgcccatcagaccaaatgtgatacccctgggaatcaaatgtgatttgggggttccatgctgaagtcaccagggatggctgggctgcaggggaacagccacagacagcatcttggccagagtgataggcattatttgggtggatggtgtgggacagcacaaagggaaaggaggctacagagaagaactttctctggctctccttaaggtaagtgggcagaaccgacagtgcatcagctccttaggctggtaggagcatattttcagactcagcaaacatttactatctactatgtgcccatcaaaaagtaaacactttcataaacagtacatataattctcactacaaccctgtgagataggtagagttttaaatccctggctttccgtgtgcttgtttgtttgctgttaacagttacatgaaatggttatgtcaaccatctgaactcttaccttaaggaaagaggaggttatataaataaatgatatggcttggctctgtgtccccacccaaatctcatcttgaaatgtaatccccacagttagggggaggggcctagtgggaggtgattggatcgtgggcatgggcttccttcccccttgctgttcttgtgatagtgagtgaactctcaggagatctggttgtttgaaggtgtgtggcacttcccccttcgctctatctctctgtctcctgccacaggtgtttgcttcccctttgtatccaccatgattgtaagtttcctgaggtctggcagtcatgcttcctgtgaagcctgcagagctgtgagtcaaatataccctttttcttcgtaaattaccagtctcgggtagttctttatatacagcagtgtgaaaacagactaatacaataaataaacaaagagacagacaaacaggttctttctctacggtatcaatgccaggaacaccttataggaacagatccagacagggtgactcgctcaccagctcagggcctggaagtggccgacttgggacttgacaccagggtgtgcaacagaacccaggcttcctcccttccccctcccactgccttcaatgttaatggcctgttcaatgcctttgtgcttctgagacagatacctttgcagttgccatctcagtagtgtgctaatagcatctctgattttgaaaatgaaaaagtttaaaaaattaagcctttctaaatataatttgcacgtcttcccctcctgtgcttttagctgtgtgtgttgtttttaaagtctttatctgggtgattattaaagtccctggtaggttgcattttactctgcttccttggtttcaatcatccctggagttatttctacgtttcagggttccatgctgaagataaatgtagaaattctacttcaaacatggacaatttctctctgtttccaaagtgatcatgaggtcaactaatgctcagctaaggaggaaccgtcctacccagaagagagttctcccttgaggtcattcactttccaatcaatgctcccgaattcccccaaaacttactgaaacttctctctcttttcacctggcccctagccctgaacgatcgccctcctgttgaggagtctgtgatggcaacatctccaggtagtttagctcatgaagggggtgctgggagtggggatgggaaaatgggagcttcaggatgtttattaagtgctggactgttaatgtcagtgaagaggtgacagaaagaggcagctgtgcccatcctgcagggagtcagtgatgctgtcttccctcctgtcttgctgtagtaccttcggaattttagagttccagactacataacaccttcagaacaattccagaacagtttgggaagaaaggaatcaaaacaaaaaataaagtaggaaccatgacctcctctcactccaggcatacacacaccacggggggtctgagtacaaaagcaaaggcacaatatcaaacatgagttttgtcagagaggaaaaatgttgagaacaaattcatgaattctagtcctatttacatttcaatccccaaactaattgtttactcataagtgttctgtcatgattgtggtcattggtagctttctgtaaataaacctaaaaaactttattatcccaaattatttttcgaatgcctgagccacaaagaagccgagagctaaatttagtgctcaactgcaataatcaatttatcccagatgactggcatttctcattctcttctccttttaattagtcttggctttccttccatttttaattgtccaggtttatttgagatttaacataataaactacctcaatcccttttgcatttctcttcgggaaattaaattagctaacattttcagatgttgactcttccttccaaggcataagcccttcctttaaaaaatcagctttggaaacacaagtatcaatagaaacacagttcaatggcttgggcactgttcttccttgttgcggacctcagctgacatgcagtctttagccagggcgtatgtcacacaggtacacaagcacttcacacatctatatctctttcatgaagaaagtgaaaccttgttctccatggaatggaaatcttaaacactaggtagagcactgatgagttcagtgtttcttcacaataaatacacagcattttataccataaaacgaatttgtactgtctgaacaaaatggctttacatactgccagatgtgattatcaagattgattttctcctgccctgtggtaaccaggttacttagctttgcagattcagctggtcttgcttttccctctggctaagtagagacagatccactcccagcaagtcaggaaaaagggggggttctacagctcagggactaatgggcaatgaaacaggagccagtgtttcctacccaagccatcgtctctcatcctgcttccaatcagcactgatcctgtccagacagccttgtgtgacaggagactcaccgggggcatcaggactcagagaaagtgaggaggagctggggcagagttcacctccccctaccgttccccaggctcctttccctagaccatggccctgcttctctcgggtcctcggatgcctgctgacgagggctgcctgcctcccgaacccttagtatcaactcctacagctagttccagtggcgctggcatcagtgggacctggcttccaatcccagctctgccacttgccagctctggatcatgtcgcctctcgaaagtccagtttgctcaacaggtagaataatcctcacatcactactgaaagtttcacctatttccagtgcctagaaccatggtaggccctgtgaaaggctctgcggttagttcctttcactctactttccagcccctgccctcccaggcttgctgagcctagctccttgctctaagattcccctctctgtagactgacagcatgttccatccactccaaatgatctggagaccgacaagaattctgtctgtgaccaaacattaatcaggctcatctgagccccactaagccccatgcttgggcagggcctccacgagcccaatttcagcaagaatcctgtcacgtcaatttagccagaatcccctactcttcatatctgattgaatttcccatccttcaccatcccccaggtcatgtctgattaccctggcctgcatggctcctgttgggtcagtttggccagaatccccccatccctgatgtttcttcttagtaattttctatacacagacaacttccccctcccctggtttttggctatcaattcccactttttcttgttggattctgagttgagcacattctccagcccgtatggtgaaacctctgttgcagtcatccggaataaactctgccttacagttctttaacaagtatcatggataatttttttaagttttatttattcattttttaagagacagagtcttgctatgttgcccaggctggtcttgaactcctgaactcaagcaatccacctgccccaacctcccgaagtactgggcctgcaggcttgagccaccgcacccagccaatgcttttctttaacaagacctggagtatctatgctcttgcttgtgactttaaggatgctgttccctcttctcctccttcctacttggttacatgatatttactcttccagatatcatgccacctcctttgtgaaattttcactggacagcccccgcacccctgactcttgtcctagggtaaagctaacccctctttcttctgttcttctagtgcaaagctctggcaccagactgtctggagtcacattccagctccacctttctctaattgtttactttgggcaaatggtttaacctgtctgtgctgtggttcccttgttaaaaaatgaggatagcaataatgcctagctcattggcttatagcactaacgcatttattctgttaagtgcttcgagatagtgtcgaactcatagtaagtgcttcaatacatttagcgttattatcagagctcttcttatagtttatagttactgttgttatcaatactatttgccctgtgcccactactgaccccacaatccttgactgggaggatccttcatagcagggattgggtcttattcatctttgcacttttcttctaatctcacgtcaccatggcacacagtaggtactcagcacttttgctgatatcagtaggtctaatgaaggattctctgcagttttaatgtgccctccaaggcagtttattttaataggaggcttcaaatagtgcttgagctgcaaggaataccttttgcacttcaccccaggaagtcaaattagctaatattgaggaggatgaggtagacacctcggaaccctcaggcctttcagtagctctgaatctcatttagtgtttggctgcatctcctctgcagaggccagggcctgggcccctcccacctaaatgatttctactcaaagccattttattaagtcagggatggggagacccagaccctgctctggtgaggccgacatctctacagcggacctcacggagtcacagccaggcatattatgtcacgagacagagtatggccacagctctctgggcattagaaaggacacaggagagggagctcctgcttggaacccccaggagctttcgggaaagaggtggcctgtgagttgggatttgaagatagtcagggtttctactggcaggattaagggaaggacagcctggaaagatggggagggattatcagcagtgaataaagagaggggaggaaaagggcagagccaccagacgtgtttgctaaaacaaaccctcaaattccctatctaggaattaaatgtaggctcaggttttgaacttgcttagagctcacagtggcaagaggaaggaagatttacaatttgagaatcaaggcgtctgaagaatttgtaatctgagagaccaaaacagacgccccctgatgaactaagacagacacaaaggttaaggggaaaagattatctattggcgagggctctggactcagtgagcatggcaacctctgaaattcttacagttaagagaaaaatcacacccttcctaaactttctaacagtaggagccatcaggcaaaatatcagactcctcctaactctgtcttacaacccagaccactacaactctgaatagacagaggactggccttataaacactctttcctgataagcatctgtagcccttaagccagttccagcagctcatagaaactgtaggcaaactgtgccctgtcattcaccttttgccctaaagagccaaattctacctcattttaatgctaaagccctgccccaaagtgaacatgggatgtttgttacctatgtgttggtccattgtgcatgtgcttgacccacctcataaatttgtatggccttcctccacacctggtgaatatgtacagtgatattcacctggtgaatatctactatgtgacacagaccttctgaggcataaaacacagcccacccttcccctctttgaaaagaaagcaccttaggtccatgctggaaactgtctcttcttggtttgcaaactgatatcatcaataaagctctcctttctactatttagccatcctgatggtcttttagatgtcaaagctatgaggaaattacaccacacagccccccacttcttgtctgtgttgaccattctggacacagaagcctctgctcttttacaaacatctctgaaggaaggagagctcctcacaaagcatcaggaatcatttagtggtgggaaagctttgtgcatgacgatcagaggaccctgaaatcaaatccacatctcccatctgatcatctgtaggccctcgacaaggggcaaaccttagtttcctcttctatcacattgaaataagccttcctacttcaggggatggtgtgataactgcatttcagagcatatagtccagtgactagcacctagtgagcacccagtgctgacaaagactgtctcaggctcctctgagccttcctcctgactttggcccctgtcctgtcagctcagttttagtaacaatcctgctaagccagtttagcaagaaaccccccttcccttgacccactcatctgcttcatagctatgaaaccccacttgtccttgctgtatcgggagcactatcttccctactatctcccctactgcagtggccccattgtaacagtcttgaatgaagtcttcctcgccattctaacaagtgtcagaataacttctctaacagtatgtgcatgtgactattgccatcatctttcctctctcccagggatcaacagacagtgaaattttctacctagttcctggttgggaaggcagcacacccatagtcctgtgatgactcttctagcaccaccgttgggctgggagacctgcccttgcacgatgactccaggcaggtactttgggttctgcctagcacagggtctgcctggcacatccctccgtagctttccttaggatcaatgtgttgagctgccaaggaggggtcaagccagacctttagaagctgctcttaggtgctgaccaacattcactccagttccaagcaatcaaaccagccttttgtcagggagaggcctcatcttaggaaaccaatgtttctgatcaaaggtcaacctccaaatccaatccagatgcaattatagttgtgatttaagtaccagagttgaggttcaaagtccaactttttttcctgaaacaactgacctctgctttgtggcaaaaatggttgagtgtcagatgactataatacaattttaatttaagatctaaaactcggtgctaccttcaagttgtcatcagtttgtcatttttttttttttgttgacaaattaaggtgagtgggcaggagtgctgtcatcttctttcacctccatttcaatgtcactctgtccctgaacctacttgcccttatactggtggggagagggtcccctccctgtgctcccaacatgtccacacccccatttttaggattctaagccactgtccctgactctgattctctcctccctaacccctggtgcaaagctgcccacgctacagactaggtggctactacccgtgatatgcaaaaccaataaaaaataaaaacacttggccaggtgcggtggctcatgcctgtaatcctagcactttgggaggccaaggcaggtggattaccaggtcaggagttcaagaccagcctggccaatatgctgaaaccccatctctactaaaaatacaaaaattagctgggggtggtggcgcacgcctgtaatcccagctacttgggaggctgaggcaaaagaatcccttgaacctgggaggcggaggttgcagtgagctgagattgcgccactgcactacagcctgggcgacaaagcgagactgcgtctcaaaaaataaataaaaaataaataaaaaaaaaaaacacttgaaaaatagttgtgtatttatttaattaaataagtattaagaaaatgattatataacacaagaaacccataattttgtggatgttattgctttagatgaggttaaatatttaagtttagctagctgacttgcaatagtaccaagtaactgatcacaagggtgatctgtgacattggaaacaatgggtggaagttgggatgatctttgcacagtggagagccctggactggcaagcaagagtctttgctctatttctcacttccagtatggccttgagatgtgccttaacctctctaggcctccttgggtatcattggtgctttcacggagctggctcctttcctgatttccaaatgtactcaagtttctccagtgtggaaaataaaccaccaatacctgttctttgagcgtgtgagccctcagatcgagctctcctctcccttctccccttttctgtgggtgccagagctgagggtgttgccttccttctctctgctctccctgacaacaccattgaaagggcctcttcagtgtcactgacgacttcccaaatagcaagcagcactgccggccctcagcttctggaacaccctgacttacacgggctttgtggacaggactgagaacttagccccgatggatcgtatgctgtgtcccaggaaaatggattctgtgtatccaatgcctccttgacaaagagaccctcagaagctatctccacccatttatatttaaaacccctcctgggttgtcaaacaatacatgacaagggtccctggtctgctgcccgcactcagccctgctgctgccttctgacaatgggaaggatggagcggtgccaggaggcagcccctggggcactgggatgtcattatgggctgcatcaggtgcccatacccacagtgaggggcatcgagctagggctgcccaactctagcagccccgagggatgcctagggagagtgaagaaaagcagctcaggtttctgggttcattacttggctctccagtagacgttccagccttggaccaatgacccctttcgtaatgcctcaatctcttaatctgctaagtggcaataattagtattaaaagtaggaaaaactttgtatgagtttgttagggctactgtaaggaaatcccattcactgggtgggcttaaacaacacaacggtgttgcctggcagttctggatgctggaagtccaaaatcaaggtggtggttccttcagagggctgtgagggaaggatccattccaggcccttctccctggtttacagatggcttccctcacgttcacacggtgttctttctgtgtgtgcctgtgtccaaatttccacctcttataaggatctaccttcctccagtaggaccacatcttaactaatttcattggcaacaaccctattttcaaataagagcatattatgaggtactgggggtgaggacctcaacatatacttttctctttttttttgcggggtgggggggtggtgggtgggcacaatttaacctataacggagctgaagatgcgaacacggagtcggggccctggattctagacccggctctgccattcagcagctgcatggcactacgtaaatcagccctgtactccaggcggcagacttctcttcacctcctcagtttgagggtaggaccccttccagctctaatagccaatggcttcacatctaacttaaaccgttctaaatgttagcagagtatttaaaacttcttacatgggcgatacagtataaacactaagaaataataaccccgcgcctcgggagaaagaacgcatacaaattcaaagtggttttcaaacataatttcattaatctttacaaatcccctgtgaagtagtattattaaagagcaaactgacaattgtgctatcatctggtcaagtaaaagaacaacatctcagacaagataatagcagacttatctgcctccagggagagttgaatatgcaaagggtgagtgagttggaaacaaataggaaatttcatctcaggtggctttgaaataggggttggaaatgaggctttggctgccatcctgggactttccaaaggagggggagagattcacaggcagactttccagaatacatgcatcattcatggcctctaatttttcatgcataaatgtttgagctgatatttaagatctaggaaatctgctgagaaggaattacaatgtttttctgaggtgagaaaaaaaaaacaacactgtcttagatgaattgttcatcgctttttttgttgttgtggttttgctattgcaaaggtagaaaagatatctgttttcttcctttctaaatcagggctagaaaagtaggcaaccttgaaatgatggaattgtggccacttcactgaagccctcatcctcccagcctctggccattgtcctgagtctgaccagcttttaggaaaagctgatggtcaggcacagtttatcccaggacactgatttcacactccatgtagaaggcaagatgaaggaggcaatcctagggctgaagctgaccctggacagtgggacaaaaggtgacattcagatctgggattgcacaaagacgtctcatcatgtgggaccctggaaggggccaagaaggcactgttgcccaacttgatcttaaatagcttctttacttgctggccttctgatctgaaattccactactggagactctttgggttgaaagaatatctatcctccaggtgaccccctcaagaattcaattgcttctggagaggtgagggctggacctcttaaccaatcgccagcatcattgtgcgaatgagtttgtctcaaccatccttttccagggtgttgagaggttatttagagagggactgggaagggcagggcaggtctccaagcctctggtgggaataagaagaagcagaaaaacaaaaaagggatgaggtggggtgggtgggagactttgaagaccatctttgcccacctcactatgctgccagatgagccacagtacaggctaacctcatttagtgaagcaccaatgctgctagtttacaggttagcttggtttagtgaacacccataccgctaaattaatttaacagttaatactgtgagccagttggtaaatctgatcgtatatcatcagaaattctcttgcagggttcttctgaggctgcttttattattaaaacttaccaatcaaccaaccaacaaataaaaagcagtgtattagcctgttttcacgctgctaataaagacatatccgagactgggaagaaaaagaggtttaattggacttacagttccacatggctcgtgaggcctcagaatcataatgggaggcaaaaggcacttcttacatggcagcggcaagagaaaataagaaagaagcaaaagtggaaagccctaaatccatcagatctcctgagacttattcactatcacgagaatagcacgggaaagaccagtccccatgattcacttacctccctctgggtccctcccacaacatatgggaattctgggagatacaatttaagttgagatttgggtggggacacagcaaaaccatattaagcagctttgaaaaatcataactttacacagaacccagcttctctgtatgacctggtgccagctgcatctctcaatcctccttccaacacaccaatacccagttccttgaagttccacagttgggccagccccctcacccctcctctgcacatgctcttccctttgtatggaacaaccctccatcccttttctacctggttaactaccattcttcattcaatactaaactcaagtctgccccttccaggaagccttcctgacttcccaaagtaggtgagggtcccctgcacctcactgctctaatcacactgattagaattgttcatttggtttccagtttcttcctctagaacgtggcagaaccaatgacctccatcttggcaaccccaatgtgagacgcggtccctggcacctaggaggttcctaacaatgtttattgtgaatgaacaattttttaaccattaaatttgctgattaaaaagcaacagaactcagttgaagcacacatctactttgtggtggaaatataaattgattcaaggttcttggaaagccattggcaaggtgtatcatgggcaatgttatcaactttgaccctggcactccacttctgggaatctagcctaaggaaataatgtaaactatgaaaaaatgatcttcatgatggtatttatagcagtgttacttaaaatagaaatgcctagaaataacataaatgtccaataatagagaaacagttaaattataatctgataaaatgttttgcaaccgtgaaaaatcaccactagaagaaactgtgtcaaatgtggaaaagaattatgataaaacattaaatgaaaatgacataaaacacatggacaggatgataatgattatgtgaaataaaatgatagctcactttaatactttacatgaactcttaattcttacaacaatcctatgtggtaggtactattcacatctccattttctagatgatgggggtagaagcacagagagagtaagtgactttccctaaactgcacagctggtaagtaatagagtctgaatttaaacccaagacagcctgtgtctagacactgtgttcttaactgtaatgatataaaattcatctagagtttagaagaaaaacaaccaaatgctatcgcttttttaaggttgtgaaaagaaaaggaatttcttagtctatatttcaacatttctataatgggcttatactacctttataacagaacaatatttgaaataaaaattttagaaattttataatatagaagtctttcttcaaacgtctatttgtaaagcatgtttacaacagttggtggcttaaatattccagaattgtcttgaatgaaaatgtttaaatactaagttacctgatgcatacacagacacatgaagctgaaactgtatttctgctcatgtatttatttcctttgtaatgtgtaacatatgggatttgatatttataccctagcaagactcttcgtagaaaggtatcaattcactagttgaggaaaaaaatcattgtcagactatgtgttgatgcctttcctttgctcaaacaccagtcctgctctcgctggtggtagaaaccccaaaccaagtcctgggagaccttttgggtggagatgtgtgagggaggccagtgttgcacctatttctggggcacaaggaaagggacctttaagtttttaccaagttaatctgatttaggtcttttataaaagcaaaactgaccgtccaggattccctgagctctcacacagagtatttctgttacaaagggaggtttcatgtctgtatatgagtgagaaaccctctatgggaaatgagaggacacagctggggaaggctcctcctacacctccgtgttcaggtttgcagaggagcgggtggagcttggtttggaggagctgttccaatggagcaaggtaaggaagaactgcagggaagccaccactgttgcctaaaacttaagactcaccgaggcctgctggagcaggggatggggggagggagagcatcaggaagaatagctaatggatgctgggcttaatactgggtgatgggatgatccgtgcagcaaaccaccatggcacacatttacctatgtaataaacctgcacgtactgcgcatgctcccctgaacttaaaataaaagttaaagtgaaaacaaaaacaaacacataaaagtaggactcattccctctgcaattcccaaatcccacgccaaggcactacaaataagagtgttcctctaactaatacttacaggagggtgttcactgtgggcagagcctggtgctgggtgagaatggggtttgcctcagctctggaaacctacacactaggtggggagataagactgacagctagggaaaaggtaattgataatctcaaactatgcatgtggttcacatttgcccacatgagtggtatggacgtgagtgtgtcaggttagtgtggggaggcagtcagaggggcactgtgtccacactggtggccgtggaatgtgtgtgggattcaaggaagagcatctgtagctatccattatgttctaggtgctgtgctaagcaatttcactatgttgttatttcatcctcaccaacaatcctatatttattttattgatcttacaaatgagaaaattaataagtaaagattacatagctaaggaagagactgcagttcaacttccaaattaattctgtttgacttcaagacccataagtagaagaaaggaggagtgcacacatgcatagtatttatgtatatgtgcgcattttcccaaaagctttccgatagatttaaatcaaatgttaccatttgcaaagttcttcttccccagaagtttaactggattctttcaatagccctgcaaagtaacaattacaactacctaaatttcacaaatcagaaaactgataactagaatatgacagagaaccaagcagtaagtagtgtagacatgtgtcccttaatgaaggggttgcgtcgggagaaatctgttgttaggcattttcatcactgtgtcagcatcatacaatgttcttatacaagcctaggcgatatggccttctatacgccaggtgtttggctgcaaatacgtgaatccactttttccagctgttaatcccatgcttgctgccctcacttacttatccagctaacctctgcctgctgctggagggccaggctctggagatactgagaggaagttgacatcacttgcctgatggagcagaggcacctgagctttgcatgtcatcaccaagagggtggtgggtgccaaggcagacatccactgaggtctttatgcttcacctggggagccaagattggaaagggctttgaagattcctaaagctgaatcttaaaacataggtttaccaagagagcaagatagatgatggtattttcagctcaggaaacaacccatgcaaaggcaaagaactgagaagccacacagggctctaagaactactgatggtgtgtgtgtgctatggactgaagggctgtgtccctcaaattcaaagactgaagccctataccctatgtgatggtatttggaggtgggacccttgggaggtaattagattgagatgtggtcatgagagtagggactttgatatgacttggctgtgtccccacccaaatgtcatcttgcattgtaataatccccacatgtcaagggtggggccaggtggagataattgaatcataagggtggtttcccccatattgttctcgtggtagtgaataagtctcaagagatctgatggttttataaacaggagctcccctgcacaagctctcttgcctgctgccatgtaagacatccctttgctcccctttgctcttccatcatcttctgccatgattgtgaggcttccccagccatgtggaactgtgagtccattaaacctctttcctttataaattacccagtcttgggtatgtttttattagcagcatgagaatagactaaaacagtctccatgatgggatttgcgtcctgtaataagaggaagtgatcagaactggcactctcccctccccatgtgaggacacagtgacaaggtggccatatgcaagccaggaagagagccctcaccaggaaccaaatctgccagcaccttgatcttggagttcccagcttctagaactgtgagaaataaatgtctgttgttaggctaccaacctatggtattttgtcatagcagcctgagcagactgagacagtatgctttctccactctagctagatgcaggcctctacctctgcagagatagtgcctggggctccagaggcctgcagtgaaaagagagcccctcttgttccttccccagctgccaaacatccctaaagccggggctcctccaaaccacctgaaatctgcccactagttattagacttgcttctaggagcctggttgcagtttccaaaagagaaagatgccagtgttaggtaatcatgcccatcatcccctaatgccaggcactgccctggctctgaagccagggctgacggatgcaaagaggctctgctgggcaagacactctccggaaggcagacagccgcattttctagaccaccacggttctgttttgtaaaagatttctctcttgtccaattaaaacagaaaattctcttctgttctccagccccagctgccctctacacagtacccagagaggacaacacaatcattccatgcattcaaaaagcagggctttttgcaaggaagagtatttgcctgctcaccactccctctccccaacataaggctcactgttgatgccgcaaatttctgcattagatggctggtagcccatttccactccctaatttcgcatatgaagatgattactgtgtttatgttgtgtgaacagcagtgggccagggaattgagaagcatttgatccatccaacttaagtcttatttctcacacacgtgtctctggctgcctggctgcctaactgctgagaccccggcaggagacaggaatgaggaggcgtgagtcatgtcttgtttgttacaacaggaagatgtcccaggaccttcttgaaggggagatgggggtgggaggatgaatacttcaagttctatgaatcaaatatgaattgaactgtaatctgggctttaagtagatgcctgcataataagtgttaaacaattcatctttctgtcaggctgcagaaagtaatttattcattaccatttaagcaagaagagatcttgtgtgtttaaagagagaaaagtttagcgtgctccattctcaatggcactgcaaagggcccaaactgaaagaaaatgctgaaaggggaaaggaatgaaggaagcttcggagcatcaaaccttgatttggcttgggaaataacattaattctctttcagcatccagttgagaaatcaaacaggcttaatttaaggagtcttcagatgaagaattggtaaattcagtaaagactgatcttactttatgcatcacaagccatccccagctatgtgtaaagttaaaaagtatgcattaagctataatcttttccctttgactttcattatgatttcagatatgtttgcttaaaaccctgaaatacaataaaagcaccatttaggccttttatgattcactgcaagcattttacatttgtcaacatgcaatctatgagccttacatcctcccacaaaaccacaagtaaaatttacaaattttctatataatcttaacacattcaggatgaatcacatgtgctctctattaaaacacgctatatagctaattttcactctactgcatttttttcttaactccatgggacttaagtgtataagcagccatagtaaccaggagaatgcttcagggttgcagccaaacttacgagctggagggaccatatggaggagttttcttggacagaattcagttgtaccacttcacaagtattatactctactcatttgttattgcatagcaaacactctgttgtgttataaagagatggtgtacagttctattttaaaacttagcagaattctctttaaaatgcttgagtcagaaaatatgtctggctaccttaacaattaaaaccaaatctctggcagagatgagattgcaaaaactgtttgctaaactagttcatgtgtgatctcaagcaattcaatgcaaatgacttttaaactaagcagtaaatgagaaactattcaaagatagacaactctgtaagaaaaaaaggagagagcataataaaacattcacatacagatttagcatgttcaagactcagtgctctcgccacagaaaatggagcacactcaaaactgagaatgaccccatatataggagccagtcattctttctaaagtagagaagatgcagggaaccaaattaaaaatgaaacctaagactgccatgggagtgttggcaggcaaagctatctgctttctatgataagttgcaagtgcttatttgaagaggaaacatggcgctctgcctagttctgcatacacaaaggcaatggggtcatatctagacctgaacaccgttggagactcgctttcctcacacatgtaagcacatctgagttttaagaatcccacactcaaacccaactgacaggaccattgcctattaaccaggatgaaaacaatttgtcataataaatatttaaacctttattgtatttttacaaactaactctgtatataaatgctagaaaacttgagaccctcaggaaagaatggcataaatggaaaactgttttctaactacaggtttcttcaagcagaggaatatgacaatgaacagacatacaatggcccacaacaggagttttacttgtttgaatctttcttgagatggaatatagaactttcctacatactggtcagagttttcctctaggatttttgaagctaaagtttagaggaaaatcttgaataatcttaaattgctctcataattctttctgttacacctagcacagattctaagaaatcataatccaaggcattttctgtccacttattaagcactgtctttcaaccacaacaatgttaataccatctaacattactgagtaatgttactcagtaatgagttgccaggcacactgcaataagccctttatatacatgatcttggctaatcctgacagcaaccctctgaggtacagacagttattagtctcattttacaggtcaaagcagtaagtcacactgaggcaggtgatagatctttgaggatttgaatgcaggttggcctgacttcacattcacagttttaaccatgaagccaattggaagtaatacattcctagatctataaaatgatgaacatattcttgaggcagtagtctacccgacaaacagattccattttcctccccacccctgcccataaaagcagtttaataataaataggaagatattatgctttaaaggtatttcatgtcagttgcctttcttcgacacacaatgcaattagagtctgggcggaaatttgattgactggccacatgtgccttaaagcattggaataagcacggaggaggtgaggtagaaggacacttgattggagaacaacagtcgtggatgaataggaaggtgcccaaagtagatcgtggatatttctcctagcttctgccaagcccatcgtggagaaaataaaagttcctcctccttgcaaagaaagaggagagtaaagaaatagctaaaaggtgactttagtgattctctggtattaacagagacatcatagataagaaattttatttattattttttttcttacaggtgatattaagcctaattacagggtctctaattctaagcaccagggagttttatggtagcctagggacttttgacatccaaactaccataaatgagaagaaaatgttaagcttttatggaaagcagagaaggaaaagagaaatgaaattaaggttggcaattattaagtacctgagtgtattaggtatttataattttaatataatttttaaaatattgttcttaagggtatcactaaaatgttatataaaccaccaggtatcaggaatctttctagattaatgctttgctttcttaatgaagagttatattttcacaggaaatatatactagattaacccaggctatattttgaaattttgttgtctacgtctttgaggaactttggtatttacactgcaagacttttagcctagttacttactgacatcttttttattcttgtggacaaggcttataaactccagcatcacataagccattgttcatgaagatccattactcatccctctctatatagatgtatttagctgcgatttgtatagcacatggtgcttagggttcttcaagaaaggtagcaatttaaaaacatatatgtgcaacgtattcaaataaaaaagcaaattcacagatctgtagataaaatgaccacggtgagactgtactaactgaatctacacaaactaaataaaaatgtaagtgaataacacatgttcatagttatatatgcagctttaagatttgggaaaaacttgggcattcattatgtcatagatatcgctcattttcatttgagaaaattccccattaatatgcattattgaacaagcgatgatttgggcccctaggctatatctcatgatgagggtgatgcagatgaagtaaaactttgacaaatgaaaggaaatccagattttatcatcacatcagattagagctgtaagctgtttctaaactcaaaacagttcagatcaatcaggggaatcttgctgacatggaggagcctctgcttctggctctactaatatttgtggaacagtgagcatggaaatgggctttaattctagatcccatcctgggacgggttgtgcattcctgcagcagctggcagggctgctgacacaggactggaacaggagttggaaatcccagctctgctacctactagctgtaggatcttagtgaattagttaacctctttgatttcattgcttgaaatctctaaaactgaaaaaacagtacctgccctgtgcaattcaaaaggctgttcatacatcaaatgaaaatgaatgtgaaggttttctgaaagctgtaaatcagatttgcactgaacttcacagttaacctggcttgagaataaagattaggtatcacaacgtggccctcaaggccccacaccatttaatcccattccatgtgtcctacctcagtctccttgctatctagccacatatcctctgctctagtgacctgaatcaggttaccattttctaccatatgacagctatgtattgtgtgttactgtatttcacgtgcacatctcacacatgtatcattcgatcattgtaactcttggaggcagaatagggattgcttctaagcagcactgaagggtagaaataagaaaattgcacaaatcccatgcacatagtaactggtggagacaggatgtgggtccggattcatctcttagggttgggtcatgtagaaagtttcttcttctctctcccccaggataggtggtaactcccagagggcatgcctacgtgctgtctggtgcagagctttgcacaaagtatgagtcaataaaaatgagtgatacagaaataaactgtgagatgtgagtaacagccaggttttccttgtagagtacagggttagtgggaatgcaagtattatggagtgaattgtgtccctctcctgccaaattcataagttgaagtcctaggccccagtatgattgtatttggagatagggatcttaagaggtaattaaggttacatttagtaatctagaagataaatatggttaaatttaagagataagattaaattaaagttatagtaaataatattaaatttaaataaataaggttgtaaaaggtaattatggctgaagccctaatctgatagaattggtggccttacctgaagaggaagagaaaaatctttctctctccccattccccaccatgtgaagatgcagtgagaaggcagccatctgcaagccaggaagagagccctcagcggaaacccactgtattagtccattttcacgctgccaataaagacatacctgagactgggcaatttacaaaggaaagaggtttaatggagaactcactgttccacatggctggggacgcctcaaaatcatggtggaaggcaaggaggagcaagtcacatcttatgtggatggtggcaggcgaagagaggatgagaaagatgcaaaagcagaaccccctgataaaaccatcagatctcatgagacttatttactaccatgagaacagtatgggggaaactgctcccatgattcaattagctcccactgcgcccctcccacaacacctgggaattatgggagtacaattcaagatgagatttgggtggggacacaggaacaaaccatatcatccaccacgctgacactctgatcttgaacttctaacctctagaacagaaatctctcttagttacacaacctcatctatggttgttatggaagcctgagcagacatcttacactttgggctggtggtggactaagtccatgatgatcctcataggctgaatgacctgatttctcattcctggaaatattttcttcatcatagtcataacagtgatcatgtcaaaataatctttagaacatgctgaaaaggctgcactcttgttctgagctcaggaggtgtgggagagatttacccatgtcagctattacacatagatcccaaaggaagtctcaagtaaatttaaaaaacacattgaactagattaaaatcgaaatttgtgggacacagttaaggcagtgatgaaaagaaaattaataacaccaaatgcttacattagaaaagaatacaattctcaaatcaacaatctatgctcccaattcaaaaaactagaaaaagaagagcacaataaactaatagcaagcagaagatataataaatatagagaaaaaaatcaatgaaattgaaaacataaagacaatagactaatttaattaaaacaaagagctagctctttgaaaagatcaatacaattaacatacctctagctagaatgacaaaggaaaaaaagagaaaatgcaaattaccaatatgaggaaggaaacaagggttgctatggagcattcaaccatcaaaagcgtaataagggaatactacaaacaattctacacgtatacatttaacaacatagataaaatgggccaattccttgaaaaacacaaaccaccacaagtcaaccaatatgaaataggtaatttgaacagccctgtaactattcagataataaatttgccattaaaaactcccccaaaagaaatctccaggaccagatggctttattgaaaaattccaccaaacatataaagaattaataccaattatatacaaatagaagaggtacaatttccatttcatttatatatattttagagaaagagtctcactatgttgtccaggtgtcctggctattcatgaaaggatgactggtgcacatttttttttttcgctctgtcacccaggctggagtgcagtggtgcaatctcagctcactgcaccctctgcctcccggttcaagtgattctcctgcctcaccctctcgaatagctaggattagtgacacactgcggtgctggtttccaattcattttatgaagctagtattactccaaaaccaaaatcaaacagagacagtacaaaacaaaagcaaaactccaaatcaatatccctactgaatatagatgcaaacatctttaacaaaatattgcccaacagagttgagcaatataaaaagaattatataccatgattaactgggagctatttcagggatgcaaggctggttcaatattaaaaaaatcaatcaatataatgtaccatattgacaagctaaagaagataaatcacatgataatatcaattcatgaagaaaaagcaatagataaattcaacactcattcatgattaaaacccagaaaagtagatagggagagaggaacttcttcaacttgataaatctacaaattaaactctatagctaacactgtatataatagtaaaagactgactactttccttctgagatttaaagcaagatgtccacactaacgactgctattcaatatagtactggaagttatagtcagggcaatagggcaaaaatacataaataacaaacaaagaaacagaaataaaagacatatatatcagaaaggaataaataaaactgtccctattttcagagggcatagttgtctgtatagaaaatatatgattaatcaaaatactcctacaactaataagtgaattcagcaaggctgcaggattcaaggtcaatatacaaaaatcaattgtatttctctatactagcaatgaacacccaggcatcaaaattaggaatacaataacatttgtaattactcaaaaaataacacttaggcttaaatctaacaaaaccggtacagaatttgtgtgctgaaaactactaaatgctgatgatgcaaatcaaagaagagctacataaatggaaagaatactaagttcatggattggaagtcttaatatagtaaagttgtcaatttccccaaaatagatatataggtttgtaacaggatgaataataaccacccaaagataacaggttctaaactaaatattgccttataaggaaatgtggtcttcacagatatggttaaattaaagatcttgacaagggggtattaacctagatgatccaggtgagccctacattcaatcacaagtgtccttacaagagagaggcagttgacaattgtacagatattatgcagagattatgatgtaaagacaggcagagattggagtgatgtggccaagggatgtcagcagctaccagaagctggaagaggcaaggaaagaattctccccgagagcctcttgagggagaatggctctgctgacactttgatttttaatttctggcctttagaactctggataatacatttctattgttttattttattttattttttgagacagagtctcactctgtcccccaggtgtgatctcggctcactgcaacctccgcctcccaggttcaagtgattctcatgcctcagactcccgagtagctgggattacaaatatgcaccaccatgcctggataatttttgtattttttttttttaattatactttaagttctagggtacatgtgagggttctatcatgttggccagactggtcacgaactcctgacctcaagtaatccacccacctcgacctccgaaagtgctgggattacaggcatgagtcactgtgtccagccacatttctattgttttaaatgaccaagcttgtggtcatttgttacagcggccacacgaaactaatacaaggtttagcacaattcctatcagaatcccaggaagattcttgtgaaaaaggaactagaatagctaaaatacttctgaaaaagaagaataaagtgggaagaattgctttacctgaattcaagatactatatagctacagtaatcaagacatgtggtgttgggggaggaatatacacatagatcaatggaatgaaatgagaacacagaaacagacacatacaaatatgcccatattcttgataaaggtacaaaaacagctcaatagaggaaggataggcttgcaacaaataataaatggtcttggagcaattggacatccagaggccaaaaataaagaaagaaagaaaagaaaagaaaagaaaagaaaagaaaagaaaagaaaagaaagataaagaaaaatggagaagaaacaaatgaccttaggtcagaatttttagttaataaaagctaactcaaaatgaatcatggacttaaatgtaagatgtaaaattataacactttaaaaaaataggataaaattttgaggaagtagggcaacagaaagagttcttagacttggcaccaaaaaacactatctataaaagaaaaatttggtaaattagatttcatcaaaattaaaaacttttgctctgcaaaaagatcctgtttataggatgaaaagataagctgcagactgggagaaaatatttacaaaccacacttctgagaaaagactagtatctagaatatttaaaaacctcaaaattcaacaattaaaaatattcaaattagaaaacaggcaaaagatttaaaggcacattgtatcaaaaaggataaacagctggaaaataagcacacgaaagatgttaaatatcattaactattaggaaaacgcaaattacaaccacactgagctatcacctcacatctgtcagaatggctacaataaaaaatgacaacaccaaatactgataaggattcagagaaactacatcactcctacattgctgatgagagtaacatggtacagccactctggaagacagtttggcagtttcttataaaagtaaacatgccattaccacaggactcagtggttgctctcctgaaaatgtattccagagaaatgaagacatgttcacacaaaaatctgtacacaaatatttagagcaattttattcataatggtcccaaactagaaaccaacatgttcctccatggatgtatgattaaacaaactgtggtacctccataccatggaatatcactcagcaataaaagaaaaaaattattcatacgtgtgaaaacttagatacatctccagaaaatgtatggtgagtaagaaaagccaagttcaacaggttttatgccttacgactccatttgtatagcatgtttaaacttacaaaagtgtagaaatggagaagagattagtagtttccaggggttaaggaagtgatgagagaggagggaagtggatgagaatataaaaaagcaacaggcgggtggatcatttgaggttgggagttcgaggccagcctggccaacatggtgaaatcccttctctactaaaaaatacaaaattagccgggcgtggtggtataggcctgtaataccaactacttgggaggctgaggtaggataactgcttgaacccacgaggtggaggttgcagtgagccgacattgcaccgccgcactccagcctgggtgacagagcaagactccgtctccaaaaaaaaaaaaagaggactctttgtggtgctgggaatgttctgtaccttaactctgtcaatgtcaatatcatggttgtgatatcacacttatgttttcaagatattactgttagtggaaattgtgtaaaaagggaaatgaaatctatattattttataactgtatatgaatccataattctttcaacataataagtttaattaaaacatatatagttgctattaaaactcaagctggtaattaaacccgatacagaattttgaaataaacttgaaaaaaaaatcaatgtatatgtcaatgaaataagcagagctctagtgttcagatcagagctttttagagggctgtggaatatgttcttctctattgactccgttttccctaaagcacaccttaaacttgagatacttggagggctctgatagccatttttggcatctcaacaatggcggaaagcggaggcaggaagctgggacaccagcacctgctaactgcatgaccatggggacctgcaatatagaaaggtaatggtgtctaccacaccaagttattgtgaagtctgtgcctaggggcacagaacatgactgtacatcaacacatagtaactttttgccaatataaaccttcattgactagtatacaccttccaagagctcctcctaccctaacaaggctgtggatgaaagctctccactcaagcaatcttcattttgtttggggagacaagaatgatgacagccaggacagcttcgagtgtcagggaacttgtttgtggcaatgaccacagggcaaggatgatggagtagggtgggggtggggggagatggatgcggataatgctggggcaggggcatgtacaccaaggatgtggctgaatccttgcaagggtctcgtcctttctcttctgcctgcctgttagtcctttcccagcttcacatggaacagctccttatctcacccatggagtggcctgtttcttgccctacagtttctctgttctaacaccatctgaaatgggctgtagaggatctgcctatttgggatcagaagactgggactgaaccacagcaccccctctcattagctagtgacctctgacaaatctctctccctgagccatatacatgtttatacatgttttacccatatacaaaatgcagagaatgaggctccttcacaaatcagcctgtgtgagggacatgcatggcatcccgtgttcagtacatgtggaccacatggttgctcctgctctcttagacaagaaataaatgccagctttattgaaaacaaatagggcttctacagcaatactgggcacgtaaggagaattagaaagtagctgaaattatagtcttagctaagaaaacactctaattctgaccttatagtagaagacctcatgccagcagaaatctagctttcacacagaatttcaggacaggttacagggctcatatttagccactccccagaaaaggattcggatcttgcatggaggtcggcatcactcacacttctgggtcacctgagggtagcttcggcaggagatcaggaacaaaaccacctccgtaagctgttccagagggttcctcttctagaaaccctgctgtgtccttgcgtggtgcacagacacccatgtcagcagggctccttctgtgcactgcccctgccaggaccacccacagataggaaccctctgcaagttaaacggaatgtatctcagaacctcatgcatttctttctttcatatatctccttgccacattccactaaggatttgagcaaacttacaagactttgcactctaaaataaaaagctacaaataatttaataaactgagaccggggagaatatatttatagaataggaaatcaagactagggcaaagttacattgccaggtgtgcgagctataggcttctacagttacaaaaattgagcagagaatgtgactctgagctttctggcagtcaaagctaagagagaaaaacatggttcacgaattcagtgaacataaggcaaacactcagcagtttttcaaggaagcaaaggtcttcctgacatttaaatctacaagagacatttcttaggtgtgtctttacatagggaacagggagtgctgtcgtgaacagcatcttcgacaacatcctatgaaagttcaggtccagggtttgcatgatttcatccacatatcctcccagagtaacaatgccaccacagttctaggaaacctagatcaaatgtgctgggtcttgacgttcaacttagggataaaacatattttaatcacttaaacttttttaaacatatggtggaggggtaggggagatgcaactacagaagaagaagctcagcacctaatgctgcgaattagacagagggaggtccagtgcctccagttcccccttctgtctccatgattctctattgcaatttcagtacctggtggattctcaaacattcatctcctcagtaagtaactattaagcatttactatgtgccgggtgatacagtttgtatatttgtccccagttaaatctcacattgaacagtaatcgccaatgttggaggtggggcttggtggggaagggactggatcatgggggtggaattctcatgagtggtttggcaccggtcccatggcactgtccgcatgagggtgagtgagttctcatgagctctggttgtttaaaagtgtgtgacacctacttcctacgatctgtctcttgcttctgctctggccaagtgatgtgcctgcttcccctctgccttctgccatgattgtaagtttcctgaggaaagaagctgagcaggcgccacattctgtacatgcctatacatgagaagctggacaggccacattcctgtacagcctgcagaaccgtgagccattaaacctcttttcttataaattatccagtcttaggtatttctttagaacaatgtgaagatggcctaatataccaggtatgtgttgaacaatatggagttagtctcgaaaggacagttatgtccttttggggcttactattagtgggggaagaaatacattaagcaagtaattactggtgtagacaccgctaccaatggtgaagtgccaggattatggaaggggtccatatggggtgttgaattagtcaggtagtgaaggagaaatagacatttaagctgaaatcttaaggataagaactaaacagctagggaaagagtattatgaatagaaagaagagcatgtacaaatcccctaagtcagagaggtgttagaatattccagaaactggagatgtcgggacattccagaagctgaaaacagtatagtgcttggcgggggcagtgatggtgaggggaagaagaggaacagctcccagtggggctgctgaaggaagtggcacacttcattaagggcctggaaagctttgccaaggatttgtgttttatcctaaaataaataggcagatattggcaggtttcaagcaagggaattttaatgccagttcacagttctgatgatcactagctgctgtgtgaaaaaaaaggataggaaggtgacaagagtggagtcagggaggccacagtctttcaaggattaggttttctgagcaggaggtgggggcggcaagagtcttgaatgaacagtaggtcagtaccagaaaagaaaagatgaccacagcgcgtgattctgaaaaaacaatccaattgcctgcaagtgaaccaccgcaagtccagtacattgtgagttggatctgctgaacagcccctgggaaaaacaggggccctgagacagacactaataacaatgcaaagtcattcatgcttttattgttcaattataatgagtccactcatcttggtaataataataatgatgtgtttgaataacataattgcttaatagccattccttaccaccaccaccaccaccccctactattagcacaaaactaaaataacttagagtatttgtcattctaaaagaggcagaaaaaattgcttttctctgctagtagcttttaagaaataaattatatagatgatctagttatttctgtggctttaaaggggaaccttcacttagggcagcaaaatgtataagggttatcctttcaggaaagcccctttcatataaacagaaacttttcttcatggaattcaattagtctctgggcctcagttttgctatccctaatgggggatcagactaatttgtggtttccaaacccaggtatacataagaatgagctaggaaacttatcaaaaattcacctctttgggctccatccatgattctttgtatgtggagcctgagaatttgtattttgaaccacttgcttggatgacctctcaagttccttctgtcttcaaaagtctaggacactgctttgcagtgtggtccacctgggagcttgtcagacatatagactctcagccccaccccagaactgctgaagtagaatttactctttcaacaagagtcctggaagatttggaggaacattaaaatttgagaagttctagtctaggactctacctttcaaatatgcaccttatttcctatagttcaggaaaacttggccattggagaagaaaccaactttctagcagaagcaaagcaactcagtggctgagctttgaatgcaattcggttgtcctttatcagcaaggacagaatgcctctctcacagccataaataagctcagagaaaagaagccgaatcagcaaaggtaaatcaagtcctgaattgtgctggctcatgcatatattgagagacaaacaaaaaaggaagcactaaaatctcctgcatatttctttaaaatatataaatagtagataatcagaggttgacttcaaatctgggtcggcataaatttcttctcaggggcattaaatatcctcctctctttcagcttcctttttcactgggtccttctcatcctgagctgtgttctgcagtttctctcctgtctcagactcaactctcacctattcagctcttctttaaaaaaagaaaaacaggcaaatcaaaataagcaacaacaacaaaaaacctgttataatttcttccattagtactacatggataaatcccaatctctttccatatttacttctctacttgaatttaaactcagtttgcctactgtcttcaggaattgtttcagtaactatcatttagtcatttattccaccaacttttatttagcacctacatagtttggtaccccaagtatcatactatgtgagattaaatccaacctgcctctttcctctgggagctcagagtttattagagatttaaaatttaggaataataataacacctaatagaaagtaagaagtgaagatttaaaagagacagagataaaatggtatgggggaaagccaaagagataaaatggtatgggggaaagccaaagaagataatctttttggctggggaaaaataataatggtttcttgggggtcatggtgggtttgaaatatgcattgaaaagttaaaatgatatgggcaggtattaaagtttccagggctggtactgggaagcaagatacatcaccaggaaagggaatggcatctgcaaaggcaaactggttaccacatatagtgtgtggacatctgaacataacaaagttgacttgagtggcccctgcatgaagacaagtaattcaaaaaatatgttggaaagattgtggagagtttttaattttagtctaagaaatttgatctttattctaaagcaataggagcaaccaataactttctaaatagaggagtgacaaagccaagcctgagtctttggaggaaaatgctggctaagagaattggacactgaaaacctagaggatgggcattgcaaaaggcttggtggagggcaatgaggacctgagccaggagcgggtgaacagtggggaggccatttataactgtggctctgtcttataacttagaccctctttcctgagctggctcagatcaatcaggttagggaggggaggaaatgggcatactataacaatcgaaatctagtagtttcccaacaggtgatggagaggatgtggagaaacaggaacacttttacactgttggtgggacggtaaactagttcaaccattgtggaagtcagtgtggcaattcctcagggatctagaactaggaataccatttgacccagccatcccattactgggtatatacctgagggattacaaaacatgctgctataaagacacatgcacacgtatgtttattgtggcactattcacaacagcaaagacttggaaccaacctaaatgtccaacaatgatagactggattaagaaaatgtggcacatatacaccatggaatactatgcagccataaaaaatgatgagttcacgtcctttgtagggacatggatgaagctggaaaccatcattctcagcaaactatcgcaaggacaaaaaaccaaacaccgcatattctcactcataggtgggaattgaacaatgagaacacatggacacaggaaggggaacatcacacactggggcctgttgcggggtggggggaggggggagggatagctttaggagatatacctaaagttaaatgatgagttaatgggtacagcacaccaacatggcacatgtttacatatgtaacaaacctgcacgttgtgcacatgtaccctaaaacttaaagtatatttaaaaaaaaaaaggaaagaaatctagtagtttcctgctatccttcagtatttttcacctagagctgcttctagctttccctgtggtttcagaaacacagagagattacagtcatgtctgtgtgtctttgcaagagcagaataaagcctatatatcttttcaaattaaggtttttttttccccccactctccagggaaagcagcaacttctccattcatgtaggaatcaaattgctagccattatgcttgctgatcatttatagaagtttatacccctagcaaccagatatgctcagtttgtctccgacacagatggaagaccttaaaaaaaaacaaaaagctcaacctttactagaaacaaatttctaaaagtacgtattaaaaaggtaagttttaaaaacaattcatgcatggatcattccttaaatagaaatttcaagtagtttcagaaaatcagaattaattataatgatcctgacttgcttggttcattcccctaggaatatctcataaatattcagtgtgtttagatttcactggctctgggtgcaaggactccaggccaagcacccaatgtcaattctccatagggtcctccaggtcccacagtcttggaggccttggagatgtcccaaagccaagactgcccagaaagatccaggtccaatccttgagcctagtaaactaaaaataagagcctttactttctcctcttttcttctcttttgtaatatttttgctaccaccaggtggtagtgggtaagtgcatctatgagaaaggtggagttatcaaagtgtaaaggctcagttttgggaaattatcaaaataaactctgtttaatgagagtctggaaatcttaattaaataggatcaatattacacacggaacaaaaccaaaaatacaaatataaatgaggtgtctttccttgtgggaaaagtcagaaagtgtgtattcagttgttttcaacaggaaacaaacttggcttctttcatataagacccaatggtcagcttgaggaatgtcccgcattttcacccacatttttctcagattccaaatactctcatggtatcattttcatgaaaagaataaagcgtactccattagaatcatcataaaatcttagaattttagagctagtaggagctttttcgctttacaaatgagaagactggccctagagaagttgcatggtgacttggtggaatggaccagggcccagcaattccttctccagccaggctttttccgccatcctgtgccaccactgctcctatcaaggagtgtgttgttccatccagtggtcaaccctcagccctcagatgctcttccttggccatagacagcattcacccacagctggtcactcccacacccacacttccttcacctgacttctgggacacagggctctcttggttttcctcctacctcatcatcctttctttaatcacatttactagttccttctcatctccccaagatgctaatattggagttccatggggaccagcctttggtcttctactctttcttagctacagtcattcattcccttgggaaatctccttcagtctcatctccctagtgaacaactccccagtgaagaccctggatttgtatcttcagccgagaccactgccctgagatccagggccctttatctctcttccttcttaagatctccacttggccattgttatggattgaatgattccagtttcccacattagaacctaaattcatgagtcactgacacaaacttgatctacctgtagtcatttctaaccccaattaattgcaactttatcccccccaggccaaaaccattgaagtcactcttgtttcctctctttctctcacattctatgtccaagtcattggctccgcctcaaaaacaccactccttaccatctgcccttccagcatctgatacaagttgtctttttcttgcttagtttcttgaaaatatttctacacatctacatgcttcagcccttgtttcactatagtctcaacttgacagctgaaggggtccttttaaaacttgcattagaacatgttttccctttgctccaaaccctccaaaaccttccatttctctaagagtataagccaaagtccttatgatgtttccaagacgcttacagcctgccctgaagcctctttgacctcatctcctgccactctcctcctgccttactctgctctagccacatggtcgtcttgccatccctgaatattccaggcattctcctgcttcagggcccttgtggtcattactccctctgcctggtcggccctcgcaagatggctgtgtggctcattatctgacctccttcaattctttgttcaaatttctctgtcacacaaagctttcctgaccaccctttcaaaaattgcaccacaccactcctgccttccttgctttattgtcctttatagcacttatttactttcaacatattgtacattttgcttatttttcctatttcttcctatgagtgtaaaaggatcaagaaagcagggattgatgttgattgggttcactgatgggtctgtgtgtataaaccagttccttgcactgttgtattgaatcaatgtgtgttgaacaaataattgtggggtgaatgaatggatgaatgaatggatgaatccaagtctagtttccttgtaatataatatatggctcttcttccagtttcacattcttctgggcttggcaaaatcagttttgaatacaactgctcctagtaatggaagttacgttagaaaattcaatacggcaatgaacttctgccatcacttctgtattgtggcatgtaaggcttgttctctaagagttgtgtatctctccttaagtgctatacttatagttcagatgagctgccactaggtagaactctgggcattcagttaggagctctgcatctctaatatgtctcttcttctccctgcatactgtcctgggccaggcccacatagtctcctgttaggtcacttgcatcagcttctcagttgacttccccattcttagtctttctcccctaattcccacctaaccagaatgatctatctcagtggcctgcaatctttcatgtttagtggccactcctttgtaattataggtagactcatatatagaacagagcatctctatttgaagctctctctttcatcccacctcaaggcagcctgtgaagaagcgtccggaattgagggagctgtagaatgaagttcatattcccctgattaagcccgtccatacacttagcttgaatgccccttttcacacaaaccgtcaagggcttcctattgctcagagaagtgtttcatctaccatagtaatccatgcaccacgttcatgattttttctttttttttttttttttttgccacagtcacatgcctctctattattcacctaatgtttttcttaaaaccaactcatatttataaacttagattcagtttagggaatctaaatcattattgtcatcaccataaactaaaacccaatgtgtcattcattatgaatagaagataatattaaaattaaatatgtagggatttggatgacaaagttatcatgttcatctgtaagtgtgctccacactgtagggaaacactgcctagagaataaagctgcagctcctttacccaatgtgttcaaccctctccatgaagaagaaaattcttaaagttctctgcacgctgttttgcacctcattgactttgctcatgcagttcccttggcctggaatgcctaccccaatttagttttaggtttaaacattttttaatttttattgaagtattacgcataaataatttgaaaaatcagttagtactctaggcttacaacaaaacacagctgcccctccctcctaattctcccttcctagagcatacactttctttttttaaaaaattgtggtgaaatatacataacataaaatttaccattttactcatttttaagtatatagtttggtggtattaagtacattcacagtcctgtgcaaccattaccaccacccatcttcagaactcttttcaccttgtaaacctgaaactctgtgctcattaaacaccaattcactccccactccctcattcccctagtctctggcaatcatcattctactgtctgtctctgtgaatttgactactctaggtacctcatataagtggaatcatacagtatttgtccttttgtgactggctgatttcatttagcatcattatttcaagcctcactcatgtggtagcatgtaacactttcaattcactccactactttcttttgacattatgctaggaattctcttttcctctcttctgaaatggatcctctgtcttctggatcccatgttttcctattctttgttttattctcttattttgatgtggcatatccttcagtaactttttaagtaaggatgcacaacaagcacatattttgagactttgcatgtgtaaaaaaaatctttattttaacttcacatttaatgatagtttggctgggtatggaattctaaattggaaattattttccattcacattttgaacacatttatcaactgacttctaggtccccaaattgcagatgttaatgcagatgctactctgattccccatcatttgtatacgatctatattttttcctttgcaagacatacaatctttattttctattactctgaagttttataattatatgatattgtgtatgccttttatagtgtgggattcaattatgctggacactttctgaggttacaatgtgtgtgtgtgagagagagtgtgtgtatgtgagagagagagagagagagagagagaaagtgcgtgcgtgtgtgtgtgtgtgacagagtgtgtgtttcatatttattcctgctccccgtattgactctgagaccctcaccccacctcaccaccgacctttgttttaatttgcgttttggtttcagtcactgtgctttctgttagaactgctatcatcaaatatctgttgatccttggttgttctttatgaaaaattcaaagccaattggaatttctatgcacatgaatgagggctgttgccttgtaaacttcataggagggtgattgggccaggaatgaaccattgaatgattccccatggcaataacagatttttctctggggcatgccagtctccttgaggaataaccccctttttttccttagtaggggggcattcaactaactacactgttctgaagtctgaaagaggagcaggctaggacatctcactgttcaggatacagactcttcctcaacctcctggtggttggtatggtgcacccatgctctcacctctgcctggcttgtggactctgtccttatattccatttagggtccctctattctctccttcagttgactcacctctgccctccagcccttactttggccccccatggcctgctttcctccctggctagccctcagctcagatatgataaccctaatatcttttcatgaactcatgatttttatctttcacataagaaagcatatgtatagaccacaaaatctatgcagaggacagagaccctttgggaatcaaactccacatccttaaaaccacaaggaagggaaggaaggaaaagtgtccaacccatgccttccagagtttcagacccctgactctaagaccctaagtaacaagagattgcagatgaatattagggagtattttacactgaagcaagccttcaaatggttatatacaaaatagattctctaatgaaacatatcaagatgaactgaacatatggataggttagcagctataaaagtcctaatcttctaattctgtattggtctttccagtgaccagaccccatcctgaagccaggtaggggctgccagtcagtagtcaatcattagcatgcaaaaatgcatcactttggaatttctaaggattttaggatttgaaagccaagaaatgggattaaaaaactaaacatatttcacaatatcacatcaagaaactttcattatggaaaagggtaactctctttaaggtggcttattactagaagtaagatttggggtcttaagacgtcccggggcttccttaacaatcgacttcctagtactttttgatgaagcactgtctctcctttaacactgcctttagtttctaacctaatcttatttggcatgattctctaagacatgccaaacagagctttcaggtttctctgttttctggtatctggatatgtctgactcacttaagaagtttcatccagtgacagtaaccatacccgatgaggtctccgtgttaacagagcttaaatgtttgctaccccctcaggctctttgggtgatgattcaaccaaagggaaaatggcaagtgaaagtgtgtgccccctcccctctgacttcagagcattgcaatagggctacttttaatgtgcttggtaacaattagctcttgaagctgcaacagctgcacaatgctgatgctctccagatgcaccaaacgaattaaatcatgcgataattcaattggaaaattgggtgtaattatggagaatgcagagtctgctagtcgccgcacggtgacttggagttcttgaaacaacagtggtgtgggatgttcagggagtgtgtggcagacacagaagccgatatgggtgtttgcagaaatctcagccccctctatgacaatgatggaattacccaaccctgttctcagttaagagctatctgagtgccactaaagagatctcctctgtaacttcaaagcttctcacatccagaccactcttcctgacatgatagtgggggctgcgcttcaagctggttgggaacgtgtaaaacaagcaaaggctggaatccctaaggagtagtgatacaaatgttaatttaaagagctagttaagtaagagaaccataaattatgataccttaaacattctgttttaactaacacacacacacatattcatacaccaatctcttgatagagggtcatgtccaaggtcaatgtcttctgcgtagcatctttctcacatttatcagacccttaatgcattggttataattttcagtttgggtttatgtgatggggaataagaacctaaaaagatctgaggatcattttcaatagcatcttctcagagatatttatgtttttctttccaaactctgagagtcacccaattcaaaggcttctgtgtgctgttttgcagttatgccctgcacaactcgaggaggcgtcagccacagggtatcccttggagtcgtgtagtgacaacttgagagtcgttctcaggggtcctgcctcatccagcagcaacttcttttgtactggcttgcctttattgaatctttctgcagcattcaactgagttttcatagaaacaatagctctctccttgcattgcaattgaatcttataattaccataaatatcttttagaacaaatacaatagcctcttgggaagtgagcatcttaactggtgagcagaagtgtgcatgtatgcaagggaacagcctataggcctcgagtgtacaggatgctatgggcatcaatcaagataatttacagagtgttctgctcagttctgggaatttttaaaaaaatgatactttacagagggaaagctaatacagagagctggtaaagggaaggttaattaagagagcttctactgtcctgtgaatttagtgatgctcttaaacaaatttctattttattattcactatttcatctatatttttttaaaatagcacctagagatgtcagccattttatctttttagtccacagataaatttctggattccttatcataactccccaggcattatagtcttcagattgggaacccctggcttagggtctgctgcccatagtgaaataaaaaatgattgagcttggttaatgaaggagtaacgagttctctttgcatgatgtgatttaaactcaaagggaagaatgctgaagcatccattaagagccatgcttttccataatgaaagtttcttggtgtgatattgtgaaatatgtttcattttcgatcccatttcttggcattcaattcctaaaatccttaaaaattccaaagtgatgcatttttgtatgctaatgattgactgatgactggcagcccctaggtagcttcaggatgggatttggtcactggaaagaccaaggcaggattagaagatagggactttcagtcccatccctcagcctcagggaaggacaaagtggctgaaggttaagttgatcaccaatggtcaataatgtaatcaatcacgcttaggtaatgatgtttccataaaaactccaaagaacagggttcagagagcttgtgggtagctgaacatctggaacttcctggaggtgtcacacccagagagggcatgggagcaccacaccccttccccataccttgccctacacatcttgtcatctatattctttgtaatatcctttataataaatcggtagacataagtaagtttctctgagttctgtgagctgctctagcaaattaatcaaacccaaagtggcaatggtgagaaccccaacttgaagctggtcaggcagaggttcctaaggcttggacttaagactggtaggaagcaggggcattttggggactgatccctcaaccagtggagtctgacgctgtctccaggtagatagtgtcagaatagaactgaactggaggatacccagctggtgtttgctgcagaacttcctgcttgcttggtgtgcggggaaaatctccatacatgtggtcacagatgtcttctatctgtgttgacttttggcgtgagagctgagaaacccaatctgtgtttttttccaccctcacctggatagtttaaaaaccacaagaaatattgatgctaaagagggaaaaagccaccagtttatccacctgggactttccccaactccttctcccttcgccctgtctttaggtacatcacatcttgtcttttaatttgaccagaccaagaattagactcgagaagctcctcactgagaaactgtgacctagggttggatcgtcttccgttgaaatcatgactttgcctcttgcttacctaacttaacttaatttgaacgttagtttctttgtctgtaaaagggtcatggcaataagtactctaccaagttactgtaaagattaaatgtcccaacatatcccaaaggaccagatatggattggatgctcaataaatgtcaggcaggagcaaagggtggctaaagttttatcagaaggtaaaggaatgggagaagatacacggtatgaggaagaggtgattcaaaatagggagatagagaagatgagaaaaagtagtaaaaatcatatacaggactgggcacagtggctcatacctgcaattccagcactttgggaggccaaggcaggaggatcacttgagatcaggagttcaagaccagcctgtccaacatggcaaaaccctatccctactaaaaatacaaaaatcagctgggcagggcacatgcctgtaatcccagctactcaggaggctgaggcatgagaatcatttgaacccaggaagggaggttgcggtgagctgagatggcaccactgcactccagcctgggtgacagagcaagactctgttgcagtaacaacaataataataatatacagaattgtgtggttaaaaagtgaatttatacacattatgtcactggcatagtccaacagccctgtgagataggatgggatttagtattcatttttcagacgagaaaacaggtctaaaagattaaaagagttggccaaaaggatgaaacagagttggcacttggacccaagttctccttattcccagcccagtggtttgctcataagagtatatgatcttcagctttctgtctttaccacaccatcttggagactccgtgatggctgtcatgctccagatgacctccttttgttctagggagagttatacaaacagtcagtgctccaggaagctgctttgggtcttccaggtctagcatgccttccagtaattattttgagagaaacaatgatggaaagaatccatgaaaaaggaagcttgggtcatacagtttgtgggtaggggaacactgaatatgaaaattgcaactggagatcaccctttgaggttaggacccagagaaaagtgatgttatgagtcctgagttattttattagtggatagaaaattataggaagtgatatgttttgaagatggaaattttagaggtctaatgtaactctccaggcatattgaaagatgttatttccatattcttcttgggtaatcaatcatgccatagcaaattaagagttcttatttttaggcttattagctacacaatgataatgaaaattgattacagccacattcccctccttaagacactgtcagtaaatgaactgagatgccccagaatcaatccatttaaaaaatatactaaaggttgaaaaaaaagccctcatcaattactttgacatctgttaataaagaaaagatgacgaactggctgcttctgtcattgttcgcttactgtaggctaagaaaacaagttcttttgttctaccaactgaagacatcttcaaaagctgaaagtatctgagctgctgaagaccagatattggtttccaggaatataaatcagagaaatgtccaaaaatactaataggaaagtgcaaaaacaagaataagccatgtctgtctctgatttatcaaccttcaaagtctaagaaggttctttggattagactcaggaagttcctgtaggtggaaacttggcaatactggggtattataaaaatgctggtaggggctgaatatggtgacattaacaaactaaggatctagagaaacagggaagtgcaccttttgtgaacctaattaatggttttgtgctttataattttgggaagatgtcaagatgtccaaataaatagcaaataataatacaccagttctgtatgttaccttttccaagccattttttgggggtaaaagaaaaaaatgctgaagatagtatcttacggggtcccacactaacactgaggtttcactaacaacagagtgcatgaggaacgcattcagtcctccctcagattattctgagctgagtccagggaggcctggaaaagctcactcataacaacacagggcaagatgacagtcctctggggcttaggcccatgatctctggactctaacactcatcaccttggagttgtaaggtctcagctcatttcagagatcaggctcatttaaaaaatcagctcacaaacatggattgcctttgaacaattatagaagttctagatactcttcatagaaagaaaatggaaaataaagtataaagatgtgtttctcttttctgaaggattgtgtttaagcaacttggaacgaatccaggtcaaatatcaagtgacttcatacttcatgcatttctctgctgattgacatatggtcatgctagctggagactgggtcataggagaagagctgctgtgctactaaatgcctgtgtccatatttatatccacaaacatctttctctaagaaggtatcattctgtctgagggtcacaagcatatgtatatatacaagtttaaataaacagaggagacactagaacatttttttggtgatggaaattttttttccttgattgcagggctgtgtgtgtttatcaaaattcatgggactgtacactacaaagggtgaattttaaaaatgtaaatttttacattaaatacttcattaaccccacccccaacacacatactaagttcttaaagacaaaagtctatgataaagcccagctttcatggccttattggaatggtagagggactgactgaatgatatgtaagatccgtcctaactctaatattctatgaataattttaaagtatctcaactgaagcactttacatttctatcccacaggacactaatgactgagactgtaagcatgtatttaaacctggccaactaatgtatacatatttcttcccacaggcaggggaacatattgaaagcaaatgctaatatctcaattcctagctaaggtaatagtgctagctaatattcattgaatagttacaatgcacaggcatttctatgtgacatacatgtattagtttatttgatataacaaccctatgaaactgaaactattattgtctccattttacacacaaggaacctgaaacacaaagaagttagatgtcctgttcacagtcaaacagcaagtgagtggtaaagccaggacttaaagccaggtagtgcactctttgtggagagactcagaatccaatgagcaaggagggatcaaaccttatgtactccacagagaggtagacatggcgtttgaagctcccatcacagacttctttatccttgctcctcattctccatcctactactccatccctttttgcagggaaaaaaaactgttcaaagaacaaaactcagaaccttttttcctgcttatataaagggcatggtgtctccctcttctgcttcctcactttttcctcctagaaagcacccatgcaaaatatttaacatagaaaacggcatcagttcaggtaagctgccagcttgaagtaagattggtgaagttgcaaggaggatgaaccaataggtggatcttttgtgatccagtgcccttgccctgccacccacttcttggtggctttaagctaattagttggacacaaaagtcttaaaggagtaacaaggctaaggtggacaagagtgagaagggaagcaaaacctggactgtaaagataacattggaaaagaagggactgagaggcagctgttgtggattagaaagaccacttgactcagagtcagaagtcctgatcttaataccatttgtgtctttcagtagaagcatgactccgaatatgctacttctctgaacctccacgagctcatctgtaaaatggggacagcatagaagggtccttgttaagactaaagatgtctctgaaactgaggtacacattgtaaagcaccgtgcaatatgaattaaaatggcagagcaccaaccaaaggtgcctgggtaaagaagctagggaattgggggatatggacatagagtgatcatgtttattctctttccaacaaaggcctgaattaacaaacacaaaatggctctgctgtcaagaaaaacacagtgggtagatacacttgaaagtcacttctgaaagagaccttgaagaagggatggagaatgtttggggtggacagaaactcctccaagaaagacaatgaaagacaacaagttaggtcacggtggctaaagaggagacaatgatttgttgtctgactctccagctacgatggggctgtaactaatgaggttattctggttacaaaggaagcattcagccccttaatgaaaaactctttggcaactggtgttagggaaagaaaaaacaaaccagcagcttattattagttccacagcaagttaattaatttttgccagtcactttgggtcacttgctggactgagcatctgtctcactcaactgaacagctggagggatggtgggtgtctctgcgggccatgcatgtgtcctgttccgggaggagaagggagagctaactacaaggctgaaaaaacgtgagcttccagtgttcatctgctcctctcctgtccactgtccactcaagccaggccaaaggattgtaattccatgggaaacaaaggaaatgaaaatgcttaaaatgagtttttttctgcctttgtgtagcactcaaatgagagcagtgtaatatggtacaatgagcactatgtcagcctgcagaagtcctagcccaggctctagggcctcctctctcactgatcagcttggagctatggtaaggtgccttaacctctctgggcttctcttacctcacctgaactaactacctgcatggaaagctgggcttctcttacctcacctgaactaactacctgcatggaaagatgttcatttggtatcctttctagcattatgaaatttgagttaataaatatatcttttcttggagacatgtcaactacttgccaaataccaccaaacaacacttccaggaagacagcagtggctaggtgtaacccttattcagggatgggagagcaagggctgcaaaagtgctcaaataaaacacccacacagagttgacctggcttcagaaaatactagcatgatttctaaagatgtgtaatatgcaagtgtgacgagtgccattttatttagcatacatattaatgctagtatatttactttctagagtggattaagtgatacaaattttctgaattatgtgtgctgcataatatgtaatacacatatataatatttattacatactcacccctagaatagaccaagatgctcataaactacactgaagcagggaccataagtttaattccctctttgagccagtttaagctactgtttgggtgctgtgatttttaaatcacttgcatttaattcaaaattatgaagttttcagcaaaacgaaaaaatcaaattgggagagagctcattatctcaagcaaacccatgtatctcactgggctttcagaattgtcctccctcccctccccttaaagagatgatgatgttaaagtcctagatttaatgcttagccagtgctctagaattgtgggtttcctctcctcctgcctctcccagaactaatattcactgtcaagcctgctgcaggtagttaaaaggagtgatagggatcctctaaacccactcaaacaaaagcattagtgactgatagggagatttgcagttccactgggaacaatgctacttaatgaaattagcattgcatttatagacagtatttaggatcccatggtaaatcagtaggtgaggcttccaggaaggcaagtgcataccactgacatcactacacccaggagtgggctgttctgcctggggaaggtgggctggggagatggcatagggtctccatggtgagctatttattgtgacagcactgtccaggttctcaactggtcacaaaacctggtcacacactttctgtgagcagccccttaagaagcgtagggcattctaagcactacgttatacaacagggactgacatttggggaggcaaagtgaatcatccattctctcagggctggggctggaccaaagttattaaacaaataaagagttctaccagcctaccacataaaccaacccatctttacatttgcaacatctgtccccagagaccaggcatttctgagggtctacttcaacacaacagattgtcttattctgtcttgtattgttataacataatactacagaccggataatgtttaaagaaaagagatttattaccatcaatctcttagaggagccctctctccctgcctccttctcttcttgtctgctgtactttaccttctttccaactttctcctttgctctcatctctcccctcccagctctgctgtttctccctttaccttaccctaatatgccccttcttatatatccagtttttaattattattagctagactccatcttttaaaaagtgataccccactttcgggacatgaaataaaatagccctctaatgtgtacaattttggaaggaagccttgtcctttccaaataagccatggatgtgctatggacaatgggggcaccaagagtctgtccagcacggtccttctgtccaccacagtccctctgtccagcatggttcctcttgggcccagggcccagtcagactctgcacccacagacacgcttcttgactggtcatgttaaatcctagcccaggaaatgcagtaacagctctactgtggactgactgtgaacacaaaccagataacgttttaaagcctgagtgatctgtgcccaatttgttcagaggaactggaaacaagaagagttgccaagacaggtgggcaaatatgctgaggttcagctgctccctctcaaggcccctcttgaggaaatcactggtggggacaaggccagcccctggatgccagtcactcaactccaccaatccccaggccaatgcctcacacaattccctcttttttaaaggaggggagtggtggagatggggtgtgatgagaaagaaaagaaggaaagatacatatgaggaagtcagggtgaaaaggggatgagggaaaccaggagaaggtggggagaggaaaagaggagagaaacggcccagggagaggggagaaagggggaaaaaggggtggtcagaagagtgagtagaggcaagcagacaggcagggggccatggaaagctggaatgtgcacagctgttccaaagctcacagctttctttcctttggggtcttcttagtttccttgcattttcataacttatgtctcttcctgaatgtgattaaacgaccctccccaattctaccttgaagtactgcattagccataaaggcatagaagaaggagaccacacaatgccctcatggaaaccgtagtgctccctcaacttctcatttggttgacttctcccatgaagtactcacaccggacatcttcctgggcagttaaaagcacttactctgctcctctctggctccttgtaacatagttacggaaagagactgaagacaccaatacttactgagtgttgtgcattcttctagggattttatatatgttgactcatttaaatctcatcacaaccctaaaacaagatattattattcttattttaaaggtaataaagccaagattcagagaaattaagcatctcaatggaagtcatgcagctacaggaagcagagtcagacgggtctgacttcactgtctccagtgcatcatgctaaccctcctgcttctcctctctacctagttaggggctttctaacaggccagaagattagatgagagaggcattgccattttgcactgatgctatgattgtcaactccaggactcaccacactatctggctcattgcattttcattgaatgatatttccacttctatgattcggataagaatagtttatgtcaatgttgagaggacacgtaagtgtgcaatcactttgaactctaacaagaaaaataacatgattgtttaggtcttaacaggtgatgttctaagacctgtcatatattaatcacatcattctcataaaaatcctataaggtatgactgtctatttgcatggcacacttgagagataaagtcactttctgaagattatacagtaaataaatatggagccaagatttgtactcgagcagtctgactctggtccttgtgttcactctatcctccacttacacacttactaaaatggccaatctgtgtcatttagagctggcatagcagaaaactgaggcccaacagaggccaatgtaagaaatgccctatctgttgaactcttatatgtttatggagtatcatactgtgtcttttatgaatatctgttttgttttattgttgttgttttttttgagatggaatctcactctgtcgctggaatgcagggcagcggtgtcatctcagctcactgaaacccctacctcccaggttcaagcaattctcctgcctcagcctcccgagtagctggtactacaggcgtacactgccatgcctggctaatttgtttgtatttttagcagggacggggtttcacaatgttgcccagactggttttgaactcctgagctcaggcaatctgcccacctcggcctcccaaagtgctaagattacaggcatgagccaccacgcccggcctatcaatatcttttaatacatatgtaactaaaagttgaccggggccagcctccctgccctttgaggtctaaggaagatgagtttgaacctccaattctgcaccttgtgaaagtctaaaattctcatgaagatttcccaaactcccaggtgctcatggccacctctaacttcagattcatgaattgtctcatttgacccaatttcctgtatgttttataataagttgccccaaaagtgaaatttggccccttccttaagtttcatccaaaaggttacttattgcaaggccatttgtgtgttcactataagatttgggtaggagaggtgcaataaatacagagaaagaatttacatcgaggaatataaacaacctcaaggtgatcattaggggtgctggctccttatggttatgccagctcctgcagttacaacaaccctctggtaagaaactgtcaaagttgacttcaccggtcctatcttttccttctcttctttccagaaatatcctctcattgttttttttgcgtaaatatggacatctgtgacctacacgtgaaggcatttttccaaataaagacagcttcctcccaagagaaatttgtgtgcctgcttttataatatcatgtttaacccttgctacatgtttgtgccttatctttttgataaaaatatgagctccttagaataagtaccatatcttttactgctatgtattgctctccaggcctagaagaatgtccagtagatagtagggactcaagagctgtttgatgattgacaataaatcagactgagtcacaaattgactcatagctcagtttgactattaggctaatactccttccactgaacacacttcctaaacaacacggtcttcccataagcctatattcaactaccactgtatttccttaaagggcaattcataaatcagagcagactaaaccacgggcctaatttccccattggaactcctcatattcatcttcctgagcaaccataaaacatgatttcaaaatgacctagtaattatgtcttagggacactgaaaaaagtttaagtaaaaatgtcttcattacacagacccaaaattcttttatggagacacactcttattaatcacttcaggtgagtcaaagtaaacgtaatcagtcaaagctttacaggaaaagattgaaagaaaattcttggtccagaatgatttctctccctcccttcctccttcccatcgtcctccttctctctctcccggattctttcaccaacttttacccaagaaagagtacaaccagtgatggcatcagtgagatccttaagcaatttccctctatagagtttaatctcatggggataatttcaagagaaccagactgtattttggatgactcacagttgtattgtgtgtctaagacatatttgaatatcttctcataacagacaatgaatcaggcaatattttcaactagttttcattctcctttgttcaatgtttaaaaaaaaagataggacaaaatctaactgtgggtatcagtagttgtgaaagtttaaattttgttccatgtaacaatgcaggaaaattataactaataggtctagtctgtaacctattatgtttaaggtcagtatatgtataatgcttctctctagtgtttgtctatatgtcaagtaacaaaacaaagaaacattttgctccatgatgaaaccaccctgaaggggacttagaaaaacctttccttgttatgttgaaacaacacaaggagagggcaaaaagagaggaaagtactacctctaggaacccccttggtttctgggttcctcatttacctctttctgattagtacagctttcccagttcttcccaggtaaaaccttctgaaacatttctcctacaaacagctctgctccaattgccaatgtctctgagagccaggagagatgatcttagcccactaaaatctcacatctacaacaaaagtggcaatgatgaaaatggcattccaaccatggttcagagggttgatttgcataagtctgcttaagaaatttttcatgggattatgaaaaaccaaacttgaaatttgttgtttctgagctctgttttaaaaataatgacgttactaaatacccagttgtccaaactatacaattaaattaatactggttctcttttctttagttaccaaaacagacctcagactcacagcctttttgtactcccacttccatttgggagtaggtttgggtctttatctgtcacttgagtagccccttacctggtcttcttgtggctaccctttcctcatactcttcttccatcactatcagagcaatcttggcaaaagaagggctggtcaagttacccccatatttatgtccttctattgtctgcccaataaagtctgggtttcttaatatgacttttacagtcctcttcacaagctggttctaaacctatctttccatcctcatgctgcaacccagctccaccccaccttgtcccaggtcctactatcaggagtgacagcataatggcttccaactactgaacctttactctgtgctcagcatggtgctatgttctatatagacaacctttcacttcgtcctcacaacttagggctgacatgattactataatagtcttccatatcacttacggaggttcagaacttgtccaaggctgcccaccagtctatcctctggctacattgccctttcatttcccatcctatataaaaatctagccttccattgagaacctggtaaaatacatccttttttttctttttttctttttttttttttttgagacctgctctcactgtgccacccagactggagtgcagtggcaccattatagctcactgcagccttgacctcctgggctcaagtgatcctcctgcctccaccccccaagtagctgtgacattatgcttggataattcttgtattttttgtaaagacagggtttttccgtgttgaccaggttgatctcaaactcctggactcaagcaatccacccacctcagcctcccaaagtgttgggaatacaggcgtgaaccaccatgcctggcctctgctcctctttgaggctggcttccacaacccctgaccctcctaacctcccgcttttccctatctgatgttactctgagcctactgtatttttttcataaaatattgtttaaacttgattacagcaataatcacagcaagtttaatgtgtctgtcacctactccaaaccatgaactatccttacgtcttatgtatttatggcatcctttatcctttatgcctaccatggcctggaacatagcaggtactaaataacttattatagcattaagtaccaggctgtgagttcttggtgggctcccaggtgttgaggttgaaagggggcctatgcaggataggacacagtgacaagggcatggtcacaagaataggcagagctcttggctaagaacattacacccacttcatcattcagaattagagttgaaattaagtattggcctacttgatattgtttgcttcaacagggcttcccctgggacccagaatgagtttaagcctgggattggaacctacgtagacttgctagctttcaaatgattttttttttcattaaagcacacagataagatataccatgaatttcacttacgtaagatcaacctcctcttgttcctgagaagtaatgaaataattaaatagaactaacccttgacctgaaattccctgccccatgtctccctactctcatgcatgggtgtttctcattcccttctgctgtcctgccaccatgccgaagttcacgcaacagtgctcatctctaggccattttcaattaatttcctgagtaaaatttcatgagacactataaaatcttttgctgaaatcaagatgtattacatctactctattccgttagtctactcatcaaaaaagcaatcaactttgtctggcatgatttgttcttttaaaacctataatgcttattgctcataattccattatcctagatagtattttattcctcttaatatttgttccactatattaacagggattgaattactagatggtcgtttctagggtcccttttttttctccccactgctttgaaaatgagctacctaatttgaaactatcaaaaaaatggtattttcttactctgttgagtcatagaataagaaaggagctcccagaagtcacttgatcaatgcccttgtatctcctcaaggctctcatctcctttctaaaccattctagaccagtactcattactcagtgtctcccaaacaggagattctgagacctcttttgataactgaatcaattattcatgtatgaccttatgatccagaagaacttcctaatttctcatccaggactattctgaaagaggatgatgggctgaagacacagatctgagctccaatcttgagcatgccattaactagccatgtgactttaagcaagtaacttattcttttaaaaaaaattaaggtaaaacatacacataaaatttactgtctttactattttaagtatacagttaagtggtaataactatatatataatatagtttctatatatgtatatattcttccccttcaccccccttctcctacctttcccagcctctggtaaccaccaatctactctctatcttcatgagatccactttttaagctcccacatagaaatgagaacatgcaatatttgtctttctgtgcctggcttatttcactcaacataactgtcttcagttccatccatgttgctgcaaatggcaggattttattctttcttatggctaaatagtattccattgtgtataagtaacacattttcgttatccattgatgggcacttaggttgagtccatattttgactattgtgaatagtgttgcaataaacaggagagtgcagatgtcttttagatatatgcatttcctttcttttggatatacacccagtagttgaattgctggaacatatagtagttttattttcagttttttgaggaaacttcttactgttctccatagtggctatactaatttgaattttggtgccctttatttatttctctgaataaattactctggccaggacctccagtgttatgttaaataaaactggtgaaactgggcatccttaccttgttccattccttagaggaaaggcttttaattttttcctattcggtacaatgttagctgtgggtttctcacatatggcatttgttattttgcagtatgttccttctatctccactttgatgaggatttttgtcataaagagacattaaattttatcaaatgctttcttggtggagtcctcaggtttttctaggtgtaagatatgttattgatttgtgtatgttgaaccatccttgcatccctgggataaatcccacttggtcatggtgaataatatttttaatgtattgttgaattagatttgcctatattttgttgaggatttttacatctatgttcatcagggatatttgcctgtagttctcttttcttgtgtccttgtctggttttgctatcagggtaatgctgacctcatagaataaatgtggaagtattccctcctcttcaatttttttgaagagtttgagcaaaattggtattaattcttctctaaatgtttgttacacaacagcagggaaaccatctggtcctgggcttttctttgaaaggagagtttttgttgttgcttcaatctcattactcattattagtttattgaagttttttatttctgcatgtttccatcttggtagattgtatgtgtccaagaatgtttccatttctttcagatttgccaatttgctggcatatagttgttcataatagtctctaataattctttgtatttctgaggtatcagttgttatgtccccctcttcatttctaatttcattatttgagtattctttctttttttcttagtctagataaatgtcaattttgtttatctttaaaaataactttttgttttgctgatcttctgtatttttttagtctcagtttcatttatttctgctctggtatttattatttttttcagtttgggggtttgatttattcttgcttttccttggggttcattagtctacttgaggtctttttacttttttaaaacataggtatttattgctataaactccctgttagcactgttttgtcatatcccatagattttggtatgttgtatttccattttaatgtgtttcaaaaaatttaaaatttccttcttattttcttcattgacccattggttgttcaggagcatgttgtttaatttctgtgtctgtgtattttccaaggttactcttcttattagagttttatcccattgtgggcagcaaagatacttgatatgattttgaattctttgaacttgttcagccttgttttgtggcctaacatatgatctattctggagaatattccacgtgttgattagtttattctgcacatgtattagtctgttctcatggtgctaataaagacatacccaaaactgggtaatttataaagaaaaagaggtttaatggactcacagtttcacatggctgcggagacctcacaatcatggtggaaggcaaaggaagagcaaaggcacatcttacttggtggcaggcaagagagagtgtgtacaggggaactcccctttacgctatgtaagacttattcactatcacaagaacagcaggaaagacctgcccccatgattcaattacctcccactgggtccttcccatgacacatgggaattatgggagctacaattcaagatgagattttggtggggacacagccaaaccatatcagcaaagatgggtgaaatgttctgcaaatatcagttaggcacattagatctagtgtgtaagttaacactgttatttctctgttgattttctgtctggatgatctgtccattactaaaagtggggtgttaaagtctcttactattattggactgtagtctatctctccctttagatctattagtgtttgctttatatacttgggagctctgatattaggtacatagatatttataattgttatatcctcttcttgaatttgacccctttactttatatagtaagttatttgtctctttttacagtcttagatttttagtctattttacctgatataaatatagctgctcctgtccttttttggattccagttgcatggaatatcttttttcaccccttcactttcagtctatgtgtgtcttttgtatgtgaagtggggttcttgaaggcagcatatagctgaattttatttctttatccattcagccactctatgccttttaattagagaattgagacaatttacatttagtgttattattgataataagaactcagtactgccattttattctctgctttctggctgttttaagatcctccctttcttaccatttccctttgtggttaagtgattttctctggtagtgtgttttaatttgttgctttttatttttagtgattctactataggtttttacattgtgattaccataggcttacaaaaacatcttatagataataataagttgttttaaagagataacttatcttagatcacaaatagaagaataaaaacaaaggcaaaaaaaaactaaaaaaaaaattctatactttaactccatatcccccacatgttgaattttagttgtctcaatttacaaatttttatattacctatctctcaacaggttgctgtagctattattgtttttgacagatttgtcttttgggcctcatattagagttataagtgaattgcacgccataattacaatacagtattatgggtttatttgtgtacttaattttaccagtgggtttttcactttgaaatgtttttcttttgcatgttagtgtttatttttgtttcagattgaagaactacctttagcatttcttttaagaagagtatggtggtcatgaagtttctcagcttttatttgtctgggaaggactagctttccttcatagttgaagaataattttgctgagcacagtattcttggaaggcagaatttttttcctttgggcactttgaaaatgtcattccattccttcctggcctacttagaagtctgttgagaagtctgttaccagatgaattggagttcctttatatgttatttcagttttttttcttgatgactgcagcatcctctctttgtttctgaactttgagagtttggttattatataccttggtgtggtcttatttgggttgattctggtgttcatagaccttggatttgtatatttcccaagtttgaggaagttttctgctattatttcttcgaataaactttatgccccttgctcttccttggctccttcttgaacaccaataattcttagatttggtctttggagataattttctatatcttacaggcaatcttcattcctttttgttcttttttctttgactgtgtattttcatatagccagtgtttgagctcactgatttttcctctgcttggccgatttttctgttgagagtctctaatgagttcttcacttcagcaaatgtatttctcagttctaaggtttccgttttatttttaaaaactatttcaatctttttgttaaatttctctgataaacttttgatttgcttttctgtgttatcttggagatcactaagtttcctttaaaatgctatttttaattattggtcagggagctcacaaatggccactttgttagggtcagtcactgtattgttgctttgtccttttggtaggtcatggttccctgttagctgttgttttgtgttggtatgtgtttatatctttgcattgaaagatcagttttttattctagttttctctctctggcctgttttgttttttattggatatatttgcttagcaaatttttacctataggttgctgcctcctttttggttctaagtagcacgtgaagcccaggttcacctctgcgctaataaatagtcaaagtgctgcctgttccaaatgggggaggtctcaaagagattacccagtagtgtgggaaggctggctagcagtttgtgcccagggaacctgtgaaatgtgcctcctaagcatgatgctgctgaacagccacattgatttggcatctcctttggctgagttacagagtagagtttccatggctggagacggcagtcctacctttgcctatgcccatccttagggatatttttccctttagacaatcacaatgcttcctgtgcattaagggaaggacagatctcctgccaaagagaccctaagaaggtggagaagctggttgaccacctcaatttcagtttttccagtgtagaaattgtgaatgaggaaagattttctatgaacttgttgccaggaaaattgtggggtaggggtgtcacagatgtgaaagtctgattctcctactacttgcttagaatattttcacttctctgtggtcctgggacctgtctgatcctcatgtttgaatttcaagtgttgctagtgaaaatctcagtgctttggttttgattttctacagggtgtggggagtaaaaccagcttgcttctacaccaccattttaaaactggaagtctccttttcttaatagaaagcaaatagcatttttagatataaatatttaaagaaatttttagtttttaattacaaaataaatatgtaaaaattctaatgatacaaaaatgtattctcctcctagttccccaaccaaaattctactctccaaaagtaattggcaataatagtttggtatacatgcttccaggacattttctttttttttttttcatttgaattagagtctcagatgtcttttatttagggaggttttttcatacattttctgtttccctgcataccttctgcaggaaatatacagtggcttctgctttttttttttcttttattattatactttaagttttagggtacatgtgcacattgtgcaggttagttacatatgtatacatgtgccacgctggtgcactgcacccactaactcgtcatctagcattaggtatatctcccaatgctatccctcccccttccccccaccccacaacagtccccagagtgtgatgctccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttggcttggttccaagtctttgctattgtgaatagtgccacaataaacatacgtgtgcatgtgtcttcatagcagcatgatttatagtcctttgggtatatacccagtaatgggatggctcggtcaaatggtatttctacttctagatccctgaggaatcgccacactgacttccacaagggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttctttcgctgtacagaagctctttagtttaattagatcccatttgtcaattttgtcttttgttgccattgcttttggtgttttagacatgaagtccttgcccatgcctatgtcctgaatggtattgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaattgggaatcctttccccattgcttgtttttctcaggtttgtcaaagatcagatagttgtagatatgcggcgttatttctgagggctctgttctgttccattgatctatatttctgttttggtaccagtaccatgctgttttggttactgtagccttgtagtatagtttgaagtcaggtagtgtgatgcctccagctttgttcttttggcttaggattgacttggaaatgcgggctcttttttggttccatatgaactttaaagtagttttttccaattctgtgaagaaaggcattggtagcttgatggggatggcattgaatctgtaaattaccttgggcagtatggccattttcatgatattgattcttcctacccaagagcatggaatgttcttccatttgtttgtatcctcttttatttccttgagcagtggtttgtagttctccttgaagagttccttcacatcccttgtaagttggattcctaggtattttattctctttgaagcaattgtgaatgggagttcactcatgatttggctctctgtctgttgctggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttcacctgcctaattgccctggccagaacttccaacactatgttgaataggagaggtgagagagggcatccctgtcttgtgccagttttcaaagggaatgcttccagtttttgcccattcagtgtgatattggctgtgggtttgtcatagatagctcttattattttgaaatacgtcccatcaatacctaatttattgggagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagaccatttgatcatggtggataagctttttgatgtgctgctggattcgttttgccagtattttattgaggatttttgcatcaatgttcatcaaggatattggtctaaaattctctttcttggttgtgtctctgccaggctttggtatcagaatgatgctggcctcataaaatgagttagggaggattccctctttttctattgattggaatagtttcataaggaatggtaccagttcctccttgtacctctggtagaattcggctgtgaatccatctggtcctggactctttttagttggtaagctattgattattgccacaatttcagatcctgttatttgtctattcaggattcaacttcttcctggtttagtcttgggagagtgtatgtgtcgaggaatttatccatttcttctagattttctagtttatttgcatagaggtgtttgtagtattctctgatggtagtttgtatttctgtgggatcggtggtgatatcccctttatcattttttattgcgtctatttgattcttctctctttttttctttattagtcttgctagtgcttccaggacattttctatgcctaaattacatatacaaaccaaaatgaggctataatatgcatactgtttaacaacctacattttcattaaactatatcaatatttttccatgttagtgtatataatatttatttaacatttttaaaaatatacattgcttttgtaattaaattttttatggatccatcctaattaatttggccagttcactgttgatgcacatttaaagcagattctatttttttctctattccacataattctgacaatgaactataataatatttaaacagttattgaaaatcaagtgaaggaaagagtgacaactgtgagatcctgagagtttccccttaaaggcagcctgcgtcttccttttcctttgcccccaaccttccctaccagcaaaacctgatgggacagagaccagggggaggtccgaaccctcagtaccttgaaggataggatggcccaggggaacatctttccctcatccagtgtgaaaatcacctgtgaatttttttttcttagatactgaaagttacagctggatccatgcctgctgcttacatgctgtatgtcttcggacaattctttaccttctttgcagctcagtttgtttatttacaaaataatgagtatacctttctgagtatacctcttgctgctgttcattgattatttcctgtgtagcaaacattgtgccaatgtttgctttagtgtatgtgcaatgtgagctttagtgtattattttgtttaattcttattaaatccccttgaggtaagttttataaatcttattttttaaaaattttgttgtagagatggcacccctctatattgaccagactggtcttgaacttctggcatgaagcaatcctcctgcattggcctcccaaagtgttgggattacaggtgtgggtgatggcacctggcctgaatcttattttttaattcagcttttagtcttattattgatttgtaagagttgtttatatattatggatacacttttttatgcaatgtatgattcacaaatttttctcccagtcttgtggcttgatttttcattttcctaatggtgtcttttagaacacaaaagttttaaattttgatgaagcacaatttatcaatgtcttgcattgattgtgattttagcatcatacctaaaaacgtttttccccacccaaggtcacaaagatgttctgtcattttcattttcttgggtagaaactgtatacttttggctcttaaattctgagttaatttttgtgtatggtatgaggtcatattctaagttcatttttttgtaaatgaatatccaattattccagcaccatttcttttacctcaggcacctttgtcaaaagtcagttgattataaattaaacatgtatttatggactctcatttctgttccattggtatataagcctctcctttctttaatatcacactgtcttcattactttggctttatagtaagttttgaaatcaggtagtagaagttctccaaatttgttccttgaaaaaatattgtgtctattccaggtcttttccatataaattttaagttacgaaataaaaaagcctactggaattttgatagcaattacattaagcttattgatcaatgtggggagaaataccatcttgaagctattgatattttcaattccaaaatgtaatgtctctttttttaatttatattatctttaatttcagcaatatgcaatttttaatgtatgcagcttgcacttgttttgttaaatttttttctaattattttctctttttgatgatcttgtcagtggaattactttcttaattcccttttggaaattgttgttagaacatagaaatacagttagttttttaatattgattttgtatctgtggccttggtaaattcatttgtttgttaaattagctttcattttttgtgaattcttttgggattttctacctaaaattcatcttatctgctaataaaggcaattttattttatcctttccaatctgtatatctgtatgtttttagttccctccctccctattttatcctttccaatctgtatatctgcatgtttttggttctctccctccttccctccttccttcctccttccctcccttcttccttccttctcccctcccctcccctcccctcccctcccctcccctcccatcccctccccttcccttcccttcctttgtattggctaggctcaatcactacaagtgatgaaagcaagtatttttcccttattcttaatcttggagacaagcttttagtctttcattattatgttgtttgttaggtatgggtatttcacaggtgctctttattaggttaaggaaattaccttctattcctagtacatagagaaatttgatcatgagtggatgttggattctatcaactgccttttctgtgtttattgagatagccaaacggcttatgtactttatcctattaacatggtatattacatcaactgattttgggatattaaaccaaccttgcaatcctaaataaattccacttggttatagtgtatcatccttttcatccgttgctaaatatggtttgtaatattttgttaagaatttttgcacccatcttttatgagggatatcgatcaggggttttctttccttgtcacatctattttcctagatttaggatcaggggaatagtgagtggcctcatagaatgagttgggaagtattcattcctttatttctaaaagaatatgtcaataattggcataatttattctgcaagtatttggtagaattccccaatgaaggcacctgggtctggacttttcttttggggtagattttcaattactaattcaagtctttacttgttataagtctattcagattttaatatttcttcctgaattggttttggtaatttgtgtgtctctagaaatctgtcccttttatctaagttgtcatatattgtcatatctaaggtgtcatatattggcaaaaggatgtttagtttcccttacaatcttttaaattctttagggtcaagagtgatggtccctcatttattcctgaattagtaatttgtgtcttctctctcttttacttgattaatctgaataaaaggtttatcaattttgttattcttttcaaataacaaatttttgggttcaatgattcttactactgcttttttatttcatggatttctactcaatctttatttcctttcttctgcatgcttttacatcgcatgttttcattgatttttctaatttcttaaaataaaaacttaggttatagatttgagactttactctttttctaatataggcattcaaagctatacttttttttctctgagcacttttaaatttcatctcataagttttaatatgttttattttaattttcattcaggtgaaatattttctatttcccatgcaattgattttttctttgatgtttatttagaagttcattatttaatttcctaatagtcagggatttctgagatttctttcagtggtcaacttttagtttgttttattgtgattgaaggatatactttttaaattttacttgcataattttaattttaattaaatttaaatttaattttaattttacttatataatactgattttttacttgtataattttatacttgtataattttatataaattaatgactttctttatggcctggcatatggtctatattgaagaatgttctctgtttacttgaaaggtttgtattatgtagtcgttaggtggaaaggtgtttatttgtcagttaggttgagttagttgatgttattgctcaaggcttctatatccttctttatccagttgttctacttttgggagttattgaaatctcccactataattgttgaattgtcttgtttcccctttcagttctaacagttttgcttcatgtgttttgtggccctgttgtttgatgcacatacatttataattgttatctcttcctggtgaattgacatttttatcattataaaatatactgtttagtatatttttgtcttaattttatctgatattaatacaaccactccagctttcttttggttaattgtttgtgtgatatctcttttccaatccttttactttcaatctatttgagtatttgagtctaaagtgtccctcttctagaaaacatacatttcatcttcctttttatgtagtctgacaatctctgatcttgtgtgttttttagttcctctgtatctttcttccttttttttcagcactgaatacttttcagcgtaccattttaatcgtttatttattttctttcattttttcctttgtttcttccttgctttttctttctttcttttctctctgtttctttctcttacattttggagttattttcctagtgattgctctaaaaattacaacatgcatcttagtttatcacagtctatttaagattaatattacctaattttactaaaatatagaaattttgctccaatctaattctactctccatttttgtgctgttattgtcctatatacatctatatatgttatcaacccaacaatatagttttataattgtggatttacataattttgtcttttaagatgttaagagaagaataagaaaaaggttgtttaagccttttatattaacccatatgtttactatttctagtactcttcatttctccccgtggattcaagttagctcctggtatgattcatttcagcctgaaacacttccttagtatttattgtaaaacaggtctgctggcaacaaattctctgtctttgtttttctgggaattatttgttttgtctttatttttaaaggttagttttgcttgatatcaaaaacttgttgacattttttcttatctttcaacatgttggaatatgtgttccactgtcttttagtctttcatgtttcaaataagaagtcagccattaatcatttcaatattccctgtacatgataagctattgttctcttgttgtttaagatctttggtggcatttaacaatatgatgatgatatgtctagatgtagatctcattgtatttattctaggtgggattttctgaggcacttggatgtgcaaattgatttttttcaccaaatttggcaagttttaggccattatttcttcaaaaaaattttgccccccttttcttttctctcttataggacttctattaaacacatattataacacttcatgttgtcccagaagtttcttaggatctgaacatttttcttaaaacatttttctctctgttctttagggtgaaaaatttatactggcttgtcttcacattttaaaatttcttctgccttcttaaatctgctgttgagctggtctagtgaattcttcattttagttactgcactttccaacccaagattttccattttggtttctttttaaaagatttttctgtccagtcaaattctcagtttttcagttattattgctcattgttgtcatgctgttctttatttctttaaacttttttgttgtttttaattgaatatattcataatagctacttttaaggttttattttctaaatccaatagttgaggacattcagaaagttttattagctttttgttttcttatgagtcacattgtattatttctttgtatatattctcatttttgttaaaactgaacattttagaaaatgtattacagcaattctggattctgatatttccctctgaagactgccataggttcttttcttgttcttatagttgttttattttgctatctttgttagttttgtttcttcatttagtaacttggctgggttctatctgtgaagtctgtcttccctgcagtgtgtgtaggctgatgtctctattgattgtttttcaggtgcttatttttatttttacgttttaataaaaaagagatggggtcttgctatgttgcccaggctggagtgctgtggctattcataggcatgatcccactactgatcagcaaagtagttttgacctgctttgtttacgacatgtccagttcatccttttttaggcaacctggtagtcccctgctcctgtgaggtcaccatattgatgccaaacttagtgcagacacttatcagcatagcacactacagctcagaactccggggtttaagcattctttctgcctcagccactggagtagctgggactacaggcatatgccaccatacccagctgttttgatttttaagcctggatttctatgggtacttcctatgttccttagtgattggcaaatgtttttacagatgatgggcttatattccttaagtcagtaagacttctgtcatctgtcaatagatctgtgtataggtaagataatgtgtttcttttcttgctttgcgtatgtcaggtcttaaaaatctggaggaggaatgcactttaatgttcaggccatttagttcttgagtgtctgctctgcatatacacaaccgtaggattggctaaaaggctgtggctacctcagactctgtcctatctccattgggaatatatgcagccataaatggagcctcaggctagcagagtagttctttccctatcccagccccatcccacttccctctgagattatcactttcacctacaacccccctgggcatgtacattacccccttccccccctcaacctcatctttatttcactccatctagacatgtgatttccttctgaaggacactgagttttcatcctgtctttgatctcaggagcacagaacccagttgatccagcttactttaaaaatattactctatttaattatttcctcattcccacaggcttctggaattcacctctcttatcaatttaggcaactaagcttgtttctctagcaagcaatgtttcctaaatttgtccttatatatgtgtcacacaaaagaccaacaggtgtctgaatttgtttttattagtagggccagcccatttagtctgtatgtcagccaatcttgctggttctgcctattctgtttccagagttgttgatgggaagaatactttaggcttttgatggcaaagagattgaggagggaagaggaagagagaacactgggatagaagagagatggaaaagtaacagacagcaaaaatgagagaaatgaatgaagcactcatttgagggctgggcaattatggatgctctctagagaactgcctagccaaaagcactgagactcctgtcttctctcaaatcctcattttgaaagcattaattattttgatgactcttttttttatattcccagtgctctgacctattttacagttaaaggctccaaataggatataatctgtgtttagagcttggacatgggagagatagcagtgactgcactgagttctcccacactgcactgcctgggtacataccactatagaatgaattccttttgggtatcaatgtgttgtcttaataaatgaagaaaaataattcttaggagaggaagattatttaatctacataatgatactttaataatactttatgtttgcttagctgaagcaatattggatataaggggattaaacaggggcatcccaagctgttgttgcagaagtaaatttaatgtctatctactttagtgtcatggcaatatataaccgaaagactattctcattgtaggcaccttgcctaagaataattcaccattcttagcaaaatatttcaaatacctccttcattgcctctagatgcaacaaatgctgatcacaacagaaagaaggaggttgccaaatataacacaaatacaagtcatggtgctccagaaaagagacacagggagctgccacactatgcatgctatcagattcattaacaagtaaacacagcatctcgcatatttccaaatactaacagcttccataagaatcaactaggaaaggagtaatactcaacatatgtacttacgagtaatactcaacacaggtactttgatcaagcatgaaggctgggcatggtggctcacacctgtaatctcagcactttgggtgaccgaggcaggaggatcacttgaggtcaggagttcgagaccaacctggtcaacatcatgaaaccccgtctctaataaaaatacaaaaattagctgggtgtggtggcgcacacctgtagtcccagctacttgggaagctgaggcaggagaatcgcttgaacccaggaggcagaggttacagtgagctgagatggtgtcactgcactccagcctgggcaacagagtaagactctgtctcaagaaagaaagaaaaacaaaaaacaaaaacaaaaacaaaaaaaatgactacgaatcaccagtaaggatcccaaagcaagatgtagaaaattcaaagtggaccataatgcattagataagaataacctgaccacaacctttgctatgcaggttaaaggtcctcaccaatcacttagtagaaagagctggacagtgagatctgaagccctgtgtattctttcaagcttgctgcacttccatttgtaaatgtgcatgattactgcctcaggtgagggctcctcattctcagcaaatcctttgtcatgtccaaaatttttgagtttaacccaccccccattcccagatatgatgttatatgtgaatgcctgggcccagtaagcctgctttgtaggatcaagatccttaaatcaagacagagcagcaccacttgcttcaggctgctgtggctggttgactgctgtcaggcagggctgtgtgttactccactatgccattttcctgtttacagaatggtctcttgtgcattattttgattgatttttataacaagtcaggaaagggagccacagaggtaaaatgacccccagatccctcttcaacttacgttgaaccagtctttctctatcttgaatgagtaaagattatctttccactctaagtagaataattctgtagttatccccattcaaaagaattttattttattctttcttgcaaggtcccggctttctttcaaatcccttcaagcataaattcagagtggttcatgacttttcttaagcagagcccatttttctttaggatgtgtcttatctgtattatttgatatatagaaatcagtgaggctaaaaaactcagataacattaataaaagcttcttaatacgaggaagtaaggaaagcaaaaagacagctccacatacttttatagatgatctagtcccacccactcaattcaccaatttagagactgaggtctgatgtcacgtgtcagccaacgccaacccagcactcaactctcagcacagggctccttccatttctaaaagggcagggaaactataaacagcttagctggtggcagtaatcgattccacttcctcacatggattgcatctctgtgtggccgggatggctggtaagttttaggctgtggctgccttggacagcactcctcaacctggccatctgcaaagaagacacaggtgacagtgggcttcccaagacccctctgaagacacggcacttccagacaccccaattgatgtaatttggttgtgtcataggacaaagcggacaccccagtatcactggtatctgggagatgccccaaacttctgaatgtactgccagatatctaatgagggtgagtcttctgtaggcacaggcctgggaagcactgtgctttaagaagagcttgtcataatggtaagaacataagactgggtgttcaaaaactggaattgaatatctgactgcaatatactggctttggagatttgaacctcttacttcatttctccgagcttctaactataggtcaagaaatatttaatgaatgcctattttatatggaggcttaggctaggctcttggaacactgcaatgaatgagaaagactcagcttcctctctttgaaacttactagttcatcttcgattatcatctacaacttagaaatacctatcttgctatattataggaatcaattgtgactgtggctggagaagcactttacagtctgcaactcttgccagtttcatttgggacaggaaacggggctcatttatgagccagttggcagctcaccccagcccctgtgtgtgtagtttcactgcctcctccaaccaccctagacaggagcttcatagaaaccgagcccttggcagctgttacagcaccttcaggctctctctacaggtaaagtagtagccttatcccaggtgccccatttctagcaatgtgccttctccaggaccctccctggaggtgctttcggtacttcttgccttacaagagccaaactcccagatgcatctccttatttctggcctcagctccttgtccccttgggtatttctttcccatttcttgtccatagagaagtttattctgtttatagtggaggagacagtttaaggactgcatttccagccagaattcattggataccttcaatatatgtaagtcagtttgtcttgaagtccccatcagtcctctgagccttgttccttctagaatcgtgccccaggtaagccctggccctggccctggccccaagagcatgtcaattttcctgccgacttggtcaaggccagctgtgttagtatcctattgctgcagtaacaaattaccagaaagtggggggctgaaaatgacacaactatattatcttttggttctgcaggtaagaagtctaaaatgggttggtggaactgcgttccttctgaatgagcttctgggtagaatccttgtcctcttctttcccagcccttagaggctacctccattcttcctctcacggcttcttcctccatcttcaaatccagcaatgtgacctccttaaatctccatctctctctgacctgtgcttccttcttcacattccttctctgacactgactctcctgcctccctccttcccttttaaggtcccctgtgattccactgggtcaacccagatcatccaagacaatctcatctgcaaagtcccttttgccctataaagtaatatcttcacaggttctagggatcggggcatcttgttgggggctggaggaagcattaatttgccaatactagtttttatctctatgctgtgatccctcctcaggctcctgaacctctagaatctaatctgacaagttcagctgctgtgatgggccaggagttcctctttccttcctccagagaaaacactagggtttctggaggcaatgatcctatcttggctctgtggtacaaagtgtgacctgaatcactgggctgtttagattccagaaaccatggccaaaccttaggaggtgggtctctctccctgggctggtagagatttctgtgcctcacaggttttatgccaggtatttggccatcatttgtattggatatgcctaagccttgccttagagcaggaaatggccttattgaccatctagtctaagatcttacctaacagatgaggaactcaagacccagagaggtaaagtgatgctcctaatggcagagctgggaccagagccaggcctctgctcccccagccagtccttctttccttgctccacatgcctatctccctatctccctgtgggcagacccatgaggttcagttaggaggggttccttgttcactggacatctataatccatcccaacaccccaggaaaggcctgtcctgatggggaggtgaacaatacttccctggaaggtccacccctgaggcaagcatgccactcattaaggcaacccttctcaggagtccaagctccagctgctagttgtatcagaatcacattagatggaaagaatcacacatcacaacttgttgatgtgattgctcaagggtccagatctaagggccagggactgtattgcttgagagacgagtgacgtgtttctacaaacagaaccagagaactaatgtgggctttcctggtgaattccaaaagacgggcagagatagaaggccacacatccacccagtgaccttagtatgatgagaaatcatgctcaaatgaaaagcataagcacccagagccctcttggtaagtctgcaggggcaaaaattgaactgaagtgggtgtgtttctgtactcttacttagatgctgggattggcccctgggtatattcctgagcctgctgcacacttattttccacatttccctcttcctacccttcaaggataagccaagcagaaagaggtagggggtggggtgctctggacttgggagcccatgccagctgccaatgtgctgtccctaggcaggcaggcaggaaaataacctgcttgtctgtctgcttgcctactgcatcctagccaggatttttggctaggcttttttgactgtggttgtggcacaaaatagttaacgtttttcccccaaagtctaagataactcaatagaatagtctcgaatgataattttttattcctttgtattaaaaaaaaaggatagcatgttttatcttattataaaaaataatatatgacaatgaactcaaatttggaaaatagcaaaagcaacagaaggaaatgaaaatcactaataattaatttacctagaaataacttctgctactgtgttggtatatttccttacagactttatccttatgtacatagttctttttttcttttacaaacaatttctactacacacattctttaacttgctttttgaaacctaataataagttccaaatatttccccatattattcaatatttttacaatgtatatgtgtaattgtggtataatattttaggtatactatattttatttaactaattccttattttaggcatttaagttatttctagtttttcaccatcataaacagcaccaagatagttttttagataagccagtaggaaatattggttgcagcctgcatcttaggtatgtcagttgaaatggaaacaagaatttctataaagatatatctcgactttggagagttagtgttgtcagtagcattcaaccaagaagttctttctttcctctccaagtgatgtagattctaagaaaagaggataaaggtctttgaaacttaagagggaacacaggggctagagctgtccgtgaggccttactggtgaaggagtccctggccagcacagcccatgcaatgggaagagagtggaccaggagaacactgccccaaaaatgctccttaaaggactggaaaagggacagagacatcaggaacgttggggccagggtaagatgacttagcaaacaaggaagtctgattccatttatagaggacagatgtgtggctatatttattttatctaaaagagaaaagaaaacctttgctaataaatagtattatacagttaggcacacaaaagtgcatataattgatgaatataacatggtaggagtacatgctcaaaaatattttaccaatggggcatacaacagaataaagtttagaaaccattaacttaaagtagaaacttggccatgaacagagcagcacaggaagggagctctggggagctgcagcctgtgaatacctggcaagggtagtcccagtttagatcatccggtttgaaacaagtgaaaagaaaggaatattgttctgcccatgagtgtgtgtctgtgtctgtgtgtgtgatcagcggtcactccaattacatttttcttctattccagttttcttacctctcctgactgtttccccaacttcaacatttttctaaaataagaggtttgctaaaggttgttcctacagacaaactgaagtgtgtaattattgactcccattaacgagatgaacttcagggtggccactgaaccctgtgggccataaatgccggacttgaagcctgcactagcacatttcactctgcagtggtgcagagcagggacaatggcagcacttttgggagaaagatcagtgattctccagctctgaaggtcgtccgtctccatcttactgacagcctgtcctcatctatgaggacacctcctacccttcctcacctagggaacttgctctccagaaacagtggcaaacccatacacatgtaggtgtcagaggtccccatcaatcagcaaatgaagcctgaactcagaaatgggtggctaatgatgagtttcactgatgaaggaggaaatgctgggcagccctttatcattccatagcctatcaatacctcaaaagatcaagagtcagaggtgagactcagagtcagctcagccacttatttgcagcctgcagtgactgtgggtgcaaaggaggctatatcctgagagaattttcccgcaaagtctgcacttgcagttcaaaaggtgactcaggtccctgctactcctgggatacagttcacttgagaggtgttcagggacccttttaagaacatggcaaacttttggggtaggggaagaaattgaagaaaggatgagaaatgctggtatgaatctggtctcctctgaacctgtctaatcagacttcctgaagggtctaagaattcacagtccacagatgcatgggatccacatgccaacccagacgcagggggagaaaaaccaaggcatagtgggctaaagagtggcccccagggcatatgtccaaatcctaacccctgtgtacctgtgaagatgaacttaattgaaaatagagtatttgcagatgttatcaagcattccagaatgagatcatgctggacttaaggtgggccttcaatccgataacacatgtcccgttaagatacagatttcagacaaggacacaggaggtatgccatgtgatgacagaggaagagtttggagtgagacatctacaagctaaggaatgccaaggattcccggcaatgccagaagctggagtggggcatggaaaggatttctcttcagagcctccgggaggtactaaccctgcagacatcttgatttcatactcttggcttctagaatgaggagagaatgaatttctgttgtttaagccatccggtttgtaagaatttgttaaaacagccacaggaaactaatacacaagggtacaacaggagtgcatcaaaaatttgaatgaccccattctgctgttgcaataccctagtcatgtgtgaaagcatccttagccactccagggctccaggatggtgtttcaccatcttttgaaaatgaagccatcttgatgaacagaagaacctcagtagcagtgctgcatccagaccctccaccaaaagcacaacaaaacaaagcaaaaacctgagagtcagaggacggggagagagttgagctgttccaggaagaataggagcctcctcactgtggagtctgcttccatcttttctgcgtgtgcccatgagtgaggccctggggagagggctctgcagatgggctgagagtgtgttttccatttttaagccaggattcatgctacagagtaaaatcttgccttactggagaagaaaaatacctttgactatattccaaaacaccggaagcagttagacatcaacatggcccctggcacttcttaaaaagtcacagaatgcctccatctgatggttcttcaagattttagtaatttataatattatgttccatcaaaatgatcactttttattatcttgctgctctgaattgtatcttccttattattctcagctacagaggccataaattaaaaccattcaggatttatacacttatagttcattatctttgattggtatcatcttgctgcctttttctggtccttctataactgacaagaaatattgcaatagcatctaaatactatctgacccatgaatattgagttagaaaacaaactagtgactacataatactaaaggcaacccatccccacttctcatcttcaccaccagcaccctttctgccaaaatgaccaagaaactgagactctaaagctctgggattaggattggaatataggacactgcttggccattgtgcagaatggacaggttgttttctcttcctgaaccttcacttctttccctgaaggtcaagggagtttattacaataggctgcttcatgaggaacaacgctacttcagggaaaggtagtgttataaataactgactacaaaagtgatgagagacgcactcctgaaagctccaaacacctctcagtgccattactgaagcagtggattttctgggagggctgggaggctgacctcctcatttccgtgactgatccatgctgtgtgagtacagaccactccattagaccccagacaaattagcagaagtttctgacagtggtgagcctctcttaagttatgtttggatgtgtccattcatgaaagagcttggtaaaggagactggtgtatccacagcagcttttgctatggttgttcacaccaccatccttagtattgctaactactacctgatgctaacagtgatgacttttcagagcaatggaagttgacaacatttactttaaaaaaaacagatattccaatcctgattcatctaatgggaaagtttcacattcagtgtgtgcactgacccttgggatccagcttcataaaaactaaaggcattgatatgtttccatgctaaagaatgctgagaagtaaaaatttatttattttcttccttccctcctctcccccccttcttttttgttttgtcatagcactcagtgtattgtgcgcatgtcagcgatcacaggtggaggaggagaaacaggtcaccaagtgaaatgtacaatttattggcactgtttaaaaacatttctttaaagcacaaactttcaaagttatcatgtgtgactcagtaacatctgtggaatttacaaagaacacaatttccacttgtccctgtctcttgatctcactgaactgtaatcacagttccactcctggaatataaatttttaaaaaacctgtaacgaccaaaaaaaatgtttctagaggtcaagtgttggaatctggagatagtcctaggggtggctgaatgggagtaagtctgaatgggagtaagtcaacagtattacaagcccagctatgcctcagaatcatccaagaaacttatgaaaaatgaaataaaacagatttctatgaaaattgaagctgcaatgggatgctgtatttaattcaccagacagacaaaaaaatacagcctgacaatagcaatactgatgaggatgtaaagccatggggaggaataccaatatattactagagggagtacaaattggtgtaaccactttggaaaatagattggcattacccaatgaaatggaagatgttctgaccctctcacccagcaattccactcttagttacatgctctagagcaatggtccccaacctttttggcatcaaggactagtttcttggaagacaatttttccacggatggttttgggatgaaactgttccacctcagatcatcaggcattagattctcataagaagtactcaacctagaacccttgcatgcacagtctgtgtgtgtgcacagtgcacaatacgattcacgtttttataatcacaataggattcatgttcctataagaatctaatgcggcagctgatctgacaggaggcggagctcaggcagtaatgctggcttgcttgctactcacctccagctatgcatcccatcctaacaggccatggacaggtaccagtcttcagcctgggtgttagggatccctgttctagagaaattcttgaacatgtgcaccaagagagatgtacaaaaatgtttacaattgtgttgatggcaatagcaagaacctggaaataattcaaatgttcaatgacggtagaagagatcaattgtgatatttttatgcaaaggattaatatagtaccaaaagcaaatgaatcacagccacatgtatcaaagtgaacagatcaaaaacaatttaatcccatttatatacaagggtgaaaacatgcaaacctagtcaatatgttgtttggagctgtatacataggtggtatagccatgaagaagagcaaataagtgattcacacaaaatataggagagtggttaccttggagggtggggaaaagtttgtgatctaggtgggatacaggaaactccaaaaagactgataatgttcagattcttcggctttttggtggtgagaatgcaagtgttgttggttttgctgtaatctctaatctatgcatgtatattatatccactttttgctaaatttcctagtagaaatgtaaaatacacagacacgtagtctccatctcagatctattgaatcagaatctcaggttataggatctaggcagtcttttctataagatatccagaagaattctgatgcactgtcaggttaagagcactcacctacacacacacacacacacacacacacacacagacacacacacacacaccctacaatacctatcaccatccagataaaagcagcttaaaatataagtcaaggtcaacccatcccaaaacagttataaaaacaaaaagtcagcccaggaaagtgtatagaaaggaaagtctcttttggttctttgatgacaaggtagaggctgaggtataagcctgagagcattaattgtttttgtgccacctccaatctccctcatcagcttacccaagacctgacctgttaggctccctagtagcataagcctgagatgagattctctcgagaatctggccacagagcaggctctggtcctggtctttctacaaagacagaagcatgatgtggtggaaagtgcccttgtctgggactcatcacagcaagtatttagacccagacccacatgtacattctgtgtgatcttggggcagtcactcccccgctctgagcactagttttcttatctgccctgcctctctcattgaaatccaatgagacagcgtaggtgggagtgctttgcaaactgaaaaaactaccctgaatgtctaataagcccattgccacttcagttattccttcttccaaaaagccaggaacataggctttcaattctgagttagtagagttttctaggtccaagacattgggagtcccaagatttggcttggtgagacataaaactagactagagcttagtgccttcatgtctctgtctaagaaactcagcacaatttaacaatttaacagttgcccactactttcctctgagcctacctttcctaggccctgataataaagaaggggacattcacaaacagctcaagaccacaggaagcatcacaccaagcaaatgtgtcgcctgagtatttatgaacggcttagaaacatttaagccagttctacaataccttccaaattaggattgccagatctggcagtaaaaataaacatgcaggacactcaattacatttgaattgttttgtaaaattggagtagttcttagtttaagtgtgttccaactattgcatgagacacacttgtactaaaaaatcatttgctgttcatctgaaattcaaatttaatgaggtatcttgtattttatctggcaatcccatttcaaataccgatcagcactttctcctgcagggaaatctgcatggaagagagttatgaaaccctacttttattacttgttaaagaataaaggtttgggctgatcttgagatgggacttgtcttcctcccctccttgcatggcccaagaagccatggaaagtcacagatattaaaagcaggtttcaaagtaaacagagcagaacaggagtgaagtctcatcatttcaaacagaaataggtattccagcctggccctgacccacccaggacatcaccagcagcctctcccttacctctgggcatctccttagaacgctctgccccaggcccatccagcaagtccatctgggaggcctcctcggaggggatgcggcgccaggaccagctctggttcctgaggtcatgcagtggaggggaatactccagctcacaggggaagtcaaagctgcactccagacctgcaataatagccaagggtcaatggaaaaaaccatttcccaaacgtgacttttcagccccctccactccacactaggaggttggccttcatctccccacatcctttgccctgtccaagggagatcagttgtcaataccacagggctctgtattggtgaaaagggacctaagagaataaaatgtgctctttctgtaactcatattacgggagatgttctcagagaaggcaggtaaaaaacaaagctaactaacaggttgaatggtgagaagctctgcatcttgtgaagttacctgaagacatagagagggcctgagggtgagtgggcagagccttcccaagaaacccatgagggctgagtccaagtctggctctgcttttaccagcccggtgactccaagcaagaaaactcacctctctgacccttaattccctcacctgtacattaggctgataattaccactcaagtttgccgtaagaactggtggtaaaacatactgcctaagaacatgtaatgtatgtgcggcttacaacctagatgatgggtcagagtgaacaggcaacctacagaatgggagaaaaattttgcaatctatccacctgacaaagggctaataactagaatctacaaagagcttaaacaaatttaccagaaaaaaaacaaacaaccccatcaaaaagtgggcaaaggatatgaacagacatttctcaaaagaagacagttatgtggccaacaaacatatgaaaaaaagctcatcattactggtcattagagaaatgcaaatcaaaaccacaatgagataccatctcacaccagttagaatggcgatcattaaaaaggaaacagatgctggagaggatgtggagaaatagaaatagaaatgcttttacactgttggtgggagtgtaaattagttcaaccattgtggaagacagggtggcgattcctcaaggatctagaaccagaaataccatttgacccagcaatccccagcaatcaccagcaatcccattactgggtacatacccaaaggtttataaattattctactataaacagacatgcctacatatgtttactgaggcactgttcacgatagcaaagacttggaaccaacccaaatgcccatcaatgatagactggataaagaaaatgtggcacatgtacaccatggaatattatgcagccttaaaaacggatgagttcatgtcttttgcacggacatagatgaagctggaaaccatcattctcagcaaactaacacaggaacagaaaaccaaatacggcatgttctcactcataagtgggagttgaacaatgagaacacatggacacagggagagaaacattacacaccagggcctgtcgaggggtgggggactagggaaagaatagcattaggagaaatacataatgtagatgaaggcttgatgggtgcagcaaaccaccatggcacgtgtatacctatgtaacaaacctgcatgttcgcacatgtatccaagaacttaaaggattaaaaaaaaaaaaaaaaaaaaaaagaattccagatggcctaggaacttcagcatgctttgcagaggaggataaggcctgcacaaaaccagagcaaaccagaaccagtggcccctgtcacctttagatcattagcgtatcattataatgcaaaagtccccacccatagaagagaatcactgccactttctgcacacgtgtcgtatgaagagcatgttcctgatctgcacctgcgtgtctgaagttcttcccaacacaagcttacatagcccctgacccacgtctaaccctgtaacattccccagcttcccactgctctgggagaagctgtctttagagcaagtgctctctccttctccatgcctggccagaaataaaacctgcttgcccttttccctaaaaaaaaaaataaaataaaataaataaaaacaataaaaaaccctaggtgatgggttgataggtgcagcaaaccaccatggcacacatatatctatgtaacaaatccatatgttctgcgcttgtatcccagaacttaaagtaaaataaaaaataaaataataaataataaaaaagtactgcctatgaaaaatggacctggtccatatttgatgctctgaaaaatgctagccaggccctgtcctttctgattgataagggaaaggccataggtaactggaatttcctcacagcctgctttgccagccctataatctacccttcgatctcctctccagagaagagggccaaggctatgacaatgagtcagggtttattttctcttggggagtgtttggggagggtcattgggtaaggagagagagaaaagagaggcaggaagggcccatgccctgggatgttttgtactttgttgagcttccctgggcagactctttctgtccaatgattccacgtttgccccacttttagggtacatgggccactcagcttttcttccccttccttgctcattgtccactccccaaagtggctgaagaactttgccatggcgggctctcaaagctggcttatggattaacagaagatgccaagatgcaaaatgttcaaccacctcttacttcatcctctccccgaagccgtgggaataagaaaaaatgggataatgtgatagatattggacagacaatatgaggaattcagtttgagtccaggcatgactagttacctctcatgtgtgaactttggttttctcaccaaaagaaaccaaaagctgttaaagcagtgcattttaacagctgcttctgaggctactactaccccaatctccaagacaattctggtgttggaaatttcagaatacagtgggggcagattctaaggcaggcagccggccactggattgtctcccaatgggtgtccacacccatagacagctggccctgctgcagagtgggagcaaaatattcctgttaacactaaccaaactattcaattgtaggagaaaagaaaaaaatccttcaattacacttctattgagtgtctttctgctcctcagctgctttccaggagctgccatccttctggccctaaggttaatactccttgccctttcacgattcagacaacttgccttcatagtggcaagctgaaatgggtagctctcactttgtttgagttgataagccacttgctctacagttggtgtccaggaaccacaggctgccttaatcttcaagatgtgcttgaagacacctggttttcagagcagactgcaaagagaaaactggtccaacattttgtactttgcaacaccaaagtgacataggaaggattagccatgaaacatgactaataaggagaggcgtagccatgaaatgtaactcctctagggagggtcaaaaagacacatccacattggtggatgttcatgtcagtaaaaaggtgagaaagccaccagccactcccatcccacattgacaattatcagtgcctttcccaaagcttcgacttctgcggccatcccctaccttgatttttctcttccaatgaaagatgacctgtttctattcaagacagaggtgaggcatgccaactgtctgagttgtgtcctgcctggcaaatgtgccctacatgtgtatacaacagacagacagtgcaatatacaatcccagcaccgagcatattaattcttggatctttgaactctggagagtttaagtgtgataattggctgtgtttgggccagatcctgcctagtaaaacaggctatgcaaatgtaccgattaaaatgcgttccttctgtaattcttagtccgcagcaacctccttttagctgttaaagctgtactttctagctttaaataggaatggagttaatattactactcatttggttgaaactgaattaggcttttctacattctgatttaatttcttacaaaacatggagacacaggtttttctcactcaaactagcctcagtgcctcttgggcaataataccttgggacttgcctaaaacaccaggttaagtcttattttccttgggcctcttccgaggttctagacctagtgtgcttcttgaatctctctccttcaccctcttccaactcagtgcctatgaggtagagactgtagaatctattttacaggagggattcagaggggtctagggcttcagcacagtgctcagccttaagcaacccaaccgcagaggcaggtccacacccacccaggggcaggggtgggaaactaccttccctcagcccctcctggcggtcttccacgcactgtcctgggtgttttccttccatcactgtacctcatctgcagaacaacactgagaagtggacggtttcttcttctctctataggtgaggaagctgaggcttaaaaagttttcttgcccccaaatgaaaggactaccccaaggcagacccagagagtgacctagaactggataatgcagaatatccagtgttgttcatctctctcctgcagcttcagaatctcaatttagggctgaagattaatttacacaatagatgagaaaccaatgaagtgttttatcttggttactcttagacccaaagcctgtaaacttttcatatctgaaaagccttcttcatgataggggacagatctatattttctaaatgtcaggcccattttgcagaatgactatgaccttcaggaggatccagagatcttgacctttttttgttttaacccaagagaatctgaccattgaaaaagagcattgagaaaaagacacactttccaggacctgcctatcacatatgtgaaatcattgtcacttactttcttgttatttccatcatggaagaaaggtaaggtaatggaaccttctggaaaagatctgccagctgagaggagcgtcaagtgctatgaagggaaagggctctagcagagcagtgaggatggttctgggcttggtcctgcacagagcagctgagaccccagcaggtctatttctgtctctaggcctgtttctttgcatttggaagatgaaagaaatggagcatgtaccctccatggtgccattcatctctgaaggtcagtgattctataggcttaccctgggccgacacaatcaaacctacagaccactcagcctgcctctgctcaggagatgctgcccctaaacaaggacttgttgtcatcccaagaggcagatttcctatggaagaagggtgaatgtacatcacactcaatggggacttggtttgcctccagattctcaaagaattaaaaagcttggctgggtgcagtgactcacgcctgtaatcccagcactttgggaggcccggtgggtggatcacctgaggtcgggagttggagatcagcctgaccaaaatggagaaaccctgtctctactaaaaatacaaaattagccaggtgtggtggtgcatgcctgtaatcccagctacttgggaggctgaggcaggagaatggcttgaacccgggaggcggagggtgcggtgagccgagaccccaccattgcactccagcctgggcaacaagagagaaactccatctcaaaaacacaaaaaggaaagcttatgtgagttttgcacataatagttgcaggatgaacgagtgagtgtgtgtgcacacacctgcatgtgtgtgtgtgtgttcatgcatttttatcatctgatactcacttcctgaaatctcccagtatatgaatcacatttttaaagactgaattcattaacaattagcttctagacattgttttagtatgaagcacagccattcaggaaaatgttgtggtaagtatcagaaaaccacggtggtgaccctgcccaaagacatacccagtctcccttatcaaaaccccctggctgtagaagagttgtcaatgacaaaccaccttgaacactctgaacctgagggtggaaatatagcctctaggaatgtgtgagactcccaaagcagtcaggcccaaggcctgtgcctaggaagcccagcattggttactcaggcagagatggaggccttccaaccggggccatgtaccaggccgagacactcaaggagattgcatgtaggttccagctattctccataacaccacaaaaggggaatagggagcttggtgcattttggacacttgggtctcctcttgagtgggctcagaatatctaacaatgctcctttgtatccagactgacctcagatttccccagaatcccttggatcaaggccctttatgcctccttaaccttgagcctgttaacccagagactagtttcctaaatcctactagttttctaaatcaccttgggtcagtttcaaggtagaggaccagcagctccccttagttttaaagacatcccctccaacattgcccagtttccaggtgaatgtagggtggcagggccttaaagggcagccccctggggcaggtccacatcagccccttggatgaggccttgcagcctcaggccaccgtgagctttggaagcaaatactgcagaatgaaaggaagagtcataaaaaagagaagaatgccatgcccatcaattccataacacttcatccttcttgattttgtctcttattatgaagtaaagctggaggtcttactttcttgttcctggcaacgcatgctgtagtgtgtatagaagagccctgacccccatggagaggacttctgtgaaggcgtgtgggaagtgtattcataagtaataacactcgccaaggactcactggggctggtcaccatgccaggcaccttacatgatcatcttatttaatccctatgaattaggcaggattcttatctccattcaacagatgaaggcattggagctcagagaagtgaagtcacatctgatgttactcagataggaaggggctatgtggtcttttactgatgtgtttccttcctgtgagtcctgaggccctgatttcagtaggtcacaaatgggattgccaatagaaaaggcagcagacatagcttccctcatgtagagccacagacatggacatgtctgtggctgcagtgaggcaggaaacagtgtacgagctccacaagtgaggcagagctgacagccactgactctgaaagtatcacctaaaggcaatgccaaccttactgtggtgcaacaaaatactaaagaaatggtcatggtcatgtgccatcaactccttcaaaatgacaattgaaatactatttctcaggatggacaggaggctgtgctgaaaaaaaaaggcatggtatgcaaattctgaatcagccaatgtgctgatttagaatctcgatattctaaatggccacacttcatactacaacaatgtacaagctctacaagtgaggcaggaaaggacctgggcccagagagggaaaggcagggcaaagctgggggcaggacaggagccagagtgtcttcgctatcttgaaggttctgatatgacctataaagttgggcctgggatgccctaggtgaggactgagtcagaggacacatcaccaagatctaagtctgaatctcagtgggtgtacggctcaggaagccaaagccacaagtgcaataaagcccagggcttaaagttcccttctaggtttcttgattgtattagtctgttctcatgctgctaataaagacataccaagactgggtaatttataaagaaaaagaggcttaatggacttaaagttccacatggctggggaagcctcacaatcatggcagaaagcgaaagaggagaaatgcacatcttacatggcagcaggcaagagtgtgtgtgcaggggaactgtcctttataaaaccatcagatctcctgagatttactatcatgagaacagcacaggaaaaagctgcccccacgattcaattacgtcccactgggtctgtcccatgacatgtagggattatgggagctacaattcaagatgtgatttgtgtgggaacacagccaagccatatcactgatgtcttccagaatatgtgctgtgtttcttgggtctgattgggatcccagtttagaaaactgagggtgggtgggcaaagtttctgtggccatcaggatgtatctgttttcagaaggggcctataagaattcatttaactgaatacttggtcaatgggatctgcatctgaaaacagaattatcgggcttgccactcacttaaaatatgacaatatgattgtgattttgtattggggttattttcctgctaaaaatgcttttctgtctccagttatcttgacttgatgtctaactactgggatacagagcctgacgctgggcctgactgtcctcacttgttgaatggtgatgtctgtgataccaatcagtcgtacaatcttttcccatatgtctatggccatatgtcttattcatcaagtgaccttaatattgtcatgaatgattcacaggaatagagcacaagacttgagatttgactctaattctgccatttgtcagctctgtgatatgggacactgctttgtgctaagcctcagtcaggtcatctcagtgagaagcctcatttcccagaactgctgaaagggcttaagatgatgaggcatgtgcttagaatggagaaattcccaaagcacattggctgattccgaatttgcataaccatgccttttgtgaacacagcttcctgttcatcctgagaaatagtattccaattgtcaatctgaaggaggtgatggcacatgaccatgaccatttctttaggattttgttgtaccaaagtaaggttggcattgcctttaggtgacatttgcagtcagaggctgttagaactttaagaaacatttgaggtcaaccatttcttcactggagaagtgaaaaaaagcaagacccaggcaagggaaaatactgacttagggccacgccactgattaatgagtccttcacatacagtgtggagggcatttctcctggttgcagaagtctttctgaatgtcacctcttcagggaacaccagacgggagctggtcagacgtactgaaccaccagctgtcatgcatcctcaggcttcacttactggcccctccagctgagactggttttcttaatggcataggaaaatgccaatgtattcctgacaagcctggttaagtgtcttcaataaagaaccatatgaaacatcatgcatacacggcaattctcttacagctggcctttagagagatctacacgtaaagctacatttcattaaatggaaccccagaaattagcattcttaaaacactgtcagtccttaaagattgtacccagctcaagggaactctctcagtggccactaatcttgaggcacagggaggatcctctttgctcgagggattcatcagaatgtcccaaatgtaggccttcagagtcatgagggaccttggagacctctgagaggaagggaaaggctggagaatgatggggatcatcaaagaatgcacagtggctggttgcaaggctggtactaaaattctgtttctaatcctgtgattgttattattataattattcaaagctgtgtataacaaaaaacaatatcttaaacaagtagaaaaattctgaaaaatcctatttttttcttgaataaattggcaaaaacatatatggctacgtttcaaatatctcccaatgatcagatggctcaactcacctccaataaagctttttgggttgtctcctcctgcatgtattcttctgccaacaaactgctttttgatggttgctggaagctccctgctggtgagcaggtctgttctcaggccaggagccacagtgagaacagggtgggggaaagcatggggccagaagcaaaggggaaagttcactagagaattcttaggaagcctcccagctccaggcgcatcagccttgtgcttggggcaattcatttaaccacttgagtcttggttttctcatggataaaccagggagaattatcacactaatgattttgataaaaataatataaatacctgtaatcccagcactttgggaggccaaggcggatggatcacttgaggtcaggagttcgagaccagcctagccaacatagtgaaaccccgtctctactaaaaatacaaaaattagccaagcgtggtggctggtgcctgtaatcccagctgctcgggaggctgaggcaggagaatcgcttgaactcgggaggcagaggttgcagtgagccgagattgtgccactacactccagcctgggtgacagagtgagactccatctcaacaaaaaaagaaaagaaaagaaatatatatatatatatatatatatatatatatatatatataaatatatatctgctgtgatgattgcataaggtaatgaatgtcgccatgctttcaaaaccctgagataccatatattaatagatggatactcttaccaccttggccctgtgatgcagacacagcactgtgtcttcctctgcctcagatttaccaccaggaacctggggatgaactgacctgacttgaccttggaggacccagggagaagcaggctagaacagacatccttctttccttgccctattttatatcaacctctcagggggctgggagaggcaccagagtgtctggggaggcattgcagggagtaactgcaagcacagatcctgcatgaggtcaggctcccaagttggaaatttggctgtgccattactagctccacatgtcagagaaaattaatccctttgtgcctcaattttttcaactgaaaaataagaattaaagcagggaccacctcctggaattgtgaggagggtgaaatgcaatagtgtatgttgagtgccctgcatggtgacttgcacacaatttggccttatttaatgatgcgcgtcattgctgttactctttaagtgtctccaggagtcagcaatggcagagagcacataagagggagtatatccagcacagcaggaagaaaactttgtttcaagccctgtttcagctggaagcataaaaggaaaaggggtggagaaacgtgtgctcctctctcaatatttcctttgcgatggctgattgagcttgcctttggaagacctccagcgagatgatctgggttctagctctggctctgtgatataacttcacacaagtcacttaagctttccagacctcagtgtcctcatctgtaaaatggagtgggggaataaaatgattctcaggtctcttccatctctaccatgctaagaataattgcccctttgggcaggtggccaaaataaactctctaacttcactctagccagctggtcagcaggaacccagggggcctgacttccagcccaggctccgatgattagggactgtggctccccctttctggattatctccttggctcaccagtcacctttgttattaatccaccagctgccatcaacatctggtcacttgcttcataacactaagtatccaacctggcccctaccccctctgcccacaaccactgttcatttgtcatagagccccagaacttgaaaccattcacttccttcccaccagcctgctccctggaatgcatctgggaaccaatcacccaattcaagacatctgtttagctcacttataatcaagctgaagagaagaagggccaagtctccttccatcaatcaattacatgaacacagcctcagagggcagtgtgtgtgcgcacgtgcacatgtgcacactgcagtgggagatacacacggaaagctgaattcttatttctcttatctgtgaccattactatgttacagatagaaaaacaggactctgctcttaatcatagaacagaaaattgaaaataattaattctgaggttaactagctcagcttcttcattttatagatgggaaaattaaggctcagaagagtgaagggacttggccaaggtggcatggcctagggcttggagcagtaagagagttgagaccagaacccagattggacttccagtttaattctctgcttgcaatttccaggaaacactcatgcagaatgtgtgtgtgtgtgtgtgtgtgtgtgtgtgtgtgtgtgtgtgtgtgtgtgtgtgttgggtaaggaagtctctaacagaatgaagcaggctccagagggcatggtgaaatccttagcagttgtatcactgctcaatatgacatctgtctaaatgggtttattcctgaaaccagaaggctggagatgaactctgagcaatgtggcatccatgacaacaggagaagcctggtggttaagggagaccccagaatatgcagacggacctccccacttactcttctgtctctaaagagacaggacctactgggtgttaatgtgaacatggggttccattcctccctgttttcaaacacaggaaggtaccagactgcccgagcacagaccttctacccttcagggaagggtcccagtccagttgggggatgaacttgcccatacctaactctaagaggcctcagggaaaacagaacaagggaggctctttgcctgggaggaccaaaggtccacagaaaaagcaactgctgggctgcatcttgaaggatgaaacaatttgaacagatagtaagggtttggctaggaagtttgctaagaacagaggaggagataaggttattctaggcaggtgaagaactgatattgcttaattcagtatagttgtataaattttgaagctgaactgcatgaattaaatcccagctcaaatactagtgtgattaaaggcaaaatgctttcaagttccagagggcaaaactagggacttaaaagagttttaagcaagaggcttagagcaaatggagccatgccaccaaaacccaccttttgctgtgccctgggcacattcagatctgtcgtcatgtcctcataataatgctgtcagttggtaatcctgatcacctccactttaaagatgacatagacaaccaaaaggagtaggtagtggctgaaggtaatacaactcacaagaatcagagctgggaattcattccacatctcagattcccaagatgagttttccccactgtggttccatgtgttgctttcaggcagaggctggaagaccttttgttgggatgttacagaggagattgactgactgattgatttaatttttgagatagagtttcgctctgtcacccaggctggagtgcaatggtgcagtctcagctcacggcaacctccatctcctgggttcaagcaattatcctgcctcagcctcccaagtagctgggattacaggtgcctgccaccatgcccggctaattttttgtagttttaatagagatggggtttcaccatcttggccaggctggtctggaactcctgatctcaggtaatccacccaccctggcctcccaaagtgctgggattacaggcattaatcaccgtgcctggcccagagaagatttaaacaggcaatgcagaggtgagttaaagccctaggattaccagacctagttctctagtccagtgaataccctcaccagaatcctgtttttaaggtgctctccaagtgactatgaggcaactagactgagtgtggccatgtgttcatctacaccaggaaggccctgaccccacactgaggcaatctgtggggcagcaaaactctgctgggctggaaacccaaggtattcaagggatgagttgtgtaaagcaacagatgggactgaaatgtgagaaaatactttgtgagccatcttattgagaagaaaatgaacccttgcctctatggtagagaggttaggtgtgggctctgccaagcagatggcctgggtttgaatctctgctttgctgctagtcctggggagatcactaacctctctaggcctgtttcctcatcctacagatgtggctatttgatcagaccacagaaggccctgacagctcacaatttctatgaacttctcatagaccaaattattctagtcatctacccaaatgggctggttcaagtcctgtgaattggaggtctcttctgacacaaagttttgcacctgaggttgctctcgacaaaacattttaagaggattttctctcatttttctcactcttgatcagtccttttcctgaacatgttttggacacacgtctttctaggttggttagaagtgctctgtatacagtatctcagatgtcccaaagctgtcaaaagagaaattcctcagctcactcatgtctgctgaatatgcttttttatgttaagaaaagaaaaaaagcaagcctgctcaaagtagttaaaatcacatctttgaatcctcaaccaaattaagtccagctcaggaactggtctccccctcagacacatttctttcctgaaactgattaatatgactagaaatgagagggctggtgggaatgtccctgccctttaataaaacagagaactttgggggctgaaaggctgtaggttgggaattgggagacctcagtttgctcctcatttgtccctgaactgctgagcagacattgccattacttctattgagtacacaatgagtacacaacatgagagaagtactaggtgtgcaaaaggaaacaagatgtgaattccttgacgtttaaatgcttaacgtctaggaagagtgataacgcaggaccacaaataactaagacacaaggaaaagtgtgacatcagaggcaccaagtagcggggagacacataaaaattttctccatgagaatatggggataaagtgaggtccaccacctcccagactgttctaatttggggttatagtgcggtcaccagctgctggttgtgaatacttgctatatggtatccaaaaggaagctctattaaatccaagagccatgtcatgtctgctaaaaatgagcaaaccttcctattaggtactgatggttcattagacccagagagagattctgtctccacagaactgattggaatgttgggggtatcacacatgcatacaacattccttcatctaaaaattcctcacttccttggctttgctgttgatatgatttgtctgtgcccccacccaaatctcatcttgaactgtagctctcataattcccacgtaccatgggagggaccctgtgcaaggtaattgaatcatgggggcaggtcttccgcatgttgttctcatgatagtgaatagtctcatgagatctgatagttttataatgtggagttcccctgcacatgctctctttgcctgccaccatgtaagatgtggcaagaggtaagcacatcttacttaccacaaaatgctcctccttgccttctgccacgattgtgaggtctctcaagccatgtggaactgtgagtcaattgaacctctttcctttataaattacccagtctcaggtttgtctttattagcagcatgagcacagactaacacaggtgactataccatctcctggttctcctcctgtctcccatttcttcatctctctgtttcatgctcctcttcctctgcttacctctcaaatgaaacatcctggatctcctctgggtcttcaacctccaatcaccagcttcaacctcagtctgtgtgcgtgtgtgtgtgtgtgtgtgtgtgtgtgtgtgtgtatgatggagtctcgttctgtcacccaggctggaatacagagtcacactctcgcctcactgcaacctctgcctcccaggttcaaacgattctcctacctcagacttccaagtagctaaggctacaggcacatgtgcacccagctaatttttgtatttttagtagagacagggtttcaccatgttagccaggctggtcttgagctcctgacctcaggtgatccacctgcttggccttccaaattgctgggattacaggcgtgagcaactgtgcctggcctcaacctcagtcttgctgctaataactctccatccacttctctcctcaaagccaagacctgggtttacagctctctactggccatcttcacctggctgtcttgaaggcatttcaaatgtaacttgattacggtggatctcaccacatttcctcctccctctagatgtcttggtcaacatctttccttgccaaatgtttctcttctctgttccagtcaatgacatcttcatccactcaattactcaaggtggattctcctgaataggaaaccaagtggtgctcaccttatatccagaatctcttccagattctcctccttccctttcttttccatcctatgcctcatatgtaggaccatgcccaactcctgagcattctcagagtaactgtctctccagcctcaccccaggtcctctacaacctttgccacagagcttgacctgttcccaaacacctttgcacatgcatcccttttgtccagaacactcttctcctgactctctgtgttccctagagtccaaggtccagttcagctgccgcagtctccaaaacatctcccttcttgagtcctctacagacctggtcctccctcctctgtgttcctgggcctctgttactgcatttgtcaaagagcaggtatgcttacctcttcccccagagctccttgagggaagcaaatgtgtcctatttgtctttatcactgacatgtctagagcacaactaagcatacactcggcactccacgactgttgacatcccttctcccattctctgtgttggtggagacgtgctaagggggaaatgatgcaggcagggtgggggttgtgggagggcctctgaagggggaagtcaagactgaagcaagcactaaggagccacctgcccaggggtgagagctgaaccatgtcaacgggaaaaagaataaatgaaaaggcagtcagagagccaagggcgacccctacttttgtgtctttctctctctttccctgtgtgtctctctctgtctctgtccccttcccctcatcatctgtttccctttgtcagtgtctgtcccactttgtgaaaagtgttttgaatggatcttttctgacttgtttttctcacctttgtgtcacatggtcattcattctcttattatattttattctgacgttttttctttctgcatttccttactcaacttgccaccaacatagagataaattgttcatatttatgaatggctctatgtgtctttgttttaaagagatatgaccaagaggagcattttaaacatgtctctcctcgaaacacctaaggcaactcctttatattgaatttccatggattgagtatattggctcccagcaggtcagggccctccaggtgataggtggtccctgatccttggtcttgtgtgactgccagcattactgtcccctttgggactcagactttgtggtgaatgcatgcagagatcttttgcttatcaagcttgtagatgaaaatacagaggcatgagctaggaaagagcttgaccccctagctcagtggagcaaggctaggaagagaacacaaaaagacctggcctggaaggggcagaggagttggtaaggaagctttcagccctgacaacagtccacaagggagctgcttttcactgacaccagtgctcctgaggaccagaatggctgatcacagccagccacattaaatacgtaatttcagaaatgcgatcaaactgacttcctgccagagctatgaagcaaatcctatacagagccagaggtcctttgtgttttccatttttgattctgtgttaggctgattttttttttttgagagagagatatttaatttacctagtcttttcaatcaaagaaattgatacattaacaggatgggtggtgatggtggcagtggcagggaaagtaattaaaaagtctaatttttctttctaaaagcaccagcccctgaactggataggtctccttggactggaaagcagacaaagtttgaataaaacttttattcaaatctaacaattattttgttgtgcttagatgttgggatgttgggaagaatattttcttttccaggagccaatgttttggacattagggggctggatcagcttcttagggcagtcataacaaagtaccatcaactgggtggcttaaaataacggaaatttattttctcacagttttggaggccaaaaattcaaagttaatatgtaggcagggccatgctctctctgaagcactaaagaaggatttgttccaggccttcctcttagctcccaatgctgcccgcaatccttggtgttccttggcttgtagacacatcactctaatttctgattccatagttacatggtgtgcaccctatatgtgcctgtgttttctcttcttataaggacaccaatcatattggattaaggcccatcctaatccagtatggtctcatttttatttgattgcaaagactctatttccaaataaggtcacattcacaggtactagggcattagaactttaacaaaattttgtggggagacacaagtcaatccccagggaccatagtctgggatggggagggagggtagagaagacaagactacctacagtgccaaggggattccactcatggttagaaagggttgaattacttggcctgcctgggatagtctccatttggtgatatcaagtcttggtcccatagctacccaaggtcttagacatcagactgatcatttagctaaacaccaggtcatccaggaagtgggcatgctctccaggcagggaaagctcatctttgaaataactttgtgatatgatagaaagagcacacagagagtcagaaagtccaggttcattcttttctaatggctcacctactccgtaaaatgaaagcacattaataaactcctttgaccctcgatttgtatttccataaaaataaaatataaaataattttcatctactgcaattttataatacaacttaaatgagaaaagtgggtgaaaaagagttttgcaatgtatcatgttttttttttttaaataaatgaaaagtccctttctcctgctcatatgggcagaacctttcatcgtcctgtttaaaaagttgatgtgattcttcccatacccagagtgggcaaatatgatttaaaggtggaaaggataccatctgtctctgtggctctaaaactcaaggtgatcaaaactgcctttcaaaacccccggtggcctcaatcttttagcatctggtgctacctgatggaacagatttttatctgagtaggtagttagagcctaatcctttagccaagcctataaataagtctaagggcatgagagctgatgataaaaagaaaaataaagtctttctttagacgtcctccctctcaaagccttaggggaggaatgtgcagccctctgctcgctgatgatgaaattagtgggcgctcgtcattcaacacaaaggcgagaaacgactggaatctgatgtcaaaagccacggaagagaatatattttacacagcatattaggccccaatgcaaattagaagaaatatggggagccttcaaaaaggtaggtcaaactttttcctcaagcagataattacagactgggggtgaataaatcttattagcctctttccaccttgtctcttctcataaaacactggaaaaaagaaagccattccaattcagaactggacagctcacccaacagaggcctagcctagtggtcatcaggacacctgcggtcaggttgttgatgctcactctcactcccccaccctgacgacctcccaccaggatgcaggtgaagacagccaaccaagcgtggacttccatgatggacttgcagagacttggtgacttctcactgtctgaagaacgatcccttcaggcagcaattttccagtcaaatttatctgcccaagtttgaggccttaaaattaatgaagttgttaacatttcttaaaatgtctttcacggcagttgaaaggtatggatttatcacccaactcagctggcctctttgattcatagacatgtgggctgagctcccaccaacatccttaaggggaccagactcttggccttagctctgtctttagcttgttctgcagtgggtcttggggcaagtcctcaacatctgtactctgaggtcagcccaccggggacactatggcagtgggcttagctgcctatggaatgatttgtctgtcctatgagcagtgaaagggaagggccaacccttacctgtctttatgtttgcatcacttcccacatcaggcacagggccaagcacccagagatggtgatggtggtggtaatgtcttcataagtctcagctgaattaaatatggcagaaagatgtaaagcctctggaatgcccaccatagtcagttaaggaaccaccaatgaagaatcagctcctccttccccataaatcaatagcaacgatggtgatgacttgggtactcttacccagaacttgggcagtaactgccaatggtttgggtcctctactctgccaagaagggaaatcatgaggattccagaccaggaggagagtttgaaagagatcttgaaaaacctccagatcgattcctttgccctaaggtggcatgccatttcaccctcattttacagataaggaggatgaagctcagggagcaccacatggtttatcagggccaagccatgggtaggaggcagcttaataagctttcatgattttctccttttgacctgcaacctcttataagatgctccacagggaacaaatatgttgccctctgcagcatggagtgggtagatttaccccttggggcattctgcattttataaaaattgtccttctgtagagatactgaatgactttgggagcaaaatcaaaaatgttacctgaagaccagttgtatcgcaaatctggttacaaagcattaacaatgaaaagatccagatttcaattatttatagatacttgcccttatcataagatgacactcagtgtctggtttaaataaaatcaggaagtaattcttatctggaatctcctgacgaccactgatctttctctcctgcaagggctgcttaagaatcacaggaaacattccagcacagaagataattataaactgccccagggtttttgatggatttttttttaagtttaaaatatggtacagaaaggtacagttaatatgaaccaagagcgttatagatgagagacagcaggctttggactggaagcttttctatagtgagtggaacatctctgttaggtgcattttaaatagcttaggcccaagggtatagactgcatagaggaataggtaaatatgcccagaagggaatctagaactccgtgccacaccaggtttataaatacttaattgaatcaggcctgatgaatgagtttcattctggaggacttttgcattcattcatcataaatatgaggctggtgcaaaagtaactgtggttattgccattgaaagtagccattgaaagactaataaggctttatgcatatcttccatgcgatagaataaagtggaaagcaaagcttagtgtctgtccttatggtgttcaccctagaggagttcaagagaattaaaatgttcatttgaaatgcttcttctctcctctaaatcttctcattgcagagacccagctactatgagctgttagaatgagcacagagaaggaggaatcttataccatgtaaaggcagcctcctgagggctgctaggacaggacctacccgggtgggtaggtggtacctgggagaaaaaatgaaagtaggggaagaagtctggcttggtagctggagaagccactctgtgtgatcttattaaacctagtttccacatctgtaaaaatgtaattggacctggtctcttcatgtcggatgctgttgcagaatcaaatgaaccaaaataatatcaaagaacatgtttgggaaactttaaggagcttcttaactgtaaggggccctggaagacctgtgacgctcataataataatcccctcttaagagactgattgttggctgggcacggtggctcactcctgtaatcccagcactttagaaggctgaggcaggcggatcacgaggtcaggagatcaagaccatcctggctaacacagtaacacagtcaaaccccgtgtctaccaaaaatccaaaaaaaaaaaaaaaaaaaaaaaaaattagccaggcatggtagtgggagcctgtagtcccagctactcgggaggctgaggcaggagaatggtgtgaacccaggaggcggagcttgcagtgggccgagatcgtgccactgcactccagcctgggcgacagagcaagactctgtctcaaaaaaaaaaaaaaaaaaagagagagagagagattgtgattgctagaaacactgtgggttagaaccagaaagcaagctacagtcaagaagcaaataagcatctcctctaatgattgataaggggatggctggaacactatataccataaaggctaagcaggagggatatggcagacacaaagcccttggctcccaccaggatacagaatgcagctggaatggcctggctggaatggtccacggggttgagcgtcactgggagacagagggctcagaaagacttcttttgcatatagggagctgagggaatgccctggagcactatgaatcccaaactgaaactcacagagtccttattatgagatagtgacagtgtatctcaagtaaatattaaacatatacttaccatatcggctgcgatgagacaggaaagggaaggagtctttcattatccaggtgagattccatgtaaaataatcaggagaaggagaaggcatgtttgttggtgattccaaggagctatgacctggacataaaaataaagaaaacactgatccatgtgcttggggtgtgtcttttagctgtcactcaatatcagtcaaaaatgaagtttataaggggctttcatgacatccatcgggaagatgagggggaaaaaattgagccaccagtagactgagttgacctcaggaccctgatgtacattttctatcaagggcagacagatctaagaggtctgaatgttctgaccaaggccatgctgaggatctctgggagatgaactagaagccagggcacttaatggcttggtctaagagttctatccaaagtctattctgcctataataatttgtgcagctttatagagaactccaattcatctcgtccagataatgcctccatccctactttatgttcagacttgtaacttcctctaatgttgtttgcttgggttattgccttatcaatgagagggctgaaactgcactctgaagttatgagttcttaacaattatgttattgtcagggttgtgggggaagctaggtgaccggagttttcccaaagccaagaggccagaaagccaaaaggattaatgtttctgatttgcatgagagaaagaaggcttgaaagaaaagcagcagagaagcattattcctgtccttagcagcacctcatgtggattttgtgtggtgaaaagtcattacaatatatctacaaatcaaatgatcatgcactgcctgatctaacacagtgcttcccagaaaatcccaagctcaatcactatttgctaatgttttacggcagacaaagccttttttgttaaagaaggaaggatttgagaattagttctctttcatagatagatgtgtcacaagactgagtgcagggaggagggaaggaaggaaattagcatttcttctgtagcttccccggaacagacgccatgctggactctttacctacataatgtcacatgatattcaccgtggctctttgagatagaaatgatcatctctgttttacagatgcatcaactgagacctagagaggcaagtgatggaagcagaaactgagcccaggtttgcctcatatcagcaggccatgttctatggtgaatgggctgacctgctattctggtggtaactgttaacccacttggagggactttgtgaagaggaaaagggggagaagaggagaagaagagaaagaagaaaaggcaggcagcaggagtagcagaggcattttcccagtctgcctgctctgcagtttcttccacattaccccctgtaccagctcttgcaggttctggtctcctacctctaacccccttttaggataaaccccacttcacacacttgaaggaaatctctggcctgggtacccatggcagtctcttgtttccagacccctccactattttacctgcaggtgctgcccttaggcaatgcttattaaaggcccttgtgccctgcaactgggacaggatgggcattccacggtctccttcctaaaaaaacattttaatctctgctttccatagctctgagttggaagtgctggctcttgggtatctaggaaagaattttgacttttctcttatatttggtctacagagattagaactgaattgatttgtgccaggtacatctttctgcagcatttctgcaaaacagctcagaggaaatgcactgaaaggggtgagagtctgtgtttgtgagttgcagagagaagccatctcatttcacctgcacatcaactctgtttcgtagataggcaatggggctcagagaagtgaatgcaaagccacgtagggttactttgggtggggttaagtttattagccttttaaaaaattagtatgtatcgagcacatatggaccggtatgatgctaagtgctttaaatgtgtgattttgtttacttcttacagtaaccttgtgaataagtttatttgtcctcattttgcagctgaggaaattgaggcataaagacgttagttaccttgactacagccacacagccagcaggagacaggaaatcagggtcaaaagactagatcaactgacactgaagtccaagctcctttcaccactctgcacaggccacagactggtgcagggtggtcctcagctctccacagggcctggcagggcccccacgacacaatggctgaggtcagaggccaccactgagcatgcttcagaatagggcaagtgggaagggtctgggaagactcggacaatcaatctccatgtgaataaaaattcacttagactctaggtctgagtcattggctaatctcaaattttaagtagctttgaagtgacaggaagactaagcctaggttatactttcctgtttctaagtgatgtcatttttctgaaccattcagtttgggaatgatattaacttcttcctggatgtgaggaaccaagcagatggggctagacttcagggagcacttatgaatctgtgaatgggtacagaatggcagataactttaatatgaatgggggccagataatatattcaggggtttaaaaaaaaagaaagctttcaaaaggaagggctctgagggctgggtcatgacccagcaaggtaatatggacatcactgtgggccatctcttcagaagcatgagcttaaagccttttatatcacaaaacaccaataacttgccaggcatccacagggttgaatattgcagggttgaaaaaaagcagaaagtcttaacttgcccttacaggaactcctagaatttcttccagccagtgggctcacagggtctccaatcttacccctgagagtagggagtgcaagtgataagccggatgaggctagggagctaatgtgggggtcagccaaaaggctgagcctccccacctgaaaagtcaaggatcaaggaaagcaaagcccacatgaatgcagttgttttccaaaatcggaagcattggaacagaaatgagtgctagtcaaagttcacagaatacacatcaatgtagaatataaagaacaaaatacttctgcatttaacaagtacagggtcaagacactgtctgttcccatcaagctctttacccttgccctacccaaccactgcagggaaggattttctagcagaaagagaagccatgccatcagaagcaatccatttaagctagagaaagccttgtcttttcagggttccactctgaaaatatgaggatccagagtgaaatgggcctcatcaatgcagatatatgggtgaaggtatgaatgcagaccaactggctcaagtagagtgactcttggaccttgggagatgaaacgtagatgagaaaggagtggggaaataggagcaggagcttctaggtgcccaagtgaggcagacaagtgaaggcctgaagagaaaggaggaagaaatatacctggactgaaggcattattgatttgctagcaatacaattgttgctgtttttctgatgatttcttaagccctttctaggcactgcagggtatcaaggcagagtgaaaacctcaagctcttgacactctgaatttttcactgtgtatcatccccctaatgtcctcagcttcagctccagggctcatctctatcataatttcatttcacacaatctcaactcctttgcctctttctttacaattatcctggagcaggtagatgtggtagtgggagaagaggggtggaggaacacacaacagtgctgacaggcctcattttaaattcatcaccagaaacctcaagaccctcaggatggcccgggaatcccattgccttccctgactaactcagttcactctctctctttccaatacaactagttcaaacttcctctcaagttctcaaaactccaattccccatatgcttccacattctcagtgaatgaatttgtttcttagcttattgagaaaagagaagtgatctacccacttacatgtatcagtgccttctcttctgttgtaaaggataacagtttactctcttaaacagtgccagcctcttcacttaggtgctagtctcgtctcttctcaagggatctgctgttacaatggtcctgcatcaacaattttccctctctaccaagtcagtcacacaaacatgcaccatcttataaagaaagaaaaagcttctttgactgccacactcttctccagccattgtccctttactctgctcttctttacagctaaatctattaaaagatttgtctttgctcctgtctccaccttcttcttcccgtgttctcttaaatccaacaaaatctagattgtcttcactactccacctcaaggtcgccgacgaccctaggctgcagatacattgaacaactctaggtctttgtttcactggaccactcagcagcatttgcccctgcaatcactccctgcttcttggatttttcacatcctggtcaccacatagtctttggttgcctcctgcttcagtgggaagatcctctttattcttctttgccaggtcttccttattttccaaactgtagaggaggaaacgtctccttttccggcagcacttgcttaggaactgtcatggctgagtattatattttatcccactggttctaaccagctgatgatcaataaatttcaagtgagtgcgggacaccagacccttcctgtacctaactgaagactctttgctgaccaatgaagataacttgtttacccatgctcacacaaacctatgcattcattcattctctttagttcaaagaaccgattttcaactccaaataaccagaaccacattgtagccctcttcgtaagactttaaaaactctgacttttcttacttggaaaaccatacagtgaatttctccttgcccgacatgtaagtaagcttgtcataaaaaacaactctgtgggatctttattttattatttgacagttgttaaaagttgaagaacttgggaattttctgcatctaaactctctctcaaagtgatcttacccagtttcatggctctaaatatcatccacatactactgttaccaaatttgtgtcttcagcccaatctctcccctgaacaacagaatacacagaatatacatccaactgcctgctcaaaatctccactttattgcccaataagcatctgaaacttaccatgagcaagccaaaaacctaacctcccttcccctaaaccccaggtattccccatttcagaaagtgttaccaatactcgcctggttgcttgggccaaaaaccaatgaggaatccttaacttcttccttttattcacaccccacatcaattcatcagcaaatcttgatggctctacctgaattttaccccttctcatcttttcccatctcgcatctctccattattgctatgagctcaaagagggccccccttcagtctgttctctatgtggcagttagattgacactgcagcccctgaaatagctttcaaatttcttgccatagcctagcccctaaaggccccacaggatctggctcctgattctgtctctaacctcatttgcaaccattttccctcattgctggagctcagtcccacaggtctccttgctcttccccgaactcaccaagcacattcccaccccagggcctttgcactggcagttctctcagccgaggaagctcctcctactcagaggtacatggccactccctctctctgtccaggtccctgtccataggtcaacttcccagaaagaatttccctggtcatcctgctgagagacaactcattgtaagccactcccatccctttgccctatttcttacacatatatgtgttctgtatattggtttattcattgtgtacctcctgcactagtcactgctatgtctccatgcctggcacacagcaggcactcaataaatatttgtcaaataaatgaaatcagcgccctggaggaaggtgttatctctggcacttattagctgttaacttcaggctaagcacacactctgccaaacctcaattttctgaaaacgatgacgagaataagaatagggcatattctaaaaattctcagggttttgtaagggccacatgagataatgtgtgcatgacacagtctttcagtatcagtcatatcattcttaaaattgtatgctcctatctctgttttagaatccaaaatgagtgggagtcttggtctcttttctatatttagatcatcttgtgtcaataattacaacgtccagaaatcaaaagtgctcccagagagctgcttcgctattattcactagttaatcattaactttgccaaatgtacatgatcacaactacccaaattgcagccgattggcactgtgtatttccaatctttatttttacatgtctcactgcatgtctatttattcctaagccaatgaacataatataataaatatatcatacttgtgtcagtataagtaatgaagagctatgcatgtgtgatggttatttacatgaatgccccaggctcactggcaagcatgttttacaaacctacatcaataaaatgtaacaaatgctcctattctaaatgctctttggaacagttcctaccttgcctgtacacgttttacttatttcttttccttccaacaataaaacaatcagtgacagtctgcttgttttttccctgttatttgaaaacacacttaataatgcattcgtttacaatgattttgtgtcacacaaagcaaagcttaatgtggccaaataaatagtggtctggatgtcaaatcaggcacagctctcagagagtacagggcaggcctgtttttgggactggcagcccaggggaaatggtttgggtattcactaggctgagcctgcacctgttcagcaaaagaaacctcagtaaatttacatgactcctagagttagcggtgatgggcgatgttgttaatttagtctgaaaaacagagatgtgatttcagagaaaggagagagtttgcagatgcaccatttgtcctaaacatatagccctccccataccttctctaggcctggaaaatgagcggtttgaactcactgctcgctaaggtcctctctggttcatacatatttgtttctctatggtttgctttcacattttcttccagctggctcattcagaagggagctattagtgtcaagggcggaatttggatggaattaaacagctcccactccacctcacctttctctaagccccatcccatcctgccagagaagtttgtgctctttcttagtagctcaaatattgaagcaaaaattactctcccataatattcttttgtactgtcaaaagttatagcttcagcatgcatttcctgcctccccaagaggacccatgtataacttttgtgttcactcaatggtgaaggacctctgccagccaatgaaagcatgtaccccttcccaaggcacaacagtgaggaatattaataaaggaaattgttagcatggtgcctacccttagggatttggttaccttcaggctatcctataccaaaaaaaaaaaaaaaaaaaggaatcacaaagaggttgctccagaatggctaaagcgtgtaaatctggagcccaaacactctggccactgtttgccttttcagccttatttcccattcagaatccttcctttcacattctatcccattactccttagtctccaaacttatgcccaagctaatctctgcctagaacatccttctccaccccctgctttcctaaatcctaccccttcttaaaggcccagctcaaatccctcctcctcaaggtccctgtcttccctgagctggacaccaaagcagttgagctgggattcgggttgtgccagaacaaaacctgaacttgggccctgacctccttaaccacttaggatagtggtgttgaggccattcaacaaacatgttaatgacgatggattgtaattgcatattaatttcactcacacaacttaagtttcaggtctgttgtttatgttgatttcttttctttttttttttgctcattgatttagaaaaaattaggaaaagcatttcacagtggctgtttttggtttggtgtcatgtaggacatgctttgcaggggcaggggcagatcaagacatggacctatttcatcagttgagctaccacatctatgcaggtactagtgactcataattcatggccaaagtcctataacgaaggccatgtgacagctgatgcctcctcttcagaacctgtatctctcagaatttgatagttccaggtcactcactgcattttcacctttccagacatgatttcagcatcccaagcaagcacctcctgactcatccatgagcgtcacaatgtctcctttggccctgaacccctgctgcaggtgtgcttggtcactggccctacctaactggccaaggtggactcacactggcttttggtagctgtggaagactaatgggcatttttattttactaatccaagacagcaaatatcactctccaggtggcctgattcttaacacacccgcactccctacccccgtaagacctgagtgcttccattagcagggcaacatgactctctgtttgggtccatttctgtggtttgcttgtactctgctctttatgaaatttactccactgtgatcttaagcctattttctccccccaaaatatgttgactagaataataatcaaaaggaaggctttgaactgccatcaggcctttcatcttgtgatctcagagagctttaccaagcactaaataattaatatactgaaagcgatacaaagacacaaagacacaaagacagggcagcctggaaaaccaagtccatcaacaaaagacctttttcttttggagtgagagagtcctggtaaggataatcacccaccagcaggcccaggagtctccagacatgttagacaagaggctacaaactatccaagaacaactggctcttctcttgacctgatgtttcaagttgggaagtaacggttaccaggatgactcctgaaatcatgcagtgagtgccctggggagagtgtgacccactttcacaggaagaagggagctccagcgtggaagagtggattgcaactgtgtgcacattcaccatgacttagggctccctgatgcctttcagaggcatctgcttttgtgatccttacaacaactttggtagttaacctcttttacagatgaaaagattgaggctcggaaagcacaaatgcccaaggtcacattgccagtgagtactaggataggatgtatgactgcagacctctgatgtgtggaccagctaggaatgccactctacagtacaaatcccttgcaggtgatgattctcctggggaacaggggttgggaattaaatacagaagaaagaaactgaccaggtcagagatgcttgctgcattctcctaactgaggacaatagatccctttgggtcaaccaggaagtcgacctagaaacacacaccttccatcagggcagctggctctgtggggtctcaggctcagccacgactgtttccatggcaaccaccacaaagcctgatgcctggatccttgaaattggtccttggcttgtccaagggaagatgcttagggtgaggggaagaagagggacaaaacactttctcctaacttccagacctttcaatccctctttatctacttgtcacccctgtcatttcaggataaagagtctatcctctaagaagccccagctccagatgccacattactcagcacaaaggcccctcaccatgactgaactcatttccagagataggctgatgtgctagagaactgtgttctcagatacagcagtgttactgcgtgaccttgggtaagctgcttaacctttttcaagctttgtttctctgcatgtaaaacagaactcatcatgctttcccagccaacttttgggatgctcaaagaattaatgagacagtatctacaaagccctcaggctcttttgaagaaaggtacactagaaatccttgtgcttttactaaggggtattggcatgatgctatattttaaatcactcttcacctgtattactaaaataaactcagcttgtattaaaatagataggccaacagcctgattggcttcatcctactctggtgctatgtcacctttgttgcttccattcatcttgcattgttaacaatggtgatcaatgttacccttggcctcatgcagagactcagagtgggggagctgggaggggccatgaagactatttatctgtgtcttcctatcacacatgtgagcaagctgaaacacaggaaggaaagatgcttcactcgaagtcatctcgttagtgaaaaaaatcacaaaatatgatcttctgtgcccccattctatgcctcacccaccacaggagaaggtagcaaagaaaggaggagggagaagaaatagggagacatgtttttgttctttaaacctttaagctgcaatactctgggatgtttttaaaaaaaaaatcactgagaaagaaaccaatacttcatgtgtgcctattacacacggtgcccagcaccatactgggggctttatagtcattgccccacaaatcccacaattttctgagtggggattattattaccattttcaaacgcaggaactgaggctcagagaggttgagtaacttgtccaaggttctggagccaaaaggggtggagctaagattaattcattaattccattcatacttcctgagtatctcctatgtgccgagctctgcccttggcagttgggctgcattcgtgagcagaaccccacactaccctcttagagcttccaggctgaggagcttagagtgtggaaggcagcagacagccatccaacaacctctcaagtccttttgacatcttgatgttgttatccattgtgaaggagacagacacaaccctatgagaacgtatgatgagggatctgacttcattacgagaggcaggggaagattacctgagaagctgatgcttgcactgaggcccttaaccagatgagtagagttaactagttaaagggagtggggtagggtgggaggctggagaaggcagggtctattccaactcaagtctctcagaacggagcgccagctccttatttgccaccaagaaaagtgaggcattatagaggaaccttgatggatggcccaatcacactgctactgtccagcaaagaaccccttggagatgacattgattgcaatcgagaacaaggacagggaatgaaacacagcagaaggagtgaccagttcataaatgcctgctgccttctcctgattaaggatgacagatgcctccagatcaacctagaaggccatctaaaactgctacctaaaatggctctgccccgtaacaggactgacctgacttgccagggaccctcctgccttttctcggatgctcagtctgttggccaactttcctgcagggaagaggcctggaacccagccactaaacctcagcctcccctcgctctgaaacctgaattaccttctggaaaagtgaagggttgaatctgccccaggaactcttcttgcagccatctgggtcacggataagccctggcttgctctccttgccctctcccatggccagggccagcaaggtcagagcctctctctttattttgctttaaaaatgaggtgaagagaggcaaagagggaggggagagcagggagagagagaaaagaagagagaggaaggagaagggagagatggcaaggagacgcctattaagcaatagagctgcaacaaagaagggaagaaacgtggtgggggaaagagaaatcatctgacattttttcactatctggaagttactgggagaaagttattcaagtaccacggtaaaaaggccataaaacaccttggggaaaacatgaaagtcacgctgccaccatacagacgagcaccctggaattagctgccagagcgatgtctaaaaagaggaaattcaatggcccacattgcagcctcctccccagtccctcccagctcccaccccctccaaatcgcctggctctaaaggcagaggcagtaatttggagctggcaagtgtgaaggaatgtggaagctgttatttgccttcatgcagcacatcttgagtgcatctttcagaatataatttaaaatacactttcggttttactatagaaaatctgaaaaaaaatcaagaagatctaaaggagaaaataaatatcacccatacctccagcatccagagaagccagtgttaacattttattgcatattggtttgtgacttggttttcactcacttaacaagacagcacttggctgaaaagtatatcgaggagaagggaaggagagagttcctctgcacccatgagatttgtctgcagggcaaagaaggtaagtcgtcctattaaaccacccaagcagcttgcaccctggcacacagatgctgaaattatggcaactcgggatcccctcgccccttggcaaggacctgccattaaatgcggcacaagctccgagaaagcaaaggctgtccttaggaagggcaggcctacggggatttgggagatgctgggatgtgagtgcaggatagaccaggaggaggcagatacactagtgtgtaccctcagcacaagtagacagagggataagcagattctgctctggtaggcaccttgtagaagtcataagaagcaaagactatacagaattatagtgttatgtaagtgcttgaacctaaataggaggtacagtacattgattttatgacttggaaaggctaaaaaaaagtggaattccacctcattttcaaaggaacagccaatgaaagtaaactagagatagagggatagagttctatctctgtggccaatgacacaccccacaaatacatggactcccaaagccctttcatttaagcctttgatcctcataaaggtttaataagataagaaaaacaaatcccaacttacacaagaggaaaacaaagaatcagagaggctaagccagtgcttcctcaccttttttcatatcatgacacacagagaaaataatatttatatgatccactggagtaaagagttaaggttgcttgcagtgaaaggcaactggcccaagggcttctgccactcctggtctggcctagcctcccagtgtgctgacaggctccataggtcagtgtctctgcacacctgttggccagcacacatgggaccacagctcactactggagaaggaagctctgggtcaggagatgtggccacaatcacacaatgagaagagcaagatgcactgtcaccctgcatcttgccccagggacatgtctacatgacaatagagacgttggcctcagaaagttcccagtgcttgtcgccaacactgtgtcatcactcaaacaaagcaggtggcatgggtgagtaagggctttgaaggttgatctgagagcgcctcagaaagtttccttaaagcatttgtaactgtcaagaggcttccctaaagaaaaggggtaaaacttggctcctatctctactctgggaaattcagaaaataatttcacaggatggttattgaatggccaaaaagtaatgattacaaatgactgagttaaactgctgtgtgtagcctcatctgtcatcatacaagcgtcttatcagaagtcccatcaggattaggggctcatcatgactggtgacatttgctggccaagatggcttggcttcttccatgtccccttcaatcatggtggcagaagccttccaaggtttgagcataaactcggagaaactgcttttggcaatgactccaggagcggctttcaagataatggactctttttctgcaagtggcactctgtcttcccaagacttcctgggtcttgctgtcactggagattctgggcagcatcgggacaggatgagctgctggcaacaggtataacagaaactaaaccttccggcctgctgaattaatgattttattagatacaggtaggtcacactcaggcagcacttacacaacattaaacctctggatggaaaatgaaaatatttcctcaaatcctgtaatatctccaaatgtaaaccaaagatatatattttcattaggacaatagcaatttggcccaagagaagcagtcaggactaagcattaaagatatttggaacaggtgaatgaaccatgggctaattggataatactacatctatctcttataattgtggaccaagagcacccctgactccttgggaggttctgtcagtgacctgtaaaggtgttgtaggaaggtgaggtcaattccctattaatttctcatactcagcagtgggaggggaagagaggagagtcctccctttgccctgggcctcgcacactgggtaaaccctggtcatttgtacagcatgcatccagagacttctggaatcctcatcttcaagaatattgctgtaacatatcactacctccataaaatgcattgctacaatagggagaaaacaataaatcattcactaagtgactcataaccaaacccagcctcatagcatgagatttttcaaattcttatctcagcaaaatgacaatttattacatatcatgtaatttggggtcgcttgcaaatagtagaaagtgtgactattaaatctgccactaccaagcaactgctgtagtcagaatatgagagagaaataaaacaagatgcaaaagtgacttttccacctactctggggtcccagactctgaaatgggcagggggagccaagaactattgtcacaaactccagaagttccagccatggcttcctcactgcccacacttgtagaactgtgaggttttcctgcctgaggtaaatagcaattatatctatactaggtttaactcacccttggggtgaaaaagacttgaggaagatgtgtttatgggttgttgactgttagggagaactgtggactaaatgtttatggttcccccaaaattcacatgtcgaaacccactccccagtgtgatggtattaggaggtgaggcctttgagaggtagggcttttggcagagctctcataaatgggattagtgcccacagaaaagaggcccaaaagagaaccctcaccccttccaccatgtgaggacacagcaagaaggcactgctcgtgaatcaggaaacaggccctcaccagacactcaatctgctggcaccttgatcttgcacttcccaatctctaggactgtgaacaataaacttctgttgtttttaagctacctagtctataggttttttttttttttaagcagcctgaatagactaagggagaccccaaagataaagacttttgagtttctgaccttcatgaattgatataagtggagtgaatataagaccaacagagagaagcactagaacatgaagcagccttccagggggttggaaggaggctaggaaataagtagaaggaaatccactctgagcaaatagaaaacatgacacccaagaggaagatacacaattggctagtggggcactctccctgaaagcggggcactaggaacaagagtaacctagccattctccctggaagtcatacatgaagtaaagcaggatcaggatctgctggtatcacccagaagaatgaaatggcagccaggtcttcttatagctttgaaatgtccttgtttaatagagatctgtggcaagagatatggaatttataaaaggggctgcaaactagattaagggaaaaggaggccagatggggaatcccagatggtaccatgctgtcttggagttgagatcatgggtttagatgtcaggctggcctgaactcaactcacagttccaacacttactagcacctacgtgacctcaggcaaactatttaacttcttcacacttcactttcctgttctgtgacatgggaataatagaagcaatcttacatgcttgccttgaagatgccataagagagtgcttatgaagcacttagcacaatgcctagctagagtaagtgttcagtcaatgtgatttatattattattatagaaaataaaatgctgggcaaaatatgggcccagccattgagagttctgagttttaaaacttcagggaagagtcatgtgatccctatgagggaaacatacactttgtagacaggaggggaagatctgcaatccagacacacccacggggatccggcaggttttcagggctgtgcaggcagcgacaggaggggttggaggagctgtcttggaaaaaagtggccatgggacattggacctgctgagcctgtggcctgtagatcctggcagaccaccactgatcaacatcagaggggccaacagtagatggcctgaacttggagttgcttgtaatgcttacaaaagctgtcagtctgcgagccagcaaagcatacatcagtttcccaaggtgagaactgaggcatggaaaaacaagttagcggcccaatgagaggacttggagaacaagcagcgggaaagggcagagatccaacactgggcccaggactcagcctccttctagccatgtgtccaagattcattgacttggcaattgtgcaatctgtgctgtttatattcattatccctcaaccatgttcaagttccaagaaaaggtgctgcagaccatctccatccccatctgctctgagtaattatggagatttcatgttgccctaaagagaagagactgtctaacgttttcagatttttttaacatgaaaaaaagataaagctcggggaccacaggcctataagtttaacagtgctcttggagaaaactctaaaatagatcattaatcagatggcacggaagcctttagaaatatacatcgaccagagggagacaaaactagttcagtaggaataagacatggtcagtctagggatagtatctttactatcaaaatgagcaacctcttcccccatgctcaaaaagaaaaataattacaaaacaaagacacctgtaaaaataaatatagatcctgatctctctttctccctctctctttctgaaacacacacacacacacaaatatccaaatatcaatggctaataaatatttgaaaaaaatctcaattccaacagtaatcaaataaaagaaaattaaaatactggactactacttttcacttattgaattagaaaatatttaaaatcacttaaataatttaaataaatttaatagatattttggtaatttaaatacaatttaaaatatattttaaaataattatgctcagcactgctgagggcaatgagatagataatcttatacattcctggtagaagtatgaattgtaaatttaatttttttaataataatgtaataattgactaacaatgagtatgtgtaaattgctatgcacatggatcattttatttttttattacaaaaaccccatgaaacaggtattggtattctcgttttgcatatgaagaaattaaaagggtcagtttcaaatgccccagagattctgattctcacttgtcatctaggggttgcagggagaatggaaatgggtaaggagaggatgaggcaagagaaagccctacagggggttctgatttggatataccattcccctgtttagaataacaacaatgcattatactgtacataaggacagataactaatttaggcagtatttaagagtgttgatacttttgactgattctctcctaagaaaatatttgaaagttataaaagtgtttgtgaacaatcacagccttcagtgattttataataataaatgctatcttagttggaaacaacttaaatatctagcaataggttaaatgatttagaaaataatagtaatagtagtagtaagagtagtagtaataataattgttattgcatactcattatgtaccaggtgctagtttaagctttacttgaattatctcacctattctttattgacatggtttgaccgtgtccccacccaaatctcatcttgaattgtagttcccataatctccacacgtcatgggaggggcccagtgggaggtaatagaatcatacggcagttacccccatgctgctgttctcatgatagcgagtgaattcttgtgagatctgatggttttataaggagcttttccccctttgctcggcatttctttctccagctgccatgtgaataaggacatatttgcttcaatttctgccacaattgtaaatttcccgagccctcctcagccatgcagaactgtgagtcaattaaaactctttcctttatgaattacccagtctggggcagttctttacagcagtgtgagaagggactaatacacttacaaaaaccttgtaagttagagattataattacccctattttgcgtataagaaaactgagccatcgaaaagtaacttgctcaagaccccaagccagcccatgacagcatcagaatgacagcccaggaagtcttactccagagcttttactattaatgatcaaactctatatatgtagttcatttccatgatggaatattatagagccattagagataatgttttcaaagggtttttgataacatagggaaatatttacattatatgcttggaaaattacatatattgtatgatctagctgtgtgaaaaatatacaaagaaaatgcctggaaggaaatgcaccaattaacagtaattgcctttcaatggtctggttatgagtcatttattttcttctttatacttttctgaatttttctaatggactaaaataaccatgtgtcattttttttttaaatccagggtggaaataaagtaagccatgttcatgccaaattacccttattttcattttgacagtgtattttaaaatttgacaaagtaacttatattttagtacattaaaaaatggaaacaagggaacaagtttaataaaaataatgcttagaattatttattaatgaagcaatgtttcctgtactaagtaaataaaagaggaccaagattaaggcttatacactcttgaatttctactccccttaccccagtatctagcagagtgccttatgtagtgtcgacttttggcaaatatttatagaatgagtgattttatcttgctgaacacttttaaaaatcaatgacaagacatagaaaaaaatgcttattgaatttgtagcgataactgatatcacagaaaatagagttaacatttgtaattaagccgtatacaggatgaaatttaatacttgtcaaaatttatggatcagaagtcttaaaatattttttattaattgaattgctaatgttgactatcccagggaagtaacagagaatgggcacaaatacttagacccagtgatgttccttgttccagtacttggtagaacctaaagattagaaagaattagatgtttaacggtatgtgataggttgcatatactttgggcatccttaaaataaaatcttatccagtaaaagcgttttgtagaaatttatgtgttgatgtagaagtattttttacaaatatgttaattttaaaaggcaggtcataaaacaatataaacaatgtgatctaatgttgtgaaaatatataggtgctagctagagataaatgcatgaaacagattgggaggctatacatgaaaatgttaggggtagatatctttgcatgatttaattataggtagctttgttatatttgtattttttcattatgttttgatgaatgtgaattacttttgaaaaacaaatgtaaaactattctctatacaagtatagaatgtgttctggaaaactgcagttggtgctgattttacatttcatatatagtttaaaaaatgggtctggatgtatgattgccccaagctctggatagctagcagtgcagcatggcagctaagaagacgttaattccaatcttaagtgacatcacgagaagcaaaatctcttggctatgggcagcagtgactgctctgggctccacagtgggcaaagcacagtgataattttgcattcatttcttgcattgttttagaaaagaactggcaaactagggaatccagaatacaacaagcaggtggtaggcatctgccatgaacatggcttgcccagaaaaagagtctattgggaagcgttacctccaccatccttcccaatctggtgtctgttttcttttacataatcctccctgagtctccaccactaggaaacattttgggatggttcctcagaataacacatgtgcctgcatggagggtggaaaatggtttgagttgtagttgaagttagaccttggaagaatagtcaggccatcatgaggatagctgagccaaggtgagcgggagaacaacaggcacaagagagagcaagagcaaaaatgcaagcctggtgggcctaatttgagccctgaaacccagatcttggtataagagcagtgaaaaagggtagagatcatcagcaacagcaagctagaaagatggctttggcagtagcttttcatgtgcctcaggtcaggaagatcatgttatattatactcattcaattattcatcaaatactacctgagcccttgttctgttcttgaactgtaactaggtgctgcacctagttacacaaaaccgagcatcacgccaaaaagtcccagcccccatggaccttggagtccatatcaatggaaagagaaggaccaaatggatgcttgaaaagtaaacgatatattataaatttgcatgccctttttgcagaagaatcatgctcatgttgtatgtatcattactttttatcataaaatagccttccacatttatgtcttgatggcataatttagcttatgagcccgctgggaaaattctgtaacttatgtggccatctactactttgttgtcactccagaactactgagtggtgataacacagcccatgaatccatctctggtcatatttagagaaggttgcccaggtttttaggacgaggagaaatatgagacgtgttttgaatatgtggaccttagggtttttcaatgtgggaaaagagaatcaaatgaagaactgaaatttcaaacaaggactattgaaaggagacttgtttaccctctatagagactgaatcaattaaagagtggcctcaacttaaagctgaagcatgataggaacaccatgccatgagccatttgctctacttggtgatttgaagttttatgcttagagcttcatgaaactcagaatgaaaccatagtcagaacacacaaggatatttgctattgacaatccagttccaaaaatagcaaaacaataatttctaggatatctgatttcaaagatgtgcagaaaagggagaaaagaacattattatattggctaggcacagtggctcatgcctgtaatcccagtgctttgggaagccaaggtaggaggatcacttgagaccaggagttcaagaccagtctgggcaacatagtgagaccctgtctcttcaaaaaaattttttaaaatagccaggcatagtggcacccatctgtagttctagcttctcaggagcctgaagcagggagatcactggagccgaggagtttgaggctgcagtgagataagatcatgtcactgtactacagcctaggcaacagggcaagacagtctctcttaaaaaaaaaaaaaaaaaaaaaaaaaaaaagaacataggccaggtgccagtggctcacacctgtaatcccagcacgctgggagcccaaggcgggtagatcacaaggccaagaaattgagaccatcctggccaactttgtgaaacaccgtctctactaaaaatacaaaaattagctgagcgtggtggtatgtgcctgtagtctcagctactcaggaggctgaggcaggagaattgcttgagcccgggaggcagagattgcagtgagccgagattgcgccactgcactccagcctgggcgacagtgcgtgaatctgtctcaaaaaaaaaaaaaaaaagaacatagttacatggtttgtgaaatttgataaacttggatctgcatttccattctaccacttacaaggcatgtgattgaggcaggttaatatattcgagcctcctttttctcatctgttacaaaatttaatgaagatgaaaattctgccttgtattattgttaaaagattttatgagatgtgtattgtgaataccaagcacatatcaatgactgtttcaatgtgagttcactccccaaacccccattagaatcaaataattagaggcaagcatgggttttgactctatagccagtgatacataccacagcagtacaagaaactctatcatgtgtgccaggcactaaggatgcaactagaaatgtggataaaatgccaaaaacaccttccaatacatgtaatgaagacttcaagaattcacttgtaatgttacttttatcatttgtattgcattcaattcaacaaacattgattgaatgcctacaccatacatactcattccctagtttagtagaacctcagagagctactgcattctgatgtgaggtcagaggctgttgtttcaagtctctacttctgacattgagaagttttcagtccctaactatgcagggccagtttacttgactattatgctccacaaaggtaaaacagagctctatcagcttcacgaattaacaaaagtaacgctttccatatagtaggagagcggatatttattcaatgaaaaaaaggaagaaaaaaggaacggatgaaagaagggaagacagacaaagagggagagagagatggacagtcagacactgagacaaacagagggtggttagaaagacagacatgaggacagtcagagggacagttagacaaagggacagacagacagaaaaacatggttatttgtccttttgttctcttatctttggaccatgacaattcctacctgcttcaaaggactattgaaaggaacatattaaaaatgagagaagcattagattctgaatggttatgaatagtgccaatattaggtggcaagtaaaacagacaaatcacactaacatagagtatttgatatttaaaaatttatttaattgtggtacatcccgataatgagatatcattcagcgctcaaaagaaatgtgctattaggctaggcgtggtggctcacacctgtaatcccagcactttgggaggccaaggtgggcggatcactcaaggccaggagttcgagaccagcctggccaacatagtgaaaccctgtctctactaaaaacacaaaaattagccaggcgtggtggtggatgcctgtaatctcagctactcaggaggctaaggcaggagaatcgcctgaacccaggaggcagaggttgcagtgagcagtgatcgtgccactgcatgccagcccgggtgacagaacaagtctctgcctcagaaaaaaataaagtaaaataaaaaagagaaatgtatcaagccatgaaagacatggaagatacttaaatgaatattaccaaatgaaagatgccaatctgaaaggactatagactgtataattccaactgtatgaccttctagaaatggaaaactatggaggaaaaagattagtgtttgctaggggttaggagtaggggtggggaagataaataggtggaccacagaggatttggggggcaatgaaactactctctatgatactataacggtgagtgcccaacatcaaaagtgaaccctaatgtaaactatagactttgggtgataatgctgtgtcagcataggtctgtcaattgttacaaattataccaaaccggtgtgaatgttgacagtgggggagctatgcattgtgggagcagggaatatatgagaaatgttggtaccttccacttaattttgctgcgaacctaaaactgctctaaaacataacgtgtgttaaaataaaataaatttatataatctgcatactgaagctaatcaatcttcacaaaaacaatctggaataagaggtcagatccattcaaagcttttaagttgagctgcttggttattgaagtgaaccagcccatgtctcccctggtgacatcacctagtcaatgagaagctgacagcaaccaagctcaacccctttcttagaagtagagaatcatttgtgatggttcttccaagacaaaagcctctttggcctctatccccttacaaaagtctctggggcaagttgaaggtgccacatagatagactctgacatgggatccaagctgcagcttcagagggaccctagtgggtaaaggctggcagttacgtgactggggtccaaatggggtcaagaagaggagctggggagagagaattactcacccaaagtgctgggactaagaaggtttcaatcacccatgaaaaaatctggacatttcaataatgaaacctgaactctgcctcccacatcagtgagcatcttggccttcatcacactaacaactttactgctcacagggcttccctgggaatgggggccatttccaactcatgacagccttcgcttctattcagcctcacctcaggcagggcctgtgtgactgcgagtgaacagggcagggaggttcatcttgtccaaggccctctttctggagggaaaatgcagggacaggtccattaggtgagatgccatcttaatcctaaggcaggcttgctgataaacatcagcagggcaagcactctacattgcttttcccacagtaggtatgggcgaatggtgctaagccctcttctgaacacccttgtgaccaagggcctgagttcacaggctgcttgacctggactgagacctgagctggagttgagagaagagatgggcggccttgcctctgttacaggctgtggggaaagaattccatggctgtgggcctagtttctgcattcataatagaaaggggctaggccaattgattgccaaggtccttcctggctctgatttcccctacaggctttatatctgtatgttagattctccacctagccagggatccaacactaggcactgacacattagtccagtgatctatccaacagaaaccagcaaccatagctcagggccagggaacccctggcaggagactctggcatgccaaacctcacttattctcccattctagccaggtgagcaagcatgccttaggttgcaatccaaagtggaactacaacctgaagagcttattccctcctttttgtttgctctaagacacctagagcagcccagagcaagagccttccctacacacagctgcagcccctaccaaaataacagctgcaacggccagcaatgaatagggcccttcatgtgccagccacctttcagtgaaggactcataataacaaacacttcttgtactttggcaacgtctcagccaaatatcacaataatggccaggctctaggcaatagacaagaaaaactccaatatcctagggatacaattcaatctcagcagccttaaacagaccaagaaaaacaagttgtgctctttctgggctcttggtatttactttttctgatgttgagtttcatgattcccctatccatgggtaggagcggggatggaaaaagcaacaatccatttttccatattgataatgcataagctagctgagatttctaaagcttctacaatttttcatttcttcttcccgccaaagcttacccagaagtttcccttaatgagaatttcctctgtttcatttagagtatgatgttcgacttggaaacctggaagccagcccttttcagactggcctttgctcatcagggaagtctcccataccacagtcagttatgtacataagacagagtagtactcaccttggtggtataaaattaaagactaaatgaaggaagcaacagacttcaaaagaaaagctatcccctccacaaaggaaggagatgagaacaagaatccatggaacagcccggatcactttccttttgtcattagtgagcccctgaggacggattcctgtttgacgtggagcctgtacttttgacaaagtccctgaacatgacccttaaattgattttaaatccctcttcagaagaaactgaaatgataaaacacacagcatcttttaaagaccatctgccagaaaccacccaacagatgggggcttaaaactctgttagcctgaggcctgccagtctttgtttaaactttaagagaactgcaggtgttaaatgggccccaggtttgcaggcttctttagggcacaggttctaatgaggattctatgagaattgctagacaattggatcaggacaggcctgcaaggctccaaccaagcccattttatggttcacatggaggtctcgagatacataaaatctccctctgaaataaaaaaaaaaatgcttagaccatgttttttttttctttaattgaaaagttgcaaagaaggctctcagagaacattgggtttccatgccactgcatgcaaaacttaggcctacaatgcaaaatacctaaatcttgcaacttttcctattttcatattagtttcctacatgaccttgggactagcagatgccttagggagtatttaatccaaactcaccacacacaggaggaaactgaggccccacaggaggagctacttgcctaagactttgcaggatgttagtggaagaaataagatcccactatggtacagtgtccttcctaatatctctgctactctgggtctacagtggtgggagagacactatggcagggggtgggttggagaaagacaaagaagtgtgctattctagttatctgttgctgtgtagcaaacaaccccaatacttagggcttaaaacaatgacagcatttattttgctcacaaatcttcagcttgggcaaggcttggttggggcagcttgtctctggtcaactctagctcgcttgggtcattcaaaggctgggggctggaatcatctgaaggctcattcactcacatatctggtgggtgattctgacttttttttaattaactgacttttctgggaaattattttattgattgattgattgagacagagtctctctctgtcacccaggccagagtgcagtgtttcaatcacagctcatggcagcctcgaccttctgagctgatgctgactcttggctgggatctcacctggggctttagccggaacatcatctgtaagaggcctttccatgtggccacttggcttttttacaacacggtttcaagatggggggtaccgagagagagagcagatggaagctgtattagcttttccaacgcaacctcagaactcatccagtgtcacttccactgcattctactcatcaggcatgagtgacccaggcaagtccattttcaaggagaagggaattcgactctatttttgaatggaaggggtgtcaaagaatttgtggacctgttttaaagccaccacgtatgccaaagatgtctttttctaccacatgggttagaaagtgaggaatcgattttcactgttttaaatacacagccccacaggaaagtgtgctttactctgtgcctaccatatactaggcactagactgaatggtttgtatggctatttcatttcagtttcaatcctgacaacagcagtcacactcacattttaccgaagaagaaactgagactcagagatcatctaatttgcctaaactcactgaattaggaagtggttgaggtagattttatcccagatctggactgaaggctcactctcttttcataacttcctgcaacttcctgccagcttccactgaggtgggaaactgtatccctgctggtacaacacccctgaaaatgctgggctctagagaagtttgatataaatgaaccctccaccatatataataaaatgagcaaaaccttccctcccagttgctggcaaggtctacttcttgtacagatgagaagaaagctggggctctcaatttgtttggagtactcctggtgaaatcgtgtctaccttatgcactaatgaaaggatcagtggttctttgcctgacacaatctttttcatcctttggacccagcttaaatgtcacctgctcaaaaagtccttctcagattatcctatcaaagtaggtccccgcttagcagcatgtcccatcactgcccatggtttgcctccttcctggcatgtatcccaaccaataattacacacgggcttagtcacttgcttattgtctgactgctaccatagtgcctggcagagagtaggtgctaaataaatatttgttggatggacaaatgactgaatgagggaatgatcctagactgtaaaaaccctgagatctgtagagcttctactttttacctcagaatgctaggaccacaggtccacactctcaagccccactatggaaaaatcaggtataataatagcaatcttaatgaggcacttaagtataaatcaggtacttttccatccccttatgattattatctcactgttccttacaacaaccctgtgacataggtattacaattattcccactttacagatgaggaaactgaggttcagagaagatacgtaacttgccctaagctaacaccactagaaagaagcaaaactaaaggttcttactgagatctgtttgactccacagcctgctctatcggctattaggcaatactgccaactatgggtttctttaaagttttgattaaaaaaaattaaaatgtagctagagatcagttttaaacaattaatttttatggaaaatgacaattgcttacttgactctctgacaacacattactaacacaaaggactgtttggactaggtccatgcatgctggtgacaggtacccaaattataggatcagcatttgtgagcctcttgaatcttcagaatacaaatagggaatggtgcaacaaagtttggctttgcttgaactctttaaataagagggtgacttgatctaaattattctaagttctcagttttctacccaggcatagggtttaatgtagcacgtggctctcatgccacctccagcatttcccttagttgtgggttgtgatatggtttaggtaacttagagaaaggttaatgagaaacctgacattttctgggattcactgaaactctaggtccttagtccagtttggggaggaaagtgcctgtaatttttcttaggtgctacctttgagatatctgttacattctaactttcatgttttctatcagtccattgtgtttgaaccatatgcctagtgtcttttcacctgggagagaaaattagaaaggcaaatgcaagccattctactcataatgtttgtgcagaaacatgacgaaataagccatgaggatgttatgctaaaagaaaccacagtccctgagatgaatctcacacagccctctattcctcacagaatctcaaggttggaaagtactgtaggaagccaccaagtccaggtcccttctcaaagcccttggcaatgacatctgacctttccttcactagttccaagtgtgtgtgtttgttgagtgggggaggtcactctatttcatgagtggccagtgctgactgatggaaaagccctcctcaattaaaactccagcttgacctctctcaaactgtcctatggaaaactagagggaaaacagcccatttcttctcctctaatcagggctttattcacaacaatatgttccaactagtctgaaagtttacaaacttatctttgaaacaggtgctcttaagaaagatcattttcatattcaaatctaaaaacaaatttcagaaacaattgtctacaggtaggagacattaaaaaataattgtttaatgaatgaatgaatgagtttactcacaccaataaaaatggaagtttcctttactattgagttaccatcaggatacatcggttttggagtgacaggaggagagcatctcttggacctcagagaggggctgatgtctctgtctcccttcccaccccatcctgggagacaggtagaagcatcagtttacatttttatcccctcaatgtccagcacaggacctagcacagagtgaatgctcaataaatactccaaagaatttccagtaatggaaagagccccagagaccatttggcccaatcattttcctcccagaaatataaaagagaaacaagtcagtaatttcttgtgggttcctagaaagcccctcccccaccaccaaatccaataccttttcatctgcttttgatgcctaaagttcctttgatggaagtctagagcctgtcatggcacacattgtcaagctttcccttctaaagtggcaaggtccaaaggaaagataaattaacctcaactcacactaaggtataaaggacagtgggcagacctttctggaaagctacataaaactaactagcaacgaaagaatgagtcatgtgaatcctaaatctctgcttctctgagctaggtatcatctaagctgatgagattgcctacctgtctcctctgggaaaacaaaaaagcagtttggaagggcggtcaagtggacttcccttcttaaaggggttgcaagacccacaacaagagatccacatggtgcctttgatgtgacactcgttaggtgtggatcagctctccagtgctttgcaaagacatctgttaccctgttaatcacatcctggacaagctccaggatgtctgagtcaggacccatgggacactagtacttttttaagagcccttggtctaccctagaatgacactttctactcaagggtgtgttgactaaactatgaatcagcagcccacacatagcaagtgctctaagcatatggcccttggcaatgcttctcaaatgttaatgtgtgtatgaatcacctggtgatcatattggaaatgcaggttctgattaagtgtctggggtggagcctaaaattctgcatctctaacaagctcccaggtgatgaacatgccgctggtcaaacactatacattgaataggaaggttatttctaaaattcactgggtgaaagaagcccgtgggaagcatgttgaacagacacaatcccaggtcaccaacctcaaaggttttgattcagaaaaactgaaatgggaccatagtgtatacatatttaataggtatccctcagtgattcagaagaaggcgcttagtcgatggtactttaagagatactaacatatcactttttttttttgaatcacagtctcactctgtcacccaggctggaatgcagtggcacgatcaaggctcactgcaacctctgcctcctgggttcaagcgattctcgtgcctcagcctcccaagtagttgggattacagtcgcgagccattactcctggctaatttttgtatttttagtagagatggggttttgccatgttggccagctggtcttgaacccctgacctcaagtgatccacctgccttggcctcccaaagtaagagatactaacatatctcttgaatgatcatactgaaggtgtgtcctctggcctgttacagaagagaaatacctgacatccacgcctcctgaccacttaggacagtgactgtcaaactccaaggcacatcaaagtcacctggagggcttattaaagctcaaagagctgccctcagtccccagggtttctgattcagtaggtctggggtggagcccaagaattcacattgctaaccagttttccaggaaatgctaacattggtggtttggaggtcatgctctgagaacctgtgatatagatgaaaggtaaccttttaaaaatcaccagaggagcttttcaacccacactcattatgaaatgcttggggacaccaacctatgtcttttacaaacagcacttcagttgctaagcacccactcagagaacaaatactccaaaggaaaggccccttaatcctgaatagataatagttttaaataaatattcttaggaccccagagagacatgtgggactgctgaccaactagacccaggggtctcagacagggaagacctcaggcccaaacccaaggaaaggcctaacagttgctgagcaggagggaagctgctccatagggcggtgggcccatcgttctcagtccccaaagcaaaggaggtcatggctcccccacagcccacagcatctccaaccccctgagcccagccatttattagcccacataaggcaacttcagtttagccgaacagcttatctataatatatggaaactagagagacacttgttcattgagatcttccccaaatttatcaagacagggagagaagaaatgagttgagtcttcctgttccacggaataggaacacattctacctggacctatggtaatcagaagtgcagtgctcctcccctaaaacactccagacccttgaaagcaggttcatgtcattatctcaagagcagcattagccaggaaggctaatgagggctccctgccaggaaggaacagcctagagatgcatttcaggaaagaggcagcaggcagagaacagctgccccagacagacagcacatccgccgagggcatgattgcatgggactcgagaagtatagtaatgcattgcttaacgatggggatttgttctaagaaatgcatcattagatgatttcatcacagtgtgaacatcacagagtgcatttacacaaacctagatggtagcctactatatgcctaggctatatggtatagcctatcgatcccaggccacaaaccaggccacagtacagcatgttactgtactgaatactgtagacaactgtataacaatggtatttgtgacctaaacatattaaaatatagaaaaggtactaagctgggcagagtggctcatgcttataattcaagaacctttggaggccaaggtgggaggactccttgagcccaggagtttgagaacagcctgggcaacatagtgagaccccatctctacaataaattaaaaaattagctgggcatggtggcatatgcctgtagtcccagctacttgggaggctgaagtgggaagattgcttgaggtcaggttgattgcttgagtggagtggagtgtaacggaacagaatgggaaggaaggaaggaaggaaggaaggaaggaaggaaggaaggaaggaaggaaggaaggaaggaaggaaggcaggcaggcaggaaggaaggaaggaaggaagaaagggagggagggagggaaagagagaaagagaaagaaagagaatgacagaggccgggcgtggtggcttgtggctcatgcctgtaatcccagcattttgggaggccaaggtgggtggatcatgaggtcaggagttcgagaccagcctggccagcatggtgaaaccccatctctactaaaaatacaaaaattagcagggcatggtggcctgcgccagtagtcccagctactccagcggctgaggcaggagaatcgcttgaagccaggaggcagaggttgcagtaagccgacactgagccactgcaccccagcctgggcaacagagcaagactccatctcaaaaggaaggggaggagaggggagggaaaagagaagaaagaaaggttacagtaaacattaaagataataaatggtacacctgtatagggcatttaccacgaatgaagcttgcctggactgaaagttgctttgggtgagtcagtaaggagtggtgagtgagggtggcctaggacattactgtacactcctgtacattttagaaacactgtacacttaagctacactaaatttattttaaaaaaattaattgtgctaggacattacgatggctatgacttcagcacgcgataggaatttttcagcttccttataaagcttatgagaccgctgatgtatgtgcagtccttcattgcctgaaatgttgttatgtggcccgtgactagtttgatttgggttctgcctgccccatggtctcggggatgggaaaggcgttgagttgtgtgtttatggagtgtgagcatctcagcttcttgtaatcccaagtaataactgcactttctgttcctcttgccttctgctactctgagttaatgaataacaccaggtaactagtttctgaggcagcctaggatcccaattctcaggttcctgcttgtatgaagcaccattttaccgaaacttagggacaattctgaggcagtgaccacctttcatgaggtgacatgttgccaggcacagtagaagcaaagcaagtgtccaccacgtcttcatgttctagatttttagggacagttcccagctcaagtattctgtcctcttgttcaaccaataagtactaattagtggtgatgaaaatatacataaaccctagagatactggttaaggatgactataaaacaacaatgatgataattgtagctaacatttttgagaccggagtggtagaggtattatccccattttagaggtaaggaaatagaggctcaggaagctaagataatagcacaaagctaacatcatctaacctgagtctgtctgtcatcaaagaccttacctgtactctacaaagacgttctgaacttatgatggcataacttaatgatcttctgactttatgatggtgcaaaagctatgtgcattcagtagaaaccatattttaaattttgcctttttttgtttatttttattattataaaataggcattgtgttagatgagtttgcccaactataaacttgtgtaagtgttccgagcacgtttaaggtaggctaggctaggctatgatgtttggtagcttacgtgtattcaatgcatttgtgacttctgctattttcttttctttttttttttttttttttgagacggagtttcgctctgtcgcccaggctggagtgcagtggcgcgatctcgactcactgcaagctccgcctcccgggttcacgccattctcctgcctcagcctcctgtgtagctgggactacaggcacgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggccgacttctgctattttcaacttacgatgggttcatcaggatgtaacctcatgctagctcgaggagcttctataccctgttgtttctgctctcacatcctgtactgacactgcagaatagccctgaaggttctccttcctggaagaaggagcaacagtcttgtcatctgagccagctctgccaaaactgcttttcaaggagcgaaaggactcacccaagactgagacacacaagattttggactggtacaagggaaggggctttcctggattgatgcctacactctagcagcagcaagtaccccaatcttcagactcagacccagcccagggtcacaggtttatctccttcactaggaccattcaggctcatgtcttccttgtctccaccctgctaactgtctacaaactcagaaaaggcctttgaatgtcacacagttctgcccgtggcagaaacacacagaaggagaagaaaataggtggggaacttcagaatgtgccataagatagaaactcctccaatgttcccagcactgaagcattaaaataaaatctttggacaattatttgcctggatcgagaaagtaaagtcattttaggagctgccactaatcttaaaaaataacaagtgcgatttgatctgtgcaaggaaccagagtgcttgaagatttctctgccggaggctccgcactttcatgaggtatcgacaaagacccaagggtaagttacgggggggagcacgaccactgtgagcttttgcagaagtagtaggaactggctaagttaagatcaatgatttccttgattgcctggcttccccctctcttaagcctggtctccgtctcaatttccattcctatcggccagaaaaataaagattgtttacagagctgaaataacacctgcttggtttatcttattttagaaacaataaaagctagggagttggagggattaaggagggaaaaaatcaattgtgttctttcatgttggaaacattaaaaaataagtcaccctgctacctgctctaaggtccaatttggctctccattacccagggcaatttccaatttcatcctgcaatttcccaaagtttaaactcggctgaaccataactgaatgcccttgacagactccaagaaactttttctggtcagtttttgacaattccaggccatgaatctgatgctagacatgccaaaagaaatggaaatgtttgctttggcattagcaccaaaatacagtcagcagcccgagtctggctgaatcattttgaatgtttttaaaatgttttacatcttgttatttcacagcatctttgtaagaaaagtaaagcagatttgctccctctcccaccgaccgcgcactatacagatgtggatgttggaaaaaaaaaatccaaacaacaaaaagagaggaattggctggccccaagccacaaggataatagatggttaaactaggttagaatccaggttttctaactcctaaggcagtgctcattctgttctgctctagaccatgcacctttgcaggatgctgccagcccaaacgcaggagtgattgggctcatcagataagaaagccacgtcctcaaatccaggctatccaagggtggccacagcaagttcagcaggatgcagaatatagcagcctttctccctgcctgcatctccccacaaaaggagctttgaaggaggacagggcagtttgaagtgtgaccccatcatacacttcacgaactagcataccatagcccctgcttgccctcactgagtttaagcatgataccagtcactccctgactcagtctcttcatctgtgatgaggaataccaaatattctacagcagtgttccaacatagggggactccatctctacaagaaattaaaaaattaatcagatgtggtggtgcatgcctgtggtcccagctacataggaggctgaagtgggaggatcgcttgagtttgggagcttgcagctgcagtgagccatgatcacaccaccacactccagcctgggtgacagagcaagaccctgtctcaaaataataataataataataataaagtagagctctaaacttgtctgggaataaggacggtttttaggctaacaatatttgccaatccatacatgttggtatttataccttagtggccactaatattatttctcagaaaaaagttctaaatgagtttctatttttctacctacaacagcttctacatccatttgacaaatagtagtatagaagtgttcaggacaaaaatgtctcttggtctcaggagatgccggacgccagcatggatgtgcagatgggaagcctcttctggaagacccccaccccagagccggcaggaagcaccgtgattctgagcttggttgcctgtgaaggaatgcttataaagtttttccaacagcagcttctctaagggtaccaactctgggagtgggaggctgaagtgacagtagggggtcagtgaggaaccctctgggtttcctacaataaggcgatttcacgcagaagctggcgaccagcactgcagccaggggaccagccctctttagtcagaaacacctcaaccctgcactcaaagggactcatggacttggagtccctgccggtgaatggccctgtgtgagggcctgtgctgcatcacaaaatgactttgccaggaagctctagagtgtcaaacatccacacatccttggctctgggctgaggaaaatcccctggttggtgctttaagaaggaaccttgcggttttaggggaagaattctccacggacctattttaccacagcacctatttctgcagactatctcaggtaaccggaatttcaaagggcccaggatggaaaacgttagcttcaagtcttccttctctggaatggattccgctgagtagaagaaggctgggtttgaagagggaggaatgagagacaggctcaccattccggggtcccctgcatgtgccaggcaacaaactgagcacattatatcccttctaattatcttgttttttacgaggcacatattagtacccacctccccattttgttagtggggagattgaggctcatagagcttgccaatgagaggacacccagggctgactcaaggctgtgctgttcctgcggggctgtcactgccaaacagggagtggcaaaaaagagtcgcagcacctcaagcacctgtgccgcatcacccatccatccatcagtcttcagacctgtcagctcagccctttctgccagtgcttaaatgaactgaaaagaataacaaacccaagttttaataagtacatgcaaggaggctgccgttggcccagatgcacctcagttgtgctgatgtaagcatcaagccagaacacaaaaagcccgagcactgagcgggactaataggtttctacacacagtggcaaggagcccacatccttgggctccctgcactcctttatgctccttgaacattctgggcctaccccgcctccaggcctttgcacatgcagttcccttggactacaattctcttcttcccccttttcacttggctaaattggtcttgcttcatggctcagctcaaaagtccatttcccgggaggaccttccggaccttttaaatgctctcaagactcccaggacttttgttaacaactcttttcagattttatactttgtcagtcctaagtatctgtgtcatatctgccttcccagctaggttgtaaactcagaaggggacaaggaccctgtctgtttattcactaccctgtctcagcatgtagtcaatcctctatatactgtgttgatgtctttataactatttccatgactctgaagcaagccccttagcaaagtacagtagatcatttactcattgatttttttttttttttttgagacagagtctcactcactctgttgcccaggctggcatgcagtggcacgatctcggctcactgcaatctctgcctcccggcagattctcctgcctcagcctcctgagtagttgggattacaggcacgcaccaccacgactggctaattattgtatttttagtagagacagggtttcaccatgttagccaggcttgtcttgaaatcctggcctcaagtgatccacccgcctcagcctttcaaagtgctgggattacaggcatgagccaccgcacctggcccatttattcttcaaatatgtgccagtcactgtgctagggattaggaacattacagagaacaagatcactaagactctcactccaggaagctggcattgccgtgggagagcagaccatgagcaaataacacagataaacagtatcagggagaggtaaatgctgtgatgacagaggaaagcagaaagggggctagagagagagcaggaaaggcctttccaggagttacagttgagcaggatcctttgtgcattgaggcagtgagctctgtaggctagtagaaagaaaagtgttctaggcatagggtgccatgggtgcaaagcctttaaggcagtgtccaggaatggccagaagaccacaatagctatagtgaaatgtggaaactggggagcagcaggaggaaaagccagacgggcatcttggagcaggtgatatagtaacagctggtactcctgatctcttactacatgccacatactgttccaggtgccctagaggacaccatcacccccattttgcagttgacaaagccgaggcatggaaaggttaaccactcacccagttatatgagtggcggagctgagatacgaacccaggcagtgtgatccagagctcatactcctgctataccaccctttcatgtcctgtaaggaaggttaccaagtaaaatacaaaatgtctagttttatttgaatttcagataaaaagcaagtcattttttcatataagtatatcctaaatattgtgcaagcatcttgtttttgtttgtttgtgtgtgtgtgtgtgtgtgtgtgtgtaatctgccaatgccactagtaagccataataaactttggattttgtctaaatgtggtgggaatccactagagcagaggtcagcaaacatttttctgtaaagggcaagacagtaaatattttgtgccatataagaatatggcacatgcagcctctgtggcatattctggtttggttttggttgctgttgtttgtttataccagccttttgaaaatgtaagaatcattcttagccacacatcacaccagctgcagtttctgacccctgatctaaaggattttgagtagtagacagacagacatgatctcactcaggccttcattcttttcatgagggaaaacacacccattcccaagagatgatattcacaccttacccgcatcctctttttttttttttttttttttttgagacagagtctcactctgtcatcaaggctggagtgtagtggcctgatcttggctcactgcaacctctgcctcttgggctcaagtgattctcctgcctcagcctctggagtagctaggaccacaggcatgtgccaccatacctggctaattttttgtctttttagtagagacagggttttgctatgttggccaggctggtctcaaactcctcctcaagtgatctgcctgcctcagcctctcaaggtgttgtgcccagccccacgtactcttatttggggagcactgggggtggctgtgactttcccatcaggtagaggaacagctgcctgctggccttggtgttaggactcactttagcattaaggttcaaccatggcacctcattgacaagccactggttaaaccttttctcagtgccaggcttggcctacttgtgtctgggatggtgatttgactccagggtttcactgcccatgggatgtatcagagatgaacaggatttgtaccttgtagaccaagttcccttggcctactttctggatctcatccctttctgcattgaatacaggcacctggccctctccttggctccctcctcggctccctcctccctccccaggcactgctcaggccttattcatcatttgtctccatgggtgacctcctttctggcctcttcctgcttttttctctcattcttcttcttcaattaaaaaggctttagccaaaatgaattcctacctctgtcaggccttcaaattcctgttttctggacatttcagatttgccttgaagagtgtgtaagacaaagcctgttctcctttcattctcaccatgtcttactggggccctttatacacagccacctctcactgcctctttatagggtcggtgtttcctgtccaacaatttgccttctctgggaatacaggctaaatcttgctttttttttctgcaatccacaatccacacttcactttggacataatgaagacacaagaatataagaatatttattaaacgcagttcttccatttttcccatctcttttctgtgtgtgtaagctgtctcctccctgcttgtcagtctctcctcttgtctgaagttaaccagttggaatgcaagtctgcaagatggtcacacaagacctttttcttcattattgtactttcctattccttgagaatattcatcatctttcacctaactgaggttttctgtctgcctttccgtttagtcaactaagtgggcaagttagctaactgtatgttggcttgtatacaggaaatggcaagtaataataaaacagtcaagcaataccattgactgagacctccatgaggtactaaggaagtttgagagaaatcaaagatccctgggcatgcaagtgcatgtgtgtgtgcatgtgtgcgtgcgtgcgtgtgtgcaaaagtaagtggagagtggagaaagaggaatgtcactttgatttagccttctagggacaggatacagtgcaggaatctttcccttgacatgctttctgggaaatttccaatgtctggctttgaccactctggctgttttaaatcagaaacactctttggcctttgaataggtttcaaaatcatcacaagagagatgtccatgatttctctctttttgtctatattccagtcctttgggttgcatgatcttgtgaaatttgtagccagcgaaacccagtagtgataggcaccatgatgaacaggtctgagtatttatttaacactgaagattaataggtcactgcttccaacgtcgaaagccattgtcacattaattcatttgtgcatacatgatgtccactgctcctaagggtacaaataatagctttgccaatatgaaagcaaaacataattactcaacaataaacacactgtacactgggaacagctgttatcaacagcacttttgaagccaaaacaaagcaagtattacaggattttttttaaacctctgcctatcattctcacagaggtaaagttagttttgtttgtttggttttgtcacaacaagtgcaactaagctacaagtactttactcagacaccattctgccctcgctttcaggccagacaagatgcttggcaacatttttgtctagccagtgcccccctacacacccacacatccctacacacctacacacccctacacacacacacatccctatatacacacttccttttcctgatgctcagcctatctgtagagtctgttggactgagtgggtgggacttctggtgccaacacttactaactgggcaactccaggcaagctatttaaccctctcggccgcagcttcttcatttgtaatatggctgataataatagtacttacattcttatagagtgataatgaagtgagaaaatgcatttaagagtcctagttactataccagatacatagtaagtgcttgataagtgcaaatatcattggctaagctcctccagtgtagaacctcactaaggtccacccttcccagggatgtttccagtgcatttccatgtcaaaatggacccatcagactccattaagccccaatctttgctaactagttgatcaatgacctggtccaggtgagtaccaggaaattcacaagttatgctgtctgactggcagggtctttgactcttttgcaaagggcttacagacattattgttgggattactactaatttttatttgggggtagagggagtatttgaaactctggaacccaaccatgcagagaactttgcagacaactcaaaaacctatagtaaaaccaggtcagctgtcctcaacacacctcaacatgctctgcctccatccaagaactctgaaagagcttttggctgtttgcacacctacatgcatccagagtctcatggttctcccctacccctgccccttctgtcccaaggaaagaaacaactgcctggggctgtagacttctcaggaagctctaatgaatcacttctgcagttctgttcatgcctgcctggggacatagagccccctgcccagggagaacacagcccttctcttggaaccatgttgtagcaatgcagaatccagcagctgcagggttgacgtggccttagtagccccctactcactaacagagaatgaacttagggagtagacagggggctttgttgcattagaaccaagcagccctcacaatgatgaggttccatttataaatttgggacgtagtaaagtagataggaagagtgaataggctttgaaggcagatagatgtgggcccagttgccagtttttcctgccactctgtgatgtgggacatattccttgacctttggagctttggccttcctgtgttaaatgggagcaataggatgatgaatatgctctggctggaggagcaaactctcctgaggattagctctcccccttctcagctgaatcttgagggcagcatgacctcggggagtgtcagagttatgttcttcctggagatgtaaatcctttaaaagcacaaaggaagagtctgcactggaaagcaaagcaaaatagattggaaatgttcagtggaatttaagcaaagaatgcagagctgctctcctcttctgctgtctgctgggaactcactggggagtccctcagtgtccacccattaaagaggctgctgagcttgtctgtgggctccacatagccatacgtagatgaccccatctgcaaaatggcttgtcctctgtgaacaagagtcacctcctagacaaaaacagacttctggatggggtgagcaatctctccctttgggttccagtaacgagtccagaagcttagaaggactccaagccggaggcaaggagaatacaacgtatatttggtatctaatttagatggtttatttaaaaatcagaaagcattcacctctattcaaaaatggcccattctaggttaaattcttaattattctggaaaatgcaaatgagaaactataaatatagagtaggggaataatcgcaatctgcacaatgtaaattcaagtcaatcggtaaagggggaaagaaaatcatttgcctttgacattaaatccagctgttctttaaagttggttttccctagccaaggatttttattctctatgaccaaacaatgtccaaatccctctgagtttagacaatacttaatctgaacatctaatagttcattcttctctaacaccactgaacacttccattaaaccaaagttattattatcaacattatgaagcctgtcagaagcaggcccattgttcaaacgaattgacctccactacaattgaccttaacattgttcaactgtttgacagtcaattatctcatgatctcccttcaaatgggtctcgttgctgaaataactaatccattacagaggggaggttattttaatagctgcgcagagggttgcgttttgcagtctccccgtgagtatatattgtggaacaacttgtagcccttggtccatctgacaagaggaaatcattataccagatccatgtctcagcagaggaaaaatatgataataaggggttggtaggactcagttatggctgaagtgaagttagctcttaaaatgtagcagctcttagagacatagacatatgtggctctgaactacagaacagaagaggaaatgaggataagggaagcttaagcaaccagctaagatgttgcagccatgcaaggaggttagaggagagactttaagtccctttctagttccaagcatctatggcagggcctctttaaaagaaagggattggctgggcgcagtggctcacgactgtaatcccagcactttgagaggccgaggcgggcggatcacgaggtcaagagatagagaccatcctggccaacatggtgaaaccccatctctactaaaaatacaaaaattagctgagcgtggtgatgtatgcctatagtcctatctactcaggaggctgaggcaggagaatcgcttgaaccagggaggcggaggttgcagtgagccgagatcgcgccactgcactcgagcctaggcgacagagtgagactccatctcaaaaaaaaaaaaaaaaaaaaaataggactctgaagtcagatgacctgggtatgggtcttgtgccaccactttctagctgtgtgacattggtcgagttgtaaacctttgccagacctcaatttcttcatctgtacaatgagaataatagtatctatcatgtagggttgctttgaggagtacatgaaatgcatggtatcagtatagaatgaggcccgtaggtagacacctaaatagcattattataatcattataaatgccaacattctccttctagtcactttgagagctagctttttaccagatatgtgacctctaaggatctttctgcctggatggagaacttggcatttagaactgtaagaataaggattttctcagtccatgaatgaggcctaataaaataggacagttaataaaaataacgagtgcctcataaatcaggaaattaagtgcttccccattaaaccaggctcagcccccacatttatgggccactggagacccagctgcctcttgaggagctcatgcacctctgctgaagggaaactagagtgcctgcctggcaggtcacaggctatagcgaggattgagggtgctgtcccgctgcccctttcctatcagctttgagggtagtgctccacacttagttatgatttgtctgaggcccctgagattcctgaaaccttaactcatgtcccctaaccctagggcactgaaaggtgacttggctcctgttcacacacaatagagcccaggccaatagagggaaatgcagaggggaggagaaagaaaggggtagagaaagaaacagccttcttcagggccccacaccaactttcagggatctttgaaactccctctcgtaacaccctgtttattctgctctcacagccacctggggaggtggagatcactatctccaagacacaggcaagaggacaaaccctcagagacatcctgtgacctcctgtggtcacccagaaccagaatccagatttccttcaaccctaacccattgttaccagtgcagtccctatttggggtcaatcccctcatgttaccaggatgcaattcaaggaccatggcattcattacatgtgtccaagggtcaggctgaggccctgggttgactgcagggctgtctgagtagagctctccaagtgattgtggggagggtgggtccagccagagaggtgcctgggggtggtccctgagtaccaagtggtctagttgtatgctggatcctctcctagaggctcccaagaccccattgtcctcacctcatcccaagtttggtgaccacacttacagcttaaaattggccatggtaggagtatttacaccacaaatatcagtgaacgtcccaaatcaggaaaatagttcttcaacatttaccggcacaccactgaggaagcctcaccttttatttcttcattcatcaaacattcttagagcacacacttggggccaggcactgtgagagtcactacatatatgaaaataatggatcttgcctgcttatgttgttctgtcactggcttaatatatcccattagggtgggcagggactcccaaaagcaaagacattcaagtccagtcattttggtttatgtcatcagcttcaataataataaggttgcaagaggatttaaatttaaggttgctatatcatgttaaaatccttggatgccccattttcatgaaatctgtttctggttgtccttctgttggttattgatatgatttggatttgtgtccccacccaaatctcatgtcaaactgtaattccaaatgttggaggtgggacctagttggaggtgattggatcaagggggcagatctcccgatggtgctgttctcatgctagtgagtgagttctcgtgagatctggtggtttagaaaggtgggtggcacctccttctctctctctcttgcttctgctctggccacatatgacgtgcctgcttcccctttgctttctgctatgattataagtttcctgaggcctccccagaagcagaagccaatatgcttcttgtatatcctgtagaactatgagccaattaaacctattttatttataaattacccaccctcaggtctttcttcaaagcaatgtgagaatggactaatacagttctgtgaaagcattgcccaagtattcattctccatgactttctcacctgaaaatgatcgaaagttttgaagtatatagagtggcctcttatggtaattctccccttccttcattttctcactgccctatcccagcttctcatgagctctctccaggattgttggattaagtgatctcctaattgatacctctgctcccatccctcatcatgatgctgctatcagagtgagcttgcttttatttttctttttatttattttttattttgcagaaacagggtcccactacgttgcccaggctggtctcaaactcgtgggctcaagtgatcctttggtctcgtcctcccaaaatgctgggattacaggcataagccaccatgcctggcgcttttagaataaaaaaagagtacctttttttttaaatttaaatttaaaaatgcatgtcaattttaaaaacttggaaaatacaaatgagcaaagaaataacctctaatctcatcaacaagtagtgctcaggtttttctcttaatatttatatatacacagtggtgggctgggagatgtttaacaagctctctgtttttttaagcccttatttgtagtatttggcaatttccataataaatacttccacttggcttatttcatgctaccaacatgatatcactgaacatggacttggaaagagatgctagcaaatcagatcttgcgagcttatgtgagctggctgcagtgcaccactgtaaaactcatatataatttgaagtgaaatgtggaaatgctttgtcttgctttgtaacacactctttaaagtcttttcatgccaatgaatatatatcactaatataattttaattagctgtacagtattttgttgtatcaatgcataattaactcaacagaatccacataaacattatgatttttgctggtataaacaatgctattatgaacataattacaaacagatctgtgtggacacagcaatagttccaattcagaaatctggttcttgcctccttcttaaacatctggtatggatccttttgcaccaccacaaatcccaactccttcacggggttgttcagaacccttcaggctgcttaggatcttccagtcctacaagcctggcatttattcttacacagcatagctcctttctctcccccagccaccatgaatcaccccatgttctcaatacaaacatatttgcctcacatatttgagtattgactccccagtctctgaaacctccttctcttccccaccacctcctgttcattcatcaagacataccctaggcagtgaatatttcccctgggtctcccagcattgcacagacacctctgttatggcatctaaacaaatatctgtgatctaaatctatgttgatctgtctactcagcaggaccataaccctttgaggatatggtaagaatgagtcttcctcatcttcatatgcatagtaactagtatcaggcctggagcaaagctgaagcttaataaatgattgttgaatataatcctttatgtacttttccacctgccatcctctgcatgatttactttctgacagaaagcatgaaagtgtccctgacagacctgaaacccatgtccaggagaaaaggagaccagtgctgacagcttctgagtgtatctcctcactttcccagagcctgacctccaaaaggctcttctagaagctgtggaacaccccagccttctgaggctccacctggcccctctctggaaaaacagcaatccaacccaaagagggcagagttgactttcttaactccaaaatctcttacagtgacaatgacatctagttttggcaatgtactacaaaataggaaccacagctatttataacttttaataggacctactatgcaccaggcactgtgatcaggagtttacatataatttttacttttcatttgattctcacaacaatctgatgaagtgttcattagtaagaagatcaagcttaaacaggccaagttacttgatcaaggtcacacaacttttaactctgtctcccaataccttcctaatgtttactgcaactttttaaaggcagagcagggataaatgtcaagagatgggggctcagcaggataaatgacacagtcaaggtcaaatacctagaaaaggagatcatcccagttttcccaggaccgttgtgattttaaaaatgaaaaatctcatgtcccaggaaacccatcagtccctggaaaaccaggatggctggtcatcctatgaaggcatagaactcagggcctctggctcctggcatagtgctctttccatcacaaacatatgtcctactttctcacttcatggagggcctaatggaagatacagtcattaggatgcgtgtattcattttcccgggcccttagtgaaataggcattttggaatctgtttgggacatcagtcactcaggctctcaagaagagacagaccccagctggacatgttctttatagtacactccagtgatgaaatgcccagtttctcccctgcctcctccccctgcctggcacacctggactgctgccactcatctgtataatgtgcctggcgccatctggcctggcatcttgtgtcctgtcaacagggatgtcaaacaggcaagatgaaaggacataactccaaggaacattgtttgtcttctagccccagtctggggaagtcgtgatgattactcattaggtagctacaagggaagaaaaatgacttgttactgtccgggtgacagttggtgcctagaacagtctttgctatttcttgtcttagtgagtcttctggggagcatcctaggagtttcaaatgaaggtggatatcggctggagtatcccaagaggctcccagggaattttcatggcttagagatctgatgacagctgtggccacgtcgctggctctgcttgcagtgagcatgcccatcctctttgtgaaagtggcaaacgggacaataaacagatttagcagagctggagctctaaaaagcccaatccacatcttctatctgagccagccttagaattctgggtaaacgggggcccagtaaatggtaattaaacaacttcagggagagctgatggctttttgagaaataaacctccccagggaatccacctcaggaaatctactcagtatactttcttggtataaagcaagaaaacattgcaaagaaagacagatagccttgattgcataaaaatctaatactaatttccatatgtcagaagatgtcaaaatacaagtaaaaaaggaaaataatacactgatggaaaagatacaacaaagttccattatattggtatataaagttcttaattaaaaatgataaatctcaaaatattaaaatggacaaaatttgaccaggtaattaaaatcaataaaaaataattacttgatatctaaactataagaggaggtatagtttaacaaaattataattttattaaattatatatgtctgtgtgtgtgtgtgtgtgtgtgtgtgtgtgtatatatgtatatgtgcctataagcaaatatttataataaaatgttaaaagtggtctggttaacagtaactttaaattttttctttatcctttttatcttttttttttaagacagggtctcactctgtcacccaggctggagtgcaggagcacaatcacagctcactgcagccttgacttcctgggctcaagcgatcctcccgcctcagcttcccaagtagctgtgactacaggtgcacaccaccatgcccagctaatttttgcattttttatacagatagggttttatcatgttacctaggctggtcttgaactgctgggctcaagtgatccacccacctcgtcctcccaaagtgctgggattacaggtgtgagccacagcatctggctaaattttttcttcatagttctctttatctctcaaatttcccacattgagctggtattacttttgaaattatgaaacagtatttcctattaaagaaggcaaagaagtatatggaaaggggttggagtctcttgacttccatctttccccagccctatttttcccatcagtctgtagaatgacgtgtctcttcatttctaggctgactttcacttttttctgtgtcttttttcatgacaaatagagagtaaggaaagctcacgattacagccatcacttctttctttagccaccaagatgtcaacaggcagaagttggctccctgtggttggacaggagaaaacagcacccacctataagctccttgagggcacagacgagtgcaccagtatctgagcctcagcacctagccccaggcctggctcggctactgaacagacctcagggtagtcacacttcagcacatagtgatcttcccctgctgagtactgagaactattaagcatgtggatgcatcgcttccttcagaggtgttccctctttagaggagtgatcagacagatttacaatgaacgataacacaaaaacgtgacatgaaataaatgtgcatcgagatgctacaggaggaaagggggcattaatgtgcaagggtaaagaaaataagcaagcaaacaacagcaacagcggtttagatactgggcagcaaatggatgactagactgatagccaattgattgaacagtgatcagaaagctgcatccgcaactgatagtgtggaggcctagcagcagccctattttcccagaactcctaaaaaggattaggcattgattgtgctatctctaggagtgttggtgggagggacgagaaactaagcaaagaagccttgatgaaagttcattcaagaagcagctggatccacaaatccccttcccatatccagcaagagaccaaaggcttctttactatctggaattggagaaatggagactcccggtccagggacaccaggcacagttagaggaggagggtaaactaccaagtgtaggaaggagtgagtttttgtatccaaaatgccgagatctccaaactctttccccattggattgccagaatcatggccactaggcctatacctctaagcaggtaactaggagagcttttccaaggggatttgaaaagctcaaaaggaaagacctaaaggtactgaccacaagattctctaacaaagtcgtccagtcacaccctacactgaagcctacagatgacacgtcccaacaacaagctcagggcttccaaacagcattctagtgtcctactcttactaagagcagaaactagtgttgacagacatctgagggaaatctctgagtttaaatatggcaatcaaatcaagcaaacgggataaaagcaaccaaataagaattatgtaagaaaaacattttatattcagaatatatttaatatgctgagagatttaaaagaagataaattacatttgtgaaaaccagagctggataatataaaaaaattatgatagcaaaacaagactggtgaaattaaaaagattatagtagaaatgggaaaagtcaacagagggttataagataaagagatagaaaataggacaggaaatataagaaaagcaaatcaccagtccaggatgcccagcatgtaaataatgagagtgccagaaagagaacacgcacagacacacagtcacacacacagtctcacagtcacacacatgcacacagccacacacacagtctcacacacagtcacacacacgcagtcacacacacatagacacacagaaacacacacatacacaaatacacagacatacacagaaacacagacacacacatgcacacatacacaaatacacacaaacacaaacacatacatgcacacatacacagacaagcattaacacagacatgcacacatacacagaaaaatacacacgtacacatacatgcacacatacataggcaaatacacacacagacatagatgcatacatacacaaatacacacatatatgcacacgtacacaaatacacacacacacaaaggaggaaagaaaattaaccacaaaacaattcaaaaaaatgtccctaaaccaaaagacttgaatttctagattaaaggagttcatactgcaagacaaatgaaataaactcaaaccataacacagtgtcatgaaattttagagtacataggacaagttctaatcaaacaagcttctagacagagaaagataaaacataccccttccaaagatgatgagtctgaatggctttgaacttctcaatagtaataccagagaccagaaaacaatggagtgatgtcttccaaaatctgaagggctatgacttgcaccctggaattcttctcttttttttttgggttgggggagctgagtctcactctgtcgcccaggctggagtgcagtgtcacgatctcgactcactgtaagctccacctcccgggttcataccattctcctgcctcagcctcccgagtagctgggactacaggcgcctgccaccatgccccgctaattttttgtatttttagtagagacggggtttcaccgtgttagccaggatggtctcgattgcctgacctcgtgatccgcccgcctcgacctcccaaagtgctgggattacaggcatgagccactgcgcccagcctgcaccctggaattctatacccagagaaactaccaaatatgaaggtaaaataatggatttgtcagataagcagggcctcaaatgtcttatctcctctgcactctttctcaggaagctgactgaggaggggctccttcagtaccagccagtaccatttggacactaaaagacagaggtctaacccacagggcagccagataaagagaattcccgagatgaggcagatggcagggcccaggatgccagaggacaacccacccagatgggagcagggaagagggctccaggagagatttcttgaagatgagattggtgggatggcagaggcttctgatacttggattagaaatacagacaactggcagagtctgaggttgacacagtgatacaatcagaggaaactaagctaatataaaaggacataatataatctaaatgtaaatatcaaacaaagcaaaacaaaaacaaagcaaaacctctagggaaaataaaagatggttcatgaaaggaaaaataaaggcttagtcatgaatatcatttgcattgctatataatataaacactgaatattgatttgaatgaaattaaaatttagctctattggaagagtgaagagaaattaaaggcatgtcttggcacatatgcagatgcaggggtggggtggagaatgcgagtggagtgaaccaattcctcgcctcccacacttcctcaccatagtgggaattccatggaaagggtttaaaatggcaaatcaagaaacagcaacacaagtgtattatttacagaagtctagctgtatgcccccctaaaacagctgaaagagttaaagggcgtctcgctgctgagaggagatggagggtaaggggtagaggactactgtttttcacgacaagccttatacactatttgcttttttaaacaatgggcatgtataaaatttgataacatgttagaacttaaagaaagaatgaatctcagttcttcaagtgccccagcctcttacaggtcttgataatattttcctacctggtctcatgatcaaagcagaggactggcttaccatgcaacacaaggacttctgtgtagggggaatgacttcttcctcctcagaactctaggaaaatgggatttgtggaacgacgtgctggagttcccacatttatctttgttgtttcactgttgtcttgcttgtcaatgtaaacaaaaacaccaaccaacattgatgttggaactatactcatttgttaattacaaccatatgttgactattaatacaaattttggtaaaatcaacaaaagcattctgtgagaatccattggaattttcaaaaaagaatattttattatttgtaaattgtacactacacatcttttctatcagtaaaatacacagtaaatgtacacacacacacacacacacatttttttctttttagagaactagttgttcaacacttaccagcacaccagtgtacctataagcaattgctcaggaatgaggaatgagaaatcctatgtagaaacagagaattggccaaaacaatctttcaggggccctctgttctaggaagtgacctctctcttcccctctttacttgttgctaccaggatagaggaagtctctgcttttaggtctttaagtctcaggtctgactcgactgacttcagttttggtgagtttcctccaaggacactggcactgatgaccgcaaagggcaaaactcattagataatgatgagtttctttagcataaagttaaagattattgataactgacagaatcattatttttcagacaaatataagtaaaacatccatccattgagatggatgatgggaaagacaactgaaatatttatggcattaagtgctaaatgcatttttggctgaattttgtttcatcaacttccctatgaaattctattctttttaaaacgcatcataaaaaataagacttcaaagaggaagagattaatttagaatcgtgaagggaacaaggagaaggaagaggatctctgaagacgtctttaatgtgaaggcttctttcaagagaaggtcttagaactgggatggtgccagatttatcaaaatcttgagaaaaacataatttgataagataatattcaatggagagctagtctgttgtggaaaagttctaaaagatataaataagacccttgcccatcgatgctcagagctgttgcaggcaaggcacagtgctaaccagagcagctcacctgtgcctaatgccacttcccaaaaacggtccaggttggcatttatataatgctatctttggtgctatttacaaacaggatgcttaattagtgctcattaaatttttacaaatgactgtcagctcattctctcccccctgttgctttgaaactccctgactgacacatttctgactgacaggaacgttaatctctgaggcaacttaattccaaccaccctcccctgccaagacatctgcagacactcactctagaaggacaagaatccactgtggggttgaagctgtggggctttcttgttctctggttcccacatacccacatcgtaatcattctgggaacccagtgctttgacctcctattgccataccatgttacagtttactaagtgctctgacatacatctctgttttgagcctctcaacaaccttatgacaagggcagagctggcagagtggctattttctcaagaagaaaccaggattcccaaaggttaatgccttgaccaaggtcctagggcagaatccaacctgggactcactcagttgttttggctttgagcccagttctctttccataaagtgctgacatttggactgtgaggtgggcctaggaggtaaaaatacaatgccatgcgcctgagaaattccttccagtagaatgcgaaaggcaccactctagaccagacaaagatggatactgacacccgtaattaaagagtttctgttgagtacatatgacttctttttgaaaatggatgacgtaactacttccaagaaaaaaaattagtagctgaaacaaacttcaccgaagagttaccaaaagggatgattctaaaattctgaatcggggatgggttaatgtaaatttatatagttgttcattctataattaaaagaatagatttctttgtggatatagttaacccagatgctcatgttaagcagacaaatagggcctaaggggagaaaagatggagacaagaaatccaggttaaagattcagaataagaccaaataaaaagaattcttattttaatcattgaaagtgtcaataagcacaaggtcccctttgactgactaaaagataaaccaaaatacaacattatgctcagtggaaggttataaaaggagccatgaattagatggggatttgaacaaaagggcctttaaattcccttccaactctcaggtcttggttaactctgagcaaaccattctttaactggaaagtcagagaaatgtttcactgaagtccataatttctgctaacaaaacacctgacagtcttgttattttgctaaccaaaggaattggagattgtcatgccaccagggtagaaggaaatccctcctaaataactgcataccacatgaatgaagccttagatgttataccccaaagcttttcctcatagtcagaaacctgttccaccatgtaggatcggagtggactccctccccctacaaaaaaaaaaaaacaaaaacaaaagcagaaatcaaaagagagaatgggtctctctgtttatacctttagggcagtgcttagttaatcacttggactcttctagacagacttctttgggtaaaaatccctgcttccccatttactagctgggtgaccttgggaaagttacttaatctgtaaaatggggatagtaattgtacctgtccatagcctattgtgaggattaatataagtaaagtggttagcacagggctggcaatggatagtaaccacccagtggatagtagaatgatcaatgactgtagtttaaagttttagtaagtattgcagtgaaggagaatcataaaggtcagggcaccatggggtatttcacacattcttgagcattttgaaaaagtcacatgacataacccaggaaactcccaggtatactagggtaacatctggaaggcagtgatggagagagacttttctgattgccacttttgaagcagcaaaccatgttattgatggtactacaagccttttgctgaatcagacataatgttgatcaccttctccttgcaaggcatgatgtgaggcacagcacaaggcttaattatattcagaccttcctggaagaagcatgacatatgtaaccctaatatggaactgtaactacgctaagaaaatgcaatggaattttgttaaaaaaaaaaaaaaaaaaaaaaaaagaagcttcttactcccacaagacattgtgatgattaaactggctatttaggcataagagagaaggctgttcatcaaaaatcaatttaaaagtaaaaaacagcaatggtaaaccccctcctcattccttccaatcctaaccttgattcagcgttgagcaagaaacagtggcagacgatagtttgaaaacagcctttgggagggcagcttctctctgatccactctgacctcctgcaccactttggtcagagggctaatttgtccctctcgctcatggcaaatgggagtgaaatgatggtggttgaatgtatagttagcttatttcaaatctgagtcagatctgtttctcattagctcccggaggctaagatatggataaactcaaaacaagtcctgattttgctgggcatggtggcttatgcctgtaatcccaactactcaggaggctgaggtgggaagattgcttgagcctgggaggtcaagtctgcagtaagctatgattgtaccactgcacttcagcctgggcaacagagcaagaccctgtctcaaaaaaacaaaagaaagaaaaaagaaaaagaaaaaacaagcccaaaccccaagtcttagttcacgtcaagtcctagaagctaagaaaatttcaggattccttcaggataccaccttgcccaggtgaaccaggactacttgtgacctaagaatccaggtggaaccccagaaacaagggttctgacccccaatctaccatcaactagctctgtaattggtagggggccatggagtcgggattttcctcatctagtctcaagaatgtgtctcctcaaactacagcaagggcagggcctggcacccagtgggaagctgagtatgtgcttagggagggcatcaggggctcatacactaaactagcatttgctattttaaagcaagaatcaaaatattcatccaggagaaaatcagaatcctattagatttttaataacctattttgcaatgtactattattttatttttgattctatggcaggagtaggaaaaagggtacatcatgaccttcttagagaccagggtctcttgaaatcatcacccagcctacgagtcactggctgaggtcacctgacagtgagtcactggcagctagtttgtagggaagaagaagagaagtgaatgtcagagaaggtgaagtttgtgcagaccttctctctacatcccctcttgccatccatctattttgcttattgctaggtacctagggtcttctaccacccagaaacctgagtcagaaattcatgcagcaacttctcgctgactggctggctttctcttccccatgtgggcattttcttggtgcaatgtatctcagaaggacagtcaaaagaatatctcataagatgagggacagactgactggctgtttactggaacatacctacagatcacctgagaatcttgttcaaatgcagatttgaactcagaatgtctaggatggggtctaaggtgctatgttctgccaagctccaagatgatgctatttctggtcctcaggccacactttaagtaaggaggcactagaaccctttctagctctgactgcccaagcctgtgagctcaccccagaacgatctcagccagaagttcccagatcaatagtctcagggattattcctgcaggcccttgctttctgagccatcccaatacaccagtccagccttccacctggcaaaaacagtgatgctcagatgcaaaagtactccaggtagcagggggacacctcagctccaggtagggaattattgctgaggaagcttacaaacacaccagaattactacagcgggtcttcaatagctccagttatcctccccaggggagtcctcaggacaggacaacaagtctaggagaaaccccctaaaatcatttgcattcacagcacaggaaacacaaaggcattaggatgcgctctgcagtccttggtggcaggtggcagagttaatcacctctaagcgaatccaatgctgttgatggcagtgatttaacctcccttcagcatcactctgacctcatatgtgaggataaaagactgaaaacactctcaaacaaataaagaatgcctatgtggttggaccaggctccaaggaagggtcatggtcacagactaaatttcggttcaaatgctaaatttggagaagatgacttcccaacagagcaggaggtggagttctgtgtgcattcctagatggttcaggttggccgccatcatgcgtgggtgcaggcatcgtgtgtgtatgtgtgtgtacatacatacacgtgcatgcatgtgtgcaagtgtgtgtgcagcaggagtgaggtggggaggaagtattgagcacactgatgctttttctgtgcagtggctgctatctgcttcgcaccctcattcctatggcagctgaaagtttcctatggcctagaaaaggcaacactacaactctgtccatcaaaaattgaacaaacctgaataggaaataggatccactcttataaggaaaggggaggggctgtattacaatgtctgtgcctgctgaaccccccgtgcgtcctgccacgggttttcctgtctgagagaaaatggaataaagaaaaccttaaggccgggtgcggtggctcacgcctgtaatcccagcactttgggaggctgaggcaagcagatcacgaggtcaggagatcgagaccatcctggctaacatggtgaaacccggtctctactaaaaaatacaaaaaattagccgggcgtggtggcgggcgcctgtagtcccagctacttgggaggctgaggcaggagaatggcaggaacctgggaggcggagcttgcagtgagccgagatcgtgccactgcactccaacctgagtgacagagcaagacgccgtctaaaaaaaaaacaaaaaaacaaaaaaaagagaaagaaaaccttgaggtggttttactaggcctctaggaagggttaagtcgaaataatttgctcctggtgtatcagacagccctatttggaagcgctctgtgctccaagagcctctagcaccccacctggggcctgggctgagtgggctaaactgctgttatggtgggcacaggctggcttctccaaggacacccttcatgcttccttggttataatgaacagacacagataaaaaggtgtgcactttcaaatacctcgagggggctttagaaaagtagcttcatttggggattaaatggggtctcctgagtccgaattcaagccaaggctctctcttcaccagcaatacggactcctgaatagagtctgcatcattctctctgcagaatgctcggtggatgtttagagaagtcacctgacatcaaattctgcaaaagaagctccccaaggaagccagtctttggttctgcagataatatatcatgtgctaaatcactcagggaaatgtcacacagttgttagaataaagaaggtttaattgccaaatattgggctttaaaaaccaatcaagtatagaaggtaactttaattagagagaagaatcagataaacagagtgtaaaaagctcagtgcttgaacagcctatatctcattgtgccttcattctccaaggacatcgagtaaaaacagagattagacctctgctagccactttgggacaattataggcaaagggaacaaatgtattacttcactgacaccaggaaactgtcttacatttatggggctttgggacaagattccttgatcttgggaatgctgagaaccaaataaccagcatcattgtggaccaagcatcccagccccaaacacagtgagtattgactctggatctctacaggtgctctcaaaaacgcagactgaagattatcaatcgacctgcagtcaatagtgtctacacactgcattcatcttgaaaacaaaatttttgagggccattttcaactcaggctcttcagcaaccctcagggtcttggtgcctgcctcatcttccgagcacagagccctcctgtccatggacctgagattgccaggggacagaatgctcactttcctattttgtctctaagggagcccatttccggaaagtgtgaaggtgataaattcacccaagtgagctcattgccaagccctgaagaccctcacccactggagcagctttgaactgcatggcgtgggcctcccacctctctagggtatttttagaactgagcatggaacaaaactgaacttttcaaacagaaaggaatgcaaagtgcttagggctagttttcaaagggcaaagcttattttaaaagattattgatcgggcctaactgcaacatgacagggtcaaatggagtcaggaatgcacaggaggaatccaggttgggagagctaagccctgaacaccttagggatatctgagcagcgccctccactgaacttgacgggctacgttagcacaacccatggcgtttcggggtaacagatgccacagcaaaaagcccatgctggttaaggaagatgatactggcgagagtgtctccaaatctttctagcatcttttcagttgatgaagctctgactttatcattatatggaaacctaagctctaattttttaagatcagttcctcagctcttcagcaaaatgttctttgatgactttctagaggcctaagtgtagtttaaagaaaaggtcaggtaggaatggattaaaatatgccaaggcattcaaacatcatcctcagaaaagaaagaactaccctgggcttcactctcccctttcattcattctgataacaaggattttctgtgcaccttctatatgtctggaagcttccaagaataaacagaacaaagatgattcagacattgcccccagggagttcaaggggtagtgagagagaaacttacacacaaatatttaaaagacacccacttactatccagacagagcatgaaggctgctcaacatctgtcagggctgtggaggcagcagcttgttccagagaacaccatctttgttttctatcccaccctctaccttggcagggcgattccctcaaagaactgtaccccagcctttaagcttttacacaaatctctgtattccagagaccaatggaaaccactcttctgggcttctcccaggcttactgataggtctagtgtgccagtttccccatcctccttgcatgggccttgcatgtcaccaaaaggctccccacctccaggaaggagagagaacatgcctgcaatcacacagccaatgcaataggcacactttttaagaaacagatcacctgcaaagtgacatcaaatcattacaatgtgcgaagcaaacaaagaatctgtctcacccacataaaaatgacactgcatgcctatgatgggtgatgaacggtactgaggtttttctcatctcctaaacctgtgtctgaaaggttgtaagccataaagtagtagctcatcattgagtgcaacacactcatacctcctgttttgcaagagaaaaagctgggggatcaggagagaatttctctagccaaattctccatgggctgtcttctttgtctcctgtcctctgctaacctgtcctacgacacaaaataaaccttctcacagcttttgggtgtatgaactgcccacagggagtttcctctagacagaaagaactgggcccacagtggtcgccccgacagcctgagtgcaagcttcaaaagcccaggagtcaagttagtgtcaaaagaaaaacaagtagggaagtatagcaggattgacagttggagatattaactgaggtgctttttattccatagatttccccttatctgcttaccctatctcttcctcatgtcattgcctcaggggaggggggacaataatagaaacacaaaaatgttgtttaattctaagagctaaattgctttgcaagagtcttaagtaagagatttggaacacagcccatcaatcagccttgcctgccctgagattagacaaggattctctggagtcagggagccagaggtggatcagagagaggtagggtgaagagacctgtgggtttataaggaggactgtgccctctggagccaggcatgagtttcttcatgggactccatccaacttgctgtctatggtccccaagctggtcagcccactggtggccccaggattcctgcagccctcacacttccaggggctgcaggaataaagcattttcttctttggtgccccgcacccattcaccaccatcactagcccctcgcggccttccctctcctgtgcctggccagcgttaaccccgccccactccagcaagatcccctctggcgtcagaacagttatgtacctgttgcctttcccagcctttgtcagtcttccaggaagggagaccaattcccagggaatacctttaggaggcagattgaaagccaggacctaatttcccatcagccatcaagcagtaaccatttcgagcagttaggctttgaagtgagccagtgacctacacagaagtgaaaagcttcaaatgccattatcattccccagagccagccttctgtgtgcctctgcctctcatctcacctttcaagagtatagacaaatgagccttcttgacatgtttatgccagttcctcttccccagtcctcattctcaggcccttttgcagaatgccctctgaccatattctagaaggatgtcctgttgtgtgagccattttgctgttcatgaacattactcaaaacatctttctttaacataactcctgcctgcgatggtagcagtgttgtgttctgtttctaggctgttcaaagaaatctgagccagtgcaaggcgtttgtcattcctcaagggcagtgacttaaagacaactggttacattacgggctcttcgctttttcctacttttgtctctgggatgtgtttttctctcatctacatcataatcaatagttcttcccccctttgtgatggatcatatcagtcacaactatgctaaattgtcacctgacatttagcttcgatgctattctcttggatggaacacagttttctctcttttcaaatgcctggaatactgaaagggcctaggcaacaatgttcaattatgtgtcaagtcacagttttgctgtaggaccaagaaaagagaacacatccacaggtggctcccaactcactacagacccataaagagcaaactcagtaagtgtcaacctgtctcctaacaaaagcccatttattattgagaaatcagacacataaaaattagatcaaagacccacaactgcccattcatgatgtactatccatgctgagtgactgtaaatttttttgattgcaagaaaaaaattaaaaatatcctcagtccagtccaacaataagagaattttgtgagaaatctctactgagttttgctgtcccaggagaggagttggtttagctgttttatcaaaaagctttgaaatataaagtgctcccgaggagttcgaaaggacacaggaaaaacactaccctttagggagacaaagaactgtaacatccctgtcctcactgggttccctggggatagaggaccctccctcccacggtcacccccagggacaaagtgttgttacggagcaggtggcctgagcacccatcccagtcctccaggattccaccaagtggcagtcgtgtgtaagatgttaatttccctgggcatcagttgtctcatctcacacataggagctagaactgagaaactccaagggctacttcagctttgaaatgttgtaattcttatatagaagaaagaacaggaatgccatgatattagatatgagagagcgagacaacgagagagcgagacagagacagagagagagagaaaagagagggagacagaagaagaaagaaagaaatgagggagcaaggagatagaactaagaaaatgtctttaggaaaccacaagagaagtataacagaaaatgaaagtgtagacaaagtagacaacaagacaaagatgggatgaaaggaactttagtgctaataaacatgaatgacgagagtttctctttatctagcacctatcatgctgcatatacattttctataatattcacagttttctgaggctggtaggaacacatctgtctcataggtgaagaaattgaggttgagtggagttaaagaactggtccaggctgggcacagtggctcacgcctgtaatcccagcactttggaaggctgaggcgggcagatcacttgaggtcaggagttcaagaccagcctggccaatgtggcaaaaccctgtctctactaaaagtacaaaaattagccaggtgtggtggcaggcacctgtaatcccagctacttgggagactgagcagaagaatcgcttgaacccaggaggcagaggttgcagtgaaccgagatcataccattgcattccaggctgggtgacagagcaagacctccgtctcaacaacaacaacaacaaaaacaacaacaacaacaacaacaaagaactgatccaagttcagactgctaattatttgaagctatgattgaacccaggaatccaacctagcctttgcactatgttattacgttatagtgcctcctaaaccattctccctgttgtttagcaagagatgcagtgctctcttctgctttagtttataaagcatggctcaactagaagacctacgagaaatccacagaggcagtatctccttccaccagcagttttgaatgtgcctctgacacagaagggaggatcaagtcgagctgccctgaaccactgacaagaagtatcccttttcaggatggatcctgctgtgggggacagcatagcaaaaagagggacaagtactggcttagacatccggagagctgggcctacactctggccacagatttctcacaggactctgccctctctcccctacctgcctctaagcactgctgatatcctggtgcacgtaagctcatgggtacaaggagttagacacaagcagaggacagttctgtcccaggcacttcctggtatatatgaggggagtggggaggtgggagccatttcagcagaacataccgatatcctgcaaacagcaggcacacagttgttgcttcaggaaaaccagactcagctttaagaaaattggcgataaaaacacaaaattacctttcagaagaaacaaactggaatgtgagtgagattgctgaagtctttttcattttgcccaagactcaagcctaccttctgttaaatagaaagctcccaaatacatctgaaagatgattcgatttacaaaagttccatttgtccacaacctttcacacaaccttgcattaacagaggtgagttacatgggcataagtccatgtgacttgcaaaaatgcgtaaaacaagaagcaaagcatacaaatgtgtgcaggctgcaaggctgagaccaagaaagaaagtagatggggttgaaaatgaatcctgcagtgggaaaattaatttagtataagccccaaagccacagaccactaccacactactgaccctcaccaccccccacccccggcctcccgtcagcaaactctctgtgacttctgactgctcccctatctttcattcccttggtatcaggaagcacaggagagattcagggggaatatcatttacatagggggaaatgtttttgagtatacacacacacacacacacacacacacacacacacacacacacacacattaccctctctgcaaggttggaactaaatatctttcttattcactgttcctggataaagtggctttaaaaagttttcgccattgtcatttccattttcgccttcactcaggcacacaatgaagaaaaaacgagactaaggatgattgacgttccccttttaatgacgaatgctaccgattttcacgtcccttggagttttcttgtattcattttctttgcctaggttagtttttttcttccttttcccatccagtcttttcgtttctttcccttatattatctgaaatgtctatagaacccgagaaggataggagatcctcccatagccctaaccagcactcatcagccaacatgagtggcactctctaactatatgaaaatggaaaccatcttattccatttaactaaagcctctgcacagccatcagggattcttttcagaggacaatgcaaaggccagcaagttgcacttgaacaaataacttctcctagaaaggaaatggcatccgcagcaatcaatgttatacctagatgtgtgttaagagcgacggtgctggagggcttccaggagttgtgtagagatcaccacgtggccactccctcagtaaacatttataaagcaccaattgtgtactgtgctgggtgaggcaaggaaaaggtgaataatgtagtccccgactgtaggaggtcagagtctcagttgtgggagcccaaagtccaggtggaaaataaatgctaatgaaaagttcccttgtattcactctgcttattgagtttacatagacaaatgttctgaggatttccctgggagttttttttgtttgtttgttttgtttgtttgtttgttttgagatggagtgttgctctgtagcccaggctggagtgcaacagcacaatcttgactcattgcaacctctacctacctcctaggttcaagcgattctcctgcctcagcctcccgagtagctgggactataggcaaccaccaccacgcctggctaattttttgtatttttagtaaagacagggtttcaccatgttagccaggatggtctcgatctcctgacctcgtgatctgcccgccttggcctcccaaagtgctgggattacaggcatgagccaccatgcccggccttccctgggagttttttgaaagggaatggaagccccctcaacagaaagaagcctcttgaagtccaatttcatacatgtttcacatcaggttcgatctaacccaagcaaataccatttttaggcaaggcacattagcactgcaataatctatctagtgattgttcatctagaatacatgtacttactatgtccgagacacagtgctgggtgctgggtaggggatacaaagatgaattaattagggctttattccttaagctacttaatgtttttctatgactgagccaaaagtcacaaagggcaatccaaggccagtgtttattaatttgcagttaaatgtatacactggcaccaaagcacttactggactcatactacacacatcatgtatgtgaagataaacaatgcacaggcttttccttggagctcacagcaatatgacaagcggtccatgggacgtatgcatagggaaagagagtagcccaggaaggctttacaagggagctgatacattcgtgggtcagattttagaaaatgagtcagagttagccaggaagagaatgagaaaaagacagtctgtagagaggaagcagtaagtatgcagataagaggctgtaagacagtagggtgggttaagtaagggagaatatttaagtggtcctccaaggaagaagaagaaatgatgctgaaaatgtgggtgggaccaaatgacctacatcccaaccaaatgtcccaaccaaagaagaatggaatcaaaatcaccaataatctttggtattcttctgtgaacatgaattccattcaagtgagattagaacctacaccttaattcaaagtgttagtatatggaaatattggttaggtgtggcacatagacatagtcatggaaatgaaaacacatcatcatttgcagcagacaccagggatttgtataaaggcaaaaaaaagtttcttgaaacaagcagtgatcacaattgctaagagatgtacctcacagcctctgtctgctctttagcctatgacctgtctataaggacaacaaacgaacttgtcttagcttatccagccatctggctgtagtacagctggttagattaaggagcatagtgataactcgctgagtgcttcgtgaggtgggtcgaggcctggccacatagccacagcacctgtcatgacaggaagggctacaatgtcatgggaggcaggcagtgagggatattccagtggacagattaacatgacattccttgtcagagaaggaacgagtgtctagctgccaaaaccagagaggtctagacagatcccaacagcctgctgtggagaccaggagcaacagttgctttctttccctttccatttctgttgcttgcacgatggactcccgggtctgggagaaattagaagttatatagggacttgggtattcatgagaaagcgaaagggagggaactagacaaggacccagctcttgaacaagggattaggaaaggttcacaggcaaccgatgcagactgaatttctgggaacatagcaaagagactcaaagaacctcagtaagactaactgactgtcataatagaacagaaagggacaggaagagcttctgcagctgtaggacaggtaatcccagattccagggtcaaaggacttcagctttacaacctggagggctaaggaacaagagccaagggacccattatagctgaacctcaaatacagcctaagaagtaaccttgttttcttattcagacagagctttatggtttttgtttccagttctctaaccaatgtcactttctatattgacacttctttctgaaggtaaaagagttagtagactggttgtttcttccttccaccaccaactttagctaagttttgcaaacggccgagtctaaaaacatgctccatcctggtacactgtgtgtgtgtgtgtgtgtgtgtgtgtgtgtgtgtgtgtgtctgtatgcacatgcctatgcgtggctgcctgggtctgagtctaggtcattgcaatatcccaaggcaatatgaacaccataattactaccatttattgagcacctcctatgggcactgtgatgaactcttgaatctctaatgcttgtaatgctagaggatatcatttcatttatttttttacagagcaaatgctgagaatctccagtgctccctagcactgagcttatgatggaaaataaatatcatcacacctccttgtaaaaggcaaggtctagaagagtaatgaccacacttagccaaccaggcaggctattctatccggaatggctgaatcagccaaccaaccaatttgactgattctgtccagtgaactgaccagttgattgactggcttggcagagtcacacagttacttctgcaccatgttgccacagctttacaatgtgcctgtgctggtgaaatgaagtgaaaagccaaggaattaccccgattatttcctgtatgaaagatgccagcctggattaaaacctcaagaacttctgtcataaaccaaactgtatggtggagaatgacaaagtgaagccatgggcagacccctagactggggtgaatgaatggggcttctcctgggtctgctgttgtccagctaaatctcaaccatgattattcattagaatcacctaaggagcgtttaaaatcattgatgtggggaggtcccagagactgcgattacattgatctggagtggaacctggataatattatttttaagcttcccaggtgattaacatttggccgtggagaaccttggagtttagtagcatggcccctccaggcctcagtttcctgtttatttgttgaggatgtcagaccaggtaatatccagggccctgtaaagttctaagattttatgttcatcctgatcccatccccagctggcaggcagctctgaagacaccactttctctttgcataattcaattcccgaatgccgtcaagatggccgacctaccacagagggtaggcatgtgggttaatgagatcacatttgcaaagtgtttggggctctagggaagaaatctctaatgtatgcagctaaagcatgattacagcaatgttaatgtcatttttttttaagaagagtaaaccacagttcacaaccctgcatctgccgtaattagactatcttgtcaggatggagggtggcggagtggaaagtagattaaagcagggctgctcatgttaagaccagatgccaggttaagcctccaagagccatgtctatgcaatcacaagtgacatagactgggcttgaaaaaatgttaatctatgcaaaatcctcttgttctcagtatacaccagaagattccttcatgacacacattcttgtggacctacttccatataacagagaaaaaagatgaatcttgtggttcttttccaagggtaaataatcatcagtgggactttatttctaaaatgttactacccattgctatttctgacatattgacattggaacacacacacacaaaatctttctttgagatggagtcttgctctgtcacccaggctggaatgcaatggcacgatctcggctcactgcaacctctgcctcccaggttcaagcaattctcctgcctcagcctcccaagtagctgggattacaggtgcccaccactacacccggctaatttttgtgtttttagcagagatgaggtttcaccatgttggccaggatggtctcaaactcctgacctcaggtgatccacctgcctggtcctcccagagtgctggaattagaggtgtgagtcacctcacccggccaaaaaataatcctttaagatcctatacattagacctgtcactccaggctgcagaaactggagtgacagcaaaggctctgaagcccaagagataggaatctgtatctgggtccacctcttacagtctctgtgacctcttggcaagtctcttcctttcctttatcttatttttcttctattagataacatgtgaaaaacacctaacaaaatgcccagtgtaactcaataaacatttagtttcctatctctgtaccatatgtaattgatgttgtcagacaatatttccacacatgcacacatatgtttattgcagcacttttcacaatagcaaagacttggaaccaacccaaatgcccatcaatgatagactggataaagaaaatgtggcacatatacaccatggaatactatgcagccataaaaaaggatgagttcatgtcctttgcagggacatggatgaagctggaaaccatcattctcagcaaactacacaagaacagaaaaccaaacactgcatgttctcactcataagtgggaattgatcaatgagaacacatggacacagggaggggaacatcacacaccagggcctgtcgaggggtggtgggtaggggagagatagcattaggataaatacctaatgtagatgacgagttgatgggtgcagcaaaccaccatggcatgtgtatacctatgtaacaaacctgcacattctgcacatgtatcccagaacttaaagtataattaaaaatatatatatatatatttccaaacaatagtcaccactgcccagatgatactgaaggcctctggtagaccagatctcttgtttttcatgacgcttttgtaatctcattcattcatccatccatttatttattgacttactttcaactagtttatatggtttgtgcaatatagaccaaaagacagtctttgtcattcatcatcaattaataattataatttgagggaatttgaaacattgcatttcaggattttctctaaacaatcgggtgattcagatgcactaagttatctgaaaatgagtattttgtgttttccatagatgtttaggaatcagcaattctgatcataacatgagcttatgaaataagagttgtaaccttgaagtgtccatgtataggtttaaacaattctaaccaaaacatgaatataatttctttggaacttgaaaaatgattctgaaactcctctgttgcaacaaatagctaaaaatagttttaaccttttttgttagggaaaacaaatggagggatggggaattctctaactatacattaggtattttataaagctttcattcttaaaatgtgtggtgctaacacaaaaacagatggaacagtggaacagttgcagaaggtagatagatggaataatggaacattccagtggagactccagaaacagactcaggtctgtataagaatttaatatgtaataaatgggacatctcagtttcagggggagggtagcactagataataattactgctgggggccactagttaagttttggggaaaaactcatttgaaccctcaattcaaatcatctaccacaataaaaggcagataaagtaagtgtaagaaaaataatccataacaaaactcaatggaaacacaaaatggtatttcacacatctttagataagacaggattttctaagattaaaatcagtaaaaaggattaaaagaaaatgagcaaaatgtgaccatttgaaatgcctcaatgatattgagggtttatttccagaccactgcaataaagcaagtattgcaataaagcaagtattgcaataaagcaagtcacacaacattttttggttttggtgcatataaaagttatgcttacactacacttagactattaagtatgcaatagcataatctctaaaaaaatatacacatcttaatttaaaaatactttattgctaaaatggctgacaatcatctgggtctttggtgagtcataatctttttgctgatggagggtcttgcctcaatattgatggttggggtgtctgtggcaattgcttaaaataagacaataatgaagtttgttgcatccattgactcttcctttcatgaaagatttctctgtagcatatgatgctgtttgatagcattttgcccacagtaaatctttcaaaattgaagtcaatcgtctcaaaccctgccactgctttatcaactaagtttatgtaatattttaaaccctttgctgccatttcaacaatgttcacagcatctttaccaggagtagattccatctcaaaacaccactttctttgctcatccacaagtagcaacatctcatccgttcaagtttgatcatgaggttgcagcaattcagtcacatctttgggctccacttctaattctagttctcttgctatttccatcacatctccaattgctgcctccaacgaagactctactgaagtcttgaacccctcaaagtaatccatgaggactggaatcaacttcttccaaacccctgttcatgttgttattttgacctcctcccatgcattaaaaatgttctaaatggcatctagagtagtgaatcctttccagaaggttttcaacttactttgcccagatccatcagacgaatcactatctatggcagctacagccttacaagacatgtttcttaaataataaggcttgaaagtcaaaattagtccactatccatggattgcagaaaggatgctgtgttagtaggcataaaaaaattaattttcttgtacatctccatcagagctctccagtgatgaggagcatggtcaatgggcagtaacattctaaaaggaatcattttttctgagcagtaggtattaaaaatgagcttaaaatattccatttattgaatattcagtttacatggtttaccatgttgtaaacacttgtgttgtcattcagcccttgttgttacatttatagaattcaggcagagtagatttagcataattttaaaagccctgggattgtcagaatggtaaataagactgacttgaacttaatcaccacctgtattcacccctaacaagagagtcagcctgtcccttgaagtttttgaagccagtcattgacttctcttttgtagctatgaaagtcctaagtgtcatcttcttctaatataaggttgttttgcctagtttgatggtttagtgtagccaccttcatcaattatcttaggtagatcttctggataactttctacagtttcttcatcagcacttgctgcttcacctcgcactttcatgttataaagatggcttttttccttcaacctcgtgaaccaacctctgctagcttccaatttttctcctgcagattctccacctcttttggccttcatagaattgaagagagttgaactttgcactagattaagctttgacttaaggaaatattgtggctgatttgatcttctatccaaaacactcaaactttctctataccagcaataaggctgttttgctttaaaaaaaatcatttgtgtgttcactggggtagcacttttaattttcaataattttcctttccatcacacttgattaactggcacaagaggcctagcttttgatctgtctcagcttttgacatgcctactcaccaaacttaatcatgtctagttttttactgaaagtgagagacatactactcttcccttcacgtgaacacttagaggcgactgtagggttattaactggcctaatttcaatatttttgtatctcagggaacagggaagcccaaggagatggagagagttaggaaaatggcaggttggtagagcaatcagagcacacaattattgaataacttcgccaccttataggggcatggtttgtggcatcccaatgcaattagaagagtaacatcaatgatcaccaatcacatatcaccataacagatatattaacgatgtttgagatattgcgagaattaccaaaatgtgacacagagacatgaaggaaacacatgctgttggaaacatggtgctgacagactctttccaagcagagtcaccacaaaacttcaatttgtgaaagttgtgatatctgtgaagtgaaataaagcaaagcacgaaaaatggaagtatgtctgtgttacaactgcatacaaatattgcaaaagactttcaaattgggaaaaatttacaacaaacgtagtagatggagggttagtcctgatatcatccaaataatttagaaaaacactaagacaggcaggtgaaaaggctatgaacatcaacagaaaattcagacacacacacacacacacacacgcaaagagctaacaaatatgaaaagttgttcagcctcgctggtaagcaaagaattgtaatttaaggtggcagtttttctttgcccatctaattaaaaaatatttttaaataatatgcagttctggcaagtgttgcgtgagataagcattcttatacacttctagtgggagtataaattgttctggaagagcattttaaaaaactctctaaaggcaaatatagatcgcctttacaatatacctattttttgacccagtaatttaactcatcgaaatccatcccaagaaaattacctgttatacacataaaagcttttttgcataagaatattcactgctgcaatctttataggataaacaaaacagaacaaaactaggaagcaaagtagctacttgaaataaaaagtgataaagtaaatatggcatgtccaaaagataagttattatgtaacttccaacaaagatgactaagactttatgtaatattaaatgaaaatatcatcttaaaaattttatatgaatcaactctagtctttaaactcacaaagactgatttaaaaatactaaattgttaacagtagttatctttggtgggtagtattatgaacaattaatttcttctttttcaattatttgaaaaataattactatgcattatttttataattagcatgacatttttataaaaaggacataactgcatattccaattattactttgcaacaggagaaagataggatgaggttgacaacggccttcgaactgcttttccttctgcccttcttttccttcctaatctctctctatgaggtccacacacacagccttgaaggagaaataaaagaatcatttgtaggcctgagttttctcttttatccttatggtcaaatgagaagacgtctaaacagaagatctaggtattatggcagaaaaatagataaatagataaatacttcacaaagggtctctctgctagggaagagctcctggaaccatcggtagatctgtaataaagcatccagtctctgtggctgtcttcttaataagccagaagcacatttactgtagcctggtgagtgacgatcagcaaaacttacgaaaaatacagcacggatttcctccaaacgttagcagccaatttcactctgggaggtaaaattactggaactgataagccaatattaaaagaccaaaaaagctccttaaatattacaaagaccaatttgagccatcagacctgcatctgaacaaatgggaagatggcaatctgaaaattgtaataagaatgaattgattttgtacctgttctctagtttcattatgatcactgacaacagaatggattcattttatgtcattttctcctaagcctcatagaatattttctttcaggtcctgagatatgaacagaaagcacagatggccctgtctgcttcaacccagcagagactacgaataactttggagttgtttaaactcgtttcttttctctaagcaacctagctattcagcagctgttcatttcaaagctcagaaagatgcaaatggagctgcaactaccttaaaagaagctccggtgtggggtggggcacggggtatgacaatggggagaggaggtgagctacctttcatgagtttttttaaatgtagaagaataagcacaaataaaattctattagtgtaattttaggagacacaaggtcatgatgctcacaacttactatcaaatggctcaatgacaacaataacaaaaattacatacatatatacatacatacatacacatatatgcacgcacacccacacacacacacacacacacacacacatacacacacatatatatatggagaaacaatatggcaaaatgtaaataattagattataaaatctaacagaaagatgtatagaaacaaacaatactatcctagcaacctttctttagattgccatcattttaaaaaaattaaaaacaaatgaagtttagcagctctctgctcataacttcctttaactgtcccatcctgtatattctaaccagtccagataactctgtttcttgagctcactctgctctcccacttccttgccatttgctcatgctatttcctccaccaaaaatgctcacctcctgctcctattcataagtctttcaaagatttttttcaaatgcttctccttgaagcatcctctaatctttgcccctgcaccccagttatatttgatttcttgcctgtgaatctctcttaagatccagtttatcagacactctccttctcccatcaaaggacagcaaggagtaatatccccactatcattgcttgttcatgtgtctctctcccttttggaactctaggatccctgaaggcagggaccatgtctgtctcattcaccagtatagcccaagtgccagggacattgcttagtgtagaaggactcactaaatatttgctgattgaaggaactgatattctgactagttactggagtagtgttagatttttaaatctccttaaatcagggactctttcctactcatctccatatccatgcacaaagtaggtgctaaacaaatatttgttgatttttttttcaaaaagcagataaataggatttttttttttactttcaccaaagcactatacctgtttattcatttactcattgacccaagaatttgggtcaagaaagctttagctgtggccatccaaagggtaccagaaaagatgaaaaggagtaagtagagccacctgcggaaggccacggggtggtaagctccatatcttcctggttagtaaggaagtcttaaagctgcctgcaggcttgtgaccaggtatcttaagggtgagcactatttggtgttgccatcaactacgatcccagagggcaaagcctagcagccagattcctcacacctgccagtgtccttcattacatcagctaataaagaaacaagcacagaaggctaaatccaaaaggaaataaccatcaccatgttgggacttatgtggccaaagcctctctttgtgtgtgtgagagagggagtcttttggatgctttattattaaattggtatcatcaccagctcctttccattttgggaaagccaagtacactcagccctaggttcactcacagggacaaaattagccacagaaatcccatcaaagggaaatctaaggaattagaattctattgcatttggaaactggtgatttcaaatattgctggaatgtgagttgttgtttaaaatttagaaaccatacatgatttgaagagattttgtgctggacagaaaatatgtagaatttggtcttttcatcacaaagtacaaaaacccccgctcctcgcatccaggtcttttcagcaaatgtaccttaaaaggcaattaaagaatggtgaagctctcgagaggtatgacagtctttggccacattctatatttgccaccatatctagaaccctctatgcttccatggacatccaaaggtaggatgataataacccaaagaacttttttcttcctttaagccgcacttaggtaaggacggctttatccccaccccagggagaataatacccagaaacctcaatcctagagagaaggactctgaccgttctggagaattttcctgggggaaaaaaaagagagggagaaagagggaaagaatggagaggtcatcggtgtgatggcgaggacactgcatttagtcaggggccttggctctattcctcctgtgcttaccaccagtgagaacttggatatgccattgagcttttctgagtttccattctctcgtctataaaatagaaattttagaaaatttgctccacctacctcacacagctattgtgagaaatcaatgagatgaggggatttgaaattgtctgaaattggaagccacagctgcaccagctagatattgttcatatgggctttttcaccagccaggttactataaaaaccaacaaactttccatagttgcttctctatcatttgtttccacttctcttttgagtgttgaaaagaaacattttcagaaacttctaaattctgaattagccattgaaatccagcaagggcaccaacttggatgctgaagtggttcagaatggggtcacagaagagttgggttggaaagaatgaccatgtatcactttaaaaacactaataaagtaatagcagctgggtgcagtggctcacacctataatctcagtgctttaggaggccaaggcaggagaatagcttgaggcccagagtttgagaccagcctgggaaacacagtgggatcctgtctcaaaacaaaacaaacaaacaaacaaacaaacaaacaaaaaacaggcacagtggcacacacctatagtcctagctactcaagagattaaagtgaaagcatcacttgagccaggagttcaaggctcagtgagctatgattgcaccactgcactccatcctgggtcacagagcaagccctgactcagaaataaagtaaaataaataaaaatgtaaaacaatattttaagagagagaagagttgacaaacaaaaataacagaaaaatacattaaaaatcatcataaagacctcaaaatgagaaaaaggcatactgtaatattgtattgtcatcaataaaccacatttggctgatcaagaaatgcaaaactagaccaaaaagtacaatgacaacaactgtggccgagccagcatccttgcattcatctattcattcagcacacctgtgttcagaactttctctgtacctggcactgtgccgcattagggtgcagaataggacaaagctccggactccaagtaggggaggtgaacatgcaaagtaacaaccataattcagtgtggtgcgtgccgtgctctaagaatgatgacagtccggaatgaggacactcattggagatgaaagtgaggggtggagaggaatgtgaaagccagggaggacccctcagaggaggcaatgcctgagaggaggctgaagagtgacaggtggggcacagccctcatggctgagagatagcaggattaacttctcagaggacttcaggaaagtccagccaccagcatgctgggcaaaggcaaggaaccagacttagtccttagcatctgagcacagaaacaaatccttgcatgtttcttcatcattcccagccgtttcctgaagctcaggcaaggaatgtgaaccattacttggttttattgcgttcacaggcaatgtaagatgatcacataaaacagttggaagaaggtgttgggactatgcagaggataattccttatggaccaggaatcttggcagaagtggctggtcaacagggacagagaactccttacaaccccctgcagctaccaaccccagccctaaaatcattaggattagggtacccaggaatttccactgaagtgtggcaacagggaggttgctgagaaggaccagagccctggaggcactcaggtttcctacacctcagacttaacaacaagctcttctctttgagatgcaaggagagccctctgggctcaaatctaccccacacccatccaaccaccaaggtaaaacaggcagagaggaagaaccacaatattcccaacgcatggggcttctgagtcctaaataaggcaatttggggagctgagtaatttacagtatagtcatttgtcatctgtgatgtgtggtgacagatcagagccacgccgctaagcgtgcccatgctcctctctccctcctgtgggctcccgtgggcgctggcctcccctctctcacccaaatcggggtaggtgggtcctactcactgtgaggggcagagcaacctcagggaggaacaggtcctgaagcagctcccccaacctcccaagaacctacagatggcaagagagacacaaccttcaacctatggaagaccatgaggcccaggaatatgctcccctacctagctgatggaggaaaaagaaaagctatgcataataactagcagatactgtgagaaatgtcttccaccaagagtaggcgaagaaaacaagaaacatggaaaacaataacccatttgctttcccaatttccagttcctcttcattgcacctaatttgaaaaacacatagaatttttaagctcaatgactagtcatctatcactcagtcccagagacagttttattaaaaaaacaaacaaacaacaacgagaaaaaaacagatgagcattctagctcctacctatactgagcaacacctcagttttctcatttgcttttaacgattctaagttcggctcctagacatataggttttgcctgcatcgtgcattctgtatgctattgctgcacgactttcagccttcaaggatcagggatgccacacaaccactttagtagaaattggcctctattccttggttttgccttctgtttttcacttaactttttttcattttctgttttccttcctgcctccctgcctgacttctttctttttccaggaggacagaaatacagctctccatttgctagtgcaaaccataaaagttaaaagggctcctagaaattatccagtaacacatcatttcaatattgaggaaatggaggctgagaaatcacagcctaaaaccacagttatttattaagaatcagctttaggatcctgaaggtcacttgactcttatgtcagtattctttctactacagagctgcagtaccactgcagggcaaatcagtttgggaaatgatagagtaaacaacttcttaacccctaggtctgggggacataaataataatgatgataataatgataaactccaaatcaaaatctacctcttgttctgtaaggaaaactgtacaatcaaagaaaataattctgtttaaatgttgacttggtttaaatgtcaaaacaaaatctcccaaaactaatcaagattaaatatatttggctcagtcacataagaaacccatgcatgtctcccaaaatagttacctacttaagctcagtgaagtatggagactgaatgagaaaagaagaaagcttagaggttgattgcactgggcaacttccatggtcttgcttatcaagagaaagaggagagtagagcagagaagaggaggggagggaaggggatgggaggggagaggaggggagggcaggggaggggaggggagggcaggggaggggaggggaggggaggggaggggagggcaggggaggggaggggaggggaggggagggcaggggaggggaggggagggcaggggaggggaggggaggggagatgaagggagaggaggggaggggaagagaggggagaggagaggaggggaggggaggggagaggaggggagaggaggggaggggaggggaggagaggggaggggaggggaggggaggggaagagaggggaggggagaaaaccctccagagccaaatcccaaatctatattcagggtatgattatcaagttggtagattattcaggattttttctctacccatccccttctgccaatatgatttttagatcactgttctatacccttgtacctacactggaaaggggaaaagaaacaaaagagactggaactcttttttttttttttccttttttggttatcagttgtggtttataataatgaggagaaggaggaaagggttgaaaaaccaaacagaaggcccaagacatattttagacagtgacagccatcccctcaacactgacccccaaaccatgcattttggcttaggtacagttctctgtttcttggaaaaatgcaaataacctaaatgggattttaaaaaaataacagaacttttaaaaagtagttacaatgtattcaaaggaattctttcttaattatctaaaatggcttgaactgttatgcaagtaaggaattgcttttattaaatgccaaatctttttttaaagcaacctcagggagttactcattctcaatgagctgtgtctatgccagcaaaacaaaaagtggcaatttgggcaatagtccacgtaattcagaccaaagaaatctgtcattgctgcaactccatcaacatgagcttctgaacaacctagcccattaggcagcagatgtgggcagagaatgggccagaagagatgaagctcccacaaagtattattgtaaagctgaatagagtcagactcttatttgcttgaattccactgattccttaataataactaaaaggccagcaactggtgattaactttgtaaaacaataattggttgtttacgcaagtccactctcacgcttggggtattcttcacagtcaaggtgtggaaactgaatagaggggtttagccatatccgcctctgtttagagagaaaaataacattgggctgtcagggtgctggtctttaccttcttcaccattatttccgattgctctatgtttcatccaatccatcacatggcaattgtctttttatcctactaaggagaaataaattgactgcaccagggttgattcattcatgtagaataaacattgtctcggcttgtctacatagtgaaatgtagatttaagaagtaatgcagataaataatgggatgccaagcttagaggttggaggtgggggaaggaagcccaaaccctttggtgcgtcatgcctcataaaagacgctgttctccatttccttacatgtgtatatgggctctgcctcaatgtcccttacaggaggcatttttagggaacaaacaacttaggctgagaataaattaacctcccccaagcaacagtggtaaatagataagtaagatgggagacataatatacatatgttcagtattagaagctgaatgagaaagaccaagtcaattgtttttcaagacaattaggcaatactcaggggcagaccaggaaaactaaatctctttttctttttgctcattacagcattgcaaaatataaaagcctgcctatctgtgaagcccgcagttagaacattttcagaacagtaatctcatcttctaagaactagctactgaatgtaaagatatgtttccaagtgaaagttaaaagtggctgcctgttgccactggccccacagacaggtggggtacaaggcagggcagcccatgctctgtctcccttgatgccatctcattccactcccaactaatgagactttaaatatctagaatgggcctggatacaaggtatggatttgtccctgaagcctaacacggactaatgcccagcattgtttgggtcacaacggactttcaaaccctcacctcatatgcagcttaagactgtaaccatttaaaagtaaggcaggccaggaagactgtgtgccttcagcagatatggcaacacaggttcagagaggttatcgagccatcatagctcacttacctggcggccgtggaggcctgtgactcccactctacctccattgccttccattgtctgcgttgggtttaaggtgataccagggctggcgtcgcagcccattagtcctaattctgactttttccaagttggaaagtatgcccaccctctctgtttcttagacccatgttgggggctaaagaaactccatcttggatgctaatctgccatgttgacttttgagtaaccctagttctcggaaggcctgtaagatttccagtttatctattgttcctgcataacagcactgtatttactataaatcctgcccctagatgtcaaaacaaccttgatgttatggtgcgttgattgtcctacacatcacttctgaatcacatatccccctttcccgggcctgaggagtaatggtgcagagatctactatcttgtctggtttctgtttggaagcctctattaaatgtttctgagaaactggatctgtcagcctctttttcagcctctcagcttccttgaactttgggggctaagtttgcacagacctgcccactgtgaaacaactcatcacctattaaatgaaatgagaacagtcatagtgcccacctcgccaaccccacagaatgactgtgagggcagctaacataacagacaaggagtccttacacattaagggctacaggatagaagcactatacaaataggctcgagctcctgggagcactattttaaaaaatattaatttaatttaaagttcttggatacatgtgcaggacatgcagatttgttacatagtgtggacatgtgcaggacatgcagatttgttacatggcatacataaatgtgtgccatggtagtttgctgcatgtatcaacccatcacctaggtattaagccccacatgcattagctatttatgctgatgctctccttcctcctgctcccagacaggccccagtgtgtgtggttcccctccccgtgtctacgtattctcattattcagcttccacttataggtgggagcatgtggtatttggtttcctgttcctgtgttactttgctgaggataatggcttccagttccatccatgtccctgcaaaggacatgatcttgttcttttttatggctgcatagtattccatggtgtatatgtgccacattttctttatccagtctatcgttgatgggcatttaggttgattccatgtcttggctattgtgaataatggggagcactttttaatcatctctgtttatgtgttcaggctgctggtttctcccacctctccatccctgactcttcatctctatttcactcctgtatctgagcactatcttcatattgctgggctaggtagcagagataccagctgaggattacagaacccaaaccataaggaactcagcacatttgacaagccatgtacatgtgagtgaggaggtgaaatggaggggtgtctgtgtgtgtctatacgtccccaggcttcagtaggtaagtaatttccagaagccttcaaatatccagatgtttaaataaaaatcaatgcattgttatcttttttttcatagtcttctaactgtgataccatatggaaaggcctgaatcccttaggatggtcttaagactaaggtaagaggtcagagagagttgaatgcaaagcctaaatcacacggtgtgcgtgtgtgcattgggtctgtaattgctgtcagtggggagaggtgtgggatgctgaagcttcttaatagcatgggagaaagactaacagtgttttaaatcagaagaaaagggttccatgtgataacagcagaggaaagaaatcatttagaaaagagaaaatgagatcgaaatctaggaacaccccccaaaatgaaagatagcttagaagctaccgttaaacaattaaagttgggagagaaggagccgccagctgatgtgggcaaacacaaaggtaactaaaattgcacagtggctgaaaactttgagctgtgctgaagcccagttgagactacctgcccatgtcctcacctggcaggattttctacctgagcaatgtcaatatttgcagatgttgtccggaatgctggggtttgtcaaaatagattggtgaggacttaaagccttccgggggaaggtagaggagttggtgacaccatgaggaagtcagatggggaaatggctgattcatcacaactctccccactgcatagggtatgtacaggcacgcatgggggccatttctgggtggcaaagacacaagaagcaaaacaaatgagttgcagaagacggtcttaggttagatggtggtaagaggaacaaacagggttcttggaggaaaagaccacaggtctgtgttagacaattgtaaggaaaaacatagatgtgtgcgcacatgtgcacgtgcacgcacatacacacacaccataattaaagagatcttagacaacccgaccacctaaagtactttcaaatttcacttgggagcaatccttagcaaggattacaatctgtgcagattgaagatgacaattaaaactttaactttcttaaagcccacaaatagtgccttgagtctttatggcaagttgtcaggtgctaccaagagctcgcctttcctatctctccctgacaacctagaaatatctgttattctcgcccctgtggctacaacagtgacataataagaaacaagggaggagacgaatctctccccagactctcatctaaggaagccaagggagggtgaatgaaaaagaatagaagataaccatagcggtgtgagtcttgtgctattgattttgcatctgtctgaaaacattactcattggaatggtggcagccctcaggaagagggtgaggaggtgtccttctgccagggagggctctgtgctcaggggcccaacacatgccaggagctttgggcagaggaagtctcagggcttgttccttggcctgcctccaggctctgatgatttgctgagtgaaagtgacaatggttttagcacctggaagttgtttgaaggtacaagtgttaggtgggagttcaaataaatgccagcttcatacaagccagtaagcaagtagtaccagtgaaaatggaaatataaatggttaataaggtgatcattatggataatagatgaagtaataaaaatgtggagttaaaagggaattaaagtttccttgtagaattttccccacagtatagaatccatactattgttgttatggcatctcactgtagatggtttgggaaatgctttccataacacaggcatggattattaaataacattagatcacattgtgagaaggtgatgtctgtttttaattctcttttaacccttctgagtatctcaaagagagagagtttcaattaggtgctgcttctctgacacttgccaagctcctttttttaacaaagagagagcaagcttcaggcttagagactttgatttggccaaagcatctatcaaggatctaatctcattgtttggttttcattttatctctttttttaatgtattttctatatgcaattactaaaccatataaggtttcttccttaaaaataaatgcattgaaattaaaaacagtctatgggaaaagatactaagtacaagttacacaaagaggacatggataatggaggtggcacaaatgtgaccagagtttggagaacaaggatgttggtcccagtgcaggaaatgacttgcccatagtgtcacatttgtctggtgtctcctatgaaggtggagagaagatgaaaggcagcctcgtctgaaaagcatctggcactcagagaagccacgtgacttctctgaagctctggatcccaagagtctcagtccctccttttcaggccaagaaacctgaaacccagagccaactgatccccaaccctgaggtgcatcacatcgtagtgacagaattagtcactttgcctcatttttcttccatcaatttcctagatccctgggagatagagtgagctgagacccaggatacctatcagatggaaaaacagacaagccattaccctcttctcactggcccgtgctccaaatccctgctgctctgaatgctcccccataggaggcagtggccatgaagggtggtgtcagcacagggttttgggccttctggtggctgatcactgcctttccacattgcagcccagcatgaccagcatacaaagtggaaagcaaaagtccatcctccactgcctgccatgcatcacatccatacacaattgcatcttgatggatgcggcaaacacaactttatatgtctgccacggccccagtgacctttcagatccctgagttaaagggaccattattcatctttatgtacagcttcctatgacaggcctacatgataaagcccagagacactttgatgaagtaaataatttagccccatccatactcacctgccattcccaaatcctaatgtctttccagggattgcttcaccaaaccagtggaataatgagtcccttattgatgacaccaggtcagtgtaaactttatgcagaagctaaactacatcggagagcatatgagttttacagaagaatatggatgaagagcatttacttaagcaaggttctggaaacacaagcttaccacacaagtacatttccattttaaaataatgaatattatgtgttgggcacctactatgtgccacatgttgtacttggaccttccatacattgtttcatttaatcctcaaaacagccttccttgcaaggtagctgttattatctccatcatactgagagtttgaaatcaagatggctttctgaatgtcatcctaatagcaagtaataaggcagaaagccattcaaaaattttactggaacaaaggaggatgtgaaaaaataaatgactacatggcagagttggatgtgaactacagttggtctgactcccttcatattcattctactggaccttactacttttatctccgtgagggagtttggtttaaggataggaggggggctgcctggcaccttgcttcctaacagccctttatcctggtttgggggtgcaggacattaggaagagtgtgtgagatccccatgatccctacttcccatcttcagatgcagtcacagcataggtttggtgggatcttgatgtgtcttctgctgctctgtcctgaattcaaatgattactttccagagacatatacaaggccagggaattccaaagagcaactagtattgtccagcaggtttgtgaagagcacagggaagtggctgctggatggtccagcttcactgagaaaggacttgtctatctgtaaccagtttgtattttgtggtctgtatttgcctatggctttagaatcttcccaagtcagacttgaagagtttgacaagtccatggatttctcattccaacttcccattgacaactgagtctaatgactatatatgggttaaaaaggtaacacagacaaagaacagtgatggtgtcaagatggtggtgttttgggtaaaattttctccttcacaacttaatttaattgagataccataatttctaaaaatggacagagagtcagccggacatggtggctcatgtgtgtaatcccagcactttgggaggccaaggcgggtgaatcacctgaggtcaggagctcgagaccagcctggccaacagggtgatacgccatctctactaaaaatacaaaaatcagccgagtgtggtggtggttgcctgtaattccagctactcgggaggctgaggcaggagaatcgcttgaacccgggaggcagatattgcagtgagcagagactgtaccatttcactctagcctgggtgacaagagcaaaactccatctcaaaaaaaaaaaaaaaaaagggatagtcatactatcaaatgttatcaatgagataatggctgagaaaagactattgcatttttagttgggtatgacttgaatcttgaataacttgtattggagggcctgggagaacaatgtgaagagatcaggggcagagtcagaaaatgcagattctcctcccagtttcaacgttgactggcctgacaactttgtgcaagtcacttgaactttctgagctatgctttcctgtgctgataaagtggcaaccacagggccttttctggctgtctcttaggccttatattaagaatatatacattatggattgaattgtgtaccctccaaatttatagcttgaagccctaattcccaatgcaactgtatttaaagatagagtctttaggagggtatttaaggttaaatgaagttataaagatagggctctaccagggacaccagggagctttctctctgcacactctcagaagaaaagccatgttaggacacagtgaaaaggctgctgtctgcaagccaggaagagagacctcaccagaagccaactctgacagcaccttgatcttggacttctagtttctagaactgtgaaatcataaattttggttaagtcatccagtccatggtatgttgttatggcaacccaagcagactactgcagagtcgaaagagatgaggtaagaaaaaaggtgtcaagtgtcacacagataaggagctttcatacagtgctgaggtcgaaggccaggctggaggggagcaggggacgtgaagcgggagagaaggcacattctgactccccccctttgaaactgaagagcacaagaaatgagacatgaagtagcttgaggaggtagcacaacagaaagaagtttggtaggatggaaagccagggtctctcccgtgaatacttacaaaagaagcagagataaccagcccatgagatatttacaaacagtatttacattgggtcatcataatgtcaagcttatctccatgtctcaagagaagaggattagatcaaatgtaatagtccttaaaaaatggatgttccctgattctaaaagctctgcatggatggagctttcatgtattcaggtttgtgactcactgacaggtgtgagatggaactaactcattgcttcacacaggaaatattcccgtgctcctaacacaaactgatttcatgccaaaggcatgactctaaagcacaaacacaataaggcatgtagctgacctggccaaacagaggatggcagattgcactgtaggatctgtaatctttctgctcctccattcctggctctgatctggatttcaagttcatgttactggtgatgcctttctcttctcttgatactgtgtatctcattgcataaatgatgtccagagtaatgcattggtatctgtctacgccccttccagttcaaatgtccccccaggctctataatgctaaggtggcaaagctatggcacaattagagtaaagccttggaaaaggtggcatagagggtgcaaggggcaggaaaactgaaggggtgaaacacacatggcaaagatgacaaggtaaatccctgttttgaaaaggcagtaattcaggttcttcatgcctccttgtgcctatcaagtgttacctagggaggaggttcccgaaggaaggacaagtatgagacacaaaaggcacacagttctacatcctggtccatactcacccatatctccttcacagatctcaggtgttgtgcccaatcacagctacacacaacaaagccaagcacacagcatctaagcctgccggggtgggggatgggagcagccaatggtaaatgtttaacaaccagctttgggtaagagggtaagagaggaggtaagctctgctctgtagtatttgctggtttctatagcataaatacccccgccatcatcaatttctagctaccaacaaaaactcactccatggagtcagaaagagttgtgtacaattaggtctcggggcactgggtgagctgactgcaacacacccctgagaggagggaaataaggctactaacaactgctgagtgtcttctatgcaccactcaccctaagaatttacattattatttcatacatataaaaaattcccttcctgtttttaaatgatggggtttcagattaaactccatttgccttttaccaagcacatgtgagtgtactggtataaccaaggtggtgcctggctccagtgaaacataagaacccctgatctggctgatggtgccatatagaggggagaaggtcacctgtccggagacctccacttctgaggacccaccatccagggctgcatttcctctacaacatttcccacctgggcttcacgtagtcatgctcatggatcacttatcatgtgttaggactgagctggacactagggctgtacatccctccaacacacacacaatctagaatgtgctgttcaagttcacacacacatacacatctccctaatggactccatgctaggggctgtatagggaataaagatggtgccaacttggtcctgatctgaagatgtgtacagtccttccaggaaaccaggacctgggtatgacagattgtgaagcatgatgctccattaagagataaacttcatgggatttcagactggaagacattatttctagatgaagacaccatcaagaaaagcttcatggaggaggctgaagaacatcccagtaaatacggctgactccgacagagtacagcacattcatgcctttctccagccagtatttcctgagcccatctactagaggttccgcactgtgccaggcaccaaagaagattcaaaaatgtcttttccaggtgtcctcacctcatatttaggtaaaggccaaacatccatttcagtctgggcagtaagtgcccaagaaagatgcagcagagatgtcacaagctagaatctcttagcactaagaatgggggtttgaggggaattagggagtggatggaggaggaggaggagggaaagcaggctaaggaaataactgtgttgagggctcaaggttgcatattcttgttacaccagaagcaaggagtcactgtctcccccaagacagcctgctaaattcattatttatattaaaaaagaagaggcataaaaataaatttcctagaacttacagggatatgggtgtctgtttctttataaaatgagaggccctgccttgcacaaataatggcccactgtagtaatatcagcttgtaacccggacccgatgctgaactctacagcatccacatctgccgactccaagtgtctcatctaaactcagtctgttctccttgtggaaccccgtaactcacaattgtgtggcaaatagcatctatatcatcagtcccataagcagcttcctgggaaagatccttctatcattcatatccagaatgaatagaattttagtgaattgaattctattaagtccatggctgtcatgtctggaagaaacttaaggagagaaagaaaggataagttcatatttcagtaacatccgagaggctatctctttaaacctctcttccaaagtctggggcctgatttctcccacagtggtacaaggaataaagaaacttggggctgacctcccctggggtgcaacagcccagactcaggtccctggaagaagaaaataacaaaaatagctaatactttgagcactctgcaaatgttaacagcaaccctaggaggcaggcatactattctgtttcatagaagaggcactgaggcccagcggctaactgacttgtccgtgttatgctgcactgtaagtggtggagctgtgagtttaatccagacagcccagtggtgatcctcccagttcccttcatggtggtatatatgtcctttctccagtcaagcacctcatctctgcttgggagttaagagtcaggcatgaccaaggccgggcacggtggctcacacctgtaatcccagcactttgggaggccgaggcgggcggatcacgaggtcaggagatcgagaccatcctggctaacacagtgaaaccctgtctctactaaaaatacaaaaaattagctgggcgaggtggcaggcacctgtagtcccagctactcaggaggctgagacaggagaatgtcgtgaacccgggaggcagagcttgcagtgagccaagatcgcaccactgcactccagcctgggcgacacagcaagactccctctccaaaaaaagaaaaaaaaagactgtctctaaaaaagagtcaggcatgcctaagcctgaatcttgggtctgctttactagttgcatgaatttgaccatgttatttaacttatctgagcttcagtttcctcctatgtgaaatgggactaatccctattcacaggattggtatgagaaattgtaagtacaatttaaatgtacttacagtgcctagcaactagtaaactgtcagtgcagggaatgttagtggcagtagtcgtggtggttgtgatttagaatcacagaatgccaggttttacaaaccctctaatttaatctgaaatgaatgaatgaatgaatgaatgaatgagtggacggactcggcctcagtgtaacatctagcatctagtatggtgcgggccattagtggaaaatcatagaaatctagagtgttttgcaaggtatgtctggaacctcagatattcctggtgaaactgtctaaattgagtttaaatcccacttctatcacttaataatggtgcaacattggataagttcttaggctttcttaggctttgtcttcttgtctgtcaaataggataacagtaacttgcaagttgtgaggacagcagtcgaagtttggaaaagatttagcacagtacctggaaagattttatacagtcactactaaccttcttaatttacttaaaaataaaggggaaggggtagcaggagctattcattaaagtctctgagtgaccccgctattcctggcctaccatatgtttaatataaagagttctgtttaaaatctggttgttgcaaagaaggtgagggaggcactgggactctgcgccgggccccttcttccaccagtccctctctgaggaaggagaagttcttgtttggaactctcctgctgttgggctgtagaaaggtctctcgtgtgggattcacagaggaggccatgcagggttgcctggaatcaactgttttaatgaataatattaaggtagtagtgacattattaattaatgaagtaagaatgtaatgaaagatcaaggaaacaaggaccaggaatgggttggccagatgcctcctcgtacctcctgtccactgtcctccaacttctgctacctgatgcgcccctgagacactgacccaaaactgaggccctggaaattccatatacactctttctcctggctttgtgtttacagtccctttgtgtaaggagtccatgaatgtttagttaccagcctgttctcaaagaatttgaaaggaggcaaatagctttaatcacattttacagggaagaatgagaaacacaagaccgggaagcaagtgaattagggccacatggccaacggcatttgtgtgtctggacagaccctgtctccttggggttggaggcgctggtagaaaactgcctaatttcttccacaagtacacattatgaatctgctgtgattactgtaggctattcgagaagataaagtatttttaacacacagctcaagctttctagttaaggaaacaaaacaaatccacatgaaacattaagtaatagattcattcattcaggcaagcaggaataacagggacatttgcagacagaggttcacctgggtgagggctgggtggttctgagcaagctcttcctttctctaaacctgtttccttctctctagaggagataaaaataatctctgcctcacgggttgttgcatcgatgagatacttacatacatatatgaaagtgctttgtaaacagtggcctcctaatccaatagaccttattattattattattatcagtgaatgcctactttgtacaaagcaacatgcccagcaggcaggggatgaaggattcatcaagaaaggcgattctaaaagtgtttactaattatacgctaataaaaaagccttcccaagagagcaagcaccagaggaaagatgccgacaataacagctctgagttccaaagagggaggctgtccagtgttggaaggaaagtctgggccacaaggtcggtcccccttggtttctagccagctccacaccacctggctctgcgaccttgagcaattggctgtgcctctctgtgcctctgacttctcatctgtaaaattagggggttggatttaattatctgcacagctcctcccagcctgacgggatgtgatgtatggtctatgaggggctaggccttgaaagctgaatcagatttcaatagaggagtgggagctcatgaataaaggcacagaggctgagacaggaatatgcaagagagagggaacaataaaaagagctgacatttattgagtgcctaactttgggtcctgttttaagtgctttgtgcgtatgaactcattacatcctcacaacaaccctaggaggtagaaaactgtccattcctcttttacagaggacacgatggaagcatggggagcttcagtagtaacctgcccaaggtcacacagcttcaacactgccacttattgctccagcctgagaccaaccaggtgggagttcaaggtttacatacaagaggaggtgggtgtgtcacactaagcggtggggtgtgggggatgggtgggtggtgacctgaatactgatcttagtcctagtcctttctttgatttctctgtgacaactggataggtcagctttcatggatctcagttttaactaggacaaattataaatcatactgcatggttggagtgggggacaagatgagaggtgaataaacaacgtgactgcaagatggcatcttttctattggccttatctgtgcctgtgagcaacatggctgggccatgtcttctgccacttgtctgtccagccaaccactctgtcccagtggaggggacccgcaggttggaaaaactgaaagtttcacaatggagagtcaaaacagaaagagtgcttagggatcatctgcccaaattcttctccactaccattatactgacttggaaacagaagctcagggaatttaaatggtttgcccaaggacccgccctccgtccctcccttcctccattcctctcttcctccctttatacataccactgtgttttgtccaagtccacatagatgcagggcagagctaaacacacacagattaaacaaaagtaatgaagagaaaagagccccctgatgcggaaatggaaggaattctcggaacttagagctggaggccttaacttgggccagggaactagaggatgccttctatagaaattgtttaaactgagctcttaagactggattatctaattttagagaaagcaagaaatgaagccaaaaaccaagcgcttatggccagtcctcatcaggcctgtgctagaatactaacgctgtatttcctctcgccatccagtgtttctccacagagaacaaagtgcattacagataccctcttggctcgccaaactccactgtgcgagaggcagggagtcagacttattattcctcttattatctcctattactgtttgcttccatttttcccagagttgtgaatttataaaactgacaggagttttgatgtgacccggattatacaaacacctgcatggatgtcactgctgttttctctctctcgaagagaaatgactgcaagtgtgtgtgtttgaagcaatttggtcattataccgtttgagtttttcccttttccctggcctatttttagatttcttctttcatttcccgagctctattagaataaggttttcattttaatcacgctctctgggcaggccaaatttaggcataatgaaaacaaaaagtgttatgcaaaatgagacgttagaggaagcccggcccggcgcgtgccttgcatacccaacacgctggctgggaacagcgcgcaggttttccacgctggcccagctctggagcctcaatctgcagcgcctgctgttcgcccccaaagcaaggcagcctgttagtgctccaagaatattccgttgcataagaaatatagcatcaaacttttctgtccaccgtgcctccagcagcgcagtagcagatatagggtttgactgtggctggcacagcgtgaggcggccctggccacagtttctgcaaagggaaatgagactggtcaggttctggattgggtggggctgcagagatatcattagtaatatgcagcttgacacctagggtcttggttctgcactctagctgcatgtgagaatcacctgggatgcttttaaaacctacttcctttggaaggcaccccagaccaagtgaatcagaacttctgagggtggcacataggcagaaggtttgctttttctttaatatccacatcctccactttaccaccatacctgtgatcccaagtccagccagagtggagaaatactgcccccaggaaaagaaatatgggggaagggaggagacatcttgttgctgaaagtgtagttcctgcctctcccgtccctccaatcaggatcatcagggagcctgttataaataaagaatctcagcctccaaccagaacctattgaatccaaatttgcatttttaacaggatcccccagactccgggagattcatgttcacattacaaactgagaaacactgttttattcctgtttttttcatccagggctatgtgtaaagcactaagaatgcctaagagcccagattctgcagtcactactgcctaggtttgctctgctgctcaattcacatggaatacgttacacagcttcttcatatctcagtctcctcatctgtaggatgagttatagcacttacttcacaggattcttgtgtgaagcagattagctaatactgcttgaaacactgctggcttgcgcgtgttctctgagtgttattattaccatgagagggatgactgggcgatgccctggactcctgctcacccaggtgttttcaccgctgactgcattctcccatggtgtagagtaaaattcattgccataaaaagtttcttagcaaattgatcttaccaactgaatgaaaataaatttatgttggagcattaggaaatggttaaaacaagtaaactcagagctgttgcatgtgtttttttgtttgtttttgttcttatttgctgaaaggactttgttctgaatgtttcagctcctgtgctagactccccatggtcagcaggtcactaaaaggtgttactggaagtgactgcttgccttccaccatccacattccccaatccatgatcctacagggatagaacagaatgaaatgtgtctttcttgggtttgggccccaatgcaggtgaggaacaggcaattcccatattcatttggcacaagacaggaaaacaaaacatctatccctaagactggggtgccttgggtaacagagcgtgatggtttttaaatacatccacagattctttggtattcctctcttcaagagatggagcataattccttcctctgtgaaagcgagccagccttagcgactatcttctaatgaatagaatatggtgtcagtgacagtatgtgacttacaggattaggttacagaaggcattgcagcttcctccttgtcctctcttggaccacttgctcagggagaaaccagctgccacgccatgagctcagttaagcagccttatggagaagtccacacagggaggaagtgaggacatgccaatgagccattatggaagcagattctccagctccattgaagccctcagatgactgcagccttgaccaacagcttgactgcaacctcagaaaagaccctgagccagaaccatctagctagggtgttcctagatgccgaacctacccaaactataatgtcacagatgttgctgtatttttaagccactaagttttgggggaatttgttatgctgcagtagataaccaatacattggtcttgaaaacatcaaatagatgttttctgaaagcctgagcaatgtacaaaactgaaagaggatagggatccagctgaaaaagaagcacgtcccatgccatgagagaagatgaagattcatgagattcttgtcttcttagtacacttacaagacatagactctggagcctggaagtgctgggtctgaccctggctttgccactgactggttttgtgacctgagtcccttaactaatcttcctcttagaagaacagaagtgatgtgatgttggagaaccaacccagcacttgccaaatgggactcagagagctggagctactgctcctacagtgttctctttccccttctccttctgttcctgactctcagaggcctgcagcctttgacctcagcacacttgttttggggatacatgttgttctcaggggttgggggtagagcagagtgatgctgtgtggagaagaaggagctagtggatagcatgcttattctacctggagcttgcccgagtgagggcgggtgtctggctgaagcctccactagaggaggggatcgagactactgccaaatcaagtgtcacagtggcactaggggaaggtggcatcacatggaacccaccttctgttttcccacccactgttgccagaggaagaagaggaaggttgtgagaataatggcgggtgctctccccaccaaccacccatcttctcctaccctcggtgttatagtttctagggaggtggccctctgagtcactagggggagactgcttctctctcaggctctagcttggttttactctcctctgccctctctgaacccacactcatctcccctcccctcaaggatctaccacttgggaagactttctcggggaaggggacaagcaccaattttgataaatctctcttgcacagatcgaagtgaagagcacctgaatttgagggccaagaggttctcatatcctggtgagaaggtgcaatccctgaaattcagtcctgctgccctgaaaggtccaagaccaacccccacaaatgagagtgaaaaggaagctggtgccatccccagccctggccaccttcccctgatgaagggcatctgtaggggttctggggcactcgattgctccagatcactctgctcctgacatcctcctggcattaagaggaagacctctggaatgcatttcaccaattgaattgtcctggcctccctcagctgttcccattcctcaggcctgggggaagagaagggaaactcaatctcctgcctgccagccaggattaagtggaaaatcaatcttgtctgaactgcccttcccactgtagcctttccgaagatgagcacagactggggattcaggggttgaagggccactctgaggtggctattgcacacattgtctggacattccttcctacctattagaaaggaaagggacctcaggaagctctctcaggccctgtatgcttagcttctaaacctgaaatcaggccttcttctgcagaatgagataataaggatgtctggaacttctattgtccttttccctaaagagtccaaaggattttatgcacatttctccaataatccagtaaaatcagctcccaagtcccaatgccacctgattcagcagagggaggagtcaaaggactgaatggcgaataatccaaggcctcatccctgccccctatctaacgaggagatctgaaatcaaaaggccttggctcccaacctggttgttcttagaccattacctagcacctgctggcagtttataggatcagcctagagaactaaagtcccagggtacttaggcagaggggagacaaaggcagaacaagttttcaggtgggaggaggacagaggaaatgggaaattcatgtggccaagtctgaattctgcccatttgctcagggagcatcactgtagctccatgtatagtcaaagtcacatggtttttggctcctgggctgcctcatttcagccagcagtggctatgatcagtggctaatgcccatccctgttctctaggacttgagtggtgtgtaaaaattgacctggagcaaggcccttggcctctctgagcctcagtgaggttcctcacttataaattgacaaaaggattccttccatctcctgaaggtctacaagtcacaaatatgaactccttggggatgcagcaagggaaccagaagagttactgcaataggcattaggagagctggattatagtccttgcccattagctgactgtgtaatgtgcaacgaatcactggacttctcacagccttggtttcctcacctatcaagtgaggctgttggttatattcttcctaaggactctctcagttctggcttttatttccgaattcaatgattctacatggagggagatataatagaaagatactgttccagacattgactcccttctctgctgatatggtttgactgtgtccccacccaaaactcatcttgaatttccacgtgttatgggagggaccccatgggaggtaactgaatcatgggggcaagtctttcccatgctgttctcctgatagtgaataagtctcatgagatctgatagttttataaagatgagttcccttgcacaaattctttttttgcctgctgccacccatgtaagacatgatttgctcctgcttgccttctgccatgattgtgaggcctccccagccacgtggaactgtaagtccatcaaatttctttattttgtgtattgcccagtctcagatatatcattatcagcagcatgaaaatgggctaataaagtaaattggtaccagtagagtggggtgctgctgaaaagatacacaaaaatgtggaagcgactttggaactgggtaacaggcagaggctggaacagtttggggggctcagaataagacaggaaaatgtgggaaactttggaactccctaaagacttgttgaatggctttgaccaaaatgctgataatgatatggacaatgaaatccagctgaggagggtctcagatggagatgaggaacttgttgggaactgcagcaaaggtgactcttgttatgttttagcaaagagattggtggcattttgcccctggtccagagatttgtggaactttgaacttgagagagatgatttagggtatctggtggatgaaatttctaagcagcaaaacattcaaaaggtgactctggtgctgttaaaaaccattcagtttcataaggaagcagagcataaaagttcagaaaatttgcagcctgacaatgtgatagaaaagaaaatcccattttctgaggggaaattcaagccagctgtagaaatttgcataagtaataaggagttgcatattaatccccaagacaatggggaaaatgtctccagggcatgtcagaggtcttcacagcagcccctcctccccccatcacaggcccagaggcctaggaggaaaacattgtttggtgggctgggcccagggtcccatgctgtgtgcagtctagggacttggtgccctgcatctcagccactccagtcatgactaacaggagccaaggtatagcttgggccatgacttcagagggtggaagccccaaaccttagcagcttccatgtagtgttgagcctgcaggtacacagaagtcaagaattgaagtttgggaacctctgcctagatttcagaagatgcatggaaatgcctggatgtccaggcagaagtttgctgcaggggaaggtccctcatggagaacctctgctagggcagagcagaagagaaatgtggggttggagcccccacacagaatccctactggggcaccacctagtggagctgtgagaagatggccactgtcctccaggccccagaatggtaaatccactgacagcttgcaccatgagcctggaaaagccacagacactcaatgccagctagtgaaggcagctgggagggggcctgtaccctgcaaagccactgaggcagagctgtccgaggctgtgggagcccacctcttgcaggtgtgacctggatgtgagacacggagtcaagggagatcattttggagatttaagatttgattgcctggctggatttcaaacttgcacagggcctgtagcccctttgttttggtcaatttcttccatttggaatggttgtatttacccaatgcctgtacccccattgtatctaggaagtaactaacttgcttttgattttacaggctcgtaggcagaagggacttgccttgtctcagatgagatgttgaactgtggacttttgagttaatgctgaaatggattaagattttgggggatggttgggaatgcatgattgttttgaaatgtgagaacatgagatttgggagaggccagaagtggaatgatatggtttggctatgttcccaccaaaatctcatcttgaatttccacgtattgtgggaaggacctggtgggaagtaattgaatcatgggagcaagtctttcctgtgctgttctcatgatagtgagtaaggctcatgagatctgatggttttataaagaggagttcccctgcacaagttctctttctttgcctgctgccatccatgtaagaagtgactttctcctccttgccttccaccatgattgtgaggtctccccagccatgtggaaatttacgtccattaaacttctttgttttgtaaattgcccagtctcaggtatgtctttatcagcagcatgaaaatagactaatacatctgcttcatctcttcatctgtccatccattcattcatcatatatgtattaagtgcctattgtgtggtcagattccctgttaggtcctgggccataacaacaagcaagatgagtatggtttggtccatgtcttaatgaatttacaatcaaggaaggaggaaaggctgagaagtaaatatatatcacagtgtatgtaaagagccagaggaatgagagaccttggtatgttcaaggaacagaaagaaagacaacagggctaggccatagcatgcaaggcagggaatactggcaggtgaagctggagagtaggttggaggcagatctggagggcttcaaactccagattaaggatgatgacttctaaaggaatcctagagaaaatcattgagtgattttatgcatgattgtgatagaattaagtttttgtcttgaaaagatcattttgtgtgtttttttttttaaatcgttgtgtaccaaagattcgacagatgaaggtaaaagaaacaaagaggccagtgcagtggtccaggcagagatgatctgaacttggactgggattgagatgaagaaagcatcagatgaagcatctgagaaatactgagaagttagaatcaaaacaacaaaaagggcaattggatgtttaggtggtaggggttagaacagagtgactatggaaagatgttctagaggctctggtagcatgactgacagtgcctggtaacccatgacatggtcttgtgactctctgaatgctaaaccaaacaagttaagttttccctacacaactgctctcctggggctctttcaggtgacaggtgcccacctgcaactgtccttccctgcagtgcccctccccaccccctagcatctctgccatggcctgctattctgtaggaaggacacatagacctgagttctgaaatctctttaaagccagcctctccatatggggtagtagaaatccaacagcaaaatccaaactattacagaaaaagaaagagtgtgcctgtgattttatgacttttttgtgtgtgaaaaatcaagcaaaaataggaaatacgtctgcagtttgtggtgtttgggcttgatctatcatgggctttgatatatcacaatgacaaaattctccaatgagaatcatcaaaatattctgagttactacagacagcatcaccagttgatttaaaaaaaaaaaaaaaagacaatcttaggtctttaccagtctctctctctctgtctctttatgtgtcagggtttagcattcacatactcagtcagtcttatacaagcctcatgcaatattaaaatgtttatgcaactctttctgtgcttgaagcagcagcaaatgttcttggtgtgcaaggaatgaggagaataatgttcttacacttcccaggagaaagtccaacatcagagcaatgcctgcctgccctccatgattaatcagagcaataaatcagatctccctttcctcagctatcttccactcttccttggggcccccaggcattggctgagtactaaaaagagagcatcatgtggtttatttgccataaggaacaaaaattggaggggcactcaaaatgtttttacccaagctcatggctgtaattctccaggcatatgccatgtcggtattagtcagatgtcaaactttaaacccattaaaggggcatgttaatagtgcagcatttcaaaaaggtttgccttcagctgctgtacccttacaggagattgatttccacatatatgaacccaaatccaagtgtcagagactaacagagatatcggtctcaatctggtagctttcaaccaatgatcataagacatttgatgggtaactattgctagagggaaaagagagcttaaagacatcaagcaatggtctcagaacagcacgcagatcagaggcagctctgggagcatggttttccaagcccagaaaaattagaatatcagagctggaagtgaaggcctttaagattattttatagatgagaaatcaaggtccagagagactaaggaatttgctcaagatctctaatttgtggcccactgtctaatgcaaaacccaattgaccttcaaagaggtcagacatttccaacaacacttgcttcctgtggctcactgtcatgatgtgatgtcctctaaatccacaggtcttctctgcttctgagcttctaccaaatgatgaactctttgcagattttacatattagagatgctgttttctgattagtatttatcctacttagaccaatctgtttagtgagctttgttggcaaaggcagtctcagggtattaattggtaggctcaaaccctatgtgaggtgatttactactcctactaagaaactgattccacagcccaagactactactggctttgcaaggagactgagaatgaaagatgaagatggaacattccacgctcatgggtaggaagaatcaatatcgtgaaaatggccatactgcccaaggtaatctatagattcaatgccatccccatcaagctaccaatgactttcttcaaagaattggaaaaaactactttaaagttcatatggaaccaaaaaagagcccgcatttccaagtcaatcctaagccaaaagaagaaagctggaggcatcacgctatctgacttcaaactatactacaaggctacagtaaccaaaacagcacggtactggtaccaaaacagagatatagatcaatggaacagaacagagccctcagaaataataccacgcatctacaactatctgatctttgacaaacctgacaaaaacaagaaatggggaaatgattccctgtttaataaatagtgctgggaaaactggctagccatatgtagaaagctgaaactggatcccttccttacaccttatacaaaaattaattcgagatggattaaagacttaaatgttagacctaaatccataaaaaccctagaagaaaacctaggcaataccattcaggacataggcatgggcaaggacttcatgtctaaaacaccaaaagcaatggcaacaaaagccaaaattgacaaatgggatcgaattaaactaaagagcttctgcacagcaaaagaaactaccatcagagtgaacaggcaacctacagaatgggagagaatttttgcatctactcatctgacagagggctaatatccagaatctacaatgaactcaaacaaatttacaagaaaaaaacaaccccatcaaaaagtgggcgaaggatatgaacagacacttctcaaaagaagacatttatgcagccaaaagacacatgaaaaaatgctcaccatcactggccatcaaagaaatgcaaatcaaaaccacaatgagataccatctcacacctgttagaatggcgatcattaaaaagtgtcaggaaacaacaggtgctggagaggatgtggagaaataggaacacttttacactgttggtgggactgtaaactagttcaaccattgtggaagacagtgtggcgattcctcagggatctagaactagaaataccatttgacccagccatcccattactgggtatatacccaaaggattataaatcatgctgctataaagacacatgcacatgtatgtttattgtggcactcttcacaatagcaaagacttggaaccaagccaaatgtccaacaatgatagactggattaagaaaatgtggcacatatacaccatggaatactatgcagccataaaaaatgatgagttcatgtcctttgtaggggcatggatgaagctggaaaccatcattctcagcaaactatcgcaaggacaaaaaaccaaacaccgcatgttctcactcataggtggaaattgaacaataagaacacatggacacaggaaggggaacatcatacaccagggcctgttgaggggtggggggaggggggagggatagcattaggagatatacctaatgttaaatgacaagttaatgggtacagcacaccatggtacatgtatacatatgtaactaacctgcacgttgtgctcatgtaccctaaaacttaaagtataataaaaaaaaaaaagaaagaaagatgaagatggttaaactgatgcagtttaaccatattctttgtgccttctaggcctgagtttgtagattgtagtgtctctttcaaggctggggagttggatgagatgcagtctccaggtggttgtttgtaagagcagagaatgagacttcccttactctcggtcctactgcatgttgcccaagactattaccaagcaagtttgtgtatactttaggcttatcacaggatatgttcagaggaccaattatttagaatcagactataggtctgcatttgtatgaatgaggtgggtccactactaagaacattttcacctaaggggggtaaaatattcatcagattaattcttggtgaacagtgaacctatcctaatactattgagttctgctgttagaaaaatccaaaatcaccagtgcaagactgtctctgattctctgaagcacagtgccccaagctatggatgtatgtatctatttctcagcctgcatggccctaacctgtgaagctctctccctactggactttgatttctctttttagtggctacacagcaaaccctatgggctgttgggagcacagaagctgtcagcctctgggtgaacatttgagatttccattaagttgatgccataatttgctgtctctctgcaaggttttgctctccattctgggcatccttcatcactcccttggcaaactgaagtggcatggagccactggctgccgagaagtttaacgttgacttggctctggcttgctgaagacagagtgtttgtgtagtggatgttttagtgaggctcttggctgtaaatactttcaggaaaacttgttttctattatttatttcaactctgtgaacaaatacatgctttgtccttcacaaagagaccaatggcaaggagttcttttcccttccaattgaattaatcattgcaggggaaaaattattcccaatcttcaaaaagtagggttgttgctaacgtaatctaggagaaaaatcattggtcaatttccaggacctgggcatagcctagtattccccactgaccaccatcacctttccagccctagaatgtaggaagaccctactgagaaagtagatatggagctttcaaaagagacttcaggtaagaggagccctattgacacaaggtcttctttaatcccatccagggctaagacccttgctattcacagtgatccagtgccaatagcaccagcatcacatggaaacttgttagaaatgcagaatacattgggcatggtggctcgtacctgtaatcccagtgactcaggagactgagggaggaggattgcttgaggtcaggagttgaagaccagcctggaaaacacagcaagaccctgtctctaaaatagtttaaaaaaaaaaaaaaaaaaaaaaaaaaaaaaaaaaaaaaaacttagccaagcatggtggcatgtgcctatagtcccagctacttgggaggctgaggtgggaggatcacttgagcccaggagtacaaggctgcagtgagccatgattgtgccactgcactctagcctgggcaacagagtgagaccctaactctaaagaaatgaagaagaagaaaagaagaagaagaagaagaaaagaagaagaaaagaagaagaagaagaagaagaagaagaagaagaagaagaagaagaagaagaagaaggggaagaggaaggggaaggaggaggaggaggagaaggagaagaggaaggggaggaaggggaggaggaggaggaggaggaggaggaggaggaggaggagaagaagaagaagaaggggaagaaggggaagaaggggaagaaggggaagaaggagaagaggaagaggaaggggaaggggaaggggaaggggaaggggaagaggaagaggaagaggaagaagaagaggaagaagaagaggaagaggaagaggaagaagaagaagaagaagaagaagaagaagaagaagaagaagaagaagaagaagaagaagaaatgtagagttccaggacttatctctgacctcccaaatcagaatctgggttttcattagactcctaggagttctggatatatattacactttgagaagcatgctttagagcttctctctttatgccctgaggcacaatgactcctctatacgctaaattcttagttcctgatcagctcctctcctgtttttactgtgtgtgctgtgtcccctcctgacctagctccaactctgttgatccacatcagtgtatatattttggcttcttattctatcatcactataatttacaacttttacaactcaagtctggccagtgcaatgccttctcaagattcaacacctaatagttagccttgggagttgatagaaatcacttaacctgtctaggctatagtttctccagatgctaaatgacgatatacatatgtgtcactctctatgggacacacatgccaggaggacaaatgaggtcattcatatttaatagcactcattattatacagtgagtgcaagacattatttgtgagcatctgtctgggttaatggccaatatctcctgaataggcgaaccattttcactgcatgcttaattctgaaaatgttagaaaagtagggatttcacagtgttctccaactgggtatggtcttatcgttcaaagatctcagtatactgaatacgatttatgaagaacctctagcaacaggaaaggaatcttgagtacaggtgagtcttcaccatgacactgggagatgaggttccctgtatgcattgtcatctcgtggaaatggacaaacaagaaacagtaataaagggcatctcaacatcatggagaaactgggttgaaattcaggatgtccagacaccaattccacatgactttggactaatgagaagaaaagcagagggtggagaacccagaaagcagatatatggagcaagcaggtggcagtttccaaaagctgggtgtggggtcccatcacataggtcgccggcaggaggtctcatgagcagagaagcagaggcagagcctgatgtgtcagaactagggaactgaggtgaattgaagaggaaggggtagatctttcaaaggggcaaaccgatgcacaacaaccaagaagcccaaaatttgttatctttgggggaagagggatatgtagggtgcacatgagagtgagtgtgtgtgcacactagggctacacgaatgccctacatttctgtcatgcctcttctcactatgtatgtgggtattttgcccagagatctaaagcttctgaacatagctacttcgaggcaatagcgaagctaaagcccttgcttcttcagcacattgggcaaaccacggaccattgtacctgcttctgaatactcatccatccacccatttatccatccagcctacaaatacttagggaacacctaccatgtgccaggctctgagtgaggcactgcccatcttcatgggtctcaaagtctagtgggcatgaatcaagtaagaatagaaataaatgttcaattttcacttcaccatgagagcatgtaaagaaactgcaggtagttgggaaatcaggagaagcttgcttcctgagaaggcggcagttgagctgggctctaaagtatgtgtagggattgacagggcaaagagaagtagggagagggctttcaacagaggcaggggcatggaaagaaagagagcccagtgtgggtgggtgcacagcccagagagcacttgaggtagggaagtggagtcacactacagaatacagagagggctgtcaggggacaagacctccggactccggccacatagagccctcatgcctggaaggaaagtgagcatcaggcccttcttctcctctcctctgttggaatctctccaggtatcagattgaaagaacgatgaaaaggcatccctgctctgcatccctgtgtctctattttcctccaccacccctcacggcacctgtgcaaggagcaagtccacatcaataatgcagcagcctccaggcagcagcctccgggcttggccctgaacctgtaagacactgaacaaaataggaaatctgcctgttttcaggtccatctttggacacgatcatctctcatgctctacagtgtgaattttcactagttgggttgaagcactcatttattttccgtatcctgagctttctaaaaaagatggaagcaaacattaggaagaaatccaacagcaagaatccttcagtgcccagaataatcactgccttttatggagcacttaccaggtgccaggcactgggcacatgcttcacaggcattgtttcatttcatcttgactatattgcatgttccaggcattttagctcccattttacaaatgagaaaactgaggctcacagatgtagaatttactcaaggtgacaccgttcataggtggtagattcaggattggagcccaggtctaccctgtatctccttgaaagcatctcaagcatgcagcatctcctttcttgaaaaattacaaacatatctcaccacatccagctctagacagttttgatgccattgtccttggaagcttaattacatgattactcgagatctcttatagactttgacattaccaatatcaactgcactcctcagcccaacccagccctcattatctcaagccagggagcacagtttaattctgcaaaatcaataggacacatggttgggcagaaaaaatggggtatacgaaagcactttgtaaactgcaaaggtatataaaatattattaaactcatcctaagacataagtcaggagtatgagactctaaaatgttagttaaattaatatgaccagcaaggccacacatctggtaaggtcaaaaccactaacttctcagccaatgatgtttggggaaaatatgagactgcttctttctgcctgagagctctaatcacacagtatgtttattgtctacatggtactcacccaattagaaaaaaagtgaaaaattcagctgattttgccaggttttgtgggcttgacacaatgccaagtagcagtagccagtctcatcaattttctcaactgatttgacatgttattttggtatatgagttgacagagctggaggcagaaaattctaggggaagtaccaactctaaacaattaggacaatgtcagtatgtggaaagtaagtagggtgggagtgaacagtaaagatttttcaaagttcttagtgaagtttgcttagacatcagctataatgccaatataatagacattttatcagcttaaaaatcaagatgaaaaactgagattgcaataggaaatactttgtctagaaatggcaacaagccaaaagggtgcgagtatagagaggggagatcacaaaaataggaggaaaagaaaatgaggggtatgattctgtactcccctaattggcagttggtcccaaaccactttactgtggtgacctgagaagtctttccacattagtcacaccaaaacacagaaagaccagagtttcctgatctgccttcagcactaacagtaccatcaattgcagcaaaagaatcacacaccttcacttcaaatcatggcaggcaaaattccatttgctttacctttcaaaagagcacaaaggcagtgtaactcattcagagctcatggtaaagaaaactgccccattagacaagctcgcagagccttgcaatctaagccaaataaaaaggcagcagtcattcaggcggggctggtgagtgggtaaatcaagtggtgacaaagaaacaagcaattttgacccatgtctttttgtgcagcaaaaggctgagtatcctgctagcagctagcaaataataagtagcaagagttgaaggcaaattttgatgctctttttttcattctaagctgatttagaggctgagaaagtagcagagaatgtaaacgttttggggtaaaattcagtggccatattatagggatatattgacagttaagacctaataacataaggggggaaaggtatttccatctgagagtactgaaaccaccagcatttctaccctcaaataacattgctgtgcatttcttccatgccattcttacaagagacaagaaacgatgtgtcttcccattgtacagaactgaaaatgaagttatggagtgttttctttctcccctgggatcacagtagtataccatgctggtgcttcatccagatgttcgtgtatctccttctacagattccccattcaccactctcccttccccaacccagactgtatgtggatataagaaagtccatgatatggtttgcctgtgtccccactcaaatctcatcttgaatggtagctcgcataattcccatgagttatgggagggacctgatgggacacaattgaatcatgtgggtggtatcccccatattgttctcatggtagtcaataagtctcacaagatctgatggttttatagggggaaaccccctttgcctggctctcgttcttacttgtctgcctccatgtaagacaagcctcaccttccgccatgattgtgaggcctccccagccatgcggaactgtgagtccattaaacctctttttctttacaaatcacccagtcttgggtatgtctttatcggcagtgtgaaaatggactaatatagtccaactcacttgccttgagttgagacatcaccgaggcacaacttccattccatagctcccctgtagatcatgctgcagcatgacaaatgagggggttttgcctgagatcattccataactcagcttcttcccttccccatcctgcttcctgcacttccttagcaatgttcccagggagcacttcttttaataagtcccttgtatactaattctcacttcagggtctgcttctggggaaccaacctagacaatcaaaatagcaaattttatcaaagttatctgtatcactcaggttaggctaaattacattatgaaaatatacaaacctcaaaaattgcagtggttggacataatagagaactacctcttgctcatactacccggccattgaaagtagagaggggctctctgctaacattagtcacttagagacccaggctgaccgagtcaccattttgaacactgctagtcaccatgaaaaaaatagagattggaatgctcgtgtcagcaataagtgttcactcagaactgacatataccacttctgctcacaactccctagccagagctaattttgtggccccatccaactagaagagagtttgtcctgctaagtataagtaagtgtaatatcaccttaagccagaataaggaagaacttcactaatggctactgcagcaaatcagagcttagacccctaatctgttacctccttgtgaaacatgctttggttttcatgaatatcaatttagctccaaaatctatttactttctactagagattacatggttggttggagaaaccaggagctgaaaaatgtcactgttattccagcttaatatggagctcttaggtaatccatggtcaatgctacagttcctccatatgcaaaatgaactgacagcattactttatgtgttctttcactttggtcaagataaaataactggtacagagctatgtgtcctagtgcaaacatttttgaaactaaaaaatattcatattaaataactgctttcaaacactggacagcaggcagtaaaggactgtaatccctgatcccactgtgaacacagacatccccctcaacttttgatagagaggtattatgaactagaagttgtcctctgttgttttaaaccactgatattttgagagttgtatgtttcacagtataacttagcctatccggaattatacagataattttctgtagggaaacagataaggtaaggcatggaattgacctcattttctatctggaggcacttgttggagagtgacatcacaaaagaaggccaaaacatggtcttgctgaggccagggaagagatattgggatttggagctactgaggtgcctggaatttgtaggatatggcaccagaaagaagggagcagtgcaaacaatgagatctacatatgtgcataggtattcccttgagtctttggctgaatactgtgctgcacatgtgcagtataagacttcacagagccaggaaaatatctactagagaaagaaaaattaccaaagataattgctcccataactgcaagatactgtaccccaatctactggagatggcacaagactgtggagaatcctcgataaattcatagaagccccagaaagtccatgcttaggagtagacctaaactagccctaggttaaagactactttagatcatctctttaaaagcttaaaagcaagcttcaaaaggactaaactgattcacaagtaaattgcctgccagaacaaaattcaactatttattaaggaagacaatacaaccaaggcagtcaataatgtaacaccaataatgtctagcatacaatcaaaaattaccagataggcaaagaagaaagaaaatgtgactcatttccagaagaaaagccagtcaatagaaacaaatcagaactgatagagaagaattgattagcattcatttaaatgactttaaaataggtattgtaagttgttcatatatttaagggaaaatatgaatttaataaagaaacaaagaaacaattacaatggagaaatggtaagcaaaaaaattttaaaaagaatccatctgcaattctagaacagagaaatacaatatctaaaatgaaaagttcactggatgggcttaacaacagaggacactgcagaagaaaagattagtgaacttgaagagcagtcataggaactatcaaaactaaagagtagaaaaatgttaaaaaggaaaaaaaggagcagagccacagtgatctatggaaaaatattaagcagtgtagcatacatgtaattggcctaaataaaagtgagacaaaaagttgggtcagaaaaattatttttgaaaatagtgttgattattttccccaaatttgatgaaaaatacaaatctacagatctaagaagctcaatgaaacccacacatgataaatacaatgatggctctaccagggcacatcataatcaaattgttaaaaactaatgatagaaagataaaagatttgtataaaaatgtttatagcaactctattcataatagctacaaactggaaataatccagatgtccatcaacaggagaatgcacaaactaatggaataaccatacaatagaatactataaataaaaaggaacaaaccactgatcgagtcaacaatgtgtatgtatctttcagatattatgataagtggaagaagccagacatgcaaaagtacatctgtgccatttcacatatatgaagttctagaacagacaaaaggaacctgtgggtgaaaaatgaataacagtgtttgcctctgtagaggagattactggcaaggggcatgaggaacctttctgtgatgatagaaatattatatatctcaatagggaagagggttatgcaggtgcatgcagttgtcaaaactcatcctactggacacaaaagataagtgttttcatggtatataaattatttaaattatttttgaataaaaatgtttaaaagttatttaaaaggcacaacccaacagcttatgtataatatactttaatgttttaagtagatactggcatcacttttaccacccaaaatgacttccctatatgctttctgatgcctaaagttacactgataattatttatatattctgaagttctaggcctggtagtctgcaaagggctcttaaattggtcccattgaaaaccatttccaccttagtgcaaattagtttatctgtttcttttctaagaatgtgtttttgaggagatggctgggtcaaattccatgggggtcacaggagatagattttcttgcgtgttctaatctcccttcaataaacaaatattatttatataataagaaagatgagtaagtttttttaagtacctagagatgccggatgactggcagaggggaggacccagtgagagagaaaactggtagaagaatgagtggctgagaattccaggaaacaaatctcatcatcttcaagatttcacataactgccttccaattcagaccagcaaagcattaggataattgcggcaattttctacacagggagacatggcaaggtatctttatggaaatttcagagtcaggatgaatacattaagtgatcacaacacaagctttttgttcatgacaaaatggttgtctcgccattcccagcccttggcacattctctcttgcttccctcctttgtttgtgtcccttcttctgcgttctctggaatgaccttttctttatctctgccaatagaaaattctcttatccttaaatggtccagggtcattccccacaaagcctttgctgagtgctcccttctctggatttctgtggctcttggtgtctcttctgtgagatatattatgacttggtgttgtgtcgctctgtaataatgataatgatataataataattgtgagtttactacacactactcatagtgctgagcactttacacacatcagctcatttaatccttacagtcatgctccaaggtaggcagcattaacacaattcatagaggaggaaactcaggtttagagaagccaaattatttgctcaagacaaagctagtctacttagcaaatctgagattacagtgcaaagctgtctaaatctatagcttttattcttaactgctacgttataccgcctccttgacatatatgtctcatatatcctaaaacaaacaaaaacaaacccagaaatctatctctttcttttaagtcacttactatgtgacaggcagagtattcagtgtgccttgagggaaggggcaatatcttgtacatctttgtattgcctcctgcatttaacgtggtatctggcaaataggtacatgtcctacaaatgcttggagagataaagagatagataatcccactgcaagactctagttctttccacagttccaaaatgtggattcctagaacttcaagcaactgaaatgaaagaataaatggataaagacaaagctcagttcccacttcagtctagtaacagttagtaattcaaacatattctcaatattgtctataaatcatctggttttgcttagtttcttgaattcctttctgttctaaaatctatgaatctaattcctttccctttgcatctcagaaatctttctatgtctcttttcaaatgtgttttctgttgaaagattacaaagaaaaactatggctgcagtatggctatatgagatcttgaattcgggaaagaaagaatttcagactttcacacatactgtgtcactaaaatttgaaacattaagttattgcatctattaataactgaacatttacatggcacattgtagtatgcaaaatacttctattgcattatcttatctgaccttcacactttggagtagacaaggcaatttggattatcccaattttacagatttaagaaaactgagacttggtgaagtgatttgctattaaataaagtcaagatttcaatctaagtcttttagatacggctactgttatcttttcaccctcactatactgtcttaactcaatggccatcaaacactgcagtcaccgctccaagtattactctaagaatcattttgttagccttgtgttaggggataggattaactcttctccctttgaataaatcatattcggccagatttttctgaatgtggtttctatcagttatagtaacagaagattttaccttaaaaggtcttaaaaagccaaactcccactaccctaacattacccccatcatttaaaaaaaagacaaaataatgcctagagatattaagcaattttttccaagataacatagtgaacagaatcaagtcttgaacatatccaacatgcaagtgttttataaagctctatcatcagctaattctagaagagatacttccggtcaagacactggcttgtgttcagaaagaaacttaaagctaatctaatccaagtttccttaatgcagcaactgcttctattgcattcatggcaggtgctcttccatttgcacctttatcatatgaatacagtcttatcagtttgtatgttagagaaggataataaccagtactgccattacagttgaacatcttgatgtcttccaccaaattttgctcagtgttcttgggagccctctattggccttctgggtaatagcaggcagcctctgctgggggctgcgctccgtgagtcctggggagttacaatgaacaagagccttagtgctgtctgaaacacaaaggggagtgaagaaatctgtttgccaaattgaaacgggcagaattgacaatgaaataaacttccatttcttcatcttccaaaaatacccatcgaaactagtttatccaaaaacaaaactctctgttctgaatcaaggccttatctgacccttcttcatggaaaacttagccaataactgttccttgacccttatgcctttgacctacctcatcctccactcttaccccagccatggtacacagtgtaatgacgtataggctatgcaggtccctcctgaaaactaacgttcccttctcctttccttcctccatcctcctcttcactcctcttttctaccttcttcctctccttccttctctccctccctctttttctccatcctcccccctccttccttccctccttctcttttttcaaaccaattttcatcagaagctagaaagttgactttgaaggagagcctgccttaagaagcctgtagtgtgataggttaaatatggcagatacatctatgaccatcctaaaaaagaaaaaatatatattatatctatgaaagacccgaggagaggttctggctagattctcatggttgcaacgaacagatatttgtttgagtgacttcaagtaacaagggatttattggaaggaatacaagaaaagccccaccgtcacacttcagaaaaagcaagaactggacgaagaatctgaatctgggggtgttcttgggctgtactgaccatcattctcaggctttaccagggcacacagctatatcccacatgtctgttcttcttcccacttgacaatgaactttctcaccaactaccccacacagttaccacttcactctccaaggataaacactcaagttcccaggttagttatggttaaggggcagtgaagactctggacagttctcaatttagtgacagctgattacctccaggacccatagcatggaccacaggctgggactggaccacatggagatggaggatagtaagaaaggactgagcaggcagggctcatttctatcagagcagctttgtcatgtgcctgcattggactgtgtagacctaacaacagtagtgtgtactgagctcctggggctgcgcaaacatccattccagcacctggttccaccaacattcctctcttgcaggtggggaaatgagttgcaggtgggaaactataggcttcccatcttcctcggatgtttctgtggcaggatactgaaaggaagtggaggttggagcaaatgctctagcataaaggacagaggaaatgagaacagggaatgcccacagcttctcatccttgtgaggtgaggttctccccactgtatgaagtccccagaacgcagctggaccaaatggcaggggcagagtgagcaggtaagggtgattgggtaagaaaaatattggggcttgagacttcagtaataccaatattaggttgtgttcatggagaggaggggaatatcaatggggatgaggggaaaagacccaccagctagaaggggtctcggtgccccactaccatgcagagtcaatttcaactatgaatcagaattattggtagtgaaattttgccctactttacacctactcccacatacggggcacacatatacacataaaatttcctccaagagttgtgtgtgtggtgtgtgtgtatggtgtgcgtgtgtgtcacattctctacttaggttgcgagggtacctgtgcaactgctggaagaaaagaaggaaggaggaagaaaagaagaaagggaggcaggaatgatggcaggaattatgaaaggacagaaatgtaaatgtgatcatatggatggctgctgatggatatggttatcatatactcctgcagcctgagggtgggcagagtgatgtccaagttctgcctgacgctgaattcattgaaggggatttctattgtagaaccctggccaacagctttgcaaagaccaaagtggtcattgatttacttaaaggacaaaacctcccataatttgtcagtaaaatggatgcaagcaaaaaattgtcacttttcaaaaccagaagttaacagaacaaaatctctgggaccatggaatgggttgctttgatatatagggagcattcataatcaatgatcatactctcaccctacgcgaagttactactgagcacttactgtatgctgagcacattattaggcaccaaagatccagcacctgccctcatgaaacttgctgtctagtgggggaagccaggccttaattaattaatctcaaaaacagaggtaaatttcaactgtgacatacgcttttgaaagaaacgtctacagtgctatgagaatacaggatggataatctgacatataggacttggtaaagggcatagaatggatgatctgttgtataagttctggaaaaggaggtgaaggaaatttccttgaggaagtcaccccggaactgctatctgaaggataagaaggagttgtctggacaacaaaggaaaaaagacattttagggaaagaaaacaacgcatgcatatgccttgtggaaagcaggggtgggtaagagcaagaactctcagaggtgctgttgcgtggctagaccagcagcagatgggggcagagagaatgagcagtgccccccggggccagtggggagcaggtgcagatcatgtacctcgtgtgccattttagggaatattttaccttatcctaagagcaaggtgagacaatgaacaacaggatttaaataggtattcaaggaacagttattaaccatatcacacataaggggtaccaaggacataaaaaggcctgtaaacctctgatatagtaggtgaaatgttacttgaatctccatttgtgctttttctctggggttaggtccatagctgttattagattcccaaaggagttcacaatcttctgaaggttagaaccattgtcctggttcttaggggaggagactggagactggatgatttcttactacgtcacttccatttctacgattcatgagccgaaaaccaacccagatccatccaagtgactgacaaactaaggtttactgtcatcagcagggaaattagagccaaaagtttaaaagtatgtgtttgatgttgctagcagcagagatgagctgagaatgcaatcaccttcaccctgataacccccctgcacacacacacacacacacacacacacacagaggcacacacacacagtacacacactgctcatcctacagaaaggctcctcacaggctgtggacctcaactctttgagaagcttatcactgggggttccggggctgtcgtctaaggcccaagagcattttcataaccaacccagtctcagcccagtcccagggggttatggatgtgagtttactcatttcctgtctccaggcactcccttgtcctgctagcaaaatgaaaataaagcaagtggatcagggctaacataggcacagttgacactcaatgatttgagtcactggaggggatcatcaccatgaattatcacgggcacaagtgctgaatcacagatgctactgatccctcaggctcacacaaaccctggcttcttcttcaacagtgattcccaaagggtgttccctggcactttaattctgggggatgttaatagggactctgtaaataaataaggtttcacggttaagtaagcttgggacatgttggattacaaaaggtgagacaggtgtctttgctgcaaggcttcctcaacctttaacgacatttttttttttgagacagagttttgctcgtgtcacccatgctggagtgcaatggcactatctcagctcactgcaacctccaccccccaggttcaagcgattctcctgcctcagcctcccaagtagctgggagtacgggcatgtgccatcatgaccggccaattttgtatttttagtagagacaggatttcaccatgttggccaggctggtttcaaactcctgacctcaggtgatccacctgcctcagcctccaaaagtactaggatgacaggtgtgagccactgtgcccggacacattttttaaccttggagaataaaatctagtttaccatttccccaaacttttggaagactcccagaaacctttggttgaggagcacctcttgggtgctggtgctccaagacagattctgggaactgtgactctccacagcactcttaaaaagtgtctgtgctccagttcatgccagggttctctgtagcacaatgcacaactttatttcccatccaaggttcatactaaatcctgcctcatgaaggaagccttttccagtggtctggtctatatcatatagtgctatagtgtggcccatacatctggcccatggttataaaaaagaaatctggttttgggcttgggagtgtgatgttctgtgatcagcaggctctcataatctggccctgccaatctctctgatctcacctggaattggcctctcccaggccagttaccctgaactcctgtctgtttcttgaacacaccacgctggttctaggatctggttctaggatctggcccttggcacttgcccccccacctgaccgcatagccagttcacgctgactggctcctttattaaccactggaactcaacagcacccctccccaaatttcctactgtcctagaaccccgttttattttcttcacaatactcatcactatataaaattgccttgtccatttatttacacacttattgtctgtcttcctttcaagaatattagctccatgagaacaagaccttgtctaggatgatccttgtctagagcctggcacgcagcaggcatgtaaacatttcttgagtgaatgaatgctctcaatgagttcttgcttataacttttataaagcagaggagtctacttggtggtagagactctggtcagtgctgtaccaaagtccacctcctcccccgggcattgaaagatttttcaaactgcaagaaagcaataccatcctcctccagagattgtcaaaagtctggcaacttccttactggataactgctaagtagcactactattatcatattagccacacttgttgagtgtttaccatgtgccaggatctatgtgaagccttttacatacatcttttgatgctcaccagagattctatgagataggttctattattattcccattttacagcagagaaaacacagctcagaacagtcaggttatttggcccgcacctataagcagatctgtctgactccagaactagaatcttgctgagctatagaatttgtaaacacacgtaaaaaggagcttgtaaagtaaaaaatggccctgccacagttgccatcacccctgcagggaaacgtgaaaggaggtccaggtggcctccaccagcaaaaacacagagaggaatctcactgtgggttggatgtggtttagggattgccaagagaagccgtgttcccaggggctcctcccttccctccacgatacctcggtattctcatctatgaataggcagccccttcttctagaggtgaccataatgagctgctcaccacacagttggcaaaagtactatcaggaaagtcggggaatagggtggtggtagggacgtgttgacccaggacctctggacctgggctcctatctgcactggagatgaaactgcctgaggcccaaggagttgaacaaatgccccaggagctatgagatgcctagaaaccaacaggggattttaataaaagcaacttgctgatcaggtacatacttaatgttataattaccccgtgatgacagcgttgtgaagtacagacaagcaggaagtactgaccaagcaattttaaaaggttggtctaatgctcttcatttttcactaaagcctaaattgagtttgtgctttcagggaataatgaaaaagacagaaaggtgaacatgacaatctagttccaagagccctagattgaaaaaagaacgggaaaataggtggattttcctctgaagccaaagaatggcattcattcattcattcattcgtttataaactttatagaatggtgttccatgacaggcactgtgctcaatgatgaaaacattggcaggggaaggggtaaaaaaagagagaaaggagaagagaaatgagagagcgtaggaagaggacaagaaggagagggaagatgaagcaaaggaggaaggagaggaggatgagggtgggggaggtgtaagaaggagaagcagagatgggaaagagtctcagctttgatacgctcattgtctagtggcgagacaaacttctggctccaaaaaataggcccagctagggagccagctggacttaaatccccccataagtggcagggatttccaagtatccaaaaagtgctctcttggctgctggtgaggctcggtacgcagctgccagggtccctgggggatcaggggcagcgggtgtgaataggtcttagtgcctctgggaggaggaagtggggaggcttttcttcccaaccacctaagcagtacagtgggacttcaattctgatgtcagtgcgaaaggcaaaaattgatattttgaattgcatagattcaaaactatccttgaaaatcccttaaattcccccagaacatgcagcctgcatgtttcatgctgaccaccttgttcaggaaggctttttttttttttttaaactagcaagtttgagaaccactgagctagacttaaaggaaggaaggaaatgaacatgtgtatgcagatatgtgctttctaaccataccaccttcaaggtaattaccaaactgctggataagtagagaattctaaagtgtttctgctagcctgcagggcttttcgcatagtgttttaatacctagcctgtaaaaccttaataaatgttaatgaatttgtgtattgttgagggttacccaggatggaaagaggggtaggctctctggtttgtggaaagggagaggcttccagcaggtctcagctctgagcttcctgtggctaaattctggaatgggtgccaggagggtgaggtgggggctatgtcgctctgaaggctaggtgaaggtcttgagcacatatcctgcgggctgttggcagaagctgacttaggagaccggctggggaggaaagttgagctcacatagaatgcacaagtcaggactgcagagatgcggccacgagggaccccaacagcagcaaagctgcagattctagagtgcgaaatattgattcaggcagctctacgtggactgattggccacaatgtactcctagggtttgtgttcccaggacagcccagagacacctctcccctccccatagtctcacctgcccttggcagtgtccctgaccttctgacttacacatctccatgcacaccaggagcgtcctcgagctgccccccatctcacaggacccgcctgctcttcccacctctctaagcatcaccttcctgagggccccactcgggcccctcctcctcagaaaagctgggcttccccaccagctgctctggggaccgctcactgtctgctgtcccttctgtttagctatgctcacttggcagtattcaagtgtcacagtggcagttagagcacaaattcaagcccacccctggctttgaatgtcccctgactaactgtataaacctgggacaccactcaggcagctgtgcctcaacttccccacctgtgcatgtggtaagaagagggactacccacagagctgtggcagaattacaggaggcaggaggcggaacatgctgagatggtgcctgatgttggcctaagtgctcggccaaatgtgtttcagaagatcctcaaggggaggatgtcacaccccactgtattctcagggcctacgtggcacctcatagattaacaggaaacacagacactttattatatcagaaactcattcattcaagaaacatttaccaagtgtccacaccaagccatctttaaaaatgaacaagatacatttcctgcccttcacaggctctggagggcaatctaccttggccagttttgctggtacctggctgtcagcacctggttgcagtggtgtcccttagcttaggccctctgaggaagaagaggagtggggaggaagcaggggaagaaggggagaggagaggggaggagggaggagagaggtggctctctggtagtgccctcccccctcatccctccaatctcgtggtgccaatttttcatttagtattctttttttatttgtttccattgtcaaacacacatacaacagagtacaacagttttagaggagaggaaattagtgacaataaggggaatctgagcaaactgaaaaggaagacccaggtcaaagtttaaaatgcaacaaaatgatagccccaaactgcaaactaccaaaatgcccattgacagtagaacaagacaaatcaatggcagtgtatacacgtcacctgatggaatatcacacagcaatgaggatgaatcaatctacaactacaggcaacactgtggacatagctcacaaacatcacgctgggaagctagaaaccaaagagcccatagaagacaaaaagcagcaagttagaagtcgggactggttccctgcagggagggcagtgccagatgaggaatggcagaggcgggggcacttccgggtgctgggaatgtcctgtttcttgatcatgatgtggggaggcagggggaacataggtgtgttcatttgaaaaaaattctttgtgctatgcacttaaggtttatgtaattttttctatgattgttatacttctataaaaaggtttaaaaacaagggcaaagccagcaactctcagggatgccccagagcctgataaagagactgaacagggaattctcattggcaactgcagaaaaaggcctcaatcccttgcatgaggcctcccaaaagggaccttggccacaacctcaaggatagcttcatttggggtcaagatagtctggggtctatgcagccaggctcgggggtgtttcctctccctagacttggttgtaccatctggtctcagctgtgcctcccagtgtattttgtagtacttcccaagggaactgttccccgggaatacagagaaatcctttgctcatctctgcccctgtgctttctcccaagccctttcctcgtccaggaagcctggtctggctgccccaacacttctttagctacccaccctctaagccactgccacaaccagccctgcccccgggggacttaacctggagatgcctggcacccttcaccggtgccggtgtgtgcgcctttgtcttgtcctctcacccagcttctcaatcccctgaaaggagttgcgtaactttctgcctccttcatagtgcctagcacagtgccaaacacataatttgtgtttaatatatatattcaaagacttccccaatagttgcattgtgccttctcccgaattagagtgtaagctctaattaagacaattaactgcccttattggattgtaaggaaatgttttaaaattacaatagcatgttattgacagaaaaggcccttctctgctccaaaccccttaatggctttcaattgaccagagcataaactgcaaaatcttttccccggtttacaaggcccctcacagctggctgcttcctttcattgccttctacacttgctcttccttggctcctaccacactggactcatttcaatttctcaaaaagatgaagctgtctcttgcgccaagaccttcctctgggatggtgttctgaatctcgcattcccttcctcttggtctgtctaagagctgattatttctcagattttattaaagtcattttctcaggaagtgctttcctgaatgcctagaccagttgttctcaagcttaggtaggaatcaggcactcctggagggcttttgggctcagtaagtctagggtggggcctggaagtctgtgtttctgtccagctcccaagtattgctgctgctggtctgggaaccacactttaaggaccactgtctagaccaagcagctcgccttattcatcttcctcaccagacacacttccatgagaacaggggcctggcggaatacatgcaaacaaatccccatttctacgactctgttgttaccaaagcaccttcacacctgtggtctcttttgctgcttaaaacagctctgggagagggtagagcaggcatagactgctccttctttacagatggaccagccaagatgcagaatgtccaagggactggccaaaagaaggtcagcagcagtaagtagtagaatgagaggtagaacctgtattttcttatgtgcagccaaagaaaagtttcttcatattattactctgttctggccatatctgcctgcaggggaagatagagaacggaacaaaaactcatcgatttttctcttccgttcccttagatgccagcacaggaataagaaacgaagcccctatgtagcgtttatccaatgacctgtggcacagagtttgtttccttggaagaggctatgctaaggtaggtaaggtggtgatggactaataaagcttgcaacttcttacattttcatggcatggcagccttcccccaggtgacaatcagacagcagacaatgggaggtataagtgcagaggctgtgagccatctgttctgcaatgaaatctgtgtggccctccttaaccccttcagactcaaaaaacagactagcagccccactcaccattacctaccaagatgggccacaccagccagacctacaagtaagacagttgctgactatactttcaaaggtgtggggaagggcccctccatgccatgagacagatctctcaatcccagctgcagtggttggaattggataagcagcctgcccagcagaggattccaacagttctggaaccttcctccacacctattccccctctcctaggtcacttagttacaactactcctgatggtacacaatctaatgggtatgcctgacaactcctatggaccgaatgtttgtgtacccccaaaatttatatgctgaagcctaaatccccagtgtgatggtatttggaagtgagacctttgggaggtgattaggtcatcagggtggagccctcatgaatgggattagtgcccttagaaagggatgaaaagaccagagctttctctctctctctctctctctctctctctctctctctctgctctctaccatgtgaagatacaaccagaagacagccatctgctaagtaggaagcagccatcactggtggacactgtatcagtcaacaccttggttttggacttctcagtatccaggactgtgagaaatagatgtggttgtttagggtacacagtctatggtattttgttatagcaacccaaaatgactaagataacagctataaccaaagaataagacagagaaaactcataaactagcagttgctgttattattaatatatgggaatcgaaagcagccttattgatttaggctttaaacatcatcaatatggttgacaacttttatttttatctctccactccccagcttctgcacagcctgtttgatcttgccatttggatatttcacagacatctcaaatgcaacatgcccaaagcctaaccctgtgtttctctccccacaccagtcttacccattttagtaaatgacaccttgatttttccagttactcaaccaaaatccaggctttgcatccttagttcttcaccttctctcacctggacagactggacatccaatctctcagcaagtctgttcatgccacctccagacaagatcccaggccccccacaccttgctctccccacttctaccacccagttccgccaccttcattgctcatctggtcttctacggcagcctctcaaccagcttccttcctgcctcccacctctgctctccctacctaccactctccatgcagtcttcttaacacttaattcagatcatgccatctgccaactcaaacctcatcaaagactttctgttgcacttgcaataaaatctaacgtcactcagatggcccaggagactttgcagggtcagcccttgctgggctccccagcctcccatacctctccctcctctcctctccctccctcctcttctctcttcacttgggggttcattcttcattcagatttgccacgtccctccccacctcctggctttgggatttactgttccctctgacaagaaagttttctttcttttcttttctttttttttttcctgagacagagtctcactctgtcacccaggctggagtgcagtggcacgatctgggctcgctacaaccttcacctcctggattcaagtgattcttctgcctcagcctcccgagtagctgggattatgggtttgagccaccgcacccggccggaatgttctttcttatcctgtcctcctccaccctgcacaggatgggtctttctcgcacgtcattgatcatgttgtcacctcctcaaggaggccttcgctatcacactagctacgttaacgttccctgtattctatttgtatatggattaatataatttatttaggcaatgatatcatttggatgtttgtcccctccaaatctcatgttgaaatgtgatccccaatgctggagatggggcctgctgggaagtgttttggttatgaaggtgaatccctcgtgtctcactgttagttcacacaagagctggttgtttaaaggagcctggaacctccccctctctctctcttaagagctccctcttttaccacatgatatgctggctccccctttgccttctaccatgattgtaggctgaggcttcctgaggcctcaccagaagcagatgctgacaccctgcttcctgtacagtctgcaaaactataagccaaaataaacttttatttaccagttacccagccttgggtctttctttgcagcaacacaaaatgcactaatgtagttcatcatccactgttggactttaaggttgtttccaactttctattaaccatcctggggtgaaggatctttgcaattaaatctttccacatcccataattatggccttataataaagccctaatgattgaatatattttttattaaaaatatacttccatagcacttcctctgtaaccagcaatgttctaaatactttaccaatataaattcattgatgtgcgtgcatactttcttttgtagttaaatatactagctcatttatttatgtctttattttattgcggtaagagcacttaacatgagatctaccctctctttctttttcttgaaatttaccctcttgacaaattttaagtgcacaatacagaattgtatctgtgacttttttctggtctgccttttccattagactgtgtgctacatgagggcagggacgatgtctgtcttacaatgtcaccaattgtaattctggtgcatggcatggacctggcatacagaaggactcaatcaatatttattgaatgaagccataaaggaacaagctagcaccctggcatttcacatacattatctcatttaatcttcacagcctccctatggcaatattattattattttttcctttctatagttggatacaccaaggctcttaggttaagagacttacatctgagtcagaatgaatcttgggcccatgctattcccactgtacagggctgccaccctgatgcacaagtaactcatctctttatgcagtgccatgctcatttcttgggggtgacacaggaacagttagccccttcttccttctaccaagagatcactacctcacacccctggggatatgaaaatgtaaagatgagaaccttgattaataggcctatacataacctttaattaattggtcaacattcaaggattatacccttgaactttgggaaaaattaacagaagagttcctaaaaattaattaataggaatcaacacactgacaaaagtctctgtgcctccctcaaagaagtgaacacaggaatttctatgtcccggttcttgtgttagagccacaaggtcagagaaggttggacagacggagaccttgcccattttgtctccataagcccatggctttcaggttctgaaaatcctgaaaatcttggtcaaaaccagccacgtgtagtcttcccatttcttcaattatttagttgtttatttccctataatttgctatgtctatagaatcatcaaattttaaagccagaagtatcctaaagatcacgttttgtttctttaatgtgtgacctcattaattcagatgacattaatttaaaattcatgataattacataaacatagagcgagcagtactatgatgccttgcagatgaaatatgcatattctgtgtactgatacgttgtctcttcttaagaaagatgtgaggtgactgcctgattaatgtattgaggttctctgagggaggaagtaaaaaaaatgacacagagttgtcagacgactcataactctaagtttcagaaaaaacttggggttgaattttagctctcttgctttacagttttgtggcctcggacaaatgacttaacagggccctagctctctcatctgtaaagtgagaaataataacagcatctttattttagagtcattgtgaagaataaaaatgattactgcatgggaagtgcctgatgtagtatcagcacaaagtaagtgttcagtaaaattacccgaactactacctgtaatataagctatcatagtgaaagcagctaatgtgtaccaggtattttacaaacacgacctcagtcatttctcacttcaacctttgagacaagttttacatatgaggaaaataagtctgaggctgagttagtaatttgctcgaggttgtgcagttaggaggtgcaggaatagatattggaacccaggtctatgtaactccaccaacaggctgctttcaccaaatcctacctcctcttagaccagaagtgggtcaagtggtgccatcctctgtctgcctacgatgtgcacaaaatgactgaagggatgagtgggtgcatcacccaggaaacagagtttcaattagtggagaagcaacatgggtgaaggagaaaagaaacggatcctgtgtccttccagaggacaaacaactgtggactcatgctaagaaagaatccctaacaaatgaagttcctgagttagacagggcgctgaattggatgacctcgcagtttctcccgcctctaggattctgtaataggattctgtaataggcaccgttctcagttgtaccttttagccaagtgtccttagttgtctgtgtgtaagtgtgtgtgtcgtgtacaggaccacgggggtgggatttagcaaatataggactctggcctaaaggcaggaaacatccggaggaggcgaatgtgcatgtctgtggagttagaactgggctcgaatttatgcaccttgtttataaataacctagatcatgaaatgtgcagtacactttcagatttggcaggtgacactaagtttttttagtataaaattgggaggttgatgggaaggaatcttaagatcctacaagactatgtgaatgggcagagaaaggtagaaaagtagaggatagttctgcaacttaaaagattcagagagctgagttctcaattaaaactcagggaattcatctgggagtctttcccagactggaccccaggggattccagttaatatgtttcagtggccaaaaatgttggaaagaaaaaaaagggaaaatacaaaccaatgagatgatccagctttgactgtggcatataatagtgtagtcacccttggctaaggctgaatgtggctctgatcccatgggcacaggtgacgggcgggagaagagcagtttaaacaatcaaaggagcattgaggctggactaaagttagtgggattctctagtccataggcaagagcatgaagggtggtatgaccgatgtcaacaaaatcatgcatgtaagaataaagaggaagctggagaagctgaagctagcagtacattctggagagtgagtagaaacatactctcgttaaatgaacaaaagtcccatgaaatctattattcccaagagatagaactggctgaaagaatgaacagttcagttcaacaaataccactaggcaagtgttagggctagaagtgctagttcttttgttaaactttttatcttgaggcaagtgtagactcacatgcagttgtgagaaatagcagagtgatcctgtggtgtccgttttactcagtttctgccaatggtaacatcttcgtaactttagtgcaatagcataaccaggatactgacattgatacaatccaacaaccttattcagattcccctagttttacttgcattggtgtgtatgtgtgtgtgcatgtgtgtgtgtgtgtatgcatgtggtatgcttagttctatgcaattttatcacacgcattagtttctgtatccatcaccacagtcaggattcagaacagttccgtcaccacaagaatccctcctgttgcccctgtataaccacacctaccttcttcctgccttaatccctaacacccagtaaccactaatctccacttctataatcttgtcattttaataatgttacataaatggaaccgtaggcactctaacattatatgaataatagcacataattaagcatgaggaacatcccttagggtgataactgagacacaaaagtggaaccacccccctctcgcacagcatctcctatgctctgacaggaggttacatggacaaaaggtctgaggccgggtgcggtggctcatgtctataatcccagcactttgggaggtcaaatcaagaggatcatctgaggtcaggagttcaagaccagactgaccaacgtggcgaaactccgtctctactaaaaatacaaaaaaaaaaaaaaattagccgctcgtggtggcgcacacctgtagtcccagctatgccagaggctgaggcaggagacttgcttgaacccagaaggtggaggatgcagtgagccaagattgcctcactgcactccagcctgggcgacagagcaagactccatctcaaaaacaaaaacaaggtcaggtgctgtggttcatgcctgtaatcccagcactttgggaggctgaggcgggcagatcacctgaggtcaggaattcgagaccagcctggccaacatggtgaaacctggtatctactaaaaatacaaaaattagccaggcacacgtgcctgtagtcccagctactcaggaggctgaggcaggagaattgcttgaaccgaggaggtggaggttgcagtgagccaggattacatcactgcactccagcctgagcaacagagcaagactctgtctcaaaaaacaaacaaacaaacaaacaaaaacaaaagttctgacccagttgatcttccagacattctcaggaaacggccactttgatttaacaacttgagtgggtggggcaggataaaatacgaggggctggggctaggaattggatttgtcccactggaagggttatgtactggggataggaaccctctctaggtgacactagtggcaagaagttgctgtgtctgcaaggtaaggctcaggcagcagttgttcagcaggaggtcaggtctgggatgggagtcaggccaggcatgaaagagaggcttacagctgaagctgtcctccgctctcccttgaagccagactcaggcacaagtggcacgtgtaaagaaaactatgggatgccaaaactgctgagaacaaaccatgctcaagaactttcaaaactacttagacttcacccatatgtattaaatattcaacagacagttccaaaaaatggagggatcaggggaggcaatgagaagtatagtgagtgggccacggcaaaaccgcaggtggaagaagaaaacctgagtgaaggtaatggcagagaaagggggtcgcttgtgaaaaaaaataaatagaaaaaatcaggagtgattggaattggaggggaaagagggaaaacatcacacatgtgtcatagatttccagcctgcgtgaacaggaaacccagaggaaggatgtcaggggaggagaagacggtttggtcacatagggactgagttactggaaagacttcttctaggaggaaatgaccaaagcaaagttgagagatgtgctatgaggctcggaagatgtgaaaatttgacatattgattgacaatcatgttcctggttgaagtcatagtagatttataagggaaagggtgttagtagagccttggggttcccaaaggatgggagaaaggagtcagcaaagaatacagacatggacaaaaggaaagggaggaaggttgaaacaagaatcagaacagcagtggcccatgagagggaaggggagaatttcaagagggtagggttaagcaacattgagtgcttccaaataagacacacaaagacctacatggctagggccttaaaatgttccccttggaagctgtggtctgaggcttatcccaggggaagaaattcttaacgatggaacttctggtagtatcacaggtatgggattattggtttgtttgtttaagaaagggcaatttttgtggtacctctcaaatcctaccatatggcaactgcctacgttagctcttgttaggaagtctcttgctcaactatgaggatgggtaatgtcctgaggtcctgtagctaactaaggattagttaaggaaagggagaaaaaaaaaaaaaaacagaaaagaaattaggaaaacaaaaacaagataccaatagcaattatcaagatttcttggattacacaggcagaaaatcaataaggaaacactggacacaaactaagactttagaccaaatggatctaacagacatacacagaatattccacctaacagcagcagaatacacattcttctcaagtgcacacaaaacattctccaggatagatcatatgctatgccacaaaacaagtcttaacaaacttaagaagactgaaatcacatcaagtatcttttttgaccacaatggtatgaaactagagatcaataataggagagatttcagaaaactcataaatatgcacaacatgctcctgaacaaccaatgagtcaaagagaaatcaaaagggaaatttaaaaatatcttgagacaaaatttaaaacacaacataccaaaacttatgagatgcagcaaaggcgattataaaaggtaagtttatagcaatacatatctacattaaaaaagaagaaagtaatttgggaggccaaggcaggtggattgcttgagcccaggagttcgagaccaacctgggcaacatagtaagaccctatctctacaaaaaaataaaaaaagtggttgggtatggtggcatgtgcctgtagtcccagctactcagggggctgcggtgggatgatcactcgagcccacgaggtcaaggctgcagtgagttgtaattgtaccattgcactccagcctgagcgacagcacaagaccttgcctcaaaaagaaggaggagggtaaggagaaggaggaagcactcaaataaactaacatcagatctcaaggagctaaaaatagaagaacaaactaagcccgaagttagcagaaggaagaaaataacaaatatcagaacagaaataaatgaaacagatacttgaaaaacaatagaaaagatcaatgaaactaagagttggtattttaaaaaggtaaacagaatcaacagatctttactatgaaaaaagagaagactcaaataaaataaaaaatgaaagaggagaattacaattaataccacagaaatacaaaagatcataacagattactatcaacaatcatacagcaacaaattgaataatctaggaaaaatggataaattcctagaaatatacaacataccaagactgaatgataaagaaattgaaaatcttaacagattaataatgagtaaaaagattgaatcagtaatcaaaaatctcccatcaaagaaaagcccaggagttgagggtttcatggttgaattctaccaagcatttaaagaagagcttatactaatccttttcaaactcttccaaataaattgaagaggaaggaatacttccaaactcactttatgaggcaaaattaccctgatactgaagccagacaaggatactacaagaaaagaaaattgcaagccaatatccttgaacacagatgcaaaaatcctcaacaaaatactagcaaaatgaattcaatggcatattaaaagatcattcaccacgatcaagtgggattaatccctcggatgcaaggatggctcaaaatacacaaatcaatcaatatgatacaccacattaaaagaataaaggacaaaaatcatacgattatatcaataaatgcaaaatccacaactgacaaaattcaacatcctttaatgataaaaatcctcagcaaattatagaaggaatgtacctcaacacaataaaagctatttataacaagcccatagccaatatcatactcaatggtgaaaagttgaacgtttttcctttaagatcaggaacaagacaagatgcctactctgaccatttctattcaatgtagtactggaagtcctagccagagcatttaggcaaaaacagaaaggcaagggaagtgaaagaaagggaagggaaagggtctgaacaggaaaaaaataagttaaattgacactgttgcagatgacatcatctgacatatgaaaaccctaaagattccaccaacgaactgttagaaataataaacaaattcaataaagtttcatcatatgaaatcatcatacaaaattcaggagcatttctatatactaataatgaactatctgaaaaagtccctattatgatagcattaaaaaacctacaaataaatttaaccaaaaatgtgaaagatctgaacactgaaaattataaaacattgatgaaagaaattaaataaaacacaaataaattttaaaatatcctgtattcatggattagaagaatgtcttcttaaaatgtctgtactacccaaagtgatctacagattcaatgcaacccctatcaaaattccaatgacattttttcacagacatagagaaagcaatcctaaaattcatatagaaccagaaaagacccagaatagccaaagcaatcttgagaaaaaaaaaaactgggggcatcacactacctgattttaaaatgcactactaagctttagtaatcaaaacatcatactggcacaaaaacagatgtatagagcaatggaacagcaagagagcccagaaataaatccacacatttccagttaattgatctttgacaaaggtaccaagaacatacaatgaggaaaaggatagtctgtctaagaaagagcattgggaaaactgggtatccatacgcagaagaataaattggatctttatctcgccccatatacaaaaatcaacttgaaatggattaatgacttaaatgtaagacctgaaactgtaaaaccacaagaagaaaacatagaggaaaagctttttgacattcatttgggcaatgttttcttggatataacttccaaagcatgggcaacaaaagcaaaaacagacaaaagagatggcatcaaataaaaagttaagctgcttctacacagtgaaagaaacaatcaacacagtgaagagacagcctgtggattgagagaaaatacttgcaaaccatacatgtataaagtggttaatgtccaaaacgtataaagtactcaaacaacttaatagtaagaaaatgacccaatttaaaaatgagcaaatgacctgaaaaggtatttctcaaaagaagatatacaaatggccaataagaatatttttttttaaatgctcacatccactaaccgtcagggaaacacaaactaaaaccacaatgagatatcaccccatgcctgtttgaatggctattatcaaaaaataaataaataaataacaagtgttgctgaggatgtgaaggaaaggaaacccttacactgttggtaagaatatagattagtacagccatttatggaaattagtatgggggttcctcaaaaatataaaaatagatctaccatatgatccagcaatcctactactgggcatttactcaagggaaacgaaatcagtacgtcaaagagatatctgcactcccatgttgattgcagtattattaaccttcccctactctttcataagtcagacctgcattgaggtctgaaggctttcccacattttctggcttctcctcttttatccctcaagacatttctcccaacagcctgtcgtgcatctaatcctatcttgacacctgcttctcagaggatttggactaacataatgctttatcttatttcataattatgataacccaaaatataagtactattgtccccatttttcagactagaaaactgaggcacagagtggttacctgcttgtctgagatcatccagctagtacctgggcagagctgggattcaatccagaactgtctgactccagggtctgtgctcttgtccctggctacgtacacatacccctccctttacttgtcacagggcagtcacagcagtctattccctgtcttgaacacagccagtttatcctgcctcgggtctttgcccaaaccacttctcatgtctgaaatactcttcttttgaatggtcagcttcctcctctcttttgagtcttggcagagcagtactcctggccttcctaagtaggccctttctctttctgtcacttgcttatttcctttacagcactcaccacaacatacaatttttgcttttacttttctacttagtgtttttgtctccttctaccctttgaatgcatgttccatgataccaagaatcacatctttctcttttacaactgtgttgataaatcctaatacagtgtctggcacatagtcaacaaacatttgtcaaataaacaaatgatgggtaagttaatgtatttgcatagtatttcttcatacatattgtctcatgtaatcatggggaaagagaagacaaaggaaagaaaagagaagagttaaatctattgaatgggagaaaaagatcactccacacatgcccaaaagaacctccagtcccagggtgcctctaatgatgggagagtctgcagtctgcaaagacacatcccatgtttggagaactgggagtgtttttcctagaccagacatgtatagaactagcagttagacatgcaagtcacattgtgatgacaaacgcctcccaccctctcccctgaagggcactggagatcaagcagggctgatatccatcagaggtgtcagagatgtcagccaagacctctcagccactttctggcctgatgctactgagttcaatgggcttttgctcctatcagcctaaagcagaactctgctgccaacagttaaattagcagagcttatggttggggtgttctggttcaacaaagtcttcccaacattgccatgatcttcttgccacgtcaggtgacctgctctgggcatgtgtcctccatgggactgctattgtgcaacttccccacttttcacaaaagaaatgtgtttaggatttttatcacagtgactagaaacctaattcctactagctccagctaaggaggaaagattttgctaggacataggctgtcccacagagcccaagaacaggcaaggagctgggtccccagagcacactgaagcctgagcctgaggagccctcaggaccctgagcccttcttttgtcttcaccattctgccaatcagctttatttgtttctcctatgtggattggcttcttttgcctttcagctgctcctgagttttatatgtaacaatctgcacatccagacactcatggatacacattctccttctctctctcccaacacaactcagtcctgcccccaaagtctagggtgaagaactattggtccatctttgctcagaaatccattcttagatcagtggaccatgtccacaggggtatgcggttggggattgtgttggaggaagagctaggctgacaaagtctgtttagtacaaggaaactgaaagttgaaaagataagtttactcaaataggtaatgtgggaagtcacctaacattctgcctgacacatagttagcactccaaaacagaagtacttattattgttattgatatggcttttattgtccaaaatcatattgccagtaagacaggagtcaggacttgaaaccaggtctccagatgcccaaggtctctctcccagacaccaagggtcgctgggagcaagggtctctggggataggggcagtatgttatcttcagcatctagcccatgcttgaagggagttgattcttcagtgttttttgtttttgtttttaactaacctaacagttgtccccactgttcctagaacaacagcaacatcagtgtctttctctacaggggagagaaagacaagggcatgggagaaagcaaggaaaatctgcagactgaccccaaccagcccagaggctgcagatggggcacttcctgactctcagtaggtgaaatgaggccacttcatccctcaagagataggtacttcttctgccacatcctttctcatctctagcacatctcaggaactgaactcactcccactgaatttattaactgaattgaaaggaagggcagtcagcccatccatgtttgcacagcagcatggtgcaactcgacacgcaatgctcagagaagagggagctggtagcatctgatgcccttcagagcatggttccagctcagcatggggcaagcacaaagcctctacagcccactaagagctggcgggtttagcggaccctgtctaagaacccaaactacacgtgaatggaagagttttttaatttctatggtaataaggagcctaaactccagttccatttacaggctatacttaggagctatatcagccccaggctgatctctgtgatatgcagatttaccagagactggcagtgactgatgagaacatacataaggaagaattaaagttaaagatgaaaagaacttcgtaattaaaggggttgagagatactgaaacagagaagagtctgaaagaaaattcttaaaggcctattgaaaatgagccacatggagcacaagtcacctgttggaaactccacaattctgcatcagccttgtgggcaaggctcctgggcctctcggttccctccctataatctgtggttcacagacagtggtgtgcaccagaatcagaactgtgtgttatggctggtccttttcgccacttacaaacaagccagttttaaccttttggctgaaatacatacactggttcaataattgaagggcataatttattatctagctggccctggatgccaacttctggggtgggtggaaggattaatatatttacataaagaaagcctccagcccctccagattctgcaagacactccacggcacaacagtagaatgttagatttaaaagaaaccttctagaaaacagtccccattttatcaaggcccagagctcaagtgagcatgtcaaagatggcaaaataaagttatttttgtctcctcatgtccctttaaggaagtttagtccttacaaaaacaaaaaacaaaaaacattaagagattgtctaaatgttctccagggcgaaggtagcgagagtagaagaaccataaccaaaatagtcatttgctcagtatgttgcttctgtattaaaaatagtcaaaatggtatttctgggaggcaatttgatcaaacgacaaggttcacttgtcccaaaaggatattcagccattttattgctgtgttcatggtattcaacagattcgtgagttgcaacaagaccgttttgtctctgacaatttaagatcttacaactgcctcataacttgggatgtgttttaaattcctttatgaggaaatggaagcccaaagatactgagaaggggcccagagccacaaggtaatgcagccaccactttcagaaggggactgtgacatttcaatggagattcatggattccaagcttgagcacccttgttccagcagccattctttatgacctcagcaagctgactatgtggttcttcagtttcctcatctgcaaatgggatcccctatatttgaccttcatgcttctcagggttgttctgaggatcaagtctccttgctttgcttgagtgaggggtgtgctgcagcaagatgactacagacacagttggggatgggaggagtgggcagctgctcagacagcagtgacctcatttccattggaaggttacatacagaagacatggaccctgcataatcgggtggagagcaaggtggcaggaacaggtgtgtgtaatctgggaagctcaaagccttgagatcatgccctactttggctacagcagagcaaaggctggccacgaaagaggtagtgatgagcagaaaggctgtagagttggagctggaaggcaaggaggtaggaaaaggaaaaggaaggagagaagatggtctggttttctctctggccttccaaaggcacctcaagatgggaggtggccaagagaaggagtggaataaggggctcctgcccttcattcagtcatttatttgttcaattattttgagcacctactatgtattagtcacattgtaggcacttgggagacatccatgaacagaacagacaaagattctgcacttgtgaagataatattctacaggggaaagacaggcagtaaataatatcataataaactggacaactatattgcatgtgagatgataagtgtaattgaagaaaaaaacaaagcaaggaagagcaataaagagtttcagagtgtgtgtaaggtcaaatttaaatagagtggtcggtcaggagagacctcactgagaaggtggttagtgaggcagtgagctatatagatatctaggggaggggaagagaacatcaagcaggacaaatagtctaagccttatgctctaatccagcttgccaaatttcctcactctaacaaatcataccttcctccaaagacggctacaaaaatgtctcccatcccacacgttttccttgtaatgggactttgacattccttccatcaggaggtggggttgatgttcccttatcttaaatctggacagacttgtgaccgtggcagagttattctacatagctactgaggtaacatataaagggtagtaaaccttctacctggttctcctggcacccttactcttggaatcctgccaccatgttgtgatgaagcccaagaagccacatgcagagacctcatacaggtattctggctgacagccccagctgaggtcccagctgatagctactgctgaccaggagacagagtttgaaacgtctttcacccatcccccagccattaagtcacccccagctactgagtcttcctcagactctgtggaacagaaacaagacattttcactgtacccttttcaaattccagacccatataatccatgggcataataaaatggctgatttatacctctaagttcaagtggtttgctatgcaaccatataacaagagataactggaacagccacataaaatatagagccctaccttaactaaataataaaatttaccttgatttgcatgtcccttgaatatataccttccttaggcatcttgtgaggaaagaagatagttaggctaaggtaagatcaatgtgtttttatatcccttgacctaataactatctaattgtctcaatattacccctaacagagatcagcagaaaagaataaatagcccagaagcaaaccttaatagaagttaaaggaagcatcacaaatcagtaaggaaggaacgaattattttaaaatcaacactggaacaattggttaactatatggaagaaaatcaatttagatcctacacttaaatctacttgctataaatcaaaaaactttatattaaaaaatcaaataatgaggaagaagaaagtatggataaaggcatattttacttcttgcagggaaaggctttccaaatataaaagcaaaggaattacaaaggaaaatattaatggattgaattgcatgccaaaaaattatatgcaatattaaaagaaaataaactaaaaactgtatctgccacaaagattataagcaaagaacaaataccaaaaacaaacaaatatgcaaaacaaaaacattaagatcctaattgattaatgtgcaaatgacacaaacagaacaattctaaatgagaaaatacaaatggtaaatatccaacctgatggttatcaagaatttcaaattaaaataataatgaggtaataatgatcttcatctatgatagcaaaatgataataatggtgtattgtgagctgagtagtctcatacattgctggtagaagtatacatttttttaaaagttggtgagttaatttgacaacacacatcataatgaataaaacaaaagaaaaatacttgaaacaatttagggtaaattatccctgtataattctgttctcacactgctataaagacatacctgagactgggtaatttataaagaaaagaggtttaataagctcatagttttgcaggctgtacaggctaatgcttctgaggaggcctcaggaaacttacaatagtggcagaaagtgaagtggaagcaggcaaaaattcacatggctggcaggagacaaagtgtgaacgggagagtgttacatacttttaaaaaaccagatctcataagaactcacacactatcatgagaacagcaagggggaagtcagctccatgatccagtcacctcccactaggcccctcctccaacatataggattgcaattcaatgtgagattggggtggggacatagagccaaaccatatcaaccaccattaaagaaatagttaagcaaattatgatttatctattttagaaaatattatttatttattaaaatcatgcttacaaagactttttaatgatgtggaacatgtaatacaattttgaataaataaaaatatgaaaaatacatctgcttctacaaataaaaaagtctaagaagatgtaccttaaactaatggtgttggttatcttagggattacctgtgaattttcttatctacttcatacatttttgttttggtcatttttttaggcaataagaaaaagaaatcagggcaaaactgatgaagatttagatctcagttttccagtaggaacaattaagtgttttaggtctttgataaagagcattgcccacaggaaccacaaggtcatgcaggatcacagggcagcttagctaacctcttttggaggaaagtgaggaatccaggactgttttacgcatcagccctcagtttgtgcatgagtgtgttttatgttcctttttcaatcctgtggggacagaaatgtctggctggtcaacacgcatgaaccttggtataaaacccattggctttaggaaagttgacagatgccaagcgttaagggttaggatgcctgactgcagaggagagatccctggtgacattaagcctacagccaaccaccagtgaaggcatcctttcacctagaggaagtttgtgtctaaactaatccaggctctcccgggttatctccaagggcaactattatctaggccataatagagccatgcaatcatcctgcactgacccctggaatcctactggacggaatgtcctggaaaggcttcattggattgacaactacactccctgtatagttcttcccactattgcccactcatcattcatagatgggagtccaaggctggtccttcacttagcagtggggagcttagggccattaggcacaagcagcatggaaaaggaaaaatcaaatcagagcatgcccagcatctaagagcaacagaacctctgattctagaatccactctcaaccaatggctctaattctactcctgaccataagaaacctgccttgactacatatgtgcttaaaaagagctttggacactctacagtggttgctactaatatcacatgagtcccctcccccacaaaaatacattagacatcagcagctctatttattttacataggagaaaaactgaagtccagagagaggaagtgactcatccaaggtcacacagatggttcacagcatatcctagaccaattctgataaaagcctggcattagctttgaagaagcaatcacaaattgagggcaattatattacctgcccgatcaggtgagagagacaccactcatatctgatagaggtgcgggtcttctaacatgccttcctggccaaagaaaccaggcagcccattgtcctccaagccctagactgggtatcagtaagtacgtggctgacatagatctcatggcatgctggacacactgacccacagatccaagcttcaggaaacctcacactctccacttgcttctccttttgattaagctcagaggctttcagagaggagaccccagaatatttgaacaatgacagggagttgactgaactggtatctgaaacattcttaattcagaagaattgaaggtgttgggagtcaaggaatttaagtacagagcaggggaggggatgcagctgaactgcagagagcatgatattaaggacatcctgaaatccttccaagcctcaatttcctcacttggtgagcagacaaaacaggtagttaaactagatacagacgttcctcagcttacagtggggttatgtcctgataaacccagagtaattgaaaatattgtaagtcaaaagtgcatttaatacaacatcataggttagcctaggctaccttaaatgtgctcagaacacttacattagcccacagttggggaaaatcacctggcaggacagtataccatagactgttgtttatcctcatggttgtgtggctgactggaagcctttgttcgctgctgctgcccagcattgcaaaagggtatcatactgcatatcattggcccaggaaaatttcaaaattcaaattttgaagtacagtttctactgactacgtatcacttttgcattattataaagtcgaaaaatcataagtcaacctactgtaagtcagtgaccctctataatcactaaggtctcttataactatgtttctttaaatttcaattttctaatctctgccatagatctgcccaaaagtagctctcttcactttcaagttgggcaaaggaatgtacagacaaatcctctgtcccactgcccaaagatgtgtgcattcagaagaacttgttggactgcaacatttgcaagtcaaaaagcaagtggtttaagagacacacaacatctctcctcggaagagttccagggaattcccaaaggcttctttgaaagtgtcttagacagtgtgagctcctcagctgactgtatctccagccacactccctccaggagtcaggggcactggtggtatccaccctgggctgtggctccaaccactgacagatgttttatcaaagtgacagctcagtgctatgggctcccatctcaaacaggcaagagatccaagtgtcatttctcatgattaatgataaaaagtctagaatttggtggcttgatttcagatgcctcttctcctcaatactcccaaataccatatccagagccagaatgacatttgtagggggtggaggaagcggctgcagaaaagatgtgtgctgggacccagagagcttctgaagccaggtcagcacatgccactggagcaacagaagctggggcagaaccagagtgctggcatttgtcaggtgcaggcactgagaatgggaaacctggaatggtgatgggggacagtgatgaggactgtgctcaagggtttgttccaagtcagagatgggaagtataagggacaactaaaatcagtggagcaaaccaagatgctagaaatatgcccagagacagaatccagaaggtgcctaaagccaaattctaggaagagaattgagcatctggagtcaaagtcagtcttaaacgaagccagacaggaagaagcagatgcctcatcgtggcctcttcctgggcaaagcaggggcccatggagctgaactcacccttcctgagttcctctgatatgaaaatgccaccaagacaagcagaacatcattacccaggatagcagtgataatgactgggtagcaataaccgcctgataatcacctccactctgggcatcaaaatcgcttttaatgtccccaacaaagcagtagcctctggacaataaagcagattccatgggaacctggtttgtactggaagcactttctttcagcagaacccaaatttagcagtggaagaaataccggttccataaaggatcctccttacaatgacctccccaaccctaagcaggaattgctccaccatcaaagcacccattaactactgaccaaatatagcaatgcactggaatgtatggacaaattctcttgtaccattgctcaaggatttatgcatacagaagcacttgttggtatgactgttcttgtgacttcaaaaaatggtgagattattcccttctctatggctttcttctctggtccccaccccacccccgccacccaggaccaagcaatgtttgatgactgtcaactcaagcccagtacgaaaagtgctgtgttcgtgtgacaaaggctgacatagttgaaataaaccttggcaatgacaagctaaacccaaagacactcagtgaaatatcagataagccagatcagatgttttcctctctcttgagaagaactcagacaacatgaaaatttggacaatttaagtcagggctagtgctggaacccttacctaaagcagttactatgccttggacaggacctcccggcccacatgcacctagatgaaatactactgatgttgttcaagctctttggggattttgtctccaaattaccaatgtcatttctcaatatgccaggaagagagaaggaaagcaagcatgagacaagtttgcatagaaatatacatgggaaaatcattttcagaaaatcccacaagaaagcaacaggggagacaagagtggattcttgattcaaagggtagtaattcccatatcagaggggcctttgtaaatgacattggaggcacagatacaaacaccttggacttcacaccaagatacgtctttattcctagtgcccaccttccccctgctcatcaagtgaacttccttatcagtccctacctgtactcagctcttctggcctgactgcacattagaatcacctaaagagctttagaaaacattcctgtatttggcaggtcctcaggaagttaaatatagaattagcatgtgatccggcaattccactcctaggtacacactcaaaagaattgaaagcaaaggctcagatacctataaaccaatgttcatagaattattcacaatagtcaaaaggtagaaataacccaaatgaccatcaatagatgaaagaacaaacaaaatgtggtatatttatacaatggaatatcattcaagcctcagaaaagaatgaaattctgatacatgcaaataaatagagacagaaagtagactagaggttactagggtgggggaatggggagtcattgcttaatgagtacagagtttctattaaagatgatgaacaagttctagaaatggataatggtgagggtggcacaacattgtaaatggacttaatgtcactcaattgtacacttaccacaataaaatatttctttttttaccattactatttttttacattttactttaagttctgggatacatgtgctgaatgtgcaggtttgttatataggtatacctgtgccacggtggtttgctgcacctatcaacccatcatctaggttttaagccctgcatgcattaggtatttctcctaatgctctccctctccttgtcccctacccccgacaggccccggcgtgtgatgttcctcccactgtgtccatgtgttctcgttgttcaattcccacttatgagtgagaacatgtggtgtttggttttctgttgctgtgttagcttgctgagaatgatggttcccagctttatccatgtccctgcaaaagacatgaactcatttttttatggctgcatagtattccatggtgtgtatgtgccacattttctttatccagtctatcattgatgggcatttttattggttccaagtctttgctattgtaaatagtgctgcaagaaacatacatgtacatgtgcttttagagtagaatgatttataatcctttgggtatctacccagtaatgggattgctgagtcaaatggtgtttctggtttccctggccctccccacccttgtctgtttttctctgcttcatcctcactctggactacgggcactgcctagcaatatgtgtgtgtgttgagattatattctgttatctaccctgcctttgccagttctatggccatgggcagcttactttatgtttctgattctcagttttctcatacataaaatggggataatactctcaactgcatactattgttgtcaggattaaaggaaataatacaaaagatgcttagtccaatgtctggcacatgataaactcattaaatgttagcagtgatggtaatgatgacagtggtgatgacagtggtggtgatggtgatggtggtggtggtggtgatggtgatggtagtggtaatggtggtgatggtggtgatagtgataatgatgatggtgatgatggtggtgatggtgatgtggtgtggtgatggtgatggtagtggtgaggatgatggtgatggcaattgtgatgatggtggtgatggtgatggtagtggtaatggtggtaatggtaatgatgatggtgatggtgatggtagtggtaatggtggtgatggtaatgatgatgctgatggtggtggtgatggtggtaatggtaatggtgatggcaataatgctgatggtggtgatggcggtgatggtgatgatggtgacggcgatggtggtgatgatggtaacgatggtgatatggtgatggtagtgatggtgatggtggtgatggtgatgatgatggtggtgatggtaatgatgatggtggtgatggtgatgatgatggtgatgatggtggtgataatgatgatggtggtgttggggatgataatgaaggtgaagatgacaataatgatcctttctccctttagaatgctctgtgtttgtagatcccacctttgcattgaaccagctctcaggccctgtcccaccagttttttcttgtccatccttccatctttcttagcttccttggtcctgacttctccctgaaatatctaacctcccaggactcatagtaaaaatcagaccctccaaactggaagagagcttagagctaatccaatccaacatatttacattatcagaggttcaacgaagtaattttcttaaggatcagtgtctcctttgactcttgtggtatcacatttgcatatcaaaaataaacataaatatataacttctttttgcctgtttataagttaagttggaggctgatgtgagccaaaatacactcacacctcagactttttgtacttgctgtttcctctgccttaagtgctcttcctccagatatcctcatggctctgtctctcatgccattcccattcttggtctaacaccagcttgtcatagaggccttccctgtccatcctatgtaaatgagcaccactgtcctatcactgtctgtcccttcccaggcttcattttctccctgacccttaccagcatgtattttttggcttattgtctgttctctcctctggaatataaacaccatgacagcagaaacttttttctgtttggttcactgctgtatccctagcgcctagaccatgcctatcacatagtaggtattaagtaatcattcattcattcattcattcagtgggtaagtcagttcattgtttaactgaatgaattcatgaggcctcagtccaccaactatctcattggctcagaatttcacagacgtagcagcatatcatgggtgacgaccccactcccacacccctcccacacgctggctctgctctgcctacctgtactttcggagtcaggtcttcaaggcaaaagcgctgctccttgtggttgcctcctggctcctaggggagaatccaggaggctgcttttccccatggaatgactggctgccatatggttcccagtaaagcaaaggcaggaaacctcctattccctctgcccaaccctaggattctggcttccttcccagacccagaagagagacatgactaccagattatagggtagtgggcccacctgtttaccataatctgtagagggcattatcccatccaccccaacttgggagaaaagctgagtagaacattgtttgataagaatggcttttcatccattgtacaagataaaaagctacctccttcattttgttggattgcaggatcaatcaagtacacagctttttgtttagcaagaagccacctgtttaccatttgtaaagggatttgattgcctccaagaaatattagtgtggagctgcagtattctacccaccgaggaagggcaagaggcacagaaatcgagagaaaaagttataagcctttgggaaattaggtctctaggaggttgattgaaaataacgaaaactattataagccaagcctgtattaagtacactgttcactgcctctattactctcacaacattcctgcagtcatttgtattttatagattgagaaactgaggctcacatgacttgcctgagatctaacaactggtaaattgtaaggtccatatttaatcccaagcctaagttttgttcttttagccatcattcctaggcaaatatgctgaaaggtcctgttgaggcattttaaaacaacttcccctagctcagacctggatgttactagtaggtcgaggtcactattggggcttagaaatttccagtcttccttggaggataaacaagttgccaattactatgataaaggaactgtcatctcatgagattatggagcaaggaggactctaaggaatggaggttcagccagtgcagtgacagtagacacagcagagagctgggtggggagctggaaagcattgtagttgacagatatgtgggatacagggttactaggtctaagaggaaagtaaaatcaggggacagtgctggccaggaatccagagttgagaaggtgaggctggtagatggagtagggagagaatccagggcaaaatgctgcagagaaacatagtagtctagttggctaaagtcgaagcagaaaacccacacagtatgcaggcaagaaacaggactgatgccagggagtgtcagtcagcagaagtcaattctacccagcattctttgactccaaagacacaagatcctttgaactcagtgaaccaggatatatgacccacccctgcgtggtactaaagggctactgtccacacatagcctatgcctgcatggcagcccaggacacacgatcctgacccagagaatgagaatccctcccccaagcagttttcttggattctaaaagaatttggcttggaaaacttccaaactttagacaaaacagcttacaaggaaatactcttattttaaaccaaagtgcttgtggttgatcaggtaagcagtgtgcaactatgcatgcagcaacacactgcttcctccatcaaaaaggtcttgcaaggaaaaaaagtgtcaactgaactaacttgtaaacttagtgatgaaggtgatttacatccttgtgcaagctccttatctcatcaatgactgtctatggcaacctgttttaaactattctgctccagctctttaggcatcagacacctcccaaacaaatcccactgtccactcatgtcctaggagactgacagcatgggaaagtagggtctgaaggactcacgtttaagataatggttcattcagcttgactcaaacaatggggtacttattctatccttttctccccaaagtgacagagtgattgttcctaagaaacaaagaggacgtgcccacttatgaaagggaagagaaaggatgaatgctaggtcattcatcccaaaagaatgcttttcttttagggaaaaacttctcttccctttggtaagaagcagtcagtaggtttcctgtaaatctgataactaacaaggccgaaacttcatggacctgaatctgtcaaagaaaagaaaggccgcctgaattatttcaaagggacaaattattacttcacagtcatctgatgctaatccaactctttatcacctgagatgattttctccaactgccaatgtcccatggcagatttaaagcagatccaagaagctccatactacagatttcctcttcatctgttagaggctgctgtcttgtcagaaaggggatttgggaaatgccatcttttctgcagacccatccttggagagatgtctgcctcattaatgacaaggccactttatcatctctcagagaaaatcttcccctggctgccttgggaggcagtctcctctccatcctgctccatacctttgttgcctatcagcttctatcttgattgggtcctggtcatatcagaattagctgtgaagtaggaaaaaccagctggccaggcagatgtaccccagggcaggaatggggtgatggtctgacctcagaaggaagcaggaagtcggggtgtatcagagcccttggctgagttgctgagtaacctcagggcagtggttttaaatgttggggggtcacagatcctgctgaaaagctgatgaaagctatggactccccactttggaccaaattaaaagccattgacttagtggctgtcacccacccccacttaagctcctactttataagtccccagggatctatggctaggtatatttggattttcagtgctgaaagaatagcccaagtgggatatcataaacacacacgcctcggaggaaaggggagatctgggttttaattctcacaatatctatgtgcttggttatgggaaagccacatttcttctagtacccatgccataaaagtgagcctgaaaaattgcttctttaaggaatcctaagtgtttcatggagcaaccatggggctatagccattggcaagatggaggctggaagcaaggttttgtggccactttctcattcttcctcttcagttagagctgcttttctggcctttaaaattttgaagctctctggattaaagggtctctaaatttccttccagagttaactttttagtagtctagatctggccccggacagagaaaggagccaagggtggacagttcaactaaggggcctcactgtaatatgcatttctgagctcttgcctctactccaacagaacgtaggtccgtcttcaactgtgtagtctcacggacaaccagctcatgctagatgcacctgcaaattgtatggaacagagaaaggtagaaatctcttcctggagaaagaggaatgcaggctgctttgccctcatttccaatccctccatttccaaagagctgagccttgcaaagttccagggccactaagtgaacgctgaaggaagcagcaggctgctcccgacccactcagtgtagagctgttttactggtattgttctgctaacttgctaaatagctataattaaaaccaggctattatcattaattatgatcttccctcttctgattggcaggttggtgcttttatcaaatttcagagaggagcatttctgtgtcttccaggatgcaagaaagatagatggggcttaattgttctgactttggagcaaagggcatggtggcattgtcaggcatggcaaacttttgtacttgtggggcgggccctcctgccagcttgtccagacacaacaggctgctggctgtctccccgcctcctgcgtgggctttaaactctttacaaagtaatgaggtagaactgggagaggaaaggaaatttcacaggcaagaatggggcaaaagttctacccagctgttttaaggctcagctgaaatgcctcttcctccatgaaacttttcccaatcccccaccctcttcatcttttccaagtcaaaatgatcctcttcaccttttccaagtgaaaatgaattattttctcattattactttcattacctgtactcccccattttccctcattttaaacctcaaattttctgtagtttctactcccagcagattggagggagaaacaactagagcttcctcagttcagaaggccaaaggagcctgcagaatggggtgtgacttttttggctctgcccttctgatctgaccctcagcccttcagcagctcagtgaagacccacacacacacatcacagtccccccacccaattcctccatctgcaaacagggactccgtctgaggttgcctcaataaacttaatcatttctaagctggccatgaaaaggttgtgaaggactgtaggtgtgagagcatcgatgtcccctcaaaacaaatctcgagggatttgaagcagaacaacttctagaactcgactgtcagaccggaaagtttaaaatcaagagaataaagccagacaagaagaaaccaagccacaaattgcaaacaagtcatttttctaaaaaatggaaataataaaaactatgaagcaaaacataatgtctcaatataaaccattacagtgagttaaattgaaacttaatttgtttataaaaactagataataccaggctgggcgcagtggctcatgcctgtaatcccagcactttcggaggctgaggcaggtgcatcacaaggtcaagagatcaagaccagcctggccaacatggtgaaaccccgtctctaataaaaatacaaaaattagctgggtgtggtggtgcgcacctgtagtcccagttactcaggaggctgaggcaggagaatcacttgaacctgggaggcggaggttgcagggagccgagattgcgccactgcactccagcctggcgacagacaggcaacaacaacgacaacgaactagataataccaaggaggcatcacttcacctggcttgagaagtcaaaagggctgtttatgtttacctaatgctaaagttgccagataaaatccaggacacccagttaaattttgactttcagataaacaacaaatacaacttttagtgatgtgtatcccaaatattgtaaacatcagatgtgattatctgaagttcaaacttaactgatcatcatgtatttttatttgctaaagctggtcactctacctattactctaatgtttttccttggtcataaacggaagtgcaaataagcttaatgtttatattgatagagaattttttcatgaaggaaggaaggaagggagcagagggtgagagagagagacgacagagagaggaagggagagaggaaggaggaaggaagaaaggaagggaagggaaggtaaaagaaaaaaagaaaaagaaaaagaaaagaggaaaggaaaggaaaagaaaagaaaagaagtacagcattaaagaatcccttacttccctgttaggcaggtcaaaacaatggttatccagcaaccaagcctgtgctaactccagctactgaggtctgccagccattccccaacctggtcttttccttattctaggtttttcctttaagtatcctactgccttaatgctgttaagctcatttattttcagtgaattccttcaaggcccaggtttaggccatcttcaccagaaaaccttcccagactctccatcctctggcctctgccctgtgatattccttggtgcatgatgatgaatttctgaggatgggtgctgtgacttgtctaccactgtatctccccaactgtgtctagcataacaccaggctcacaggggccctcagtaaagaatgctgaattgaaacatgttcttttcccaagagatgaatacagagaagccaactaactcagattcagtggggtaaaaactaggctcagacctgctcactccttgaagagtaagatggaattttctcatatgccaattaaatatggataacctttgaacaacaggagtttggaccgcacgggtccacttacatgtgaatttttttcaataaatatattggaaaattttttggagatttgtgacagtttgagaaaactcacagatatagtacatagcctggaaatatcaaaaaataagaaaaagttatgtatgttatgaatcataaaatatatgtagatactagtctattttatcatttactaccataaaacatacacaaatctataagttaaaatgtattaaaacttattgtgcacacaaacacagactgtacatggcattgttcataattgagagaaatgtgaacaaatgtaaagatgcagcattaaatcataactatgaaattaattttagttaatactgtactactgtaatagtttcataaccacctgttactattgcaagaggtcaagtgttgaatctgtttaaaatcttcatgttaaaaaaaacatgagtagttttctctccagtaaatttcatatcatagtaaaatgtgatctctcatagttctcacatattattcatcatgtttagtgcaatactgtaaacctttaataacaccatgggacccatacaaagtgacagtagtgatgctggaactgctcccaagaagcagagaaaagtcatgacgttacaagaaaaagatgaattgcttgatatgtgccatagattgaggtctgcagctgccagccatttcaagataaatgaatccagcataaagaccattgtaaaaaaaaaaatgtgaagccattgctgtggctacacctgcaggcataaaaaccttgcactttggggtaaatacgtttttatgtcagattgaaaataaagcttttatatgaatgcaggattgttataagaaagccatacctatagagtctaatgtgatttgagaaaaagccaagttattatgtaacaacttagagcaaaaggaaggtgaaggatctaaaactggagaaggtaatgtcagcaaaggatggtttgataattttaagaaaaagtttgggttataaaaatgtcaagataacagggaagcagcttctgctgaccaagagacaacagaagagttttagatgccatgaagaaaattatctaggagaaaggatatctgcctgaatagatttttaatgcagattaaagtaccctactcagaaaagaaatggccacaaagcacatttatgagtaacgaacagaagtgagcaccatgattcaagggaggaagggataggctaactctaccattttgtgcaaatgcagatgggtttatgatcaggacttatcaatacagctgctaactcctaaaccttgaagagaaaagcgacaggtttggagttatacaagaaggcctagatgctgagaccctttttctggattggtgtccttaatgctttgtctctaaaatcaggaagtaccttgctagtaagggactaccctttaaagttattttgatattggataatgccccttgttgcccagaaacctgtaagttcaacaatgaaggcactgaagtattctacttgcctccaaacacaatgtctgtagttcagcctctagatcagggggtcacaaggacctttaaggctcattacacatgatactctatggaaaggattgtcaatgctgtggaagagaaccccaacaaacagaacatcacgaaagtctgaaaggattacaccattgaatatgccactgttgttatagaaaacgttgtgaaagtcatcaagcccaaaacaatcaattcctgcttgagaaaaccatgcccaggttttgtatatgactttgcaggatttatgacaatcaaggaaatcatgaaagagattatggatatggcaaaaaaaaaaaaagggtggagaatgaatgctttcaagatatgggtgttggagaagttcaagagctaatagaaaccacaccaaaggaattaacagaaaatgacttgatggagatgagtgcctccaaaccagtgccagatgatgaggaggaagacacagaagaagcagttccagaaaacaaattgacagtagacaatccagaaaaagggttctaattactcaaaactactttttacttcttttgcaacatgtatccttctatgagggtgctgaaactaaagtacatggtggaagaagaattgatattgtatagaaacatttttagagaaatgagaaagcaaaaaagtcagacagaaattactaggtatttccataaagttacaccatatatgcctgcctctcctgccttctcttccacctcctccacctcttctgctcctgccacctctgagatagcaagaccaacccacccttttcctcctcctcctcagcctactcaacttgaagataatgaagacctttgtaatgatccacttccacttaataaatagtaaacgtattttctcttttttatagttgtgttaataacatttcctttcctctggcttattttattgtaagaacacagtataaaatacacataatatgcaaagtatgtgttaactgactgtttatgttatcagtaagactttcagtcaacagtatgctattagtggttaatcataatagtagttatgtttttgggaagtcaaatgttctacttggatttttgactgtgtaaagggtcaactgtgcaggggttgttgaaaagtcaagtgtacatttcagccagttaactaagaataatccatcatgcatgtgtagtaccctggccctatacctatctatttgcctgtaccttcatctttgttagcccttttataagagactaaacagaaaaagagatgtaactcaaaactcaggcctatggccccagccatgtccacttcctcccacaagggaagagaaagaaggaagattgcccttagctaacactaccttgtcaggactgtggtcaagtgcatctcagtctcatgccatcaaaacccgggtgaaagagacactcaagtaagacagacctatatttaacttccagaagttcactttgcacaagttatatcaccccttttggcctcagttccatcatttacaacatgggaatcattatacctagctcaaaaggtttttatgaagattagctgatataacacagcacagcgcttagctcaacacctggcaaattggatatttattaaatgccaattttcaaattcttatcagaaggtttcccatggtttacacagtaaagaagggaagagaaagactgaatgaggaacattctcacttgaaatcaggaatattttaacccacccaagcattttgactactctgtggacttttctcaatgcctccctgaatgattgattattgctgttttgtccagtgctttcacattttactgggcctacagttagcttgctgcctaacaaactatccccaaaatttagtggtttaaagcaacaaccattgtattatatctcataaatgccatagttacaaaattcaggcatggttttaactagttgattcttctgttccatgtggcatgagctggagtcacttgttggtattcagctggcagatagctggtcttgagggcacagggtggcttcattcatatgcctgacaatctagcaagaatagcaggaagtctgggcttagctggggctgttggccacagtgtcttcatgggtatctcagagcacttggaagtcttaaatggcggctggcttctcccaaagttagcatctcaagagaatcaggagaaagctgcacgaccttttctgtcctatgctcagaagtcatcctgggtcatttctgccacacactattagtcaaacagtcacaagcctgcctagattcaaggggagggacatagagcccatcacctctcaatgagagaggatcaaggactttgggcctatatttttaaactgccatcctgggaatcttgtcaaagtgcagattctggttgggtaggcctgagggttgggccttggattctacatttttaacagattcccaagtgatgccagtatggacattttaaaagtcacactgtgggtaggaaaggcttgacaagcccattatgttgtatcttccattgcaccaaaattctgttactgttcctgttgtctcattcctggttagcttcatttaatttaaaactcagacagccaatcttttcttgtgcttactggaaggactgctatgttaagagacctttacttcaaaagaaagaaacatccctgtgtttagatttcacaagagaacctaaaagggctaccaggaaaacctttggcagagaatgtcaggtcaggtaatcataaagccctctgggtaccttttctctaccatccactttgaggagagagtaagtccaaaaagctaactgtgagaggaggactcactggtggtttatcacctcttagaggctcgtgggatagctgtgactcagctagttgctaactagtaaatattgatgtcttggtttctggcaatataagtcaattatccaattaccatggctgttcctagctgtggaggattgggcctgtagacattgagcacatggtccaataaattgtttttttttttttttaaaaaaagggaaactatgtattaagctaatgatcaatgatcacaattttatttactaacatttacttgcttacttaaggaatgatacaattcaaagcaggattagaagaaatataaacatcaagataaaatatggtgatgtctagattaattatcagctgttataaattatcattcccataggaccaactttctttaaagggacttttccctttttcccatcgaaacaagtgcagattttgccctgtgtagaatttccactggggtgggctgttccagctaccgaaccagcttccgaactcagaggcacatggcaccagtggcattgaaatgcacgctccagcttacctgaaaggaattgttaatatttctgttcagtatacctaattagctctggagtactgaaatttcacagaagtaaaatttgatatatgtccatgaattcctattaatttcccaaaaaggagtccctcttactatatccaaaatttttgcatcttttacattttcattgaaaaaccactttaaaaaaaagttacatgccaatttctaagatgtttcctcacaatcagaaaaatgttgttaccgtaacatccaatacaccatttccttctgactcctggggaactcgctgttggtgtaaaagtggaattttcaagctgtttagttgaaatagaacattttgttaagtgaagtcctaaggggaatcccaatgtataaaaccaacaagagtgagtagctgtgactgaatcaactgtgggagcatctctgtctccaaacacagtttgaaaaccactgagtagaagttaatttgaaccaaaaagtgactttgaatataaatctagtctggctagatttatattaagctttcttcttaaaaagttctgtctttttacttagttgcattttaaagcacatttaaatagaaataaatgtttccagggatatacaatggtttctctgcagtggaaagaaaggaaaaatatatatacacatatatatatatacacatatatatcatatactctctatatatatcacatataagctaatgagcaatgttaacacaattttatttactaatgtttacttgcttatttaaggaatgataccattcaaagcaggattacaggaaatgtaaacctcttgataaaatatggcaatgtctagattatcaggtgttataaattatcattcccacaggatctattttctttaaaatgactttttcctttaaataatagatggatggatggatagatagatagatagatagatagtagtggggaggctgtggagagaaagtgacagccgagagaaagtgacagcagagagacagcaggggaaaacacccacttcctgggtctggccatgcacagacccccagtactgttgtggaatatctatctatctgtatctatatagatagatagacagagagagagagagagagagagagagagagagagagagagagagagagagagagagagagagagaaaccaggagggcaggcaggtgaggtgcataaaggccctgtgatggacacagactccagtactgctagtcctggatgactgtgtagtcatttcatctctttatgacccaagttattgaaggataagaacaaccaccagctgttgctggaccctcttgtgaaagcaagctgaaaaaccaagacagcaagatgctttacaaagacattgtagagaaatgcttcaaaacgtgtacatccagaggtttccagtcccctaagcaaggatttccaggccatttgcactctcagctgaacatagagcatctgcaagtaggagagagacaagctctgctgggtctttaaccaggcatttatcttgacaattgactctatgccctctgccccttagcactttggttttgctgttttatgtcagtgtgccttttcccacctcaagcagaccatgtgccactagaatgaagggggctatgtcttatgtttggtaaccccttttagtaccatacctaacctaagtattagtactgtttcagaatgaaacagtggaagtttccagagtcaaacaggcctgggcctgaatccaccaatgcctttggtagaaatctggatttctatgccctgagttttctaaaagtgagtctgaaattctctgttgtactctctactacaaaaaggttataggcgtgatattctttgccgtgtcctagaaccctcaaaacaaacattttaggggacaggattgccttttcaggcagaacctctgttgagggaaaatggcagttaggtttgttcccatttccttctaaagagaaccaacaacattgtcatctatttgaatgatgttaaacagtttacaaagaatttttacgtatattctctctccacggcccctctgaatctctgagcgggtggcagggtagctgccatcagtcctgcttcacatatacgactcatcttaagccagtgacttaatcagctgtgtccccccatctaagaaccaaggtctcctggtagctaaccgttcccttgcctcaattctgtgttattggagacttgcctcaggccacacaggccagaagacttctcaagtcttggaaggaagcccccaactcatagctcagcacacatcttctcaaaacataataaaagaggaactgaatagaatggaaatttcagtgaagaagacctaagtttgaatctcacacctgctgttcctggctgtatgactgggtaagttaacttctctggaactcggtgttctctatctataaaaatggggatagtaatattttcttcaagggggttttgtgaggattaaaagagacaacataaatgaaagcacatagcttggggggaaacctaatggatgctttataagtatttatcaaattggaatagaggaaaaagaggggccttcctgccctaaaatgtcttcctccatacacctgtaacatcacagtattagaaaggccttcctttgggggtaaaggctcatcttcttcaagagtgttaacaatgattaggcatgcacagtttaaggatgtcttgcagcagatttttaaaaagaggtgagagtaggagaaactccagggtacaggagacctagagaggatgccgggtgacaatctctacttacagtaatgtgggtaacactatgcatcttaaataagcacaatgttgacataacacttatctgcattagcatgtttcagatcaagcacttcagatgccttctctacacttgtaaaatcatcatggtcatagaccataggaactgcaaatggccttagagatcactctatcccatctcatttaaaaatgacaaatctgaggcccataaagtagaacattttatagttctggggagaaccataagaactataagaaaatgctgaattctgatgctgcctgggaaacaagtgttaatattcacatccaactgcttagagagagaatgactcaccatcagttcacacttccctgggaccacatgctacccaagcctaggagctgaaggggctgataaggaaggtcagtgccatgtcacaggtggaagcttagatgcagcaggactgcaaggaagggcacagtcttcctgacatccagcttctctctgtacaatgctagcatcaagagaaagattcagcaaaagctcattctctgaccacatgtcttttgctttagtaaatggtggcttgactgagttcaaccaatctctccctaacccagtcaaccggctttctatgtacaaccatggtcctaaccatgccctttgaggcacaccctattactctcttgcaaatattcagtcttacctactacctgcacccccaccatggaaggatgtggtttcctgtccactgatgttggccttggcttcaagatttcctttgctgattggaatgtgtgcagaaggggcaatgtggcagtttcaagaggctctcagagctctcttgcactagtttcctccaatctgagaatattcagctcacataggagatgccctttcatcttgaatcacaggatgggaagatgcatggagcagatctgaatctactgacagcctgaagaagagcagcagccatcccactgcaccaacaagcaacatcaataataaagttgttggaaagtatcaagaatttgaggttattcacgcagcataaccaagtgaaaactgtccactatactcttcatctgttggactgtgatttctgaatgaagggtagttccactgtcccctctaataattgcttctaatcacttatctgcactaaaccctgtgctaagcactttacaatcaatcagcccattggaccctcacaatgagcaattattaaggtattactgtccctgttctatagagaaaatctgaaggctgagagctgaagggattggtcacatgattcgtaagtggcagacctaagacttgacaccatgaccacccacgctagagcccagactgtccccacactccagactgactctacgcacattaatgcaatgagaatgcatcttcttccctgctcccacacacatacttcccaactgtgtataatacttcttccttttaagtaagcttgtggtagaggggggagaatgacttgtggatactcagaatgatctaagcacccactagtccatttttttaaaacatgctgaattttgagcctttccaaggttgacttggtcaattccattgtgcccagagcctggccaacccagctttataaagtcctccagcccattccccattagggcacagtactgccttgcgctggccataatgtttccctccttgatttatggggccatctattctgggccactcctgatgtgctgttgtcgcccctgctgcctgacagctttagggattcttctcaggccataattcttgaatatttccacccctccccttccctggccctgggatttcagccactttccattcagaaaaagattgctccatttattctcagcttcatggtcctttttacatttatctactgctcagctgccttcctgatcaggtatttaaagataagcccatctgcttctgatgagtgaccctgctcctttttctcattgctctgactttctgccatgcagcctcaatatcattttatatgttcaccagctcccaattcattccattattcttttcttcttatcaaataagaaaatggatgtggaagggccagggaaactataaagaggtgtataaatattagttctttgtgttattgttattgttgttataactaacaacctcccgaatttgattctaagtggcaaaatgttaactttcactgtggggaatgttccaggattctttctcagcttggcaaccaaacaccaaggtttaggtcctgttcaggtctgaattccctggtatacaatcctgcctctaataagcagactgcagcacaggcttccagatgactcagttacgtagattactgtttccataatatctgtaataatagaaattagcttgtttaaatgaatggaacttactgaatttcaagaacagtggctcaagaagtttcttctatggggaaaagcatggagctgacagagctgggttcaaatcccagttctgacatttacaagcagaatgaccttgagcaaggtaaactctgaacctccatttcctcatttaaagtctcttatggactgatatgaggacaaaattcagtagttctacaaaaacccttagcagagtgcttggcacatgacagtcacccaatataagcatgtaactggtgatacgaatgaagaaatggaaaactagaagtcactgcaaataatttaagtgctcataaactttcaagttgaaaggggtgtcaaggacccaaacccttttcttataatagaaaatgatcaagaaacccagagagaacttggctgtcctcatctgcaaactctgagggcaggggccatgtctgtttccttcacagtgcctggctcatggtagcccccagtgaatatttgttgctgttgtggatggtggtgttaaacccaggggaggcaacatagcatgggggctaagggcaggtgtttggggatccaggagtcctgagctcctgctccacaactgaacagtgagatacttgggcaagggacaacctctctaagcctctgtgaaatgggaaaagcaatactatcccccacgtggcattgctgggagggctacatgagaaatggaggttaagcctgacttttgcaggggagaaaacattcaacaaagtgttagctctcacaactaccaataacctggggagggggagcagggaaaaaaactatcaataacttatctaagataacttagtaaattagtggggaccagcaaaaccccaagcagaatgacttcaagtccaggataatttcttctagtacagaaaaattaaattttaaaaatcagggtgatatcattctattaatgtttcattcttacttctaaagcacctttttgaatgcagtattctgtgattctggactcccttttaattctcaactattttgcttttctaggaggatgacgggaacatactagtatctgtgagaatgtgatgcttcaaacacacacacacacacacaaacacacacacacacacacacacaccccgacatactcctcttaaatgcacttggtggtcaatatctcctatagagagatgtagcatttgtttaacaatcaatgggaaccataaaaagccccatgtttccatcagtggtaaaacctccatatgtcaagtcatgtgctccatatgtcaagtcatgtgcttcctttctgaagacttaatatcaaggtgtcatcattatccataatgtgtttttgaatcaggtcttaaaacttaatgtagcttttatgcctggagataaggcaggatttggatttggcaagttacacacaagggccgctggttgatcctaattctctagaatgatgtaaaaccttaattagctctgaaagttgttacttgggatgacctcctccccagcactctgcactgtggaggggtgacaacttgggaaggcagaccacactgcagtgcactgggattccattagaaagtcttttttcattccgaaagacattgagagtgaacaaaggttaaaacacagagcttttctttaaaggagaatgggcaatgagctgaaagtttaagactgaaaggcttggcagagagacaagaattgaggctggaagcaggaagctgcagctccagggatccctggtctgtggctgtgagcctggctatactatggtccagcaccagaatgccttaacaacaccaatgccttcagaaacccacagaaaggaaacaatgcagaaaggaattcatggtcttttaaatgagtgttgcatgattggccatagtttattattttattccttctagatgatatgtgccttttagtagtccttccagtggcttagttcaggagatccctagccatctcaattcaacagttcattgtgagcctccatctgcttaattaccatcttattggccagtttatctgctctcctaggtcatttcttttggccgatgtgtttttgaaaagaggaccacaggagtgagatactggctgtccagtattctcagtggcttggggtgaagaaagagggtaggctacaggttatgggtctgtgtttttccctggtcttccctacattccccacaacctgtgtttgatgccagaacattctgacacagctctctccatcctgaagtaagggaaacttactgaatgtgtccctaggatccatgaactgtttcctgcaatgggagagtaggtatggtagtgtgggtgcagggagacaaactgccacagaagctgcaggacaaaaagagctcctacaaggcaggggtcacaagctcttggggagcacaaagcccttgtgtggaagcagggagccgggctgcagaggaaatgggtcttagaggagttgacatttgagtggagacttaaggtacgaagaacatttgccaagatgaagaagaatacaaagggtacctccgacccccaagagggaatgtcttgacaaaagcacagagctgggagggcagattttgtgctgttacgggctgagtcacgttcattcatctgttgaagccctaatccccaatgtgactgcatttggagatccagcctttaaataggtaattaaggttaaatgaggtcaataagggtggggctctaatctaacaggattcacatccttataagaagaggaagagacaaagagaaaaggctctgcaaggacaaggagagaagacagccacctgcaaatcaaggagagaggtctcaggagaaacccacctgtggcaccttaaccttggacttctagcctcaagaactgtgagaaaataaatttctgctgcttaagcttcccattctgtaggattttctgatggcagctctagcaagctaagacaagtgtggagcacctccacatgatcccattggacaataaaagttcattgtaagaagaataaaatctccatcacgcacctccacatgatcccattggacagtaaaagttcattgtaagaagatgctcagcttgggtttttcattacctcacacaggcaggtttctgtattgtgtaaatacatggaaatattgggaagaatacacaccaagctattaacacaggttacctctagtgaaggagaaagagcctaggttgatgttttgagcaaagcagagcttagatatagatagacatagatgtaaatagagatctacaatccacctttaaaaagttagcagaggccaggcgcggtggctcatgcctgtaatcccaacactttgggaggctgaggtgggtggaacacttgaggtcaagagttcaagaccagcctggccaacatggtgaaaccccgtctctactaaaaatacaaaaattagctgggcatgttgataggtgcctgtaatcccagctactcggaaggctgaggcaggagaaccacctgaggttgcaagtggttctgcagctactcggaggcagaggtttcagtgagctgaaatcgtaccactgtactccagcctggacagagtgagactccatctcaaaaaaaaaattaattaataaataaataacaataaaaagaaggaaaaagtaaagaaaaaggagagtacattcacatgtcactttcataaataatacttcagtttaaaaacaattgtaaagaggaagggaagggtgcatttgttctgttaccagggacatcagagtgggaggtggtggggtgggggccccagggaggattctcttgggaggcttttcagcaggatttccctgatggctcctccctccaccagtcagcagtgtggcactgtgagacagggtgctaaagcctcaagacctcctctctcattcagttaccctgggatttggtgattaaatctctcctccttctacctaggactttttataattgtgtaactcaatcctattcccttcagccttccctttctctcaaggaagagcccttacccttctcaggctttcctcaaatgtccatgcccctcctgtaccctgcccttctccctgggtacggtgagagtccttcttgtggcccatgttatatttcctcagtagcaggagccaaacagcctccccctagttctagcccagtgtgcaggcttgtgctatagagagaggtggaaaggggaaagagaagatgaaagaaaagcagtcatatccaaaggcaaaattatgagcttgaagtcagacagaagtgaaaatgaagttggaggatggaaggagtaaaggcaagactagaagaagagaaaagggaaagggaagaataaaagaaagagggagggtgaagagaaaggacagcaggtgacacagttccatggcctcagggcctctctttcctgccaccttccccagccccaggcagcctagagctgtccatagcaggcctgtctgattttttcggtgaacccattctgaattcttcttccaagttttaggtttgaaaatacggggaaaggccacattcctaaacaaaaatagaagaaagggtttgtttgaaactgatcaaatgcgattaagggagagtacccaactcacatccctttgattaacctttatctggagagaagtgattggtgattaagaattagatgaggtgactaattatatcaggaatctgccttcgaagaaatctcagcaccagagaaaaagctgataaaaaacaatcatggctgtaatggtgccttttaaggataataattaacctgtaataacaattttggcctcaacttaagccctgtaaaataatcctttttcattaacttcaagttcaattaacatcaataatgagtgctcatttagaagtaaccgccacatcaagctccctgatggctgagctcgggcagctcagcttccactgaaagaccagcagcccttgccacaggactgaatgtccccaacatggtaagctttgggtgtacccattacaaaacaaggaagaatgtgatgttcagaaagagagaagcttcagatggcaccgaagtttacagtgaggaagaagaggaggaacagaagaaaagggtggggaggagagaagccaccaccaccacctctggtggtctactaatctcagtgtttgatatccatctgtaactccaaaaattaaagatgatgtgactacctggcaggcacttcctccttccttcttgctcacagagcctctgctttttttcagatttggggcttctaggtacttcaggggcctgggagatgattgctgaatagttcaaatcaatgcatttcaatgtgtggccccaggaccggcaggttttgttagaactgcaaattctcaggccctacccccgacctactgaatgagaaactctggggatggggcccagcaatgcctgtgttaacaaaccctccagtgactctgatgtgcactcgagcttgagactatgaattgtgttcttttctctagtgattgactttggcatcgtgtgaggcagccccagcaaatgggacaaagaaggaaatccagtgagggccttcgggaaagatttttgttctccaaagacccttgccccttttttgccccctgcaagcagctgtgtgtgaaggtgccaagggcttctgcagccacccatcaccctgggggcggctactcaccctgaggaaggcagagtagaaagacagagagcctgggctcttgagcttgtaatgttgcagctgaattaacctaccctggagtcacatgtgctctcaagctctcacatgaaataccacacccctagggctgggcacagtggatcatgcctgtaatcccagcactttgggaggctgaggcaggcggatcacaaggtcaggagatcaaaaccatcctggctaacacggtgaaaccccgtctctactaaaaatacaaaaaattagttgggtatggtggcatgcacctgtagtcccagctactcaggaggctgaggcagaagaattgcttgaacccgggaggcaaaggttgcagtgagctgagataacaccactgcactccagcctgggcgacagagtgagaccccatctcaaaaaaaaaaaagaaaaaaaagaaagaaagagaaaaaaagaaataccacacccttgattgttgagctactctgaacgggtctctgttacttgcagccaaatgtattctaactagaaggttcaggatgcacttaccatgggccaagcactgcagtggctgcttcgtgggcttcatcatcatgggcatcacagctggtctcgcctcttcattgacctaaaatcctcactattagccactcttctctgaaaggctgacctgacctgagagcattttaaggggctctggcccacgccaatttccctgtcttgcccagatgaatgggctttggaaagcacacacagatctatcctgagagtaggccagttcatgcattctttcatttatcattaaatagatctcaggggaagagaaaagagagtagagaatctgcatggggtaccacctgagcagtgtcaatggagatgggccacctaacagggagccctggacactcaagggttttagaccaggcagtgaccatatagtggaccagggcaggttgccaaggctgcatatcaagctgtcactttgtataccagggaactccttggcttcttaagcagggtcgctgcctcctcttctggcttcctcactcctttctccttagcccctatttcctaaataggcaaaacgtaagcacactcatttttattttaaggaaatttcaatttagccacttcaaaataattttttctggcacccactgtggtgccttgcacagagtgggtacttcactcaatgtctatccgcagtcaaaatgacagtcagaagcagtaaccagcaaacatgggccatctacacgcccttgactgggcttcacagaaaggcaatgaaacgtgcacaggacactgtgagagatgaaggacttgacgctctgctgcttcatcactctcctcatcctttaacccctccacctcaagagagagacatgtaagaagaaaggagcacatcccactatgagaggtagagaacaagagaaaagaaatcaagaaggagtgagggacaagggaagtgagtgacagacgaggagtagatagatatgagagccactcgattttcatcctactccacaggcttccagaaaatcacagctgaatgtcttaagaaagaaagaaagagagagagagagagagcaagcaagcaagcaagcaagcaagcaagcaagcaagcttttcctcatagcaggggtgagaagaaagcacagatttggaacgaggaggggatcctcaggcttagaaacctaagatcaaatcccagttcagccacttatgagtcatttgacctaggcaagtcacttaaccccacagagcctcatttgtgaaacagagataaaactatctgtctcttgcagctgtgaagattagatgagaatgtctgtaaagtgcctggcatgtaatagatgttcaataaacttcagtgccacatttctcttctctccaatcccccttctcatcattgccttatctgaggtcatgtctgatattctctctggcaggtaattcttgagcatgtctcagcaaattgcttgcaaatttttccctttgaagaggaggacaaagaggattaaactaaagaaaattcagcttctgagtgttgcacccgctgtttatgctaactcagttcaaactacaaaggcaagcttggtgccagggaaggagtcccagcttcaagcccacccaccaggtctgaaaaccctactttatctgattgcattattggccaagccgctcatctctcattgagaatcagtgctttacttaagaaaagctgcaaatcaaacaacagggctgtccagggaactgagaatttagctccttaaacatttcctcctataaatataaattgttgctttcctctaaagaaagcctctctccctgtgatctatgaaggattggagagggggtcaggaagatcgccgtatcttctggtgaacattctcgatcaccttaatcccttcactgacagtcttctgatctgaaagaaatagtttattgtgttcctcagtttacaaagaattaggggtagggggtgtggatcaacaggaagaacagaacacaaaattcatcagggaagcagaggggagggggaaagagagaattactttgaatacagttgcataatccataattcagcaagcttttcatttctcttatcttccaaaaagacatgaaattaagttctaagcaaagcacataatttatgagaagtctctgtgctgatgactcccaaatccccatgcccagccctgacttcttacatgagttctagtgccatgtttccagctagcaggacacagctgcttggagttgggctatcatctcggctccccaggtgcaaattgaactcaactcttcctccccaatgttttttcttcccaaattcttttctatcaaatgacccattattattctaatcttgctggcaaaaagtgctagaaagcttgaatttctctttttcggccccttgtgccaaggcctgtgaagtttttctgaagccatcctcttctccatcatcctgctgaatctgcatctttccaaatcttccctctcctccaccccagattcctgaccccagtccctacatgctaatccagaccacacaccattgccagtttcatcttcctaaaatgctatttacatcaggcctttgatggctgcctgtttcctgctgcaagaaagtcaaacaccctctgcttgctctccaaggtcctggccccatcctgcccatccaactgtacttaccgacataaaatctcttctccaaactgagagggcccagtagagcatgaggctcattttaggcactacaggaagacaaactggactgaccttgtgctccatactctgtggtccccacctggaatgctattcctctttcatcctgactattccaaaccctactcctccaaaacccatcaagcttcagctccatcaggaagcctgtactcaccaatcctactcactgttctttgcccgaagacatttagctcttaagctcacaccatctagtattattttaaagtatgtagtataatgctcacagtgcttttgattttacagtgcactaacctatgcatataatcttatctgatcccctcaacctggtggggttggtatcatccctgcacttaactaggacccagagagtttaaatgaagatcatgaaactaactgatgatggtgtcaagtcttgaatccccaaatgctgactcaaaatcctatattttttgtttacctcattagactttaagtctttaaagtcagggactacatcttgtaattattgcctgttaccctatagaaccgtacaaagtcctgaacgcatggaaagtctcagggactatttgtagaatgaagaattggaattaaggaaaaagtcagtgaaccattaagaattgggcaagtgaatgtataaacacaagctgtattcactgggacatgggctatgaaagatagaaagaacttgctcagatagtccttttaatataccacatttatatccctcattcattccttttttcttccttcactgattcagcaaatatttactgagcgcctactacgtccctcatctgagacagatgagtcaaacactcccttgtccctcagtcccaaccctaacataaaccctacccaaataaggaagagaaaatagtttttatgtatgtatgtaagtaggtagatatttatttatcagttggtctatcaatcaattgattgattgcctctgttcacacaattggctataatgattggaacagaaaaccataacaaagcagctctggtgagtttactatatatccagaaaagcatcaaaataatttgggttttcctttggggtagaaagaaaaataaatgttcttaatctagtcatggtctttaaagcatattagaggtaagcagctcttatcataatttaccaattacataagaatcagagaaggtgatgatttcttattactgctttatgaaattctaacggaccctgcaactgtttatagaaataacaccttcccagtcatgcttcagcatcagcccaggaaataggttagaatcataggattttaatatgaaaaggacagagattagaactcacttatttgatattacagaaacaaagactcaggaagtttaggtgatttgcccagattaaaaaagaataacttggtatattctaaaatgaaaacctaatctcacaactcctggtcgagaactctcttccctctttccactgcttcaactcacattacagtttttaaattttcctagttagttattgaaatagggtttttttctgctgtgaaattaaaagatcttacaatgaatatcctgactttggaaatattatttatgatttaattaaaatccttcaacatgaataaataaataaacaaaagattcgctggttcaatatggaatccttaggcaatgcataatgggacaggattggttttctggtaactttcactcttagagcaaaacagctgctccagtgctcaatatctaaagaattatattgtgaccctcatttatttagttatattttccacaagataaactctaactgtgagaatagttagatctcagcaaaaatgagatagaaaggaagccacaaaaaataatgaggggaaacccctttattaataacaacatcaataataataaaacagaagataatggataatatcttcagtgctctaaccatgtcacagatgctacactaaactcttcttaaaatttacctcatttactcctcaaaagaaccctataaagcaagtactataattttacagataaggatgctaagaccagaaaaactattttcatattagcttaagaatgtctggagctgggtgtcaaacctagaactaattccagattctgcttccttaacacaatgtaatatcctctcctttcagaagtacaggggttaacgaatgttcagagttctttaaacaaaacaaaacaagaaacccacctttctgagcctgttcctgatgataattgagtgtgaggttgagtagagaattacactctgtctgggggattacacttctatcaggatttacagagctgaagcaagataattctccctccttctgttttaacagtaaatgtcttcagtaaaatgggaataaatgatacacatacacatgcacatataaaatactttgcatctgataaaggagaggacatgtgggttgtgggtccttctccagatgccaccacaccactcagatatgaaaaatgcaaacacaattttgtgctgcaaagtaatttcttgatgttatcaaacattctcattacttatcaagggtcatttaccacttctactctattctgatttttcacattttctgttttctgaaatgcaaacaccactgcttgtgatggatcccttaaagtgcttctgattcacataggtcagcatgttcatgtaaattagacttaagtctaaactatgtttcttgcctaaatatttaagcacataaataatctctggttatccaggctgtcattttaagctatttgacatttattgttctgaagagaagaaaggtcagatatatcaaatctgcatttgtgcttcatgacatttttctccaatcagattcttccaaattatggtgtcaagattaatactatgaaagaaagaaggtaagagggaaggaagagaaggagggaaagggaaaaggaaagggaaagggaagggaaggggcaaggaaagaaggaaggaaagaaggaagggaggaaggaaggaaggaagggagggagagagggagggaaggagggagacagagaaggaatcccttttcctacctagccagccacagtgaagcattctatttagtaaattttgtgctttcccccttggctgcatttgtcaagcagatgtgtgggtccaagggggctggagcatgaagggaaaggcaggatgcgaggaatggaaggggatgcatggctttgtgatctgtttagcacaacctttgctcatacttcacagaacagattgagaccgctgtctggccccactcctgggctctctgcctttcatctctgcatggccttggatacatttgtcttctcatctcagagaaggaggttgttttccttctctattgtacccctgcctgcagttctgcccatgcctaccgctaaactgcaacaacacaggtttcccagttcaagggcctcgctatagagggtcagatcacaggagcagaatgttgtcctcatctggggccatgctttaagaggagagggcgtgtggggcaggggggaagaagcaggctcagtgagcactgtgaaacctgtggtgaatgaggaaaagtgacaagggggctagagacgtttgtttccttcccagcatgtatcatcatttctcattatatatttatttgttcatttgcacatttaatattcttccctcaccattctataaatcccatgcgggcaaagcccatgtctgttttgttcattgctgtctgtgcagcatctagtacagtgtctaacatactgaagctgcccaataattatttgttgaattaatgattttttaaagaaaagggataggagagaaagaggaggagaatgaaaagaaggaggagacaaagaaaaatatataggatatgtgggataactgacttcaaatgtttgaaggaccctcatgttggggagaagttaatacttgtcagccaaactacagtcacaagtaaaagacataagacagagagatcatagatgtggagttaaacaggctgaaattcaaataccagatccttcacttactggctgtgcaacctggatcgtgttatctgacctctctgagcatcagtttctttatttgcaaaaacgaaaagagtactaaaatcataaaactaccacattatagtgaggactaaataaagcagtctatgtcaaactgttcaatggtagctgttatcattaaattacagaggaatagaatttgaccactattaaatattttcccaacagacttgtccaacaggtaacagggaagccttggaaaatagtgatccccacatccccagaaatatacatatacatttaaggttttttttttttttttttttttttttttttgagacagaatcttgctctgtcgcccatgctggagtgcagtggcgcaatctcagctcactgcaagctccgcctcccaggttcacgccattctcctgcctcagcctcccgagtagcagaaatatttttttaaataagattgaatgaactctattttaagaggaaactccagaagcagacagggccctagatataacggcatctaagtcctgtataagagtctgcacctagattgaatggttttgctatacaattatcctctctctttcagatacctgaaatcttttctctttagctttttccctcctgattttcaacattaagaggtttgctatcataaaacatgtttcctccatgctgctgaaccctctgacatcactgatatttcattctctttctcttctttctttcaaagacttcttaaatgactacttaaacacgttttgcttctatttcttcagcactctctctaaacttccttctgcctgttcctgctctgtacaagacactccgtgaattgctcttggtccaacacaatggtctctccactccatctgccttgctgagcttctataacaccacatgatccacagaggcctctgttccttcttgtaagaaaattctttctggtgatgtcattgactccattctactgtctaattatgaactttcctaaatctaagctgtgaccttccttctttcctctctctacgtcctctggaaaactcatctctttttttcaaggattaaattaccacgtgcatgtaaatagctcccacatcgatatcttcagccttgacctcttccccattcctgcttcaggcccatgctttcatgtgcatcccagataccctcatctttggatggatgccacactagaattattgtcatgccaaccacttgcccctcaaaccagatcctcttcccaactgtcttctttatcagtaaaccataagtcttcaaggttccaaaaccttagacttttgactccttctcatttgttcctcttatatctgggcatctattggcccagctctgactctttcattgcttatttggtgtaatagcttcacggggctccaacactagccctctctacatccaggcctgagacccacactaaaatacatttcctgaataatctgcagtcaacacgcagtcaaaatgcatctcccctactcaagacctaaataggttcagatttctctagcatcaaatcaaaattccagacacaaaaagccaggctaacctctagttcagaatatctgacctagcaccttagagctctctgctctggctggttctactctccagagcacacacacacacacacacacacacacacattgtctatctgcctttctgtctctctgtctctcctttctcttctctttcctctctccctttctctagccaattgttcttcatctgggcattattttggctcttgccccaactcagaagatcctttgtccttctcttttgaagtaaaaagctgcactctctccaagaccctattctcaaattacctccttctggaagtgtttttattttttactcacttctatctcagtctcaaaaggaaaccatcattctcagcagatatcctttgacctgactccctgccaaaaggcaataagcttattgtttctaaaattccagagctatagtttcctgtctcagagaaactttacctctcccataatgcactgaaaactactgctcatctgcctttaagggaatgcttttgagatttggaggtacagcatgaaactctccttaatcaccccagcaggaattgacctctccaaccctctatccaactactataaccagctgcaccatttgtttagcattcaagtgctgccttttattggagttatttattagcatactttgtctgccttttctcctccaactagtttgtgaactcctgggaggaagagactgtacttcattcaacttggcaagtgctcaatttaaaagaaaaaaaaactaaaccaataaataagcatttcctcaggcaaaaattcaaacttatagatctccattaaaaggattcccttgtctaatttctctttggtgcgcacctcccatggagatctatatggtatctcaggagacaagctagtatgacctagatcccaaagcttatcatataggctcctggccatgatacaagaactagcactgcatgatccttcctaccatgaataactgtaaaactgacaaaatatttgaaagaaactgtggaataatcagcaacacaggactataatccttgaaagagtgagaatgtatgtggtgggccctagcactgttctgattttttgcctagaggcatttaccagactctgacacaggaaagagaaggccaaaaagagcatagtggcctcagtgacttgaggtcatagagattggtgtctagaaaggctgaagcagctcgaatttccagggagcaaaccagagaaggcacaactagacacacatacacacacagagagagacagacagacagagagagagagagagagagagagagagagagagagagaatgctccacaaaactgcctagaagtcctcttgagtctttggctaaatattaagttgtgcattcatacagtgagattccacaagactaagcaaagagcagctaccaagtaaagaatagctatcagggaactgtaagccaaacaatttctacagctcatacatggaattgggaaatgttttttaagtgtgtaagaaccagagaggagagacctcattgaatacctttgaatacccgaggcatgtgatggagactccagaaaggccaaaccttaagaggaggcttaaactaaccatagaataaagacttctctaaactccctcaaacaaagcttgacaataatccttgaaagtataaaattgatggacaagtcaattaactgtcaaagaaaattcaaaagtctttcaatgaagacaaaaatgtccacacattcagcaatggaatattcataatgcaccacaccaaaaaaaaaaaaaaaaacaactgcaaggtatgcaaagaagcaggaaaatgtgacctatttccaagagaaaaactgatcaatataagtagacatagaaatgatagaaatactataattagtggaaaggaactttaaaatagctgttatacgtgttcaaggacttagagaaagacataaacataatgaagatagaaataaaaatggaagcagaaattctagagctgaaaatcaatacagtatctaaagtgaaaacttattacatgggctggtttattagcacattagacactatagaagaaaagagggtgaacttcaaaatatgcaataaaaactatgcagactgaaatacagagagaaaaggggctgagaaaaaaaatgaacagacccttaataaagtacgggaaccataaaagtatagcacaattgtaattgaattcttagaaaggaggagcagaaaacaatttttttaaaaatttccaaatgtgatgaaaaatataaagagaaccaagagtctatcaacaaattgctaggaggaaaaacacaaagcaaattacataagggcacatcattaatcaaatttctaaaatcctatgataaaaagaaaatcctaaggaaggcagaaggtgggaaagacataacaggaaacaggtaaagagcatctctgactcaggaaattctctgactcactggaaataatgcaaaccatgtaacaatggagcaacagcattaaagtgctatccacctgaaagtatacccagtgaaaatctttttctgaaatgaaagcaaaataaagtcactttcagcaaacaaaagctgagataatttaaatacagaatagcacaacattaaatattaaaggctaaaggaaaaaattacagatggaaactctgattcaacatagaaatgagaaactccaagtgcagccaagatgaaataagcccacaaagtcctgttcatcctgttctttacaaccgaaatactctggacgaaacaacaacaacaacaacaacaagaaaaacaaaaaatgactactggggactctgaaaagtaaaatcaggaacattgaggaagagagtcaaaacctgaaaaaagcaattcatatgaaggcaagtcttctgtttttacctcttttgtctgtgaactgaatgcaggcacccagaaaatctgtggtggtagcaccatggacagctaaggggcccaaagcaatcttttctttctcacccaaaggacagggaaaggaactttatgattcagtgagtgcagaggaaaatctacatttacttgttttttccttcttatctcatgatggtgacccttcagtagagccagcatagctgctgatagaaaccctcaaatagaaaccctggtagaaaccacaactttcaggataaaggactgggaaaggggtcccttcagtccaaagggtatggagggaatccccattttgtttctctttatcatctctctactttcatctgctttatcatctctctgctgtcatctctcaagggcaaccctaaatgcaggatctgtgcagcaataatacaggtaggtaaaactctaagtttaaggagaatcctaaagagagctggagaaggaaatatgctaattcgctgacggaactggccaagggcctcagctcacctgagtggcagaggtgtggacagactcaaagcagaataacaaaggctttgagaacaaagcaaaggttcaaaccacacccaactcagaccaaacaatgtaatgtacaaaatttgcaggatacaatctcaaattactcaacataaaagaaaaaaaatgactaattcttaagaggaaagatatcatatgccaataataagatcatccagatgttggaattatcaaagacgtgaaagaagctgttatgaccatgtcccataaggtgaaagtaaacactctggaaaatgaatggaaaggtagttctcatcaagaaacagaagtcattgtcaaatatgaaacatttaaactggaaactaaaatatctaaagtaaataattatatcagaatggagataacagaggaaagagtcaatcaacttgaggataggtcaatagaaattgttcaatctacagaacaaagagaaaaatttcaaaaaaagaaattagcagcgtctcaagagcatgggagatctaacaggtgtgtaatcagagtctcaggagaggaatatattggtgcaggaaaaaaaggagaaaataataattgaaaaatcccatttgatgaaagacataaacttatagactcaagagtctcaaaaaactacaaacaggataaagtcaaataaaaccatgcagagatacatcataatcaaattctgaaaaccaaaagccaagaaaaaaatattgaaagcaattacaaaaaggaacaacaatgtaatggcagattgctcatcacaaactatgaaggacacaggaacaaaatagttaaagtgtggaaagaaaggaactgtcaatgcataattctgaacctagtaaaaatatccttcaggaactaagagaatttatcgtcaatagtcttattctaatggaaatgcaaaaaaagacctctttaggctgaagggaaataataaaataggaaatattgaaacttgaggaaaagggaagagcaaaagaaatggtatatatctggatagctataaaggactatttttctatttaaaagttatttaaaacacgcatgactggcatatatatatattttatttataatacatatataaatatacaggcttagcaagtttaagagagttgtagaagattgcaaagctaacaaaagataaagaacatcatagaattcatgtcttcgagctcctaatctagtgttctcctcaccacagaacacttactttacttatctgggcttaaaagagtcctttccatgctcaccctcatgaactcacattccaatgaaaactaaataaaagataagtaggggtcaaagaaaaatataaccaatggttcaatctatcctcatttcctttggctagtttcctgatttctttaagcctgcctagatttcccttgtcctctaacttcatacctttttcataccttcctttagctttattcttactctaaggatttctgactgcctaccactgcatgcacctgttgttagtcagaaaggtaaggtgcaagaaaaaaaaaagactcttaaataaccaagggattgggtgtatcttccccaagggagatcttctctgcccactttctggaatatgtacaccacaacacaaagcgaatctgatagaatttccctgggaaaggacccaagctcagaacagccagctgaaaaattcatcacaaaatttactgaagaaaaataagctattctgaaaaatacaattaatcaaaaagcatactgaagaatgcctccaacctcctccactacctcaccaccaggccaacactccctgcttacatcttgacctgtgtgaaagagccctggtcatcacaaggttaagaaacattggccacaccctagaccacagagcaacacaatggctgtaaagaagaaggactccttgatagctttattctcagctctctccacatgatcctagacctacaaccatcctcacccacacgccttattttttatctactcccaagtagaaatgatgttcatgtgcatcttttggaggcaatggctcagctatggttcatagaaaccaccatgtacaaaatgttctgtggttcttagcctctttttttagattgagggatcttcctgaggcagcctcccactcaagtccctgggttatacgtctccagggagtctcaaagtttaactgctcttaatgtgctcaggtccattaaccagttggtaatttacatttctctccatattctccacttggcaatgaagggtgatgctgaaaatacagaaagaacacatcttcagctaattaaaataaaagagttaccagaggccagtagcccagtgcctctagacctggacagagcactctcagttaagaaacgtctgccatctgaaaatgattccgctgtaacatctctatcttgttcttcctccatcttaactttcatattttcataaagttaagccttggtttccttctgtaggaaaaaagaactggattgcgaatatgctggtggactctttgaactgaatccaaagtcaaaaggcttacgagaggacattaattcatggggaggaagtaaataccacacttcaatcctcctttccatgcatatttctgagaaagtcgccttccatggtgaaatggtagaaactactacacttataactctcttcatttcccatacatcccacctttcatctcttaggggtaagaagctagttgaatggagaacaacagcatcacaactgctgctgccaagattgccacacatggccacacatagagattacaactccagatggcaccattcagacagactaaaatgtatatggaacccctagagttgcagagtgcacagcctgcatgaccagatgctggagtgcagctgttgctattatataaaaaaacaatagtggttcatattgatgaagcactttattttgcatcaggcattgggttaaggatttgcacacatcatctaatttaatcctcatgacaacaccttgaactattactatccccatttaggaacatttaagaactattatatccctatttttctaatgataaagctgggcctcaatgatttcaaggaatttttccaagccctggctattgcccaccaaatatttgttgcatggtcttctagcaaggatactggaaattttttcacctattgacatgtcttgctctttgtaatctgcacttggagatgattcccttagtggaaagaactctgacttgaaggaaaggggaactgtggttctagtcagtatgaaagtttccaggtgtataccattttgtgctatatgacctggaaaaatatggtctggattccagttacttcatttacaaaataaagcaaacatttgtcctgcctaccataggattaataagtaataataaatgtgaacatgctttataaattgtaaagttccaaataaccataacaggacactaataatgattataaagaaaggcaaaatttcctttacaggtcagactggaaaaatttccatgttgtgaggttgccaggcagtgatcctgagtggcagggcactgagacttctgctgatcaactctcattcttttcttctcccaccttcaggccagttcctcctgattttcagcagaccaacttccttatagatattcctttctcactctgttgcccaggctgaagtgaggtggcacaatctcagctcactgaaacctccaactcccaggttcaagcaactctcctgagtagctggaactaaggcgcatgccacaatgcctggctaatttttttatttttagtagagacagggtttcaccatgttggccaggctgatctcgaactcctgacctcaagtgatctgccctcctcggcctcccaaaatgctgggattacaggcatgagccactgcggccagcctagatacccatttttattaataatcacactctcctcccatgccttacacaaaaacccctcatggaccttctttctcttttaaaaatttttgaaatgttaaattggatgtggatgaacttcatctttcaaatggcaatatagattctcaacatttaaagggatttttaagtagccagtaggagtccaccaaatctagaactgatggcatcttctcaagacacaggtcaccttttgccctgctcagtgatgctttgtcatataccctcacccatagatgtatcttagatacacaattctctggtgattgtgcctcccaaacccctggatatacagatcgcaccccagagaaataatctatgtttaattggagggcagggaagaataaattcagtaatttcaaaatatttgtcattaacaatttcttaagtgcttctcaccaacttcaaagatgtatatgcaattcttttcttttcctctaaaaacaccaatgcccaaaggctccagggtttggatcataaaaaggttctgattccttctgccattctgcatcccagctctctgtcctgttgtagcttctcaatatgtgaaaatatagaactgattaattaggaatgctgggacttgtctgacccacatctcacctgactccccactccattggaattccattccatagtcagaggaatatcaatgtcagaaaacaaggtttccctgatatccaacccgaagtttgcttctacaagtatgatccaattacttccatgggccacgctaaataactcctctccttcactgccactctctctcttcagagatttgtagattgttaccatggctttcccttcatcgccatttagcccagccatatatatttaattcttttcatctttcattgtaaatcagtcccttcaactgttaaatcagctctctgctcttctctggactagttccaattctcccaattcacctccaataactgatatcccttctgggagctccaatttcctctccatcctcctttgctctctctgcccactccagaaatgaaatgggaagggactgacagatatgggagttcaaaggtcagatatattgcattgcatacatctctaaattgctcaggcctctccatagtacatgtaaaatccaaagtcatgtatccactttcctgggtggggagggagtgcttacagggaaataggcctcctatcccatgagtcatcatcccctagccctctgcctgggtgacagcagaaacagatctcaaaacacctgtaagccaggatacaaactggagctgtgggcaacatgccagccttgcagacagacatcttttctatgatttgggctgtcctgggagaggccagaaccattaatacagtcccagaaactgcctcttcacctcttctccatgaatgggtgaatttgggatctgcctcagacttgaaatgccgatcctatttctgaattcacagtaacccacaaggaaaaaccattagcatttcatgcattataaggcctctcagacatctttctgtcctctcagacagcccaaatcacaagcaatgcaacggttttgctttctcctaactggtgctttttcatttttactattttagtcatggtcctgctcaggtttaggaagctatctttggtctgagccaaatgggctgctccaggcccctcaccacaaaacatggaagaacaatcagctcttccctcccccacaaatagccccatcagcatcattgtgtacctccagacaagacacttgggcagacacaggaagaaaataagctgagctgtgcctactttccttctgtataattgaagagcccacatcatagaagagttaaatgccttttctataaatcagagcctatataaaaataataaacccatttctccaaacatgataaatagcaaaatcaatcccagtgtcagaacctaaccttgaattttcatagggaaaatgaacggaaccataatgatacatgttgtctgaaacacagaacatggtatagcaaggtgtatctactccatggggatgtctgcaatggagactgtatctgaatgaggctggggaggcaatgataatgtgagagaggctagtcctgcatggccagctgcctaactgcagacagcatatgtcctcagagaaaggagagaccaggctgttccaagtatgatcaccacaaggcccgaagtgcttttcaataggctggctgtctctctggaggtcatggggagctcatccagttacacttagtgtcttatttgatcctatcaataatcatttgattccaatcctgctgaaaaatgcttggccaaattttcttgccttttaatggcagaatcctggctcctactgaaatcagcattgctagatgtgtcaaatgatgcataagggcttggtccagctgccaaatgtactgggccactgagggagggcttgggatgcccacaatgcttccctacagccaatagcagagaagcccttggagcacagcctttctacataaacctccccactcagcagctccaacaccttatttaagacttgagtggagtatattctttaaatgaattaagcatgtgactcttcagagacacccactgatagcttcatgcaacctacctgtttacagttggcaggttcggggctgtagaaatgagcccttttgcctgtcaccaacatctgacaacagctgatacagactgctggattctatggtcatttgataaaaggtgatggggaagctccacagatgctcagaggcatgaaactagaagataatctgcatttccagagaagtcatttttatatccattactaaaacactgggcactaaaacagaatgttgcatgtataaaccacacaaaccacaatgacattaaagcccagctgttctttacaaaaacatcttgggtggaacaacagtatcagtcttccatctcagttcactgaaggcactatcaaactcatcagtgcctcttaggatggtctatataaattccagcactaaatgaaaagggctcactttaggtgccagtgtcactaacactaatgttgaaatgtgcatccgcactctgtttttcttgggggtcacatactagtatgtattctgtgcaatgactagggaacctcagcttctgaatatccctcctgcatgagagtactcgtgtgtgtgtgtatgtgtgtgcacaagcatgcaagatacttgtagctctacaatgggcccttttcaatggtttccatccaattaatattagacattagtagccagtggagcataagaacttcatttatttctgatgatgagaatgatagaaaagaagctgggtttgcttgatggaatttgtgtaggctttttaaaagcctgatttcttttctgtgcctttcttattcatttacattgtatattttattcacaagtcttccccagttgtcttacaagaagaacatcgattcaaaaccacctggttttccagtcaaaggatactctggaaagagttagaagtaagtgcctgcacacacacacacccccaactcagtgaatatggcaagaaatgagggagtaaatgaaacagaaaaatctcattttaggagtctccagcagggagatctgcagtgaaacaagctgccagagactatcatcaagagctgctgctgcagacgttcaagctaagaatcagaggggaaaggaggagtggggaaaggtaagaaaagcaggaaaaccaacgatggtttctccctggcttcatagtgactccccaaaggaagacaatcttgacaactttccttccttcctccacacctccctcctgtcctctgttccttagtttctctggggctttcccaacaacatgtaagagaaaggatgagtcgagagtgcatagcagactgggtgggggtgggagggggagaataaataaataaagaagagacaatccctggcaatacctgcccaagccaacgtttggaatggggacagttgggtgagattcaataatatgaagagaaattctatattccctgagaaggtaccatatttcccaaatctgtgctggccaggaacaagagggagagaagggcaatagttttgacatctactactaagcttggaacctggaagtaatcggggcatttcaactgtcccggggcccaggaagaggggcgcccaattttgtctcggacagcgtataagtccagagaagaaggcgctctgccaagagtatgaaacttttcccccaacttggttgctaaagaggaaggaagacccctgaactgcgttcagggagaaaacaagaaactacggtctgattcgggaaggaggtttgcgggaggaaggagggcgatgaagcagagctgaggttttagaaagtggggtggaagtgaagattatttaatggttgcatatcaatgtgactaaaaacactaaatcccggcacactcaggcgggagctgctcaccagtcccgaagatctggaagagaaggcggggctgggaggcgcgaattgccgcggacagccttccctctctgcccacttccgacgccttcttctcgggcatcaggcggatcctcagtcgcccttcgccttggcgaatccaccaactgaacagctcgctgagattgaactggagcagccccacagccgcctccccggggggcccgacgcaaccctccaagatcgcctcctcgcccagctccagcaccaactgcttggcacgccggagcttgcgcacggagccgcccttcagcaccctggacagcgtccgggcctctgccggggctggtgaaccggcggtccaggagacccccggcgccggccccagcaacctgagcagcggggcgcagtccagagctagcgagccgcgggcctcgggcctgccagccttcagctccgaggaggatggtggcagcagtaggtcccgggcgtagacacggaagagcgagggcaccacgaagtcaactgccagactcttcctctgcaggcgcgagtagctgagtggctcccggggctgcagcggcggccccgcagctggggagcccgcgcgctggccggtccccatcccggagcccacagctgccgtggaaagcagcagcggcaggagccacaggagcccgatggctcccatcccgccggaggaggccgtttacactgctctccgggcccagcctcacccttcgctctccccgagatgggaagaggctctgaacagtccttggtacccagcggctccttccacctgatctccagaggactgtgcgtgcgcgcaagtctcttgctttcccccaactgcacggaggcgagcaggagtctaaatgaaacagacctggaagctcaggggcgagtccagagacactcaagcacactgggctcactggctgggaccttgagcctcccgctctccgcgccgagtgccgcgcccccgtctgtagctcgctgcgctcggtacagaggaactactatggttgaagggaggtggcagttgggtaccgtcctctcctgccccccgcagtcggagctggggtctgtcccctctcggggcagcctccaatctctgcaacttttaaggctgagaacggcggctcccagctgctgcacgctgtcctggccgccttttgcgttccttttggctcctccaagctcttctgcccggtctgggcgggaaccgagggcggaggctgccgtcttgcgcaccctcaagctatctctccgctgcgggaaggcttcggactgtctgcctgctgaacttctgggcgtgaatcccagcccccgcgctgcgcaagtttgcagcgtccttgctctcaccggcgcctcggctcctcagagttcgcaggcactggagcggccccggcggcagcagctgagggcgttcagggcaggggcgcccgaaatcttgccgccccctcctcacccatcatcagcgcccgcggctttgggtggccgaccagagggcggccggaaagcacctcggtgccccgcgaccctccgaacagaggcggcgggaggtaccagctgctaccaccgctgccgcccccagagccgctggatcgcatctgcctgggcgcccgccacttgcagctggctgagccgcgcgagcgcgcgcagggagggggcggggcccggagggggcggggctcacaagccaactccgcgctgctgcccgacccacgcagtccggcctcgccccgccccacccgcaccctccaaccaatggcgtggctcgatcggctcctatgcaaatctgcagaggcctcggcattcattgagaaaaggagtgagcccgccccaccctccctctgttccctctccagtctcttgttcttcccctcctctagattccctgccctatttctctgcagtgtgaaagggagcaaatgtgagaactggaagaggcctttgcaatcaagcactctccctaattatacatttaagagattaaacgggtccgacttcggaaaaacaggttccagaataaaactggaggagaggggaagggaggggggagtgggaagggaggaggaagtggggagagggtggcagcgcgacactggcaaatctgagaacagcttgtattaaggccctgagacagaatattttctgacccatctattatttgaatgcattcctgggagcttaggagtcctgccgtccacacaggagaatttgggaataggggggcagagagggatggatggtcttggtctggcagagttgttctgcagctacaacaaatacctttcagacccctgtcagtcgctctgttttctcagaatggtgtctgaacatgtgtaacctcccctagtctctgtaaggcaaacattttaattccagatttacagatgcagaaactgagttgcagagcatttaattgtttgcccacaatcttgggaatgagggttcagaaccttaggccttttttactcacctgtaatggctgtacctctcctctccctttcctttcgtctctcctgagctgccaacacagaactcataatagctgtttttataacaagtggttcactagatcctcagacaaaactaccatctttgggtcacacaaatccccttgattccttcttaaaggctggttgtcaggccttgggctgactgttgaagctaagaataaggcaagatcctctctggagctcacggcctgtcgggtagcacaggagttttctcacaggatcagagcacagtgtcacattgaacctccctcactgagctcctgggggccgcagtaacttgcctaccaccccacaggagatagtggccaggtggaacctctgttctcctaggagctgggcctttccagctttgtggcaatgccttggcaagtggaagacccagtaacaaaggaatattgattctcggaatggctttcttcctgctctatgtttggcaactcacttaatttgacaggcatctgccctctctctggaagtcacactggatacactgactttacaagtttcagggcaaagaattatctcacccgagaagaaaatatgctcctatcttggtggaggaagggtggaaaagaaagaaaagagggaggaaaatgctatggtagttaatactttcctggtacaatatatgtttgattttcatcagatttttctgacatacctactggaagaggaatttttatttgaaatatgaaaaaagactaaaactccagcctttccctatttctctatacaattcttgaccaaaggcattactgactccagttaatttgtcagttaactgtgaatcgtctgctgcacccaatggccactagggggctgcagagacttgaaactttaaatgagctgccagggtttaacgttctctaataatacccctgtccattgcttttgcacctcatagacacaagagtctcaattaattctcatgatttatacattgtctcaaacttttcccaaggaaaaataagtgcctttccctgtagattaaatgacactaaatctcaaaaaatttcttcttttttagataatttttttttaaaggaggcaggaattaatactgatagtctaccaggcacgaatgtatgcatctgtagacatgtgggtgtctaacacatcacacagtttttttgggaaagggtatatgttattatttctattacagagataaaacagctaaggctcagaaaggcaaaataatttgcccaaggtaaaacagcaagcaaataacagagttggaattcaaaccgctgactcttttcctccaacatttacacaacccactgagaaaagttaggaccttaactcatgcccaaatttataattttaacaccccatcctacataatttccatcaaaaggatgggagacgggaaaatgaatttaagagcacataggggaaatagacagaaagatgaaaagtgtgagaatgattgctaacacatcttgtgcacttattatgatctatttcaaaaagactttcattcactatctcatttcatattcccagtaacactctgaggaaaagtaatagtatctcttttctacagatcacaaatagaagctcagggaggttaactccccgacaaagctacacaggtaactagagctgaacctggatacctgactaagaagttcatgctcttaaattctgggtgatctcccgcatgttctcactcataggtgggaattgaacaatgagaacacatggacacaggaaggggaacatcacactccggggactgttgtggggtggggggaggggggagggatagcattaggagatatacctaatgtaaatgacgagttaatgggtgcagcacaccaacatggcacatgtatacacatgtaacaaacctgcacattgtgcacatgtaccctaaaacttaaagtataataataataaaataaaataaaatttctgggtgatctcacaatagagaaaatgggatgaggtaaaatggattgagatgagccaagatcaacagaggaagaagctgaaaggccaaatcagagagatggggagtggaagtggcagacatagattctgacatagatactggaatccccaaggagacaattaggtgggctgctctgtgtcaccttgcagatgacttgggccattgggctgggggaggaggaatgtgagttgaccatgtaccaagagaggaagtggccaaagaggacactgagaccaccaacaacctcctcaggaaattcccaatttctggaaagggcaaagtgaacaactcagtcaaggaggtacataaattctctataagagaagtaataataaaaatgacatgagaaattcagcaatgtgacttaaggtaaaacatatctcacaactgcaaaatctgattgggacatataggatcaagttaggcattttgttggtcaacagatactcctcgtgtacctaatgtatacaggatgttgttctatgttccaggaattttttgctctggacaaaataaaaggtccttcaccttaagaagcttacactctaatgatgagaaacagataataaatgtgcaagcacataaagtaatttaagataataatagttgctataaaaaacaaaatagggccatgcggtagatgacttgggacagcaggtgcgggtgctgtcctagctctaccttcatagttgaagaagtcctctttaaggaggttacagttaagtcctgattggtgggaaagaggcagtcatgaaaagctttcgagaaagaacgttctaagcaaaggaatatcacaggcaatggtcctgagatgagaatagctttgcatgtccagtagacagtaagaaatcaatctggctggaacatagtgaacagaagacagaaaggtggaggggcagccaaggtctagatcttctacagttggataggccatggtaacaagtttgcattttgattgcaatgggaagacactactttagcggaaagtctcatactctgatttatgctgtagacttgcactgtttaatatggtagccattagtcatatgtggcaattgaacacatgaaatatgcctcatccaaactcaaatgggctctaagtgtaaagtacacaccacatttctaatgtttattatgaaaaaaatatataaaatccctccttagtatttttcatattgaatacatgtttaaatgataatattttgggtatatcaggttacataaaatatattattcaagttaattttactttattaaattaattttactttagttaatgtagctagtattctgggcttggtcaagagttttaacctcttggccttatctctcctgtttaaaagtggattataatctatttctgacaaagttgtcgtgacaaatatagcaaatgtgaaaattcctaagggcatgataggtacccttaccttcgctaagctaaagcaagtcaataatcatggtcaaatgtcaaaaataaagacaggatacagttgtattctggctgggggaaaccacgtgttatatgagagagacagagattgagagagagaagaggaagaagaagaagaggaagaggaagaagaaggaggaggaggaggagcagcagcagcaggagcaggagcagcagcagcaagcaggagggaggtgaggaggagaagggggataaaaaggcaagagacaaatcaataagtagacctgaaactagatatcagagtatacttattgctaaggcatttggaaacccatgaccaaaggaacttaccctgggccaagagcaagaattggcacccagaagaaacattcaaatgaaccaagacttgtgttcaggaaagtagattttcatcccagcctttcttctcagaggttctgtgactttgggaaaacctttggcttatccagactcctgtttcaaattagaagaaaggaccaagtatagtctttaagatacaagtctgaaatcctctgtgaaattcttcaagtggccaaaaggtctcattcaagaccggggaccggaggtgacaggtactagaagaagactgtgagtttccagcacaaccaggaagagagctgggccccaatgctgcagagaggaaaaaccaaaccaggatttcttttaaaatatgctctgccacatggcaagcctgagctctgaatctgtagcctgacactgctgaccagtcacatacaagatatcttgtaaggatcgacatgctaagaggagggtagttaaagtcattaaatattaatttaagcacctaccatatgctttgctgtatgtgatgtgccatggagagagaccatggtgaataagacagtctaagttccacttttacactgttggtgggagtgtaaattagttcaaccattgtggaagatagtgtggcaattcctcaaggatctagaactagaaataccatttcacccagccattccattactgggtatatacccaaaggattataaatcatgctgctataaagacatatgcacacgtatgtttcttgcagcactattcacaacagcaaagacttggaaccaactcaaatgtccatcaatgacagactgcattaagacaatgtggcacatatacactatggaatactatgcagccataaaaaatgatgagttcatgtcctttgcagggacatggatgaagctggaaaccatcattctcagcaaactatcacaaggacagaaaaccaaatgctgtacgttctcactcataggtgggaattgaacaatgagaacacttggacacagggcagggaacatcacatacaggggcctgttgggggatgggggatgggggagggatagcattaggagaaatacctaaagtaaatgacgagttaatgggtgcagcacaccaacatggcacatgtatacccatgtaacaaacctgcacgttgtgcacatgtaccagagaacttaaatttacaatttaaacttataatttaaaaatatatattaaaaaaacaatctaggttcctactaccatggggcattgataaaattaaatgaaaaatacccagagtatgaaatagaattcacacctatgctacaactcagcaaaaattaaaaacacaaaaaaaacaaaaactggaggaaatcattgaaaaatagatttatttggatggcagaattatgagtgacttttttccttctccttttttttaacaaatgacttttaatagttttgtagataacatagtaatagaatttgctccccataaagaaagcgtattagggtagctaggttatgatgtaataacaaccaacccctgcccctccaaatctaagtaaattaaaaacaatatattgaaatatattcttctcataatccatgtccatttcaggtgagcagagggctctgatcatcatagtcacttagagatccaggctgagggagcacccactcttgtaaacttggaggatcttgcacccacaagtaaatcctccagcctggaaatggcacatgtcgcttccattcacaactctggctgggaagatttacatcgtcccaccctatcatgagagggcctgcaaggtggagagtcagaaatatctagcaaatgggcttaccaactcccaaagaagggggagacctgcaagcattgcattagatgacttagactaggaagggtccacaagactagagttacccagagaaaaaaatgacctcaactccccagggatccacagtccaggtggggagtccaaccgtcatcagagagcacaatctctcctcgatatgcttcagtctgtgaatatatcatcgtggaaacaatgagagttatctggcagctggataagaggtggcatagacacaagaaaagcctttcccaaagagtgacagctctctcctaaaaactagaaacaacctcacatctacagaagaggggagaaacagcaagagagatagaagcacattgtgtccaacactgaacatttcacagcaatccctgttcttgccaaagcacagtacatcagggaagaggggtgggagctattactgtaacgaacaagtgttggtcttatcacctgctgctattctaatacgctcttgcctttttaaatatccttttgagctgaggaagacaaagaaaccctttttgggtaatttggttatcgacacagccttcttgaaaagccttttaaagggctccaaacccacgtgcagtgtcctttccatgtagttctctctgccttgcagtcagaattgtggtctgtgacttttagtggcatcatggagaagcctttggtgtcttagagcttagacatgtctgtgaggtgggtcagatcaactgtaggcaagtcaatctctgagctatagattacatccaattgacctgctgcagttgtcaactggacaaataatggtcaaataaaagacagctcccactggccagtctaatctgatctatcagctctcatgtgcattgtcatgcctgggcctccgtccttgccttcctttcttatccagaccctaggatggcagaatgcctttgactgagccccatccccattcagagatcaatcttggttctatctaggaggaattaagaccacgcagctcaacatcaactccctctcatattaattcccctctcacttcgaatcccatttctaataaattgagtgaatcctattttgtcctgcctctatgaccaagccacactctgtccctaatttcttaaaagactgtttcttaaccttgttcttataggaccctcccccaggcactgcccttcctctgaggtctgctaccccctaactggcttccatgatgccagtaccttgctggcccagctgtgtgcacaccaggtcctagacctctctttgggaaataaactagttacctacctctcatccattttccctttcttgtgattaagcctacggccaaggggggcattattaattaccatgggacctcagtcatagccatagctgattagatcagaggtgaacacctgactccagggaagctaagccccaggccaggttgagccaatcagcttttctctccaaaatttgaactaggaagcccagactgtgtggagctgacatttgagtcatgttaatagtggagcacctaaatgcctgaggactggtggtttccatcagatctgtgatcttataatgaacacctcaccttgagaaaatttgggatggactttgctcctggcaaataaaactaagataagctgggacttgccctttccctcttcactggtccctgttggcactgactccctgcataggccccacctaaacacttttctcaaagtctcatgggtatctgacccccagcacctgtctaccctggtatccaggactggccttgttcatcccattgtgacagaaccccagagtcctctgctgtcaccccttgctgattgtgaactgagtacccaagtggatttaaccagcactaggaaaacataggtccatcatgaccatattttcagagccaccaatctggatatgcagtcaggtgggacttctgtatagagcatatttccacatatgaggcaatttgggagaagtagcttggatgctacgatgtcaatattttgcagatattttgaagcattttggaaaataaagttacatcaaggctgatccaatgcatccaggatacaaggttgtaacaccaccagccaatatctgcacccctagctggtgggacaacagtcctgtaaacagggagtgaaatcagtgtcagaagggaaaagcctcctctgtgtctacttcccctttccaagtcccaaaccctgtctcatggctcctgatggcttagcagccagtatggcccagatagccagtcctcatcctgtaaaacagaccctcgactctcccaccagtccaagatgtctggccctgtggtaatagccgagctctggagtcttgctcattactttgagaagcatatgtccactgatgttaaccagcctcgaaaacagtcccaccttctcatatttgcacacttgtccattgccttcccacagtgactagggctaaccagtgtcaccaataggatatgcagaaatgagagtatgatttctgagtttggtcataaaagacactttggctctcttggatcacttgctctgagggaagccagttgccatgttgtaaggatatttaagaagccctgtggagatgtccatgtggcaaggaacaaaggactcctgccaagagtcagctgtaacttgccaggcatgtgaataagccatcttggaagtagatgctccagccccaggcaagccttcagatgcctggagcctcagccaataccctgactataaccttgtaagagaccctgaacgagaatcacctgcttaggtcaggtttttgactcacataacctgtgagataataaatatttattgtatttttggtggctaagttctggattaatttgttttgcagtaatagataacagacataccacttcttcctgttcaccaggtacctctgtctttccacctgtgtccccagccaggctgtgccattgcaggtcaatctgccacagctggtgccacatatacccaaatgtccaccaagacaggactcatcaccacaggctatagccagagacaggaaaccccctcaaaaatatttcattgttcccttaacacctacagctgaagctacacagcccttcatattcctgggaaggaatcctttaattttttttcttttatagaattttctttctgattataaaagtgatacatattaattgtgggaaatttggaaaattcagaactgtgtttaaaagaaagtttcaataacccacattcttaccacctaaaaggaatgactcaaaattttgttatagttccttctggtattgttttaaaccagaatcatttggttgatgcaaagtcatatcctgtgctattttttaacttaacattatattataagcattttcccatatcacagaacattctagggatttatggtttttaatgactgcatagaattacaatgtatagatataccataatttgtttaaccaatctctatttttggacatgtaggttgtttccaagtctttgctgttacaaataatgctgcaacaaatattcatgtacatta

SEQ ID NO: 1027 - DNA, 34649 bp, Homo sapiens
ttcttttagctgagcttcttccagatagaatgaaaaatacaaaatactctggctggtcttccagctgggtcctgaaaggagagtccgagggttgggtgttgtgtccctgaagactagtctagcagtgggggcttgaaggggggtgccaggatgggcctcccaatctctttacggaaatgttagaggccgggtgtggtggctcacgcctgtaatcccagcactttgggaggctgaggcaggtggatcacttgaggtgaggagttcaagaccagcctggccaacatggtgaaatcccgtctctactaaaaatacaaaaattagctgggcatggttttgcatgcctgtactcccagctactcagaaggctgaggcagaagaaccgcttgagcctgggaggcggaggttgcggtgagccgagatcgcaccactgcactccagtgtgggtgacacagtgagaccctgtctcaaaaaaaaaaaaattaaaaaaaggaaatgtcgagtagagccagctccagaataagtgaatggaagacgttcaggtgcatgcgttcaggcggtaaattcatgatcaccaattttcacctagtgtctcagccatgccaagcattcctatcccagcccctcattcagctctctctcttatgccctcagagtctattcaaactttctccactctccttctatctctgaaatgcccctacaacttccttgaccctcagaagccagatccttgccaagcacttcacaaagaaaatgcaattcatcaaatgggatatttccccacacgtcattttcaagttgatttgctgccaattccatttgttttgctttgtttcctattacgaaggaagaattgtctctcttacttcaggccatgttcctctacttttttccatcattgcccccttatggagcctttatgacttttttttttttttttttttttgcgaaagagtttcactcttgttacctgggctggagtgcaatggcacaatctcagctcactgcaacctccgcctcccaggttcaagtgattctcctgcctcagcctcccaagtagctgggattacaggcatgcaccaccacgcccgactaattttgtatttttagtagagacgggggtttctccatgttggccaggctggtctcaaacacccaacctcaggtgatccgcccgcctcagcctcccaaagtgctgagaattacaggtgtgagccaccatgcctggccctaaggcattttttcctaattgctccccgctcctgctaccttgtgaaattttaaccccttaatatatgtttgtgtactctgaccctttcgagggccacgaatcattgcaatatctaagatgtggttgcccactctgagaatgcacgatctgtctacggctatagcaccctgaacacatccaatctcatcggatctcagaagctaagcagggccaggcctggttagtacttggatgggaaaatgcagatgtaaggccagttcctccacgcattctccagattttatctcctccctcgggatcttcccctcatcacttacacccaaggcctccagcatcttaacctgtccctctcactagctctactgactacccatctccagctctggccttctgtttgttaccttcacagccctatttctcaaaaggcatgctacactccaaaatgcactctgcctccatctctccactgactctattctctgtaatatcacaaacacactctgtgtgcccacacacacatactctttcacccagcattccctcataagagcacattagcagcccttgcctaggacgtagcaatactgaatgatgtgtttcaccagaactgtttataatcagccaaagcctttttcccaactttactgaggtatgactgacaaataaaagttggctattttagggtgtatgacgtgatgtttactatatgcctacaatttgaaatgattgccacaatcaagctaattcatatattcatcacctcacatagttaccttttttccattgtgctgagaacacttcagcacatttccagtataccatacattattattaactatagtcaatgctatggtttggatatggtttttttttgtttgtccccatcaaatgtcatgttgaaatttaatccccaactggtagcggtggctcatgcctgtaatcccagtactttgggaggccaaggtgggcaggttgcttgagtcaaggcattagagaccagcctcggcaacatggtgagaccctgtctctacaaaaaaaaaaaattagccaggcatggtggcacacacctgtagtcccagctactagagaggctgaggtgggaggatcgcttgagcccagggaagtctaggctgcagcgacctgagactgcaccactgcactccagcctgggcaacagagtgagaccctatctcaaaaaaaaaaaaaaaaaaaaaagaggaaatgtaatccccagtgtagcagtattgggaggtagggcctagtgagaggtgtttgggtcatggggctggacccctcatgagtggcttggtgtgcttctcacagtagtgagttctcactctcatgagcctggattgattctcggggaaatgaattcattcccatgagtgtgtgttgttataaagccagggtgccccttgggtttggatcctcttcgcaggtgctcatttcccctttgaccttttccaccatgttttaactcatcacaaaagccttcactggccaggcgcagtggctcatgcctgtaatcccagcactttgggaggccaaggtgggcggatcacgaggtgaagagatcgagaccaccctggccaatatggtgaaacatggtatctactaaaaatacaaaaattagctgggcgtagtggcgctcgcctgtagtccacctacttgggaggctgaggcaggagaatcgcttgaacccaggaggtgaaggttgccgagagccaagatggcaccactgcactccagcctggtgacagagcaagactccatctcaaaaaaaaaaaaagaaagtgagatagccttattactgatatggagaaagttttagtggtccggatagaagattaaaccatccacaacattcccttaaaccaagcctaatccagaacaaggctcgaactttcttcaaatctgttaagggtgagagagataaggaagctgcaggaagctagcagagttggctcatgaggtttaaggaaagtagccatctccataacataagagtgcaaggtgaagcagcaagtgctgatggagaagctgcagcaagttatccagaagatccagctaagatcactgaagaaggtggcaacactaaacaacggattttcattgtagtttaaagtcttatattggaggaagataccatctaggactttcatagctggagaggagaagtcaatacctgccttcaaaacttcaaaggaaggctggacgcagtggctcacacctgtaatcccagcactttgggaggctgaggcaggtggatcacaaggtcaagagttcgagatcagcctggccaacatggtgaaaccccatctctactaaaaatacaaaaattagccaggcatggtggcacatgcctgtagtcccagctgctcggggggctgaggcaggagaatcacttgaacctgggaggcggaggttgcagtcagccaaaatcgtgccactgcactccagcctgggtgacaaagcgagactctgtctcaaaaacaacacaaaaaaaaacttcagagggcaagctgactctcatgagaagctaatgcagctggtgactttaagctgaagccagtgcccatttatcattctgaaaagcctagggcccttgagaacttggctaaatctactctgcctgtgtctttacatggaacaacaaagcctggatgacacatctgcttacatcatgatttactaaatattttaaacccactgttcatacctactgctcacaaaaacattcctttcaaaaatgactgttcatggagaatgcacctggtcacccaagagctctgatggagatgtacagggagattaatgctgttttcgtgactgctaacacatcattcattctgcagcccaaggatcaggagtaattttgacctgtcactgtaattattttaaaaaacagggccgaggcaggtgtatcacctgaggtcaggagttagagaccagcctggccatcatggtgaaaccccgtctctactaaaaatacaaaacttagctgggcgtgatggcaggtgcctgtaatcccagctactggggaggctgaggcaggagaatcacttgaccccaggaggaggaggttgcagtgagccgagatcacaccattgcactccagcctgagcaacagagcaagactctgtctaaataaataaataaataaataaaaataaacaggggcccagacatggtggctcattcctgtaatcccagtgctttaggaggtcaaggcaggaggatcacttgagcccaggtattcaaaacaagctgaataacataataacatagtgcaacctcatctctctacaaaaaatttaaaaattagccaatgcagtggtgtgcacctgcagtcctagctactcacaaggctgagccaggaggcccactcgaaccaaggagctcagggttgcagtgagctatgatcacaccactgtactctagcctgggcaacagagactctggctctaaaatttaaaataataataataataaagtaacaaagaaacaaatacatttcataaggctatatagctgccatagatagatctgggcaaaatgaactgaaaaccttctagaaaggagtcaccatttagatgccattaagaaaattcatgattgaggccaggcactgtggctcatgcctgtaatcctagcactttgggaggctgaggcaggcggatcacctgaggtcaggagttcgagaccagcttggccaacatggtgaaaccccgtctttttttttcctgagacagagtctcactgagtggcccagtctggagtgtagtggcatgatctcggctcactgcaacttccactcccaggttaaagcaattctcctgcctcagcctcccaagtagctgggattacaggcacccaccaccacacccagctaatttttgtattttttagtagagacagggtttcaccacgttggcctggctggtcttgaactcctgatctcacatgatccacctgcgtcagcctcccaaagtgctgggattacaggtgtgagccaccgcacctggcctgaaacccatctctactaaaaatacaaaaattagccaggcgtggtggcgggcacctgtaatcccaactactcgggaggctgaggcaggagaatcgcttgaacccaggaggtggaggttgcggtgagcagagattgtgccactgtactccagcctgggcaacaagagcaagactcagtctcagaaaaaagaaaaagaaaaaagaaaattcatgattcaatggaggaagccaaaatatcaacataacaggagtttggaagaagttgattccaacccttatggatgactacaaggggttcaagacttcttggaggaactaactgcagatgtagtagaaattgaaagagaactagaattagaagtggagcctgggacgggcacggtggctcacgcctgtaatcccagtactttgggaggccgaggagggcagattacctgaggtcaggagttcgagaccagcctgcccaacaagacaaaaccccatctctactaaaagtataaaaattagccaggcatggtggcgggtgcctgtaatcccagctactcaggaggctgaggcaggagaatcacttgaacctgggaggtagagattgcagtgagccaagatcatgattctatctcaaaaaaaaaaaacacacacagaaggtaaattgttctgcaaagagaggtaatgggaatgtgggagttggcttggctactggcacagacagcagggaatcgggagtttgaaagaagatttacatttggcatacacgtgtgcccacgtggcctttcctactgcaaagggtgctgacaaaatcaagcccctgatccttcctgtggcatacataagaacaaaatggtagttgttagggacaaatcaaaatttaaaaataaaatggccaggtgcagtggctcacccctgtaatcccagcactttgggagggaggccaaggccagcggatcacttgagcccaagagtttgagaccagcttgggcaacatggcaaaaccccatctctacaaaaaatacaaaaattagtcgggcatgttggcacgggcctgtagtcccagctactggggaggctgaggcagtataatcaatcacctgaacctgggagatcaaggctgcagtgagccgtgatggcgcctttgcactccagtctgggtgacagagtgagaccctgtctaaaaacaaaacaaaacaaaaggctgctagtcagtttgggctactataacaaaacactggccaggcgcggtggctcacgcctgtaatctcagaactttgggaggccaaggggggcgggaatcacctgaggtcaggagttcgagaccagcctggccaacatggtaaaaccccatctctaccaaaaatacaaaaattagccaggcatggtggtgcgtgcctgtaatcccagctactcaggagactgagacaggagaatcgcttgaacctaggatgtggagattgcagtgagccaaggtagcgccattgcactcccgtctaggcaacagagcaagactctatctcaaaaaaaaaaaaaattaaaggcttagttctccatgttgaaagtaagggaagagacttctccaccctctcttttcttagaaaatttgctttagaaaacttgtaaaattttttttttttttttgagacaaagtctcactcttgttgcccaggctggagtacagtggcacaatctcagctcaccgcaacctccgcctcccgggttcaagcaattctcctgcctcagcctcccaagtaggtgggattacaggcatcctctaccacgcctggctaattttttgtatttttagtagagatggggtttccccatgttggccagactggtctcaaactcctgacctcaggtgatccacccacctcagcctcccaaagtgcggggattacaggcgtgagccaccgcacccagccagaaaacttgtaagttattttctgtgtcttcaaaacgtgtataaatatttttagaagccacacagcctcttgccagctttactacccagggatgtctttcacaaagacccaggagccatctccttgaaatgtaaacaccaagaaagatggagccttcatttcccagtttctgtgggagggtaggactaacttaaatggacactttgcttgagctgcaaaactatctgctgtcataaaaatctgaaaagctggctgggcatggtggctcacgcctgtaatcccagcactttgggaagccgaggtgggtggatcatctgaggtcaggagtttaagaccagcctggccaacatggcaaaacctcgtctctactaaaaatacaaaaactagccaggcttggtggtgcacacctgtaatcccagctactcaggaagctgaggcaagagaatcgcttgaacctgggaggtggaggttgcagtgagccgagatcacgccactgcactctagcctgggcaacagagcaagactctatctcaaaaaaaaaagagaagtttttcttctgattaagccagttagctaacatagatggtcatcacaattgccaggtgtctctagactgcactatatgtgacaaatggtgctatcgagtcctcctaaagattatttatagtttatcttgagaacacatatgtaatgggctgtatctgcttggctagataaaagtgagacttccttctgtctttgcagtctcttagcaaactgcctgtgatgtgctcacattctggtttaatgcttattcaataataaaactgttttctttcttcactactttcgtggagaggttttttctgggttgggagaaaattttgcttctaattatattctcccaacatagcgcatgtgcttaaaagggaaacaaaagcaggagggggaagggtctagagtgataagagctctagtgagaggctaggcctagagagggacatggagaaatagcatgcggagaggaacggtagaggagcaacgctaacattcagttgtaaataatacaatcatagcagctaatacatagagggactacacgccaagcactgttctcactgtttagccatattcactcatttagcatgcgcagtagcttgaatccggtttttcaattattcattccctctctctgcacgtggccgtagagtacactagagtgggcagaaaataagtcacaaaacagcaaagaaacagtgcttttggaagtaggtatgagacaaactcttttctaggcaaaagtaacccacgaaaatgtgtgtggaaaggccagatcctactattaggcaggatgggaatttgagccattttatttggatattacagaatggggtgaccccagaaaactggaagaactggggaccagcaaatggccgacctgcagtcctgagcagaggatgtaggccagagtggacctagaagataagaaagggaattgaatccagtaagggacagacactttatttttttatttttatttatttatttatttatttttgagatagagtctgatctggaggctggaaggcggggctaaaactcccactcacttacctctaccaacaactaggccaccaagtcatttctgaggactggctcaagaaagcagatttaacttacactggcctagcccaggccaccagatgcatccacggagatccaaatgcatataatcacttgaatcaagatctagacagggacgcgtgcagcaggcttcatctgactgattcctgacacgggagagaaagcctaagctccgaatcatccttcaatgtttacaaaggccctaaatagcagtgggctaattgctgttcctggatttccaggagacctgagacccatgaaggagcaggaaagagcttggggataaaaaattaatctggaacctactggagcggaaggggctgcactcacctggaaaagacaaagttcttgggaactggccacgtaggccaggtccctaagcaattccatcccgcaccctaacaccccgactggtgttcctgggtccctaacattgtctgtacccgcttcggaggttggacaaaatgagtttttcactgccctgcctcaggcctctctcaaaggtctggcccatgatatttggtgtacattgggaccccagcgcccagatatttgaaacggggtggggagcgggtgttgagctgctacatttccaggttctaggtaccctggggaacccctggtcgttgacggaagcacagcgttcaagggcggcagagctcaggtactggaggacacatgggccgcgccgggtctagccgcgggacatccccagaccccagcacggcctcccaggccgaccttccagaagccggcccactgccttccccgggtcccagcccagaaaagcggagaccttcccctccgtttggaagatggactcatcccctacttcctcctggctccccagaagacctggagacctcgggaagtgttctcatctatgttcgctccaacccgggggctcaggcccacctcgatcccgccttcccgggaggtccaggaaggtcccgccgcacccaccccgttggcctcaccctggctcgggcccctttatcatcctgcagctacgctccgaccaggaggcacagccagtccccacagccggctctaccgctctgctcgcaggtttgggctagtctggggcggggacttgggagcgcctaaaacttgcgaggagggcggggccgcagaccggtcctttaaaggttggaagtggccccgaggcgccggcagccctgggcggtcccgggaatcgcacaggacccggctcccctcgcctaagctgctggggggcgccatgggccgctaccgcatccgcgtggccaccggggcctggctcttctccgggtcgtacaaccgcgtgcagctttggctggtcgggacgcgcggggaggcggagctggagctgcagctgcggcccgcgcggggcgaggtcagcgcggggagcgaggggagctagggcagcggggaccccgggcccaggcccgggccgagctgggctcgcggcgggagggcgggaggctgggggcgaggtgacagcgcgacctcgcggactgggacttccacgaagctgggacgaggtgggcaagattagggacagggtccgcagctgggatcccgggctgggctcaaccccatctccctttcccgcccctggtcccggcagcccccagctccttctcccagtgacccagagccaatgtaagtatgaggccagaggtcagacgtgaagctcctccaagaaccggcgcggggagagctcagttaatgggacccacgtgggcgatgctgctccagcatcagctccaggcgctgcgggccctcgtcctccacccgactccgggcgtctgagacccaaagagcaggttgtgcgggggcgggaacgaggcgatgctgtctttggaggccctgagaaactgaggttgcacaggagcgcggctctgtcctcgaaacggcctcagtcgggtccctcctactaagtctggcctgggtccggcctgcacaggaggaggagtttgatcatgacgttgcagaggacttggggctcctgcagttcgtgaggctgcgcaagcaccactggctggtggacgacgcgtggttctgcgaccgcatcacggtgcagggccctggagcctgcgcggaggtggccttcccgtgctaccgctgggtgcagggcgaggacatcctgagcctgcccgagggcaccggtgagcaggcggcgtcggggaaggaggcacaaggtctcgggaactgctgcggggctaggagggcagagttaaggacggtcggagcagacttagaggatgtatgggcccagggcaggtgaaatgtagggatcccagggtgctggacagaaaacgggaaggagttatgaattcccaaagttttacacaggctaagagaggctgcgtgtgaggctggaggcagggagtaagtgatctggagatcccatcttccaagaaggcaaagacagaaagtgggagttgcagcgatccaggaaaacagagaagcaaagtgaaagtaggaaggagatgtaaaggtgactcagaagtcaggtgaggggaccacatggaacaggagggggtgggtgacccgtgagagcagacagctaagggaagaaaacataggatgctggagagctggtttggttggaataacacggaagacacccgtgaaagacaagaagcacactggcccgcaggagacgaggaggaatgaggatggcaaatagtgaattttttttttttttttttttgagatggagtcttgctttgttgcccaggctggagtgcagtggtgcgatcttggctcactgcaacctccacctcctgggttcacgccattctcctgcctcagcctcccgagtagctgggactacaggcaccccccaccacacccggctaattttttatattttttttagtagagatggagtttcaccgtattagccaggatggtctcgatctcctgacctcgtgatccgccctccttggcctctcaaagtgctgggattacaggcttgagccaccacgcccggcccaaatagtgaatttttaaccatgggtaatgagtaaaagagagatgaatccagagatgagtgagggcagtagggatggaacatcaaatctatgactttgagacaggtgagtgtaaatgcagaaaagacccagaataagtccatagatacagattatgatagtaaatccagaaagatgaggtttaaaaaaaaaaaagcaaatgtagaatcttttgaggacaggtgaaggcgtggcaggtgaggtttaagatgtgaaattaatcaaagcaatctgtagtagacagtaggtgtaggtgtataggtgactaagatttcatcaccttaattaaggtgatttttttccaaccatagatattgatgaagtaaggccaggtaggggaagatgagtgaaggagcaagaaatggtggcaaacaggaggtttttatctacaggcaaaggatgagggctgaaataagagaaagcaggagtgcaaagttggcaaagatgggataaacgtgtctggtggataatcaaatgaggcaaagccagagataaaagcaacagtgcatggctgaaaacatggaatacggctaaccacagggagatgaggacaagaggcgggcataggaccagacagagccgtgaggccaattgtcttgatgtctccccagcccgcctgccaggagacaatgctttggacatgttccagaagcatcgagagaaggaactgaaagacagacagcagatctactggtgaccacccaccccttaaactaaccccgccaccactgtcccaccccttccctgcccctgcccctgcccctggccccatcactgaccatgacatccttcctgaagctttgtccccaactcctagctgggccacctggaaggaagggttacccctgaccatcgctgcagaccgtaaggatgatctacctccaaatatgagattccatgaggagaagaggctggactttgaatggacactgaaggcagggtgagaaaaaggctagacctcggagtgaaataagggctgggagggccaagaatgatgatagacggtgagggactgagggatcagctgatgagttaagcctcaatacctgtcctagggctctggagatggccctcaaacgtgtttacaccctcctgagctcctggaactgcctagaagactttgatcagatcttctggggccagaagagtgccctggctggtcagtggttccccgaggtctccataatcccttaatggcccctctggatgactcatcacactccacagtcccccgtaactctttgcaagaagagaccttatcatatctggtcaactcagagaggccttgagaatgaaaacgcagaagctgggttcagggagggttatatacctgaacccctggggtagattttggagaagggatatgcaggctgtggtacatatatcctcctttcaccgcccaccaaagagaaggttcgccagtgctggcaggatgatgagttgttcagctaccagttcctcaatggtgccaaccccatgctgttgagacgctcgacctctctgccctccaggctagtgctgccctcggggatggaagagcttcaggctcaactggagaaagaacttcaggtacctctccttcccctgcctggcactgttctctccttagtagtgtggtgagaacggacagagagaatccaaactgagtcagaggaaggctgcagtactgcattgccccttggtgcagtcctgtgctggaaaaatacagaaataaaatatgtaggggaagaaactatgaggagctcccagcaggaaggggaaaatagaatggatccccagcacacagagaggggctggagatgttagcaggaacagtgacattgcctggccgcagtgttctggactccagtgttcatgggcagggagaaaagtgaggaagtgccatcaggtggggagaatcggggaggctttctagaaaaagagagcggggtttggaagcaatggactgtactgaggacaagcctaggcaaaatgtgtgcgtatgcatgtgtgtgctgtatgcggtggcaggggtagtaggggaagctctctggaatatttggcagaggatgtgagatttgaatagggaatgaaagagcatttgctgagctgataggagccaaaaccagagcgcagaccattcgggaatgatcagaaaggggcctggccatttgacaggtggtcagtttacaatgcctgtgatgccaactggattgagcaggcctggttccaaacccagatctgccaccacatccacacacaagacatctaccctcaccagactgtttcttcactttaagatgagaggaactggaccaggggctctagttctcccaacagggctccggtactgatgcaggagaatggcaagaagctagactaaatctcttgccctttgccccggccccctgggggtagactttgaactctaaaaatggatacatccctcctgtccccagaatggttccctgtttgaagctgacttcatccttctggatggaattccagccaacgtgatccgaggagagaagcaatacctggctgcccccctcgttatgctgaagatggagcccaatgggaagctgcagcccatggtcatccaggtaagggccccagacctctcccacaacgttgcactctgttcacctcaacctctgctcccagggacccaacccccagctcttggctcccaaaccccatcctcactcagtgagacttgtcttcatgtcactatttgcctgtaccctcgtctcccctgcctcatccaactagaattactttttcaagagtcaaaatggcctcctggagttctcatcctgtatccaatggtcctcacacttcagtgtgcatcagaatcacctgaatgcctgttgaaatgcagatttctggatcccatgaccagactttctgattcagtatgtctggggtgggaactaagagtttgcgtttttataagttccaaagtgatgctgacactaccagttcaggactacactttcagaatcactatctcatctctcagtggcctctggctctgaaccctcgccatctcttgaatatcttttctcgcaatttcttttttttttttgagacagaatctcactgtgtcactcaggctggaatacagttgtgtgatcttggctcactgcaacctgcgcctcctgggttcaagcaattctcccacctcagtccctccagtagctgggaccacaggcatgtgccaccatgtgggcctggctaatttttgtattttttgtagagatggggtttcgccatattgcccaggctggtcttgaacttctgggctcaagtaatctgcctgcctcggcctcccaaagtgctgggattacaggtgtgagccactgcacctggccttctctcactattcttaacagtcaggtgacaagaactgtcaataatcttacacctcctacttctccttcacattccaccaccatctgagcgccgaccccaaagcagcaggtttctcccacaccactgttagggcctccttctggacccccttcttccagtccctcctgccttccacctgacatcagggcactccagctagcgagcggcaggctgggagggttcacagtcctcctgctagactataacctcctagaaggcaataatcttacttagtcatctctgtttccccaagaatgctgactataatgtcatatacggaatgggagttcaataatttctctttctcccagattcagcctcccaaccccagctctccaaccccaacactgttcctgccctcagaccccccacttgcctggctcctggcaaagtcctgggtccgaaattcagatttccaactgcacgagatccagtatcacttgctgaacactcacctggtggctgaggtcatcgctgtcgccaccatgcggtgcctcccaggactgcaccccatcttcaaggtacttattaatctattaaatcacatatccctcagaccccagagagaggaacagccccatatcaaaagatattgcagcagcaaaaactctttgtagcaatttgtgagtgaagaggagactgtctcaatatcttgagatgttgattttaattaagtttattaagtttagtcacttaacattatataggaatcctctgaaattctcagagatctgacagtctagcagtgcgctcacagtagggcttgaacactgctagtaaaacaaaagccatattcctaccttagatctagtatttagccagaaaaacaagtgatgcccataagaaccaaccagagaacagtatctggtactagagtttgaaatcacaagggacagcctataacagtatagtattgatgaagaatgtttctacccaattgaggagtcagctaagtagaaacagaccaaaaggcaaggaagaacagccagcaagccgctcatacctgcccaacagtaaggtggatagagatgtatgttagcatggtaatgacaggaatgaaaaggaaagaatctaaaacgtagtgaagggaggaaatggtagctgcagcgtgcctgggtgcaagagagagaaaagccagaagtccaagcttctgccacacctgtaagtccctggggcaggtgtgttatactgacctagaaatactgtggttttaagagctgggtgtggtggttcacgcctgtaatcccagtgctttgggtggccaaagcagtatgattgcttaagaccaggagttcaagaccagcctgggcaacacagcaagtcccggtctctaaataaaaagaaagaaagaaagaaatactgtaattttataaaacagtgagttccatatatattgctgggagaaggcaaaataagacctgtgcttgcttaagaaaatgttcttaaaatcttgatgatactttatatacagggaacttggcagagggagcacaaaaatgatacaagcttacaaaccagagtaattgtcagaaacagtaaagttagaagaaaccagagtcagcaaaaatgaggtgtttggttttaggtacatggagtttgatgtattggcaagatatgcaagtatgtcctgggtaaaaacaaccaaattgtgtttcagctgggggcctccaccaagaccccccaagcctggccagtatagctgtgccgcctctggaattttccccttcggtaacatagacaagatggagaccagtctgatgaatggaatcttggatttcattcatctcatgctgtctcctgcttccccatcctctgctccacacgaacaagtgaagcctctattcacacttacaattccgtttcctagttcagtcctctccgtgtctccactcaccacagtaatgccatgccccagcggacagctgagttgctggcagatgcacacaagggtcaagcctgcacatgtcttaacagtggcctatgcaggctctgactttggattgctggggtcttagtcctgaaccccggcctcaataatttccagatgtcctcacatgttccatcgtgaggttattaaaggttaaaatgacttaatggtgtgacacaagctaaatgctacaaaaaacattagttcttgcaaatttttttttttcagagacaagttctcactctgtcacccaggctggagtccagtggcgtaatcataactcactgcagcttcaaactcctgggctgaagcgatcctctaacctcagccttcagagtagctgggactacaggtgtgcaccaccatgcctggctaattttttttattttttgtagagacagggtttcactatgtggcccaagctagtctcaaattcctgggctcaagcgatcctcctgcctcagtctcccaagtaacctggattgcaggcacatgccgccacacccagctagttcttgcaattattattattaaggactgtttatccttaggcatcctttctcctcatgtggactttggcctttccgtgacatttggcatctttcatgaatcttctgaaaagcttcaggttaatgtgagctgctttggtatcttaacaccaaaggtgtcattggggtcattgccagtgtccagcatcaacaattcagacaagcaccaaaactgcttgaaacctgcatgttaactatgtggaaaggaagacaaacagtctaagataaaaagaaacgcatgtaaggaccatgccttttttaatagctaaggaaaatattttaatatttttaatttaataaattttaatttattaaaattaaaattttaatttaatattaaattaaaattttaattttaattttaaataaataattaaaatttaaataaatttaaatttaaaatttaaatttaattttaaataaacatttaaatttttaattttaatattaaattaatttaatttaatattaatttaacttaatttaatttaatattaatttaacttaatttaattaatttaatattaaattaaattttaatatttttaattttaatattaatttaatattaaattaaattttaatatttttaattttaatattaatttaatttaatttaatttaatattaattaatttaattttaattttaattgcttcaatattaaattaaattttaatatttttattttaatattaaattaaaattttaatttaaaattaaatatttaatattaaattaatttaaatttaatattaaattttaatagctaaggaaaatattttaatattaaaaaaagaccatggccttttttcaatagctaaggaaaagcaggagaagaggggcccaacagtgcttaagtaggggtggagaaagatttgcttaaacaggtagctgaatatagctcttctagttctgacagaaagtattctccccatccatcccctaaagaaacccccaactgtgaaacaactaaaagatggagatgcagctttgatcataagcagagaggctagtttaagaggatgtgaatgacagaggaggtagcaaagaaaatcagaaagggctgattcataaggcacctatactcaaggtagaaacaatgaagcagacagctactattccaggactcttatgtgtaatagacactctccaacatcacttaggtgagcatcaccacagcccctgagataagagagtctattgctgccccctgttgacaaatgaagagattgcagattaaaaggttattaacttggccaagtctcaaatgaggagtaaagtgtaggttaaaatcctggtcagtctggctccagggcccaactcacagggaagttggagagcacaagagtgagtgatcagaacagcaggagatcagcctgtaaaggaaagcatcaagaggagaaggcgccatgctgggtgccaggccctaccaggaaggacccaagcatggcctccaccagtcacgccctccaatctcctcctctccagttcctgatcccccatatccgctacaccatggaaatcaacacccgggcccggacccaactcatctcagatggaggaatttttgataaggtgaggagggtacggggcatgggactgcctcatccatctctccatgatctgccactttcaggatccaagatcaactatgtgtgaatgtcctcactcttaacctatgaacctgtcccttttatacccatgtcttttttttttttttttttttttttgagacagagtctagctctgtcgcccaggttggagtgcagtggcgccatctcggctcactgccatctccgcctcctgggttcaagcgattctcctgcctcagcctcccgagtagctgggattacaggcgcccgccaccatgcccagctaatttttatatttttagtagagatggggtttcactgtgttggccagactggtctcgaactcctgacctcatgatccacccacctcagcctcccaaagtgctgtatacccatgtcttaatatctgaaaatcccacatttgccccactttatggaagatgtgttggttctccagccctgtttccccctctaagacctgtgatctcctgtcccaggcagtgagcacaggtggagggggccatgtacagttgctccgtcgggcggcagctcagctgacctactgctccctctgtcctcctgacgacctggctgaccggggcctgctgggactcccaggtgctctctatgcccatgatgctttacggctctgggagatcattgccaggtgagtaaggaggagctgagaaatggtggggccggggggggggggggctctggcctgaggccagcatggggcaaaagcaagaaggtccagaaaggagaagcagagaactcaatcctggggagagatgaggaaaagtgaggacacagtgggtggctctgaaaatgaggagactgggatgaggcagagagaggaggtgaggggagctgtggggggagactgggggaggtgtctggaaaaatcaggattttctgacgatgtatgacagcaaccatgcgaattcctagaactaaggacccacatcttccatgagatgctagtgtgtttagagggctgaggatgtcccaaaggcgaggtgtcttcccagatactgtggaagcattgggcagatgccacagaaagaggaatagaggtcagaggcgggggctttctgccctcaagtgccttttccccctgggcaggtatgtggaggggatcgtccacctcttctaccaaagggatgacatagtgaagggggaccctgagctgcaggcctggtgtcgggagatcacggaggtggggctgtgccaggcccaggaccgaggtaagatccattctagagacagaagaagctcctgggagactctgccagggcgccttcccagccctgcccttctggggacaggaccccagcctctcatcacgcctcccttcctccctccacacgggaaagcatgtgtatcccattcccacctcctccgactcaggacaattctagagacccaaggactgtcctcctcagagaccctggccatcaacccctagtcccactacaccccagtcacagatgcccctgaactgccatatcctggggccccccaggccatatccacagctgggaggggtctgcacagtccctgctgggctcatattctctcctgatggttccgttttcctaactgaggatgtaaatgggaagattttccctccgaagcccacaaggacccaccctggctttccctccctctcttcctgcctgccactgtgcagcacgcacagagggtccaggaataccgcacgcttgctacagtgcaaggtcagctcttgatgcaagctcaatcctatacatgctttgcctcaaacccaaactcagcaccctgatccttggggctcaggtttctttggctaatccaactcttccaccctaaccaccccttggccaaaatctagccactacctttagtcaactctcactccccacatttgaacctctgaggaagaaaaagcctttgctgagctcttaggtttaatcacacaggcaccagcctggactgctgtcactcatccttcggcccctccccctcacacttcagatctaggctgtgaataccatcctctgcctctgtgagacaactacagacatttactggggagcccttatggcgaatcctgggaatgtggcaaacctccttaccctggagggagcctctccctggggaatctgcaccaccctacccttccaggaccaaactctctctagttcttctcagtacagtcccttaggctcctagcagtttgggctactacaacaaaacactagctgggcacagtggctcacgcttgtaatcccagcactttgggaggctgaggtgggtggatcacgaggtcaggagttcgagaccagcctggccaacatagtgaaacccgtctctactaaaaatacaaaaattagccaggcgtcgtggcacgcacctgtaatcccagctactcgggaggctgaggcaggagaatcgcttgaacttgggaggcggaggttgcagtgagctgagatcacgccattgcactccagcctgggcaacagagcgaaactccgtctcaaaaaaataaaataaaaaaaaccacacaccatagactgggtggcttataaacaacagaaatgtattcctcacagttctggaggctgaaagttcaagatcaggttctggtgagacccctcttccaggctgcccacagccgatttctccctgtatcctcacacagcagaaagatagcaagctagcactctgtcctctgctcataaaggtatcaaacccattcaggagggctgcaccctcacaccctaattatcatgtggggctccacctccaaataccatcacaataggattagatttcaatataaaaatttttcggagccaaagacattcagttcatgacacatgttaactttaacctccactaaccaccctcccccctgttctctttcagttctcatagctcacttttgtctagttttcccagcagacattttagaggctaaaattaaaaatgccatgggattagcagtcaggaacctgagttcaagatcagcctctgccttttcccaactatgcagtcctgacagtttattctctatgggctttgattttcttacctataaaatgagagtaattatatttattccacttaactgataagattattgggtctcccagcactttaggaggccaaggtgggcagatcacctgaggccaggagttccagaccagcctagccaacacggtgaaactccatctctactaaaaatacaaaaattagctgggcatggtggtgggagcctgtaatcccagctacttgggaggctgaggcaggagaatcacttgaacctgagaggcggaggttacagtgagccgagattgtgccactgcactccagcctgggcaacagagcaagactccgtctcaaaaaaaaaaaaaagattatcgggtctctgagcccccatatccactgcaaaatgagtggactgagataacctttgtgggagcccctctcagctgtgacactggaaatccatgacttattccccacattataacgcagacacttgtaattctgtctgggaataggattacgcattcctaaattatttatttattttttaatttttaaatagagacaggctcttgctctgtcacctgactaccagcaatcctcctgccttggcctcccaaagtgctgggattacaggcatgagtcaccgaccacgcatccctcaattggtttttttttttttttgagacagactctcgttgtgtcgcccaggctggagtgcagtggcgggatctcagctcgctgcaagctctgcctcccgggttcacgccattctcctgcctcagcctcccgagtacctgggactacaggtgcccgccaccacacctggctaacttttcgtatttttagtagagacggggtttcaccgtgttagccaggatggtctcgatctcctgacctcgtgatccgcccatcttggcctccccaagtgctgggactacaggcgtgagccaccgcgcccggccgcatccctcaattcttaaccactttttgaggcaagggatatttggtcactcagaacttttcagcccccaatccttccataacaataattattacttacttattgagcatttattacagaccaggtgattttgatacatcatctcatttataatgtaggtatcgtccatattttacaggtgaaaaaaactgaggttcaaataggttaagctggcctatggtaactaagtgtaagtgactgagccaggacttaaacgcatgtctgatgcaaatacgtctaaataaaataaacaaattcatcaattctaaaatatgggcatcccaaaacaacagcctttgttcctctcctcttatgctgtagcttctaactgctattcctttcctgcccaggtttccctgtctccttccagtcccagagtcaactctgccatttcctcaccatgtgcgtcttcacgtgcactgcccagcatgccgccatcaaccagggccaggtatggacagctgaaagcccaggtccctgaaggcaaggtgacctgagggagagatgggagttcaaaccctaagtaccagggttctagggttacagtttcttcctccagctggactggtatgcctgggtccctaatgctccatgcacaatgcggatgcccccacccaccaccaaggaagatgtgacgatggccacagtgatggggtcactacctgatgtccggcaggcctgtcttcaaatggccatctcatggcatctgagtcgccgccagccagacatggtgagaggggactctcgggagagggaaatgacagttggaaaggaaacatcagagtgaggggctgggctctaggtgcgtttgtctttagaaactgactgatcctttgttctgtctcaggtgcctctggggcaccacaaagaaaaatatttctcaggccccaagcccaaagctgtgctaaaccaattccgaacagatttggaaaagctggaaaaggagattacagcccggaatgagcaacttgactggccctatgaatatctgaagcccagctgcatagagaacagtgtcaccatctgagccctagagtgactctacctgcaagatttcacatcagctttaggactgacatttctatcttgaatttcatgctttcctaaagtctctgctgctaaggctctatttcctcccccagttaaaccccctacattagtatcccactagcccaggggagcagtaaactttctctgcaaagactagatccttttttacgctttgcagaccgcatagtcactgtctcaactactcagctctcctgctgcagcatgaaggcagccacagacaacatggaaatgagtgtgactatgttccaataaaactttatggacactgagatatgaatgttacatcacaaagtagtcttcttttggtttattcaaccatttaaaatgcaaaaaaaatccacaaacaaatgtgctttgtttgagacatgcacagccaggctacagactggatttggcccttgaaccctgcactagcctgaggccctgaccctacttccaaaacatccaagatcatggagcagggggatttcttagaaaaatcagcttacctcagctaactctccattcccaggaactaaccttcatgcctggtggccaatgtacaaattcctgactcagttctttggcaaattccttccacccatatttctcctattcacccatgtaccccaaaagtccctgaataagaatcatgtttttggggcagaatacaaaccactgccccaaaatggcttctttctccaaacagtcccagatgaaaggcacataattcatgtcttaaggctacttttccagcccctttaatactctgggatctatgtgtttcccacattccaagttatctttcacaagccttttaagaacaacatgcacaaaataaatggacaagaactacaaagttattctagccaatgatagtgtttatttgttaggtcctggggtctcaaggtcaaatgatccctctcaattattctgaggtcactgtcctcactagagtgggtacaacttgctcactgcaaaactgtgttcttcaaacatccctacttcttttcttttctttttttttttttttttagaagtagtctctatcgcccaggcgggaatgcagtggcgccatctcagctcactgcaaccttcgcctcccgggttcaagggattatcccgcctcaccatcccgagtggctgggatcacaagctcatgccaccacatccagctaatttttgtaatttttagtagagacagggtttcgccatgttgacctggctggtctcgaactcccgacctcaggtgatccgcccgcctcgacattcctatttctaaataattattacagatctgtcactcaccagttaaacatacaaacggcttttttggaggggatgacctatttatatttttaaatcttatatcctaccttattcaaaagtcctatcagttttcctagtttagagaagcaaagtgacatttttgtgtacatttaacaggactgcttaccttcacaacctgctcagtcggctttccctggacttctcctaaccgcccatttttcctggatttggcaccgagagttacagtatttcacgtgcgatgataaaatgttacttaggagaaacagttccaataccaagaaacttcagcaattttaaagcattttaaagccacaaaaccatgcccgatccccaaaagggggtcctaactcctttacactgtcagaatctcaattttaaaagggaggagtagagaagagatagaaacgctctctgttggtgaaaatctgtcttacttaccatttccccaacacaggagagactaaggaatttcaggtaaaaatcagatggctccaatcctccgatactaagagcccatcgccccagttcccaggagttccgccagttagactttttcccccatggcctcgctaaggctagttcctcgtcacgtgacgtgacaggcttggtcacgtgacataccagctccttccattcccgtgtgcggggggagggggaccaacaaaccggaggccctcgctcttccaatactcacgccctagctacagaggtcaaggaaggtttccccaggagcagttttggtttcagacggcgccgtctcccgcgaaagtcctgagaggagcccagccttttccgcctgccgcccccggatgggatggttgaggccggggccacgccccctctgcccccctgcgagggcatcctgggctttctcccaccgctttccgagcccgcttgcacctcggcgatccccgactcccttctttatggcgtcgctcctgtgctgtgggccgaagctggccgcctgcggcatcgtcctcagcgcctggggagtgatcatgttggtgaggggactccccggcaaggatcggagagggcctgaggggctccgggctgggagggctgggaggcgaggaaactctgggccgcaggcaggccggaggggccggggatctacaggccccggagaaggagacagactgaaattgaaaaatgggaactgttcgagaccagcctgaccaacatggtgaaaccccgtctccaataaaaatacaaaaattagccgggcgtggtggcgcccgcctgtaatcccagctactcaggaggctgaggcaggagaatcgcttgaatccgggaggcggagggtgcagtgagccgagatcgcgccactgcactccagcctgggtgacagagcgagactccgtccccaaagaaaaagaaaaaagggaactggagcggagggccctggagtgggaggagccagggctggtaaaggtggagacccctcaaggtaggagaaacaagagcggggtgcctgagaggtgcttgagttgaatggaggacatgggaggaaaagagagtgcttgttccagaaatgtgtagctgggccttgttttcccagtaatccacccaccgccacttcaagaagaaatgatatgaagaagtgccggttctccctcccctcttccgcactgtcccgtgatgatgacgcctccagagaggacgataatctgggttcctgggagagatggcttggtcactattcccacccttgcctcgaccacttgtctcaatgtcaccacctcacgccctgttccaggtggctgagtccgaatccagtaaccaccacctcgttttggttaatctcaggctcgggtgttgtagcaacattggaaatgggaggggtttacgaagtgaacatgaggtcaggtgcctgaattcaacagtctacccattccccttttccagataatgctcggaatatttttcaatgtccattccgctgtgttgattgaggacgttcccttcacggagaaagattttgagtaagtattcgggtgggggaggcgggctgggagcaggtgggaggtggcgaggcctagggtcagaattacgtctgggaggcccggtgcttagggcccctaggttagaggacttggagaggagagcggctttcttgagaatgtggttaggagccagggagtcagacctcagcggccatcccaaacccaccaccttaggtgtgacctctttaggtattttacttttctgtgcttctcagtccacctctgcaaaatggctatgacagatctcaccccataggatggtcaagaagattgaataaagtaatacacgtaacagcgcctaaacaggtgtcgggcacatagtgctcagaaaatgttggctcctattaaagtttgacccctttgcttcattcccacccccaggaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgcgggactgggtttcccgggcgagagactgaatcccttctcccatctctggcatccggcccccgtggagagggctgaggctggggggctgttccgtttctccacccttcgctgtgtcccgtatctcaataaagagaatctgctctcttcagccctgtgtctgtgcttgagtgggggcgagcacggggctgagactagaggtcggcctctgcctggaaagtcccgatgtctgagcggaagtggagcgaagtgtggcgcggaagtgaggcgaaggctttccccatcgactgggcgcgccgagcggtctaagcgactgcgtctgatggggcggggagccgccgggttgagcctatccgctgcggggagggcgggacttcctgcgcgggggcccgagccgctcagtctccctgctctccgtggtcccggctcgcgtgtagcggcggcggcggcgtctccgtgaggaggcgcgcggggccatgacgtcagcgtccacaaaggttcgacctccctcgcggacagcgctccctggcggccacgggagggcgggccccccacttggctcgcggctcttccgccccgggcggggggcgggcgggagccgagcctggggtggggctaggggctccgggcgggacggggagggcgggcgccggccccccgtgacgctgccccgcccccaggtcggagagatcttctcggcggccggcgccgccttcacgaagctcggggagctgacgatgcagctgcatcccgtggccgactcttctcctgcggggtacgtgagcccggactgggacgtggacgctgagagcgggcgcttggactcggtcacagacacggaccctctctagcacagggacagacattagtttccctttgtgcgtggcacagcacagagtcggtgttaataaatgatcgttgggtgagggaatgaatgacagataaaaatacagacaggcccatagcccagactcctgtttcacagttctccctgctgcgaacgggtcgaccacaaaccaccgccactcccaaccaccccagttcatggaattcccccagacggctgcaggctgtgttggtgggtctgttttgaaaagcccttcctggcgagttggtttcagtgtgctgtgtacagcagccgtttaacgttgatggtggaaaggggtgtctaaggtggaggtggttgtgatttcttgtgattggggtcctcccggttcccgcagggcctcaagagctttccgcctccccttacggaggacctctttatgcatccgtggaaggggtcccagaaatcggaaggaggcggctggttggctgtgggatgcatagcctgtgggcgggctccacaccccccctcccatttttgctatcccccctctccccttctgacagtgcgaagtggacggagacggaaatagagatgctgagggctgctgtgaagcgatttggggacgatcttaatcacatcagctgtgtcatcaaggaacggacagtgtgagggagggtggctgccagaaaagggcgggtgggcagccttcttcctccttacccaaggttccatcgtcctcagaactcctttccagctcagctgcttccctactttgtcactagttttttagaatccccttgaggactgaaagaatagaattgtcacagttggtcagaagttcctaaaatgctgtggtaatccttccaagaatgtgaatttaggttgcctgagatgctgttattgtatttgatgatggaagtcccctggttatttatataaatgtttgaggaccccactgcagtgtttccagggatatggtgaccctgaactagttgatcagtaaatctcaatccacctgtaaatcaccaagctctacctgatgtctctcccagaagagaattaggagatgggcctttcccactactcagttcagggactccactctccacactccatccatcctgagtgagtgtaaaacttcgagaaagtgagaaccctaccaatgggttggggccccgacctggattcttatgaagggactcccagaaccccttcccctcccgtcccctcttctgttagtctctctgatgactcctttcctaacctcttctctcttttcttcagggcccagataaaggccactgtgaaacgcaaggtatatgaagattctggcatcccccttccagctgagtcacccaagaaagggcccaagaaggtggcatctggtgtcttgtcacctcctccagctgcccctcctcccagcagctccagtgtccctgaggccgggggtccccccataaagaaacagaaggctggtgagggctgtggagttgctgcctaggggttaaaggtcccatctgaggtttagtgagagaattgggcctgggtcaaagaagggtcagtctctcttcctgtccctgtggaggttcccagagaggggcagaggggaggggagaggaggcacaaagctttgggaagcttggggctgggggagaggctgtcaggggaacctagaacctagcttatgcccccttcccagatgtgacactcagtgctctgaacgactccgatgccaacagtgacgtggtggatattgaagggctaggagaaactcctccagctaagaaactcaacttcgaccagggtaggagtcctcctcctcccacacagctgacggggttggggagaaagggctcacctggatggcagggcacggtctccgcaggggcccctcccttgtataggggtttcagaagagaaggtgctctcatacacagcgcagggcattggatcagtacgtagcagggtgtttcagggaggtgggagtggccttggaagcacactgggggctcgctccatctcggcccattttacttcctgttccagacagcctgaccctggattctggccttctcatgacctctgctgatcctcctctcctctcctgctgagccttccacctctgacctctcactgttcatgccggacctgtggatctcctgggactccgagcaaggcctgcacgagagagggctgaaaggctgctggggctgccacctcgctattcccgcataagcatctgcccccaacccctttgaccttcatctgatggacatttttatacagaaaacaataaagatttccctctcagcttcgtgctgtctgcttaacattattagcaggagaggcctgttccctcttctctcctcggcccatgggggctcagcccctcctcggtagttttcaccaccctgcctggagcagcacagccaatattggcagactcgcttccctgtgccaatatttctgtgctgctagagccagggaagctgggtgtgggcaacaaagactccactttgttctcttgaggcagaacttactcccagggtctctggccatcagtattcttgaaactgccctggagattttagaggggtgcttacataccccaccctctccttgcccacctggcaagaagtttgtcacaaggccccagatgttttttgtgtcacttctccaggatggcctcccagggccaagcctcggcggtgcctcccccaccctcgctctaacaccacagtgtggtttggacgtggccacagtgccgtacaaaccacagtgtgctgctggggcgggagcaggaccggggtgggttgaaaggaagagagcacatagcagtgctgggaagaccccagcaccacctccaggagcggggggatagagaagccttaaaaggcaaacatggcccccaaaaacgtttgggaggaaccagggacgggctgagcaggcaactggaaggcgacggaccatggggatgagctcacagtgtagtaagattggaccatcttccctctgtaggaactcagctcaggggatccctagggtggggtcagaggcagaagaaatagggaatgactggaggggccaacacactgcctcctgtctcagcaagggcagggacccaaggcttcctgtgtccgtccttcctctccctgggtcagaacccaagagaaaagcaaggagagacagagggccaaggccagcagggttgggagttggcagtccagaggtggtggggccggaacatggttgggagaggggggccggaagtcgccctgggccctgggcctgccacaagatggaggccaaaggcaggaaatggagaccagggggaaggggagcagcagagcccaggaagagggccatctggacctggggggccaggtattcaacccccagtgctgttcccactccccagggcccctgaggacccgagccggcccccacagcaacctccatcagcccatccaccaggccagggcaggcgggcccaccccagagagccacgtttaagctgagacaaacatgcctctccccacccccaactccaggccttccctcagcccttttctcctgtccaggacttgattttttaaaaacacccctcagaaagcaaaatccaagggccaaaactccttttgcaaatcaaaatatgaccccctaaaatccagaagttatcttcctatatcccatcgcatcttttaccaccccctcttccgacacaccccccaaaactcttagcaatctgaaagatccaaggtggtgtatgtaagcagtctttttaggcccccgaagatgccagacccctcccggacacccctatctgccctccatcaaatcttgccaaggcctcctgctcctccaccaccctccatagcccccaaactaacagttgcccccagctcctacctcggcagagcctttgtggggggtgaaagagaaattaaacactatcctaacggctggggatgttggggggctctctggtctcagcctttggtttccgtctggggggctgcagtttaggggtataagagaaagcctctccaatcatccccccaattccaagactgacaaagccaaccccaccccagcacgcacctccaaacctcccccccaaccgccacgtctctcctgaaaacagaggacacttccctccccacttacctcagctactctcccctgagatcctggtcccctattttgaaaagagcaaaatttagggtgcatccctcacatttggggtgcaggagaaaggagccgccccagtcgcatcgctggcctccttcctctcggctggctcagggactggggagtgccctggggagggggcacccccacaagagatctcaggaggggttcctccactcccagtcagaattggggacacccccccaaaacccgtcccagcccatccgtctccaactcggcgggagaggcagctgcaatgccccagtcagattcacccaacactacattcctcaccccatctagaggggtcccggggtccccaaaaaatcccaaaaaaatctaggatgttgggaggacggtcctggactagctccccaaatttggggtcctcagatacccccgttttttcaggaaaattccgtcttttgcctgcctcccgccagccctgctctgtcccgatgccaattttggaagtcactccctccttcctcctccccgtctctccaggccccccccaccgctcgggggctagggtccaggacacctggcttccagaccggggggaatcactcctcaaagggctaggggccaggaggtcaagctcattgcccctgtcttaaggaagcaggaaagcccgttcctcccttcccctcccccctggctggtcaccgtggtggtttaggaaagcctggaggattggaatctgccattgctgttgcacaggcagttttttttcttgggttgggggggtgggcggtgggagggagagaggggaggagggccgaagagagaagggacccaggcgcgaagagctggcctggcttaccctgtagccccggctgccgtggggaacccctccccgccatctcacccacactcccagtcctctgtctgctttctgtttggggctcatcctagaaaatcagggtgcaagaatcacctccttgtaccccaccagcacccctccttgccacagttccaacagcactgccctggtcaggggtgcccacttggccaagggacaccccatttttctccaacttcccccaaactaaggggtgctcccttaagaaattgggattcagagtctgaaaccgccttttctccctctcttctccctcaagccacataataataaaaggagataccacaccctttccaagtttctcccttcaaatcctgggcttatttgggggttcactaaagaaacttctagaatctggggtgagagggcactataagcaaaagacatcccaaaccagggtccaaattaagtgaactcccaaatcagtctcaccttatgattatcccttagcttcaccaaaagcagcc

SEQ ID NO: 1028 - DNA, 41809 bp, Homo sapiens
tactaaaaatacaacaattagccagacgtgatggtgcatacctgtagtcccacctacttgagaggctgaggcagaagaatcacttgaacccaggaggcagaggttgcggtgagctgagatggtgccactgcactccagcctggacgatagaccaagtctgtttcaaaaacaaaaaaaagagaataaataaataaatatgaattaaatgaataaagtccattagtgccttgaaatctaagtactttccttttattttatttatttatttatttatttacttatttatttatttttgagacggagtctcgcactcgcccaggctggagtgcagtggcacgatctcagctcactgcaacctccgcctcccgggttcaagcgattctcctgcctcagcctcccgagtagctgggattacaggtgcctgccaccacactcggctggtttttgtatttttagtagagacagggtttcagcatgttggccaggctggtctcgaacttatgacctcaggtgatccatccacctcggcctcccaaagtgctgggattacaggcatcagccaccatgcctggccagtaccttctttataaaacgatcatggcaaaccttcagctcacttgccagggcctaagtgctttacagggatcgctgtacttagtccaggaaccatcctaggcataggtattttgtatcactattggtaccgatgagggaatctgaggctcagaggagctaaataacttaaccaaggtcacagccaataaagaggccggcttggggacccattttcgccggttttcatcacctagggtacccaactcctcttccccaacctaatctattccatttctcaagagtagatacagaccatgggcagtgagatgcctttcttggtgtgtcactcaacaaatcagaaactgtggattttggggaccccagaagggcccacctgcacttcttcctcagccaccatgggcagggccctccgggcttgtcttgatgccttatttaatacaacagtaggcacagcgtcctgggcacagacctccgggaggttagtgatgagagaggcacccactcctcacggggtccctgaggcacccacagaccatggcactacccgcctctgttgggctcccgggcactcaccgtgagcagtggacggggcaggggcgtgggtgggagcgtggtgagaagcttagcagctccatccagatgcgaattgtccctcccatacttcccgggctgcaggggcctccatttagagcccccaaggagtcagaatccacacctccgcaaatgggcccgctttcccaggggccccctgcccagactttccctgggctctgtgggttttgacacctctctgcaacctggcggggggccacctcgcacctttggtcaacataaaagctcaggcctggaggtggccaacccagcctcccagagcctgcagcccggccatggcccagtcgcctcctccgcagagcctcctcggccacgaccactggatcttcgcccagggctggggctgggccggccactgggactccacgtccccggcctcctcctccgattcgtcgggttcgtgcccctgcgacggcgcccgcggactcccgcagccacagcctccgagctgcagctcccgagccgcagaggcagccgcgacgacgcccagacgagcgcgcaccggaccagcgggcggacagcggcagagcgccagcgagcgggagaaactgcgcatgcgcacgctggcccgcgccctgcacgagttgcgccgctttctgcctccctccttggcgccggccggccagagcctgaccaagatcgagacgctgcgcctggccatccgctacatcggccacctatcggccgtgctgggtctcagcgaggagagtctgcagtgccggcgcaggcagcgcggggacgcggggtccccttggggctgcccgctgtgccccgaccgtggccccgcagaggcgcagacgcaggcggaggggcaggggcaagggcaggggcaggggcaggggcaagggcaggggcaaggacaggggcaaggacaggggcaagggcaggggcgcaggccgggcctggtctccgccgtcctcgccgaggcgtcctggggatccccgtccgcctgccccggagcccaagccgcacccgagcgcctggggaggggggtccacgacacggatccctgggcaacacccccttactgccccaagatacagtcgcccccgtattcgtcccaagggacaacctccgacgcgtctctttggacgccaccccaaggctgtccctggacgcagtcgtccccagagccccggaacccaccagtgccctggacggcggccccagcaactttggagctggccgcagtgtaccaggtatgtgtggaggcccttgctgtgttccccagcctccagtctgcagagaatctcgtactttttcgatcccagcttatctactccaggattatctaacggaggggagaatggaaggaacccccggctccgtgggagaagagatgggaccctgggaagttaaggccatctccacagtcaccacaagcagtcttcacagccatgggaaagagggggagcccgccgactttctcagagggtggaaagtagcagggtgggcgtgctggcttcaagtgctattaagactgcagtgggggaaggaagtcccagggtaagggcagcatttcctgagtagatgggcctagagctggtgatttcaagttttcttcaagattcgttcattcatgaggctcatgaatgactcatcgtccataaaaaatcatattaaccaaaatttgttgaacactttctatgtgcccatcatcattcttggcaccttacatgtattattcagccccagtaatgaccctaggaagtaggtattatcagcatctctattttacaggtgagaaaactgagactaaaagaagctacctgagttctcattactagtgagtagcagaactgggatttaagccttagcagagtgtctcccgagccagtcctcttaaccacttggctttgctgcattcatggcaccagggctgtccggatgctgccagccataccatggcaaccagccagattcaagatctctggatatcagggagtagcccactaaccaggctgctctcatctctcttgcagggtctctctgtgtctccagagccctgtctgtcgctgggagctccatctctcctgccccacccatcatgccagagactgcagcctcagacccccgggaggtgctggagccacagtgcagaggtggtgcccaactcagaggaccagggaccgggcgccgccttccagctcagtgaagcaagccctccccagagctcaggcctgcggttcagtggctgccctgaactttggcaagaagatctggagggggcccgcctgggcatcttctactaaatggcctcggcttccctctttccatccaggaatcagtcctgtagcttgggtgcctccttatttgttaattagtggcttttcatgttctcctttagccaaggctccctttttccaagtgatgtctttcagggaagcagtgtttgaaatagatagcgggtaccttccctggatggagtcagggcgggggcactgtcctccactgctagacacccccagaatgcctggcgctctgcagagcacagtctgagctgctctaagaaggggtctcctttaccctaaaggcagctgggcagggacaggtgggagaatgggtgtaggaggcaggccccaggctctgcttcttggtgacagttggccagagccctgtatgctttgatttttttgtacttaaaaagaaaaaacacacacacacaacaaaaatttggtttggccttgttttttgttcatcaacctgggtttttcttgcctctggaaaaggaaacatgttttccttctgtggggaacaagttctgctgctctttccttctctaatccaggcctgccaaggtttgggtgggccctcatttgtcagtttgaccatatttattgcactggagctccagggccaaaagctccacctggcttgctgtgcaaggtagcacaggtgggctaagcttgggcctgcccacttgcctcagccacatcaccactgcccttttgtgttcttcgggtgcattcctggtgactgctggggtgggtgcatgcagctgtggacagacagacaggagccccaaatggggagaccacagtcccagagacctgtcatttagggctctttcacaatgacatgaaattttcttcaaagaatactgggagtggttcctacgtgctaggcccagtgtattagtttgcgagggctgccatactagaatgccacgggctgagtgcagtggcttacgcctgtaatcccagcactttgagaggctgaggtgggaggatcccttgaggccaggaattcgagaccagcctgggcaacatagcaagaccttgtccctacaaaaaacttaaaaaaacaacaaccacagactgggtggcttaaacaacagaaatttattttctcacaattctggaggctagaagtccaagatcaaggtgtaggcaggttcagtttcttctggggcctctctctgtggcttgcagatgactgcctgttcgttgagcccctacatggtcacacatctgtctctattgtctgtgtcctgatttcttataagggcactagtcatgttggatcaggacctaccctaagggacccatttaactgtatttactcttttagggatctttcttctaatacagtcacagttacattccgaagtattggatgttagggcttaaacataagaaacttcttttttttttttttttttgagacagagtcttgctctgtcgtccaggctggagtgcaatggtgcaatctcggctcactgcaacctctgcctcccgggttcaagcgattctcctgcctcagcctcctgagtagctgggattacagatgcctgccaccatgcccggctaatttttgtattttcagtagagacagggtttcaccatgttggccaggctggtctcgaactcctgacctcaagtgatccacctgcctcggcctcccaaagtgctgggattacaggtgtgagccaccacacccagccaaacataggaaattttttttttctttttttttgagagggagtctcactctgtcgcccaggctggagtgcagtggcatgatctcagctcactgcaacctctgcctcccaggctcaagtgattctcctgcctcagtttccctagtagctggcctaggtgcctgccaccatggctggctactttttgtacttttagtagagacagggtttcaccatgttggccaggctggtcttgaacccctaacctccaatggtccacccgccaaggcgtcccaaagtgctgggattacaggcgtgagccaccacgcccagccagacataggaattttatgggaacacagttcagccgcctcagcctcccaaagtgctgctattacaggcatgagccactgcgctcagccatacaggaattttatggggacataattcagcccataacaccatgtgttaggtgccagagagaaaatattccccaactaatgtgaattacagggaaataaatgatcagagcccaggtcctaaacacaaggatgggggtttgtgtgaggtgcttagggaccaggatgcggtaacctggtgggaggcgaggttggcagtaccatctcattcttgagttacctgattccttagtcctgctgccttgattgcggtgtcttaagagtaagaggcactgccaggatcttgggaaaaggatgccaagatctattagcaaaggctcccgtgggcatgggagccagcagtggtggtaacttccttctgtatctgctgactcagggaggagagagtgcagaagaggtgaccttggagctgggtgttgaaggatatgcaggagtttatcaagaggagtgagggaagagaggtccaggcaggagcaacagcatgagccaagtcgaaacagaagcgtctagtgtctagagatgacagagaaaagtggcaaacagagccggaaaggggcttggaggcaagtttgtggggagttccacgtggtgggtgatgaggttttggcctccgtttcccgaatgatgggcagcactgagggttgggagttgggggtgagctggtaagaagtctgctctcagtcccttcggccgcttcatagaaatggaaccaggcaggaggccactgcaacagtccagcttgagagaaagggagaggcagcacagagcatgagctgcctgatttcctgggcttgagctcttggcgtgtggggctttcccctctcatcctgcaaggttgcccgttgcctctgacacgccctgtggcatcaggcaagtcactctttctgagcttcagttttcacagttcctaaaggaggaactatcttgggtggtgctgaggtaccttcttcctctaaccttccagaagtgctctggttctgcccttagggccctgctgtcccgaggggctgtcagccacagctggaaggatgagaaaaatccaggcaaggttagagtagacacacagcattggggcccaggttgcgcattctactcggctcttacttgctgtgtaaccaagtgagactgacagataagctttggaacctccctgagcctcagtttcttcaactgtgaagtggagacaataatagacctacctctcagggttttaatacttggcacatagtaagtgctcaataaaatgagtactgaggccaggcatggtggctcacgcctgtaatcccagcactttgggatgccaaggtggggtgatcacttgaggtcaggaatttgagaccagcccggccagcatggtgaaaccccgtctctactaaaaatacaaaaaattagcctggcgtggtagtgagcgcctgtaatcccagctactcaagaggctgaggcaggaaaatcgcttgagcccaggaggtggaggttgcggtgagcgagatcgtgccactgcaagcctaggcgatagagtgagactctgtctccaaaaaaaaaaaaaaacaaaacaaaaaaaggaaaaagaaaatgaaagattgcgttagctatgctgactccacagtctcgaaaggctgagtcagaggagccaccaaggctgctgcctacagagcctcagcaccttccattcctgctggacttgagtgctgagggcaggcaagagcgctgggcagggaatcagccgccagagttctagttggttcctgctctttgaccttgaccaaggctctgcaggcattcctctggctctgtgtatcctcactgcattccaggatcagccatggaggtcctgatgagtgccagcattgtacactgccaggtggcatcgtcagaggtgtttgaaccagagcgattccatcttgaataggggctaggcaaaatgaggctgagacctgctgggctgcattcccaggaggttaggcattcttagtcacaggatgagacaggagatcggcataagatacaggtcacaaagaccttgctgataaaacagcatgcagtaaagaaaccagccaaaacccgccaaaaccaagatggtgacaaaagtgacctttggtcatcctcactgctcattatgcgctgattataataccttagctgctaacagacactcccaccagcgtatgaccgttcacaaatgccacagcaatatgcagaagttaccctgtatggtctaaaaaagggagaaaccctcagttctgggaaatccccacttctttcccaaaaaactcatgaataatccaccccttgtttagcatataatcaagaaataaggctgggcgcggtggctcacgcctatgatcccagcactttgagaggctgaggtgggcggatctcctggggtcgagaaaccccatctctaataaaaatacaaaattagccgggcatggtggtgcatgcctgtaatcccagctacttgggaagctgaggcaggagaatcgcttgaacccaggaggcggaggttgtggtgagccaagatcgcaccattgcactccagcctgggcaacaagaatgaaactccgtctcaaaaaaaaaagaaaaaaaaaatcaagaaatagctcttaagtttactcagttgagcagcccatgctgctgccctgcctgtgtagtagccattctttgattcctttcctttcttaataacttgctttcattttatggacttgccctgaattctttcttgcatgggctccaaggatcgagacctctttccagtaacggcacaagcatggcagtatagacgtcacgcactccaccccagctccagatggagaactggcttccacttctgtgcagggagtaaagccagacagtggttccagttcagttctactgagttgtgacttcatctccttgccctgcagtttccttatctgtaaagctgacataaagatattccttatctcatggtacggtttagaactaaatgaaataatgtgcataaactcttctccctggcaggccagctctctcctctgcaatgtccagggatcctagagcccattagaaactcaagatggtgaggccggcccctcccacagctggtccccagaaggtcaagtgccagccacggccgctgggtactggcgacaggaagggttggcccaaagtggctggcggagcttaatctggggcggcccagggagcctcctggctggtggagggacagagcaccatcatccgggctggcctccgcccttagctcaccctactctttgatgtgcagatggtggtgggggatggggggccttcctggccccaggcctgcctgcttctcacaagggggaagagggccaagggtgataataaaacccagctctccttatgcgtcaggccatttgctaagtacatgtatctccttcaatccacacaccagcccaacagctctgacactgcctcgttgtgcagatgagacctaggcttgggcatgtgggtcccttgtctaagaaactgaaaccagacctgctggactccatgattccagcctgcggagctggctgtgggtgtctgttggaggtgactcctaaggacccctgtggctgttcccgccttctccccctcctctcagccttggatgttcaactgggccttgcggggcagaggctgaggggagcctgccacagtggggctccatttgtcaagaaatgctcaccagggccaatgtgtgcgtggagctgcgctggtcccaggccttctcagagttggccctgaccatcttctgccccaggcgatgtggagggcacagcccccactttatgagcctggcaaagctgtccccaccccatggtttgcctgctcctcagcccagcccatccctgtgtgctgctctagaaaacaacctctttatgcattggtacccacaccccactccacccttccaccacggaagacggtggggcgtgcccttggccagtgaagggtggcaccaggtatgggaccctgtgcttgctgccttcactgcacagacctgtcccgcattgtcccaggtatcccaggtgttcccgtggagcaggaagaggggcacggccagcaccctgcacccttgcctcatgttaaggagggtgcttcctggagagcactccctgcgctctgccagggcccctctcaccactcactgcgggagcactgggtccacagctccccaccacccagcagctccagctgccatcagaataggaataaaaggagccctgcaaaccacccagctagctcagtcaatagagcatgaaaaggagcccggagtcctgcaggcagacatggaggcacaggcgcagggcacctgcaggaagggccggcaggctgggcacgtctcccctcctgtgctctggggtcccagactccacggtgctccgcatgcacccagcttcccccacccggcctccccagctgctgtattgacccactcctgctttagtttagtaatgagtctcactcatctagaaatcctttatttacattttctcttagaaaaaaatatacagatctgctgccctgttgattcctcagatttagggtctttagggaaaggtgaaagagggtacagggcggcccccagcaaggccgttcattgtccatcgagagcttctgctcatctggccctggagctgggcttccctgagatcagccccagggcactgggcgacaggtgccatgccaggcctagggcggggttggcatgaggggcaggggctgggaggtgctcaggcagcctgggtcatcaggaactagactggctcacaggcagagagaacgtgggctggagactttgtccttgaggggaggacactggtgcctcgggctccaggaatggaggccctgcaccagccgctgggatggacacatgtgggcaccttgcatgggggccgggtgacttcaagggctggggactatttgctgttttctgtgaaccactggagcaccacctccttgttctccttcacccacttgatgttggctttcgtcttctccagggcttgctccagggcccgggtgcctgagccgaagcctgtttcctcgttgtccttcttgaactgctccagctgccagaaaaacaaaagattctcagtccggctgggtccctaacagccttgaggaggagctctctcaggcctctggctttccactcccactttagagtccccatggatgggaccacaccctgttccagggataggcaggacgtccaccttgctcccgggcaaagtccttgtgaacacagaggttgcaaaatgacaatcccaggcaaaacctggctcagggagattctggccttcaggtgtaatattttattataatatcaatccaatcaagagagtagagaggggctaatgaagcaaccagccaaatctaaaatgtggaaatttctataccacaaatgatccagttgcttcagtaaataaatgggtttaaaaaaaaaatactcctacaaattagaagagttatcagtcctggaggttctagccaggcaatcagccaagagaatgaaatgaaaggaatccagaaaggaagaagtaaaactatgtgtatgacatgtttgcatacataaaaattttaaggaatccattaaaaaatctattagaactaatgatttctgcaaggttgcaggatacaagagcaatacacaaatatcaattgtattcccatacattagcaatgaaaaacctgaaaatgaaattaagaaaacaattccatttacgatagcatcaacaagaataaaatatttaggaataaatttgacaaaataagtgcaagactggaatgccaaaaactacaaaacatttttgaaagaaattaaagaacacctaagtaaaaagaaaaaagacccaaataaatctgtgtccatggactggaagatttagcatcattaagatggcaatagtccccatattgctctagagattcaatcccatcaaaattttaactacttttttttttttttttttgcggaaattgatcagtgatcctaaaatgcataagaaattgcaagggacccagaatagccaaaacaatattgaaaaagaacacagttggccagcctgggcaagatggtgaaaccctgtctctgcagaaaaatacagaacattagccgggcatggtggcatgtgcctatagtcccaactactcaggaggttgaggtggggggatcacctgagcctgggaagttgaggctgcagtgagctgtgatctcaccactgtactccagcctgggtgacagagtgagaccctttctcaaaaaaaaaaaaagcaaattggaggactcacacttcccaattttaaaactcactacaaaactatagtaatcaggacagtatggtacaggcataaggatgcaaatatagatgaatgaaatagaattgagaatccaaaaacaaacccttatatttaccgtcaattgattttcaactaggttgccaagaccattcagtgggagaagaacagtcttttcaacaaatgggacttggacaaccggatatccacatgcaaaaggaatgaagttggaccccaacctcatatcatatacaaatattaagtcaaaatagatcaaatgcctacgtttgagtgaaaacataataaaactctttttttttttttttttttttttgaggcagagtcttgctctgtcatccaggctagagtgcagtggtgcgatctcagctcactgcaaactccgcctcccgggttcaagcaattctcctgcctcagcctcccgagtagctgggattacaggcgcccgccactgcatccagctaattttcgtattttttagtagggacggggtttcaccatcttggccaggctggtcttgaactcctgacctcatgatccacctgccttggcctcccaaagtgctgggattacaggcgtgagccgccatgcctggccaataaaactcttagaaaaaacatcgtcaggtcttttgtgggtttgaaaaatttttttgaaataaaaaaataggtataaatcttcatgaccttgggttagacaatactttcttagatatgatacataaagtataagcaaccaaagggaaaaaaaacagataaataggatttcatcaagatttaaaattttgggtatcaaaagacctattaagtgagtgaaaagacagtccatagaatgggagaaatacttgcaaaccctatctctgattaagggtctaatattcagaatatataaagaactcttacaataaaaagacaacccaattttaaaatagcaaaagactgggcacagtggcacatgcctgtaatccaagctactcagaaggctgaagtgggagggttgcttgagcccaggaatttaaggacaacctaggcaacatagtaagaccctctctcgaaaagaaaaatagtcagttttacccatttctccaaagatacacaaatgtgtataaggccaataagcacatgaaatattcaacatcatgtcattcattactcattagggagatataactgaaaaccataatgataccacttcctacccactagatgactatactaaaaaaagagggaaagagagataagtgtagacatggagcaattagaaccctcatgtgatacactgctaataggaatggacaatggtacagttgctttggaaaacattttgtcagtttctcaaaaagttaaacacagagtaaccaaatgacccagcaattccgctcctaggtgtatacccaagataaattaaaacatgtttgtacaaaatttgcacgtgaaggtccatgatattcatcacagccagaagactgaaacaacccaaatgcccatcaatgatgagctgaaaacaaaatgtggtacatccatgtaatggaccattattcagccataaaaaagaatgatccctgctaccgtatgcatgaatcttgaaaacattacactaagtgaaagaaggcagacagacacaaaaaggctgtgtgtatatgattccattttatgaaacatccagaataggtaataaatccatagagacagaaagtatattagtggttgccaggggctgaggggaccaggtaggaataaggagtgactgctaatgagtacaaggtttttttttggcgtaataaaaatgttctggaattagacagtagtgatggttgtaccacatggtttttttctgtttgtttgtttggtttggtttggttttggttttttgagacagggtcttgctctgtcacccaggctggaatgcggtggcaccacctccgctcactgcaacctctgccttcctggttcaagcgatcctctcacctcagtctcctgagtagctaggactacaggtatgcaccaccatgcccagcttatttatttatttatttatttatttatttatttatttagagatgagatcttatgatattgcccaggctggtctcaaactcctgggttcaagggatcctcctgcgttggcctcccaaagtgctgggattacaggcatgaagcaccccacccaccctaccttgttagtttactgaaaaccacttaaaatggtgagtttgatggtccatgaattatatatcaattttttttttttgagacagagtctcactctgtcgcccaagctggagtgcagtggcacaatcttggttcactgcaacctccgcctcctggattcaggcaattattctgccacagcctcccgagtagctgggactacaggcaccccccaccacacccagctaatttttgtatttttagtagagacagggtttcaccatgttggccacgctggtctggaactcccgacctcaggtgatccacccaccttagcctcctaaagtgctgggactacaggtgtgagccaccacgcccagcaaattatatctcaatttttaaaaaagacaaactaacttaatccaagttgactttgtcaagcttctaattcaagcatatatatcaattgtaaaaagaccttttataaacaacttagaaaatttgaatatgccttgggtatatgatagtaagaagataatcattttcctgggtttgctaaggacagtgtgattatgttttaagaatccctttattgctgggcgcagtggctcacacctgtaatctcagcactttgggagaccgaggtgggtggatcacttgaggtcaggagttcgagaccagcctggccaacatggtgaaacctcgtctctactaaaaatacaaaaattagccgggtgtgggggcgcatgcctgtaatcccagctactcgggaagctgaggcaggagaattgattgaaccccagaggcagaggttgcagtgagccgagatcataccactgcaccactccagcctgcatgacagagcgagactcagtctcaaaaaaaaaaaaaagctggacgccgtggctcacgcctgtaatcccagcactttgggaggccgaggcaggcagatcatgaggtcaggagatcgagaccatggtgaaaccccatctctactaaaaatacaaaaaaattagccaggcgcggtggcgggcacttgtagtcccagctactcaggaagctgaggcaggagaatgacgtgaacccgggaggcggagcttgcagtgagcccagatcgcaccactgcactccagcctgggtgacagagcaagactccatctcaaaaaaaaaataaaaaataaaaaaaataaaagaatgcgtttatttttcatatgactaaattatttagaggtaaaattacatgatcagtgatttgcttaaaaattgcccgcccggaaaaagtactggcaaaatgttgataattgttgaacctgggtaacgggtacatggaggttcattataccactcttcccttttgtgcctatacaaaaatcccaagatgaattttttaaattgaattatcaacatttccaaagtctggctactcggcttcctctgtaaatgaggaaggcctggcggcgtggagcctgtgctccctcagggccacgtgggagaagaatggagtgcccctttggcctgggaaggaagtaggcagagcccaggtctggggaatgacttcttacctgctgcagctcatactcggtggagaatcgtcgtgtcactgcctggatgaggttggagaaggagaacgagccaccaccataactgcagggagggagagaggtgaactgtgagggaggccgggaactaaggaggctcatcctcacacctactgggtagggagccatgattatagaggagatgaaatgacacgccctgggagaccccactaggatgtgggggagtcacagcttgaacacaggtctgactgccgagttcctcactcccctctcttctggagaatacgcccacacgccacgttttccttccaaatgggaaaagggacggcccataccccagcttgtctttccattcctgccccaccctagcccccaggcttggctgatttttgtccacttctggttagtgcccccggcgtgtcttacccgcacaggccaccccccggggccccagcctcggcgctcgctgtccctgacacccattccacagactcactcgttaaaaagcttcttccagttgctctggacaaagtcccagaccagaccttgcccaatgacgttgttggtaatgctgatgatggtagaggtggcgtcctgcttccggattaagtccgggttcagggtgtagctcaggtacctaagagggccagatgctgtctcagctactgctaattcaggtgactcaggagagaacttggactgtcccacgcacatcacctatgcctgcatcctctcaacatcccctcggcctgccaggggctgagggaccccttggtccttcttccctctatagatggaaaactgagtcacctaagcagggtcacagggtcactggctaagctagtgtcatgcctgacatagaaatatttgacaatgaatcaatgaaggaaggagtcctagcgccccaagccctggcaccaggtgggtggtcactcccgtctttgacactgagggtggcccttcttttcttttcttttcttttctcttttcttttctttcgagacggagtctcactctgtcgcccaggctggagtgcagtggagcgatttgggcttactgtaaccttcgcctgccaggttcaagtgattctcctgcctcagcctcccgggtagctgggattacaggcatgtgccaccatgcctattttttttttttttttgtatttttagtatttttagtagagacggggtttctccatgttggccaggctggtctcgaactcctgacctcaggtgatccatccacctcagtcttccaaagtgctgggattacaggtatgagccaccacaccctgcccaagggtggctcttctttactgcatccaggtaatggcatatgaggcacatggtgggaggtggggaccctcatccaagggcttgagggggtgcccagctggatgtttgaaaagacccaggtccagctacaccagagcctttgacagaagggaagacgagttgttgtcaggtaaaggctaagaggccacagcagctaggaacagaggacatggacccagacctgagtccatatcttgtctctatcacttattaaagcttccagtctgcaccggttactttggaaatactgcctccacctcaacaggtctgtgggggtcacgtgaaggatctggcgaggagtgtggaggcctgcctggttctccaggtggggagagggctctcgcagtcccaccctgcgccaagactcacctgttcaggatccacaactctttgctgcaggccagggctgcccggagcttgtcagcctcattgaccagtgtggcatttcggaactgctcccaggcgaagtcccactcctcctccccgccctgggcgatagcgttgcagtagacggtggaccgcaggttggggtggatcctggtgtggggtagggaggtcaggtgtggaacagcagcggggagggtgggacagggttctgctgaggacggggctgttgggggcagatgaagactggcagaggaggcgcaggggagacactcacgggttattattggggttctccatccactgcttgaaaaggccagagaccatctcctcacactctggaactccgttggagcaggcggtgctgatggcattaacctcgctgtacctgccccaggggtgacacgcggttagcacacctggcgaactccagccaagattcacctcttgacacacaaccccaggccggcaccctgcctaaggctctgtggcctaactggccctctgacccccgctgtatgtgctttgtgccttgggcctgaggttccttggtccccaaagcagccctgtgacccagaagggcaggaacaggctccagccccagtttcaacacctagaaactgtataacctcaagccagtggggtgagctagagtttcagtttgggtctttgtataaagaggtccgatgggccctcaggccacatggagcctcagggcaggacctccctgctcctgggtgggggtctctccctgcctggtgcccccgcattgagagctgcggcagagaacactgccaggatgttgctcttgactccccggggtgcccaggacttccaaacccatgagagctcccactcactggtccatcaggttttctgggatctccctccagttgttggtattatttctgaagtgaatgaagaggggtgtgacctgcttcttcaggtagttctggggaaaagaaaatatgaatctcatcaaagactcatgcctgacctgcctggagccccacagagcctctgatgttggggggcaggcgctggcagagacgtcagaggtcagggcctcacctgaggccaaacagtgctcaaaggggcccatagaagtctagagttcaaataactgagctgagtttctttctgcttaaagccttagtcagttgcaatattctttgtctacgggtcaccatttcttaatataaaatgttgggttttccctacacaatcataaatattccatgagttgctgggcgcagtggctcacacttgtaattccagcattttgagaggctgaggcgggtggatcccctgagtccaggagttcgagatcagcctgggcaacatggtgaaaccacgtctctactaaaaccacaaaaaaattagccgagtgtggtggtgcacacctgtattcccagctacttgggaggctgaggcaggagaatcgcttaaacccgggaggcagaggttacagtgagctgtgatcacgccactgcactccagcctgggtaacagagcgagactccatctcaaaaaaaaaaaaaaaaaaaaattccatgacttattgtagggaatttgggaaacacagagaagtatatgcagaaaataaaacacacccaggagctcaccaaaactacagtttccacattgatgcatttacaccttcttttttctatagttttttcttttttacttagcatattcttcacatggcatttttctcctaacattgtagtgtaagccccaccccatgctagtaaaatcctttgtggactctggtttgacatggcaggttgatttctgtgcccacctggatccacgtccaaatgtaaaaggaataaacccccaataacaaagaacaggagaggcaacagcggatgcaaggtcaatatagtttaggcagctgggacgcgcagaaagggagatgtaccaggcttggcagagtgggagaatttgcaattgagaatctgcagaaggggagacagaagcaagggaacttgctgtgacaagactcagaattaaagggacaaggccaggtatgggggcacatgcctgtaatcccagcactttgggaggctgaggcgggcggatcacctgaggtcaggagtttgagaccagcctggccaacgtggtgaaaccccgaagctactaaaaatacaaaaattagccaggcatggtggcaggcgcctgtaatcccagctactcaggaggctgaggcaggagaatcgcttgaatctgggaggtggaggttgaagtgagccaagatcgggccactgcgctccagcctgggtgacagagtgggattctgtctcaaaaataaataaataaataaaaataaataaaaaaattaaagggacaagtcagcaagggacagaggggaggtaaggactgcaaacaggaagatgaagtcaaagtctacagaaggagtcattcaacccccaagtccccacttccctccttgtagagggcagcacccctcaccaccccatgagagagattgaaccagggggctcagaaagtggggtcaccagaccacagtgggagggttgctggattgcaaagagggtcagaggtgaaagtttccatactgaaaggtggcaccccagttcccttccctcctgtgtcctagaatgggagtactaccagcctcattgcacaatacagaggcttactctctggaaaaactgccttgtctcgagagaacaaacccatggactaatttttgagggtccccagtgaagagttacttggccacccagtcacctcgcaatgagatcccccggacaacacactccaccttcccatggagcttccacttgcattttgtttgtgtctgtctcaaacccaaaggggtggctcagcctccaacttgaaaagaggccaaaacaaacacaaaactcaagaggaaacgagtcaatggaaaaaaaaaaaaaaaggaaaacttcataagagcctgtaataaatatcctctgagagtgaagagaagatattgcataggatgctggaatcagaaagaacacttggaaatttaaaaatacgacagaagaaatgaaaacaatttctaggtgaggtggtgtgcaaagctgagggaacctcccagggggcagaataaaaagtcaacaagctggaaaacagaagagaaaaagaaaactagaggatgaaagcaagagaaataagctggattacaggggttccagaaagagataactggaaaaagtgaagggaataaagtttaaagaagcaatacaaaatcttccaatactagatgatgtgaatgccagtcctgattggaaaaggtagatggagacgaggcccaaaccaaggcccaccaggaccgagagaagctcccaaagtttccagaagggaggaaaactggtcacattcaaataactggaaataagaatggctctgggcatcgcatcagcaacatggcaagcctgacatcagtggagcaagaccttaaacattcagagaaataatttcccaccttgaaacttctaaactcagctgaacgctcaatccagtgtgagagtggaataaagacatttcagatgatctaccccagaaaagtcacctctcatgaaccctttctcaaaaactcctggaagatgtattcccctatgagaggggaaaaaatcaaagaatccatgggatgcaggaaacacagtagagggaggcacctccaagcatgggagctgtgtggcagctctggaagagagcaggcagaataggactccaggaggagtccagtctcaaaactgggctgggcacagtggctcacgcctataatcataacactttgggaggccaaggagggaggattgcttgaagccaggtgttccagaccatcctggccaatacagaaagatcccatctctacaaaagatgcatctctacaaaagagcatggtggtgcacatctgaggtcccagctaatggagagactgaggcaggaggatcccttgagcctaggtatttgaggctgcagtgaagcttgattgcaccactgcactccagcttgggcaagagagtgagaccttgtctctaaacaaacaaacaaaaacttgacctattgtgtgatacatttgtaactgtgtacaaaaaaggaaacataaacatagtgctctacatggctcagcagagaatactatttagataatcacaataaagcaaatgcttaacactgatttgactaaatattatgatttaactacattaggaggatggggaatgtggggaaagcagtaagagggttgaaacttcatttaccaaaatctctcatttaccataatggatattaacagataattgaactttttttttttctttttttttgagatggagtcttgctctgttgcccaggctggagtgcagtagcaccatcttggctcactgcaagctccacctcccaggttcatgccattctcctgcctcagcctcccgagtagctgggactacaggtgcccgccaccacgcctggctaattttttgtatttttttttttttagtagagacgaggtttcaccgtgttagccaggatggtctcgatctgctgacctcgtgatccgcctgcctcggcctcccaaagtgctgggattacaggcatgagccccactgcacccggcctgataattgaacattttttaatgaaaaaagatctcttcaagcatgatttaatgactacatatcacaccctgaaatggatattctacagtttaaccaatcttcaacctttagacgtttaagtatttgtgttttgtttgctttttgtcttttataaactgctgcagtgagcatcctatggatgtagcttattcatccagaataagctcgagtttccttttggtctcccaagcgggagcctcagccctcaaataggcccctatgctcagccttaagatactccaaagcagccaatacccacatctctctcatagcgcaggtgggctggccgggcaggtagaggcctgcccatctgacagagaagttaactgggtctgagaaagggttgcccaaggccacacagctggcaaaagacaggtcttctggccctcagcatggtggccttttctgtgccttctgaaagcgttaattccccatatttcaaatcaacaaacgttgctgaagtctccgcgacctttattgttttgccccacgcagcctcctcactcacctcctcagtgcctgctcactcacctccatgtccctccggctcgctctttcacctgcgtgctctcaggagagaacctgacaaggcaatctttctttttttttggttttttgttttgcttttgaaggttccctgaccaggagtccagtaggcaatagtctattaacttcctaatagtgcactttcaggcactggggcgaactggttcttgaaccctaccatgcacctccgtaccttcatggggccatagacctcggagcggtcaaacatgagcttgaagtagctcaggctgctcagggcggcctcccagggcatgtactgtctctcttcaatcaggaagagggtgttgttcagcgccagagtgacagggaccttatgggcactgggaataaacagaggggcccaagtaaagcacctccacccagcccagccacagcctgggaaccccaacccaggccctcaaagatgctccacacccctaggccccctgtatccactcctggagccggaggtcccagattcccaactgagccagctcaggcatttgccatggaaaaagagctacatggctgctgggtggtgccacaaacaaggccccaccctcacccattggcagttccactcctttgcttattatccccattttacagatgaggaaactgaggctcagagaagtgaagtgacttgcccaaggtcacacacctcacgagagacagagctgagatttaaaagggcaagaagcccgtgttcttaactctgaccacctcttctgactttctgggcactctaggcctttcttcctcctgccttctgtacacatttagctcacaaatgtccttgtctgtgggtgacatcactcatgtccaagagcttagagtacctcaccccaaacagagtaggtgctcaataagtacctgtttatccatactgcatccctcctgccctgtccagcccagatttttggcacttagaacagtggcccagcatagtcagccttcaggaaaagcttggtgcagctgggcacggtggctcacacctataatcccagctctttgggatggcaaggcaggtggatcacctgaggtcaggagtttgagaccagcctggtcaacatggtgaaaccccatctgtactaaaaatgcaaaaatcagctgggcatggtggcacatgcctgtaatcctagctactcaggaggccgagaagggagaatcgcttgaatctaggaggcagaggtcgtagtgagccaagatcacgccactgcactccagcccgggtgacagagcaagactccatctcaaaaaaaaaaagcgggggggcatggccaggtgccatggctcatgcctgtaatcccagcactttgggaagccgaggtgggtggatcacaaggtcaggagtgcgagaccagcctgaccaacatggtgaaaccccatctctactaaaaatacaaaaattagctgggcatggtggtgcacacctgtaatcccagcaactcgggaggctgaggcagagaatcgcttgaacctgggaggtggaggctgcagtgagctgagatcgcgccactgtactccaacctgggcaacagagcgagactccgtctcaaaacaaacaaacaaacaaacaaacaaacaaaaacaaaaacaaaaagcttggtgctgtggagtagaggatggctttggagttggacaagcctctgtctggctgtcatgaactactgtgtgacttcgggcaaggtgtcacattcttcatctgtgaaatgggtgtgtggggacccagggagggacgtccagggagcacaggagctcagggcacagcacgtggcatatgggaagggcagcaggaggagcaggggccctcattgtggactcagacttgctgaagtcacgagcttctgcagctgagccaggcagcggagcactcacctggccaggttgaaggcgtcattaatgatctgtgcccgattgatgacagggatggcctagaatgcgaagcacagcatgtgaccatgggttggctgtgggtggcaggccttgcagtctggtgcctgtcctggggcagggggcagggcgaggggtggcagacactcaccgagtggtctctctgcagctgagtctgaatcttcctccagttctcttcgtcgtagttcacccggtaatagcccgtcacattgaggttcagcaggacccactcattgcctgatgtgctgaagagatcgttctgggctgtggagagggacgagacctgggcagggctgctcagaggccatgggctgacccctggacctcttgcaagagcagctgcccccgcagcctggcaccacctcaccctcaagctgctggggagacgctaagggtggggaaggaagggatgaggaactgggctgccagtggcttcacagaccatcaacccatgaagatgacatgccaccccaaacctcagaacctgccctgcctccctaggctctgcacggccaggccagctgccaggccgctcacactcagcaatccaggctgttcctcctccttgccctcctccacactccatcacacctgtcacccaagtgggaaccacaggcagctcctcctctcccttcccctcccattcacccagacccccagtgctgctgtctctttctggggcttagtgccccttcctccctgtgggtccccctcctccctcactcctctcatactttgtttcagcagccagaggtcagggccaataggttgctcatttcccacctgccccatccactgtctcctgcagcccctggggcccttggggaccagctttatctcttgggcacacctctgccctagctacactcagtccccacactctctcctacctctatccctggcacttgctattccctttgcctggaattcttttctctgccacattagcctgtctgattcctactcttcctctaagactcagctcacctcctccgggaagccctccctgacctctccatgaacttgaatctcccttattccctgctccatgtccccatacctcactagccccaaccatacactctgaaagcactcagcacagcactagaatgcctccaacttcttgccttccttcatctgtagccttggccaaggcaaaggatgacttgtcatgcccttcgcttcttcagtgccttgctgagtagggctgctcataacatgtgccaggcactactttaagcattttatgtggattctctccttttttttttttttttttttttgagacagagtttcgctcttgttgcccaggctggagtgcaatggtgcgatcttggctcactgcaacctctgcctcccaggttcaagcaattctcctgccccagcctccagagtagctgggattacaggcatgcaccaccacacctggctaattttgtatttttagtagaaatggggtttctccatgtttgtcaggctggtctcgaactcctgaccccaggtcgcctcggcctcccaaagtgctgggattacaggcatgagccaccatgcctggcctaggattctctcctttaatcctcacataactaatggagtattgctcttagcctcattttatagaagaggaactagagaccagagcgggatggtaacttgcccagagtcacacagcgaagcagcagcaaagtggagattggaaccaaagaagtcaagtccatttgttgaatggaatggcccatcacagccctcagaacatgggccaggagctaggagtatggggtgggggctgctgcccataaggcagggctggattacctcttacatctatcagccagtagtcctgctgctgtctgccatctctgatggatgtgatgggcacaatccacacgtagctgcaattaaagatccagaggtggtgagagatggcggtgtggtcactgccagtgaggagcagctgcccaggctcccagcttctgcccagctctggcaccgagtgcccctgaactcctggctctggagggagggtctgtctacagtggctggggctgggaccacaggaggccagtcctactatggtcccttagtaactgccctctaccccacccacctgaccatgcctcagtgaccccatctgctcacttgaattctgaggggcgggtaacattggaatcggggtcaaggaggaagtgctcctgggaaagggtccccgtgctggtatccaccgtgatgaccgggaagcccatctgcagggtccagcggttcatgatgtcccgcacggtggtggggagttggatggaccggttgttcacagcctgtgggtggagcgagagggcgtggccatcagtgggaccctccagtccctgccatccagggcatctcctgcagattctcgcctcgaccccggggggccacttgtatgggaggcctgggaagggcactgggctgggagccgggagccagggtaccgtccagctctgcctctcctcggctgctcagtgctggacgagctggagaacttcccagcaaatctatgaggccctccattctgtggtccaccctgaggtgtgtatgtcagggagggggtgcccaggatgcccatggctcttcctgaacaacactgggaggaggacaagaaagaggagacagagatgagagaaagccagtgttcaggtgtcacaggcaggggtgggggacggggccctgggggtcgcatgagggaagtgcactcggactggggtgtggggcgggactcaggggcactgttgttgtcttcttgtcttcttggatctttgctcatgcacctgccttgcctttgtcatcacaacagaaagccaaccccatttgttaataactgaagaaaggaatcacctaagaacggggccacacagagggcagaagagcatgtggggaggaaccagctgggggctgccggccgagggtctcaggaaagaggagtgagagggaggagagcttggcttaggagggaacgcaaaggggaagttggggcagggcaaggaaggtagtgggggagacccaggcaatgacagtgtcattttgtcagcagcatcttggggtctagggggttggaaattgcccagcagggacccggacctcagctgtgactctgtgacaagatcctgggtctcgcttccctggtgagacaggcctggactggaagtgcagcagcaacagtggggtagaagctggacgggaatttgaggctcggaactctggaggggctgtcggtgaggagaggacatgtctgtcctctggcttaagacgctagcattgggcagagctgcagggaaggggtagggggcagctgtcagggaaatgatgtcagcggaaatgatgggggcaggatggagaggaggtggactccaaccctgggggagggagaggagcggcggcctctgggggaaggcaggagggtgtggcagtctggggatctgccctacaaacaggggctgtgcggggtctgatggagaggaactcgagccggggcaggggcagagggcagagttcctgctgagggtggtggagctgtgtgcagagacatgcccgtggcgccagcggggggcacagggcagccaggagtggggagaaggttgaatgtcaggctccagagttccaggcagaggcgggaaccatgagggcagtttcctcaccaccaggaaggggctctacagctcccatcaagaagcccgctgtagcctgaggtcagctgctggccaggacctcaaccacagcctcactcagacacctcttgcaaggagccatcccggcttccactatagggaggagcaacagaggctccatccaccctgcagggctggtcagccgcggagctggacccattctcttacgcatgtgctgcccccaggtaccttcagcatctcaagaccccaacaggatggctgtggaggggctggctgctactgacctcctgcaggtggtcccacaggttcaggtagatggtgttctggtaggcaaaggtgtggaggtaggactgtggaaagacggggcacagtgagagcacagctggagccccccaggctccccctctgtggtgggcagaggcccgggtcaagggcgaggggcagaaggagacccaccctcatggctggcccagggtgcagtactcaccgccaggccctgcttgaatacgtcctcggacaggaagctggagagcatcctgaggactgaggcgccctggggtgggggtgagggggcgctcagaaggctgtgcagagccaccaggaccctgtgcccccagaccctgccttcagtgaggcccctccaggccaagtccccacctccttccccgtgccccacgaggagcgggctgcaccttgctgtaggagatggcgtcaaacagctcactgatctgggccggcgtgttgatctccgaggcgggtgtggacagcgggtgggaggaggccagtgcatccactgccatcacgcggtacacatcattcagcaccatgaggtctttctgcaaattccccagggccatcaggagactggcctggtagcggtggcccaggtctccctccatgccccccgcaccagacccctgggcagctggcttaccaagttccaggtgggctccgcatagtcagcacccaggtactccacgtaggaggcgaagccctcgttcagccacaggtcattccaccactctatggtcaccaggttcccgaaccactgtggggggaggggtcagctgggcaagccacgcccaggctgggcactgagaatccccagaactaccctccccagggctggccatctgccaggcacagtggggatttcaacaccatcgtgaccccttcctgctgccctgccaggcggcaccctcctcccttctcagcagcccggggcagagcctggacttgcgccgtctcctctcggagcccctgtttccttctccgcactccccgagatgggggtctacctggtgggccagctcatgagcaatcacagtgaccacccgctccttgttgctgctggaggaggacagggggtcgaacagcagggagttctcccggtaggtcaccagtccccagttctccatggcgccggcgttgaagtctggcaggccaatctggtctggggaggcgatgccattggcaggatgaactccgggagtggagctccatccactgcctccctcctcaaggacccccactcacctgattttgggagtgggtagggtgtgtcataatgaccagcaaagaagttaaggatggggcccgtcacgttcagggcataatcgccgtggcccgccgcaatggcactgggccgggcccagatccggatctgcaaggtgtgaggaagaagcagaccaggggctcctgtttgatcctggggcaggtgggctgggtcccagggcccagtgggctggggggatccctgatgggccagggctggaggccaatcaagctaaacctagaggcctggtcagcagaggggaacgctactggggtctggaggctgtgggtcctagagaagggcctttggagaataacaatcatcatagccaccgtctgtctggtaaccggtgggtcaggaactcccttcatgaagagaaaccattgttttcatttttcaggtgcagaaatggagaaccagagaacaagacacttgcctgaaatcactcagaggtgggattccaaccctggcctaacaattcagaaactggcacagggatgaagagaacgggaagacccctcaagccggggccagcccacgtgaaggagagatgggcccagcctcataccaagacaccattggatgcctgcttctccacgtagtcgaactcactgacaatgaaggccagcaagtacgtggacatcttgggcgtggtgtggaactcagtgacattccagttggggtcttctggaagtggggtgctgggacctgggcagggagcatgtgtgtgtgaggacgtaccctcctgccccacaccccagcccagggtgcctgccccctggccctgtggccgcaggcagggcccactcacctttgggaagcatgttggacagggctgtcaggtccttggggtggataagcgtgatgttgaactcggccttcatggccggctcatcgaagcatgggaaggacttccgggcatctgcagcctgcatctgtgtagtggccaccaccctgccccaacaggaaggttagagggtgtgccagagctgggggtgtgggaggggctctgaggatgctaccaggcatgcagggaaaggggtacatggaaggctgccccagcctaacccctgctcctgctcccacccccgcctcgccgggagcctccggagccctgccaggccagctgactcgtgggggttggggctccttctggattcggggtgccagcaggctctcagggacctcgggtgagtttctctcctctgagcctcggttttcctgtctgtccaagggacgctctgtccctcatccccagctccctggtgaggggtggggaagccctcccagttcggtgcatttgcagctgctttgccagcagctggaggtgaagcaatgggccagtctcgggctccacagggttcaaaggcctgcaagctaagtccttccttggccctcagaatccagccttgcctcagcacctcggatccaccccaccgggcagcccagccggaactcactttctgacattgccctccatgtactcgctgcggtagaagcccgccaggtcatctgccaactccccctcgaactcgctgtccatctcatactggctgtccttcaccagggagcccttgaggtgcaccaccaggtactcggtgggctccaccagctcagtcttgtcaatgtcggggggctgggagcctcccacaccacgcaggaccaccctgtgcccctggctgagggtgtagttgagcttcttgctgtggatgatgatgacgtcagtggcctccttgcaggtgaaacggacggtgctggagcccttaaaaacgtacaggcccctgtcattgggggtgaggtacggtctcagcgtcacccggtaggaatcgggtttcagcgtgttggggaggcggtaacgattccacgctttactttggtccaaggtggtggccgaggcggggttggtggtggctgaggcggacggggtggtggaggccacgggggagctgttggcgttcttgttcttctcctgggagtacaccactgacagtgcgatgattgtgcacacggctgccacgcccaggaggatccccaggatgcccagggacttggaaatatagaagcccttggccatggtgatggtggggaggcggctcagggagcctcaggccaggcagagaacggagcagccccaggccgggcttatatccccaaaggggaggagccccacaacaggcagactgggcaaaaattaaccagggctccaacaggcgaaggtcactggactgggcaggggcacgctccgcctggggagaggagatccaggaacggtgtgtggagctgggctcggggggtgcctgctggaagcaaacagtgtctggttacaggctgcaggcggcctgggatcaggcccgagggctgaagggcaggcttccggctgtaggcccagtgggcaaagcaagcggccaggtggcattgcattgatctgcttgagagctgagagggtgggaacagcatcagaactgaggttagagtcagggaaggacttcccaggggcaagaggtgggaggtgcacagagaaggggttcccggctcctattaagaacacactggggtcacccctttggttgcatctctggaaggatgccaggggctcctcagtgacaaggtcccagcctcccttgcattcttcaagagcagggagttcctccaggttcccctccctgccgcttcttgccaaatactttttcctccattatcagctcacggaataaaatgaaatgagttgttttgctttttttgctgaaggcttcacctctttccagctgtgaccttgagcaggtaactttacccttctgaacctctctcctcataaataaataacagtatttgcctctcaggtttgttgaacagatttagtgagaaaacatattaaacaccaaatagtagaatgattaaaaatcattcccggctgggcgtggtggctcacgcctgtaatcctagcactttggaaggccgaggtgggtggatcacgaggttaggagttcaagaccagcctggccaacatggcgaaaccccgtctctactaaaaatacaaaaaaaattagttgggcgtggtggcgggcgtctgtaatcccagctacttgggaggctgaggcagagaattgcttgaatccgggaggcagagattgcagtgagctgagatcgcaccactgcactccagcctgggtgacagagtgagactcaaaagaaaaaagaaaaaaatcgttcccttctttcttacccaaagctcaacaattgcctctttctatccttggtagaaatgaagatattacttaccatacaaaataaaatacacaccttacaggaaaattatgttcattgtcactttccccatccaccagcccagtttctcagacctcgacaccgcctgacctcactccacatccaattcacccacattcccccatcgcaagatgcacttggtcaaaaccattctcatcatttatgtggacacagcagcgcccctatggactccctgcctccattcgggcctgcttgaacctgctcaacacaaattggatcattttatgccactgctaaaaaaaaccttccttttgcttgtagagtccagaccagaccttctaaaggcacccacaagcccgggtacagtcagcctgcccatttcctggcctcttcccccctgttgcagtaccccagccactctggccttcatcaagccccagggccttggcacaacctgttccctctgcctggatcttctcttccctattgccttggttaattcctttccatcctacaagtcttccgcagcgaagccgccctgacctccctgaccaagtcaagctcctatgagctccattagctccacagacctgttctgcaaagccccagaactcagcgtggttttccctttgatctgtgtggtgataacttgagtcctggactgcaggccccatgacagcagggcctcaccagcacttagcacagtgcctggcacacagtaggtcctcattactgagatgttgagtggatgcgcacatgcacgaaggattgagtaaatgaatgaatgagtcagtccaggagaaactccttaccaaagtctttctggcctctgtctcccagcttgtccccaccccacacctgcccccagaagaagtgcctgcctcttctgagcccttctccaagcatggcaggcaggccggactcgtgccaggccccagcatgtcagggccccacatgccttcctgctccctcagctctgctccctgagggcctcactcgtctgccacccctgccacccctgccacccctgagcttgcaggaaggcttcttaaataaatgcaatgtgtgaactgaagggacacgtggattagttcaatcaggcataagcaaaacacaaatacctgccgcctctcgtctggtgtatggaggccgagtctgagcccagggtctttaggggagtcctgggtgcccacctttgagactgagggtgttctgagcctttggcatttccccaaggggccttggtctgggaccaggatggacctcccactgcagtgactagcagacaccccattaggcttgggtgatgaccccaaggggcaatcgtgcgaaatcaggtgtcaggaagggctccagcttgggcgtggtgagagaaggagcagtggctcccagcacatgctgccaggctcctcccatcagggtggatggaattcgccaagggagcccatctttacagcaccccccaggctggcactggggcaccatgcctgcccctgaaaagccttttgatatgtccctgacggagcctgcagccccctcccacctttgcagcagaaagacccacaagtcggcctggactaatcccttttctaaacaaagaaagaggccctgcctggcccaccatactctcttcctgtttgctttggattcagaccataggcccagctggctggaatctttactcttctggacaaggcctctggtcttccaagttggtgcagcaggtagcccaaagttggctctataatgagaggtccctgctctaggcaccaggccaacccaggctgggggcacagagacagccatgctctgcagcccccaccttcaggaacacacaaaagggcttccctcgtccagtcccctgccacagcccaggcctggccacctccacaccccatcgggcagtggcggctatgctaccctcccctgtcacccaaccccaccagcacacgtcagcagagggctctgcctaagagtgtgggtgggactctcccattcaaacctggtgcccaacctgcagagtgaaaccttaactctggcttgggccttaataccttctgtgaacttgaccctctggcctgtcctctttctactgcccactgtggctccagctgccagcgtctccccagatcatcggggctttttcatacctctgtgactttgctcattctgttcccactgccaggaatgcctttcctctccctcttgtcaaactcctactcatccttcaaaacccaactcaatgtcactgccttatcatgcacaccagcccccactcccctctgcgcttccccagtctccagttcccacctctatcacagcacttaggaaaatgccactgaggctgagcgcggtggctcatgcctgtaatcccagcactttaggaggctgaggtgggcagatcacgaggtcaggagttggagaccagcctggccaacatggtgaaacctcgtctctaataaaaatacaaaaaattagctgggcatggtagcaggtgcccgtaatcccagctactcaggaggctgaggcaggagaatcgcttgaactcgggaggcagaggttgcagtgagccgagattgtgccactgtactccagcctgggggacggtgtaagactctgtctcaaaaaataaataaataaataaataaataaataaaaatacaaaattagctggacgtggtggcgcacgcctgtagtcccagctacttggggggctgaggcggaagaatcgctcgaacccaagaggtggaggttgcagtgggcggagatcgtgccactacactccagtctggacgacaacagaacgagactctgtttcaaaaaagaaaaaaaaaaaagaaaaagaaaaatgctaccagtgtgttcaaaagcctgctgctgcacccaagcacctcaaaggaaggcctggtggcatcgtatgcccctccatgcccagcacaaggcaggagcccaatacatgttggccaaatgaatgacaacacccacagtccttgccgtgacctacagggcctgtgtgatccagcccccagtgattctctggcctcatctcaaacgctctcccctgtcacttctgtgctccaccccagtggcctctttcagttcaaatccaacctgcttttccccgcttcattctcccttcctccctacacacaagctgatccttgggcctggaaagcttcctgcctttgcttcatccactccccacttgccctggagacacaagtcagtggtgctgcccccaggcagccctccaagtgcctccatgagggtagcaccaggtgtgccgtatcctctacacctggcgtgcagtgggagggcaacacgtgcttgtggaatggggcatcagtgcaagaatgagagacagcagttaaggatggaacttcagagccttgatcctcgggacaggttccaccctctctacccgacattccttcctgggcttctgggctgtgcacaaaccaccttcgtgatccacctttgtgattatttacttcgtatttttctttaaatcaattcactttcttagcctccttctgagcgataaaatcatggttggatgtgttaatttatattaacaattcatgactattggtttaaaaattgttcctgggccgggcgtgttggctcatgcttgtaatccctgcacttcgggaggctgaggcggacggatcacgaggtcagcagatcgagaccatcctggctaacacggtgaaacctcatctctactaaaaatacaaaaaattagccgggcgtggtggtgggcgcctgtaatcccaactactcgggaggctgaggcaggagaatggcatgaacccgggaggcggaggttgcagtgggccgaaatcgtgccactgcactccagcctgggcgacagagtgagactccatctcaagtaaaaaaaaaaaaaaaaagaaaaaaagaaaaaattgttcctctaggtagctcctaaaaggatcctgtccagttgcacccgctttgggaactgctgctccaccctgtatgatgttggggttgctggccctgcgggttgtctttggtgcaggctctttctgccagtgagcaaaatgcatgtgttcctttcgctgtgaatttcttgacggggtagaagccgagctctcaacccacttcaactaaagcagcctttctatgggtttatgtatttcttccctgcctatgttttagtccagaaaacgtaagttcttctaaactaaaaccaaagccaaaaccaaaaaacatgaaggttgacaacgatcatgccagggcataactaagtcacagtcacagtgtggaagacacccacacttgtgggtggggagaggctccttggtctcagatgtgaagtgcaagaggctttctactctaatatgaagactccaggagcctgggaggggctgtggccgggagagctgagcacccgtggccgggtgagctgctgtgttatccatgctccatccccgaccactgggtccttgggtaggccccacccactcccactcagtgtccctgactgtgaactatgagactgggagctcagggacaacctggggctcattgtctgctctgagggagcagtgagcgagaagggtagggacgaggctgggcctgggccagggcacactctgtccccgcaggcccctggctttctcccaggcttctgaggcctccgcccatagctgcatcaccccagggtgcttcctctgggagccttggacattgcccctcctgcaagaacctcagaaggccccaatgggaagttgcctctcatcagcctcttcagcccaatgcagggcacacaggaggaaggagcagaggcatttgtgggtgggggaagtacacatagggtttgtgtggggccacagatcctgcctggcaactcctgtctgccaaatggggggtgattatcctggtgagacacatggtaaggtgaaactgagcacctactatgtgccctaccaggataatcacccccatttggcaaatgaggacactgaggcacagaaaggttaagtgatttgcccaaggccacacagctagttagcagcaggttccacagcttaactacatatgcctcctaaaaatgtcctcccatacagcccctcacatctactgtggccgtgccaaggggagttgaagaccacaggagaagacacgcacccatttggccagaccagggctgggagctgggggtagttctcagaagtagaacttgttagccagggagtgctgggggctgcttccagacacaggcctgtggaggacccacatcttgcctccaaggtgtgactgggaccactgtagggccaggagtgacaggcacccggggtgaagcccgggctagggatagatggctgccagcctatgtgaataaggacaccccagggcctcggtgtgcggctgacacactgtccatgccatgcctccagggctgtccaggagccccagcatagggttccagatctcccaccagagccagcccaggaactggacccagttccaacaccttggctccttccgacatggggacccccatctatgtcctcagaatgcctagcatacaattcttacagcgatggggctggaggccttagcttaaaggctgtaggggtgtaaggagcgccagcgtgtaacgaaggtctcattccccagaaggctctgggggaagcacagggcaggcggctgggctgcctcaagacactgggccggtttccccacctgtgaagcgggagcagcgctgtgggtggcctccttgcactcatagtgtggccttcgaggctagggctccacaggaaggtggctgagagtggatgagggcctcatgggcccagcacaccctcccacagggagaggggagtccaccctcttccctgcccagctcccccatacccactggggctagccagccttcctgtgggacagaggctgtccccacttcctcctggtcacccctaccccacacgcccacctcccctccacaaaacacataccctgaggggccctctggtccaagcctcccctttcacaggtgaattaactgaggcccagtaaggccagggcgtttagagactcagggatgaagccacatcagacctcaggtctggctgagaccagggctctgaccacccccgaacacggcctggtgggttgcagtccaggggctgaggtgggggaggagtggggatccagtcacaaaaccccaggacatagcccacctgggccgtccctgcccaccgcactgctggggggggggggtgcgttctggagtcatttggggaaaggatcccattggccctgtttaggggaccttttcccagaccaagagtggattgcaatggggccctggatctgtctcagttgctcaccagggagggcgtggaataggctccacaacccccaaacctcggtccccatccatgccccggcatcttggccgggttgtaggagcgagggagaacgcgactgtaacgcgggcgttgagcacctagagttccccttcctcttcactgagagctgcggcggaggctttagaccgaggagcgagatctaaggttaaagaaagggcctctgagcccagtgttggccagagaccccacaggcgggccgggttcgccctttgccttcggccgcgccccacccaccagggacagagtggccgcggccgagccgggtccacccgccgcagcttagctccgctccgccgccctccccgtccgtcctccccaggctcccgtcgccctcgcccaccctggggccccctccccagatgggagcccctccgacccctgcgaggcccgctggggacccacttgaccgcgagatcgtagtgggagctcggccaaaagaattcttcgctttccctggccctcagtttacccatctgggaagaggggcgtcgcggccgcagaagtccagctccgcacgcgccaagcgctgggtctgcagctccctcggttcccgcgcacccaactgccccacgacccctacccgcgcccgcagcccccgccctcccgccccacttgcctgggccgccgggcgctggaacctggaccctggaccctggcgggttccgagctgcgccgccgccgtccctgcccctccagcactggactcctcctttcccgtctttttaaagggaagtaaccggacccgaccactactccacccgattcacccctagcgggccgcccgcccgcagctccgcccgggctcctcccccgtccgcccgcggcttcccgggagccccccagggctcctccgctcctccgacggcccggccttccccccggggcctgggatgcaccagggctcctgctgcccccgacggggtccctgtcgccgcagcccgcgggacccgccggccacatctggacggcatctgccgcgggggaggggctcagagcctcgccctgagtgtcccgcagggagccttgtgcatccggggcaggaagccagcgcatcccgtgcagacgggtggtgcagataacggacccgccacagcacgcaattcaactttcttggtacctgggactcgtagttcagaaggcgcagtagcacgaccttgcgaaaaagcaccggagtcgggaacacgcgcttctcatttttttctttttcctttatttgtttttgagacagagtctcgctctgtcgctcacgctggagtgcagtggcactttctccgctcactgcaacttcctcctcctgggttcaagcgattctcctgcctcagcctcccgagtagctgggactacaggtgcacgccaccacgcctggttaatttttggagttttagtagagacagggtttcaccatgtaaggctcgtctcgaactcctgacctcaagtgatccgcccgccttggcctcccaaagtgctgagattacaggagtgagccaccacacctggcctgcgcctctcatcttgatcctgcttgcagaggttgtgcagccaccggagccccgccagggtggggctccctgtctctgagcagctttaatgggcggtaccagataatatttgtattggttccctgtggctgccgtaacacaaacataaaacaacactaatttactatcttacaagttttgtaaaatcagaagtccaaaatgggtctcgctggactaaaagcaagggggttgagggatacagctttcttgaggctggaagggaacctgtttctttggcttttctggcttctagaagctgcccacattccttggctggtggccccatccatcttcaaagccagcagtggcccaccagtctctcacaatctgtcactctgacaccaactgttctgcctcttgcttccactggtgagcatctttgtgattacatcgggcctacccagataatccagggtaatctttctattttaaatcaatggattggcaacttgaattccacctgcaactgtaatttcccttcgtggggtagcataacatattcacagattctgggcattagaaccagggcatcttttgaggaggaggatatgattatgtctaccacaatattcaagctgacttccagactttcagatttataatcaaatttaagctcttccttatccatgattggaatccttgggacagttaaagccttgcactgcatggtccaaattgatggctttgtgactggctgtgttttattattttacttgcacttgctcttcttttggaaacttcatggaggaccagggtacctctaggtagcagccttgcttctccttcctaatttgctctgtactcttaaaaaccaggtcacaaacatatcggaatatagaattgtgtgtaaagtaagagtaagtaggctgtgagtgagacctcagaggctattttgttttttttctctctccagtctcatgcatgtctgactctctccactatcatatctggcataatctcctccatgtctgacaagccaaggaaaacactacatcaggccaggagagaa

SEQ ID NO: 1029 - DNA, 22594 bp, Homo sapiens
gccactgaactccagcctgggcgacagagtgagaccctgtctcaaaaaacaaaaaaaaaaaaaaaaaaaaaagagacgggatcgggaaaaggaagaaaagaccacagcacaattttggatgttagaaagcaaatggaccagttgtgactgatttagccggccttgggaatgctggtcatgagctggcagtgagaaaagatgagttccagcctgacttacaccgctggattctcaaaaggcgaagagatgatagtagggctcctgccagcccacgctgcacctgtgtgtgcaatagaaacagcctcccctttctcaagacactctacagccgtctgccagaaatttgacatgataaatatacaaatctgtcatgtctaccctgtgagggaggtggcctcagaatgatacagtgcacagcttgcacagccatatatgactgtcctgaattgggacaccagtttctactgaaagtagaggtgacggaggaggctgtcataaaacatgaaagattggttgaaactatttaaggagcagttagagctttagcttccctgtctcaccttagtagaagactggaagtttattctcttgaacgtcaggcagagttgagggcaggagacctgtactagcaagaggattaaatcaaagtataccctctgaaatgctgaatcaccctcctgcttcttccacttggccccagggacactgtattcaggcctttaccctccaggcagaagagtgaaagacatttcttaggggaatatgtccagctcaagaggtaagacccaaagattttcacaatggggttccccagctaaacatctcagtggatcaccctgcagtgacattcatagtcaataagtactacgcacgtattggagcttcaaatcacctttaaaatctcccattcttttcttttttctttttgagacagagtctcgctctgtcacccaggctggagtgcagtggtgcgatctcggctcactgcaagctctgcctcccgggttcacgccattctcctgcctcagcctcctgagtaactgggactacaggcacctgccaccacgcctggctaattttttgcatatttagtagagacagagtttcaccatgttagccaggatggtctcgatctcctgacctcgtgatccacccaccttggcctcccaaagtgctgggattacaggcgtgagccaccgctcccagcccaaatctcccactcttaaacttaagcaaccaaggattaccagtcatttgaggaaagattctaacatgaaagatagagacccaaaacaaacaaatatttaaaaaggaagttagagaaaactgagaatatacagaaagaagaacattgaaaaatgccattaataacatcagagaatgaaaagattacattgattaaacaagaacaggatagtataaaaagaccttcacagaataacaataacaaaaactcttagaaattaaaaaaaagatagtagaaataaaaactgaatagagagtaaagaaatagttcagaaagggagagcatgtagagattgaagtaagaacaaagataagaaaatgagaggatccacgccgggcgcagtggctcacgcctgtaatcccagcactttgggatttaatataaatatattaaatattttaaataatataattttaaataatataaatatattaaatatattaaatatttaaatatattaaatatttaaatctttttgtcttgctgagttgtatgagatatatatatatttatatataaatatagatataaatacatataaatataaaaatatatatatatctcatacaactcagcaagacaaaaagatttattaaattcattcagtcaacaaatatttattgaatacctactaagttctagtcatcatgctaggcactgactgttcaagaataaacatagacaagacttctgccctttcagaaaccagccaagattcttcaacccaaggcagctgtgaagtataacacatctctggctcaattttctccatatggtttggggttccatgaatgagtctgtgggaagatttcctgtacgtagaatgcatgtataaaggaataattattctatggttcgaaagagaaaaaaagtaagatcaaagtgtagaagctatgttaagaaagattccagtttaatgatttttgaaagagcagtaaaaataagaccaagatgtggaagctgtattgagaaagatccaatttaattctaataatctttaacagaattgcccaaagatagaatgaattgttttgagagatggtacagttagctgtcagtgggagtgttcaatactaagcaagattcactcgctcaaccattgagtgatgaccacatgcaggcactgtgctaggctctctgtattttcagtaagctattgttgtacaacaaagcaccctaaaacagtgtcttagaacaacagtaaatgtttatgatctctcacaaagtctgtgggtcagcagcttggctgtgtgtttctggttcagagtctgtcatgaggttgcatctgaaggcttggctgaggctggaggatctgtttccaaggtgaatcactttacatggctggcaagttggtgctagctgtttggaaggggcttcagttcccccctgtgttgacctcttcacagggctgcttgcacgtcctcccaacatggcagctatcttccctcagaatgagtgatccaagagaaatcaaggtaggtgccacaatgccctttatgatctagacttagaagtgaaataccatgacatagcctattgatcacacatcagccaccattgtgagggctagctaccacatcctgcaaatacaatgatgaacaaacaaatggtgtgcctgagctcgagggctgttagcctagagttaagatcattccttaaatgatatcaaaggaattagggctgagagacaaggttgttccctccaaccctaatgccctgtgatcttatgattccaggtcctaggtcttttgttcccatatcaccaatccattatctcagaaccagcagctcaccaaaccctcgctcctcagatgtgggccattcgggggtttttattgtgcccctgcattgtcagctacttgtcatcacacagcaagatagcatgactccaccctgcacgctctcagacaggagacaagggagtgcccaaataaccctaagcttgttgtttctgtccccaggacatacctcagcctcctcctgggagcacagggcatactatgataacagcaggaggacacggcgtccccatgcaggagctgcttttgatcctgccaggacaatccctcaagagcagcaaggccctgtatgtacaggaagagagtggccctcagatcacttccctttgccctaatcagggccacgtagtacaccagagacctcaggggtagtgaccctggatgttctcagaggacttctgacctttgaacttggggatgggcataggagtgtggctagcatctcagcctggcccaaaccagtgctggtcagcatgcctttgaggcactaacccaggcccacagaggagtcatctacttccaagtcacctgaggagccagtggtgaccagggagataatggcctgaaattgtgctggctctgagggactgttgggtaagctaatgtgggctgggctggagttcaaacacacctccctggtgcccacagggacctcccagcacacgctctcctatgggtctcaatgattcagtctttcctggtggcatagactgtagcctggagaagctctggggaatatttcttttcttacttatttctggttttaaaagtactactctcaggatgactattgttaaaaacaaaataaaacaaaaccaaaaaataacagaaaacaacaagcgttggagaggctgtgaagaaattggaaccctgggcgtcaccagtgggaatgtgaaatggtgccactactataaaaaaacagtttggcggttcctccaaaatttaaatatagaattaccgtgtgacccagcaattccacttctggatatttgctcagaagaattgagagcaaggactggaaagatatgtgtacacccccattcatagcggcagttttcacaattgcttaatggatagagttttctgtttggggtgatgaaaagattttcagaaatagtggtggcggtggttgcacaacattgtaaatgtaattaatgccactgacttgaacacctataaatagtttaaatggtaaattttatgttataaaagtaatactaaagtggtggcatttttttcttttcttcttcttcttttttttttttttcttgagacagggtcttcctctgttgcccaggctggactgcagtggcatgatctcaactcaccccagcctcaacctcctgggctcaagcaatcctcccacctcagtctctcgagtagcttggaccacaggtgtgcaccaccacacttggctaatttttgtattttttgtagagacaagttttcgccatgttgccaggctggtctcgaactcctaggctcaagcaatccacctgtctcagcctcccaaagtgctgggattacaggtgtgagccaccacacctggcctaaaatggcatatttttttctttctcttcttttttttttttttggagacagagtctcactctgtcacccaggctggcagtggcatgatctcggctcactgaaatctccgtctcccgagttcaggcgattctcctgcctcagcctccctagtagctgagattgcaagcacgcaccacaaagcccagccaatttttgtatttttaatagaggagggggtttcgccatgttggccaggctggtcttgaactcctgacctcaagtgatccacccgccttggcctcccaaagcgctggtaaaaaaaaaaaaaaaaaaaaaaaaaaaaaaatcccattccaccacttgctaggtaatgtacctcaccattctgaagtgcctcttcctcatctattgtgtctttgatgtgatggtcgatcatgagaattatatgagccaatatggtaatataaggtggtttttaaaagcacctcacactaccagcattgcagtcagcaatgaattgccatccttgcattgaaaagctctacaaccgttgccactgggcatttcttattggccatcatttgtagggggctttcacctcctcatgtattccctgttttcccttctgtgacctcccctcctttcctactcttcattaccacctcaaatgccagtgcagggaatgcacggaacaattgactccatctctctgccttgtggtctctttccagccagttcctctgggtgtcctggtcaacagctagcatgcactgtcaatgacattctctctttcagaggtattctaggtctaactgttaagctaacaggattttcacttccttacacgttcacataccaatatgtatgtgtgttccttgaccgggttgtaaagtacataatagttgaaaccttgcttttttttttttcataaaatatcttggacatcttcccataaataaacagattccccaaaccaaaccagagtgttttgcttgaactcaggacctcatgagagatctgagaccagctgttagagaatctctgagaagggcaggtagaggctgttgcccaggtccccagtcagctcagccgctggagaggagcagaggactgactggccacagggggactaagtccacctgctagctcagaacaggaggaaggctgctttccttggaagatgggaccaaccctaatgaggactaataagtgtatctcagacaaaccaattgaccaactggaacaggccagagatgagggtgtgtcttccaaggcccaaagcaagagaaacatccctaagagggaaggggtgtgtggggtgtgtcaatcaaagtgatgtgtgtgtgtttgtttgtttttgagacagagtcttgctctttcacccaggctggagtgcaatggcctgatctcagctcactgcaacctccacctcctgggttcaagcaattttcctgcctcagcctcctgagtagctgggattacaggcgtgtgccaccacacctagttaatttttgtatttttagtagagacgggggtttcaccatgttggtcaggctggtctcgaactccctatctcaggtgattcacccacctcagtctcccaaagtgctgggattacaggcgtgatccatcacgcctggcctcaatcaaggtttttaattgctagccacagaaacctactctggaagacataatcagaagatgaacttactgacatatttccaggaatttcaaggaaatgtctaggaaagctggagtacttggtttggaaaataaacaagaataaggggagctgagggagaaacatggccatgctcatgccacagaactagagtgatggggacggctgtgctgtcaccactgagccaggatggggacagcccagtttgcccaccagccactgccacgcctggtccctggcctgaggctctagcctggccgcaagctgcctgttgctgccgcactgttcctgcccaccccagaaaagattctccactgtctctgtttctttacaccagtctggggcaattacatctgatttgctgagcataggtcccatgtcccatgctggaggtaagcgaggctagaaggcaggcgactggagttgttagtgtctgtaatggaggcagcctctgactcccaccaaaactcatcagcgagacactttcgaaacaaaacaggagagcttcagaggctgggaaagtgtcttagatcttttgggcttctataacgagacaccaaaaactgggtggattacaaacaacagacatttattcctcatagtcctggaggctgggaagtctaagagcaaggcaccagcatatcccgtgtctggtgagggcccacttcctggttcataaatggcaccttctcgctgtgtcctcgcacgtggaaggggcaagggatttctgtggggcctcttttataaggacactaatctcattcatgagggctcccccttcatgacctgatcacctcccaaatgccttctctcctaatgccatcaccttacagattagaattgcaacataggaatttagggggacgcaaacattcagttcactgcagcagccaaaagcaaagttactaccaagagacctctgccagacccaggggattgatgagacatcttggtacaggaaagagaaggcattcctcatccaggaggacgaggactgtggcaggaccctcagagacctgcaggatggccctaagggtggtgggagaggtgcacgggtctaatccaggattcatatatagatatattcatatctatattcatatagatatgaatatatatatatgaatatctatacatgaatatctatatgaatatctatatatgaatatctatatgaatatctatatatgaatatctatgaatatctatatatgaatatctatatgaatatacatgaatatatgaatatatatgaatatatgaatatctatatgaatatatatgaatatctatgaatatctatatgaattatatatgaatatctatatgaatatatatatgaattatatatgaatttatatatgaatatatatatgaatatatatatgaattatatatgaatatatatatgaatatatatgaatatatatatgaatatatatatgaatatatatgaatttatatatgaatatatatgaatttatatatgaatatatatatgaatatatatgaatttatatatgaattatatatgaatatatatgaatatatatgaatatatatatgaattatatatgaatatatatgaatatatatatgaattatatatgaatatatatatgaattatatatgaatatatatgtgtgtgtgtatatatatatatatatatatattttttttttttttttttttttttttgagacagagtttctctctttttgcccaggctggagtggtgcaatggcgcgatcttggctcactgcaacctccgcctcctgggttcaagcgattctcctgcttcagcctcccaagtagctgggattacaggagcccaccaccacgcccagctaattttttgtatttttagtagagacggagtttcaccatgttggccaggatggtcttgatctcttcacctcatgatccacccacctcggcctcccaaagtgctgggattacaggcatgagccaccgcgcccggcccagggttcatattaagaaccaagttctgggagacactgaggcccccaggggttctggagtcagcactaaaccaggcagccctcaggtgaggtctgagagcatctcagaagcttccagaccctcttggaacccggcccaccctgcatctcacttccttttggtgactcgttgctctgtttggcctcattggccctttcctaaagccatccagtaaacctccaggtgcctggtgggtttgtcaaggtgtttccccataggttcctgtgcttctagtgggggtaggtatcaaagtggccgcagcagccttactggcctggtatgcaggagcgagagcagctggggcaggggagacccgggggtctacccttggccagctgtggcggtctcattaatagagtgtggcctggaggtgagcgggatgaggaagtcacatttactgcagcaccagctattgcacggttattctgtgcctgatgttaagtgcttgactccgttgctccatcaaaccttcagcacaactcctctctaagcagaggattgtcattacccatgtcttccaaaagaagctcaattattcgccccacatcacccggtagtcggtcaaaaagccaggattcaaacctaggcttgtctgattcccaagcatacatccctcccaccaggccagcaccaggggccagaggggtataggcctgggccagaccatgctgggggccactaccctgagggcaccttgagagggaaggaggaggccccaggacaccctccaaggggacttccccctcctccttagcatgttccaggcctcttccaggaaagccctgaagggcctgcatccccctgtggcgaggaaagggaggtggctagactcgcagggctggggtccacgggtaacaggctgtggagtcgtttgagacaaacgcttgaactggctctttccttgtgaggttttcgagtctctaagggtggggtgaaagaccactccaaggctgcagctgcccacagctggctgtgctgatgagactgctcaggccccctgactctctgcccctaaccccagtggctgcaaactcagccccaaactggcaggccacctggcaggaggcccctggacagagcagaccagggccccgcaggctccagcacctgctctgcccctcctccccagactcgtctcggtccccaagcctcaatccccaattctggatggagaccacaggtttagcagtcaagaaagttctgaaataagcatgaatcgctttcataatggaactggggtggggtgggttaaatgacactacatgaataagttaaaggcactgaagatctcgtgcaaggaggaaccatctcccccagtgtactgtgagccccccagggccagggaccctgttctgctcgcctccaggtgtccccctcagtgtgaggcagagtcgggcacatggctgcacaaaagctgtttgctggttgtccggtgcctagaataatgactggcgcatcggaggcattcaatgcatatttgttggctaaatgaatataagtaggttgcatattttgtcttgggataatgtgtgacatctttttctgcctccccttagaggactccccatgtactcgcctccagtccaccaggcccttacctctcctgcagtctcatctccccaatcctgggtgtctcctgccaggccgctgctaagctctgcccagtcatggttacctccccacctccccagctgcaaggaggattcatccggcaaccagttgaggctagattctcagcagctttattgaatattgagaggtggtctcacctcccactggacatgtgtcctcaagttcataccagaacttctttgggacagacagacagacaggtggcagggcagggcaggtgtccacgagggtggggccagtgcaccaggggcagctcagctctccaaaggggccagcatctgcacctgctcctgctgctgctcctgctgctgttcctgctgttgctccagctcagggagggagagagtcttgtcctggctctctttctccttgaaggtgctgaagaaggagttgaccttgtccctcaggtccttctccaggaagctcaagtggccttccacgtcccccgcatgggggcccagtttctgcctgagctgttccatctgctgcaccagggctttgttgaagttttccccgtagggctccacccggcgtcggaactcctccacctgctggtccaggtgcccacccagctctgccagtgacttctgcagcccctcggtgttgcccctcaggttgccacgcacgtcctcggccaagggcgccagcctctgccgcagctcctcggcactggccgagatcctggccttgagctcctcggcgttcttcttcatctggaaggtcaggccctcaagctggtggttgagcttctcctgcgtgtcctgagcatagggagccaggctgcggcgcagctcctccacggtctggtcaatcttgactttgaattcgtcagcgtagggcgtaaggcgtcccttgagctcctccacgttctggtcgatcttggccttgagctcgtcggcgtggggcctcagcgaggcctgcaggctgtcggcgttctcccgcagcactctctccatgcgctgtgcgtagggggtcagctggcgccgcagctgctcggcctgcgtgctgacctgggtgcgcagctggtccgcgtagggctccaggcgctgctgaagctctcgcaggttgtccccgatcttctggctcacctcattggcatggggcagcagccgggccctcagctcctccagctccttcccaatctcctccttcagtttctccgagtccttggccaggcgttcatgcagctcggtggcaaagggcaccagcttcttctgcaggtcacctgcgtaagtgttcacttctccaagtttgtcctggaagagggcactgtggggaagggcacaaggaggccacgttacatttggcatttacacggcaagactttgtctgcttgtataccactcgccttatgcacacgtgctaggacaggtgagtgctcagaggtaccgagttcaccctccctatggtggtgcagattggagaggatgggtgtcacagactaagttacgatgctgaatttctatctcaggatctcccacatagtttgtctcagaatctacccaccatgtcacctccagcagtttgctttcccctccttgtctgcagagggtgggactttgaggtccttcccagagggagtgttctgggccataggatcacattgtgtaacacaatgttgtcttcttgacctctgctggggtcttccagtggcacaaggtgctgctttccttgcctgtgcccaggggcctcccaaatattcccacctccctccccttgattccactggggcctgtctttctgaaacgtattagaaatcagctcacgtgacattttcctccctccctctcttccatgagcctgaatgataggatgtggccatttgtcaaactctagaacgtcaaagcaaaaggacatggcagggattattcggtccaaacttccggtttacatatgtggatcctaggttcagaggcccggccagttagtggcagggcagtgggtatcctaagctcagggctcctgtctctaagctcaacccttgccagtacattgcatggcctttaagaattccccgtcaccaccgcacactgtagtccctcttacttgagttgctgggtgagttcagatttctggagatgttccacggcctccttggcattgttgctcagctggctgaagtagtcccacatcaccgtggccacctggtcagcactgacctcagccctggctcctgggtggtaacagagagcaattcatgaggccccgtctcctgtgtggcccctctgctccagctctgagctgcagactggatgatggtgggggtgcctcaacctgccattttccctgtctgagcttagctttttggaagccacagggatatgtgaaactggtatagcaccaatgccaatgggcccaccactgggactgggccagctctcctgtgagccacttggcagccaggcagacctcatgtccagctgggggctgatgggcactcagaagtgtccttttgctttggctcagcctccatcctgcactactcagagcagcagcccaggagtgccatccaaagacagcttctactcaccggcgacagccaccagggccagggtcaggaccacggccttcaggaacatcctgagctgcttgctgggctggaggagtttcttgccacactggatcctccctacaatcaggggagctgacagagaggtcctcaggagagctcacctgcgctgcagtgggaactgactgaagctcagagccagccagacatttaaactctctccctatcgccacccccctggctgccctcccctcctccttcctcagtgtgactccacgctggaaggtgacacattcccaagaggcctcttggacttttgtgaccctgagactacgtggaagctgacagcagatcagggctcaggcgatagttagaagtggtggctgttccgtgcgtgggcacccccacccccaccccaccaacctcagcatggaagggaggaggggaacggaaaacagtaggagaaacacctcagggagcccatgagcccgggactgatgcctcgaggccctgctggcggctctgggtttgtgccgggctcatggggggcaaagtccacatctcctctgtctaccccagtgaagacaggtccccccagtctccacatccgccactaatgctgactccatctcagagcaccagacactggagtgggaccatccaggactgcagacagcatagtgagctaaaatctaggtctcttgtcaaggtacacccaagaggagggggccctggagagcctttgggcagatgggtgtgggagacagggccttgtcctgaaagggttaattgtagagtgcttcatgtcccactcccatgctgtgcctccttggtctagttattcaaagccctgagcttcagtttctcctctgaacaatgggatggttcagtacattaaagaagacattgcttgcgaagtgggtagtacggtcatctctcagtctccatgggaaattgattccaggaccctctgcagataccaaaatccatggatgttcaagtccttgatataaaatggcatagtatttgcatataacctaagcacagcctcccacatactttaaatctctagattacttataatacctaatacgacggaaatgctgtgtgaatggttgttatactgtattgtttaggaggtaatcaccaaaaaagtctgtatatgtttagtacaggtgcaattttttttttttttgagatggagtcttactctgtcacccaggctggagtgcagtggcacgatcttagctcactgcaatctctgccccccaggttcaagtgattctcctgcctcagcctcctgagtagctgggattacaggcacccaccaccacgcccagctaatttgtgtatttacagcagagacggggtttcaccatgttgctcaggctggtctccaactcctggcctcaagcaatcctcccatgtgggcctcccaaagtgctgggcttataggcgtgagccactgcgccctgcccagatgcaatttttttaaaacattgtttttaatggagatggggtgtcgctatgttgctcaggctggtctccaactcctggccttaagtgatcctccaatctctgcctcctaaaatgctgggcttacaggcatgagccactgcacccggcccacagatgcaatttaaaaaaaaaaatatatatatatatatatatatatttttttttttttttttttttttgagatggagtcttgctctgtcacccaggctggagtgcagtggcacgatctcggctcactgcaagctctgcctcccgggttcacgccattctcctgcctcagcctcccaagtagctgggaccataggcgcccgccaccacgcccggctaatttttttttttttttttgtatttttagtagagatggggtttcgccgtgttagccaggatggtctcgatctcctgacctcgtgatccgcccgcctcaacctcccaaagtgctgagattacaggcgtgagccaccacgcccggcctaaaaaattattttcaatccaaggttggttgaatccatggacacagaaaccaaggatacagagggctgcctatagagctcctggcacagagtaagctctgaaaaatagttgctgttattataataatcatactgtataataatcatactgtgttcctgatttggagcaaagcagggagggtagcagagtgctccctcctctagtgagagtggcagagtgagactcagccctctgaggggcgccaggtgggccagaggcagggtgatgggtgggaccagcctgaggcctgactcctgcccttcttgccccccagccacactccctgggcaggagcagctggcttgagcagaatcttgggacctgaggctctcaggggacctcccattgggggatggagggcaatggtggtggtgcccaggaggtcttctacttagatgtctattggatctctaaatgaggctgcatgcataatcacacacaaacatccactgagaaggtgacacaccacgtcagcatgggtccctctgccggaccacaccactcctagtgactatgaggtgacatccaggcacgttgcactattggctcctgtcggtgagtgcagtgcctgacaacagtgagctacatttatttgtaaaaatgaacgccatcagagtagaccacaattgtactaactctaatttgctttgtgttcattttttcagtttccagaagtggcttaatgtttcctagggtcaaaggcagtcaaatgacctcctgactctggcaccccttctgctgggtccccactgccctgtagtggtccccacgctaccatgctgcctcctttttgatgcagcctgtgccatctctccgtgattgttggggtcagatgctggagtccactccctggcttggcatccaggctccaacacgtactgcctgtgtgtccttgggcaagtctcataacctctctgagcctcagttaccttggtgagacataaccattgtacctgcctcctaggctgtgaggattcactgagatgatcttatagtgcttgcaacaatgtctggcacataggaaaagtgatcactaaatgttagccacgtcttactcctgcaaggctcacctccctggaacccatcggtcccaaccctgctcctgaatcaggcacagtccagcttgcagcgggagcaaaggtcagtactcagtgcccctgtcccttccccaggccagaggggaggaggagactgagtcacgaatgacacctcagccgcagtttgacctccaggacttacagtcctagcagccggtgccactagcatgtgagaggtccagaggcgcttctgtctcacccgcccgcctgggtgcacccatgctgggagcgcctgcaccatttgagcatgtccgagagcatccaccagagtgtgtgtggattcacagaagtgtgcaaatcactaagaaccaagggactggcacagcccatgcgtgcacccacgctcgcgaggggacctgctgcctttcaacgtggcggggacgtgacctgttaatgaatgtatttacttcccaaagtctgagggtacgttttgcatcaatctgtagatggatttgttttggggagcagggagagaatgagagccccctgtgctcagtcttagagggtgcaagtagctgatgggaagagcagactgccttccagccaggcctggtcctgtgagtcagggacgtccatcttagtgggcatgaaaggcctgtgtgatctcgagggagacatcgcctctccaagcctctccttatctgtgcaacaggcagacttaatgattggtgaggcaatgaggctgatagctcagcattagctacagccacccctcctggccaaccacacagggatcaaaccaggggtcagtccagaggtcagagtcaggagcagacaactcagatccagccagggacaggcaggtcacacggacatgtgcctcacgtatgcttcaaggggccctcccccgggcagaactgaaggacagctcctgttgccataggagggagctgggtgagatactaggaggaacttccggcatgatgatgtgtgatgaacaagggcctctggccaacaggtctgaatcagggctgcccagcccagcctggtgggaagggcatggagcatgggggctcatgtactaaacctcacctggacacaaggtgaaacagcccaaccccagaggaccatttttggccccggatggtcaaatcccctcttcctcccatctaccactggcttctccctggagcagtcttcatcccaggggagccatgatgggagagaggggcagcgcaggctggccaccaagagatcccctgccggggtgcaggttggactgttggtgaggggccacaggtattctcaggtaccaagcccttggaaggagacaaggtaccaggcttcctggaggtgtgctacatctagctcagcaccctgccaggtctctctacccacatgtcctgacctccctgggtccgttgccatgcgggagagagaggccaggctcctccagaccctctgcagagatggaaaggcttggagggtctggggccacgggaccccgccagcccattctagcacacccgggcccatagaccttgttgcctgcccctgcctggatctgggtccccactgtgcctttgcctctggggctatggagcaggccgcagcagaagaggaaagggcatccccaataccaaatcctccagtgaccacttcttcaccttctaccccaccaccaaagtctgcaggagacttgagacaggtttgttctgggcgtgtgactgatgcctctataggggtctcagtgctctaagccgtctggtatttgcctggggtgtgtgaagacctggattaaggttcccagccttactactaatgggctgtgcacttggagcccttagagccttaggtttctaacctataaaatggacttaacgtctacttcacagggttctatttgcattttaacagaaaacaaagtcttaagtcaaaggaatgaatctctctctctctctctctctctcttttttagaccaagtctagctctgtcactggagtgcaatggtgcgatctctgctcactgcaacctccacctccggggttcaagcaattctcgtgcctcagcctcctgagtagctgggactacaggcgtgcatcaccatgctcggctaattttttgtatttttagtagagactgggtttcgccatgttgcccaggctggtctcgaactcctggcctcagatatccgtccgtcccagcctcccaaagtgctgggattacaggcatgagccactgtgcccagccaggaatggatcgctaatagaggaattccaagtctcacccaccgataaagaattctgagggcagagccgggccactttctcaggcctctgatttcatactgtggtgttagttacttctgagaggacagcttgctgccagagctctattttttatgttagaggctccttctgcctgcagactctgctgtctgggaagggcacagcgttaggagggagagggaggtgtgagtccctccatggacccgctgctttgtacttctctatctcatttccttttcagcaccactctgggcaatcagtattccagccccattttatcctcagaaaattgaggctctgagatgttatctctgtgacctgggtcctattacgtgccaaaggcatcatttaagcctaagatgtcctggctccaaggtgtcagcatctggaagacaggcgccctcatcctgccatccctgctgcggcttcactgtgggcccaggggacatctcagccccgagaagggtcagcggcccctcctggaccaccgactccccgcagaactcctctgtgccctctcctcaccagaccttgttcctcccagttgctcccacagccagggggcagtgagggctgctcttcccccagccccactgaggaacccaggaaggtgaacgagagaatcagtcctggtgggggctggggagggccccagacatgagaccagctcctcccccaggggatgttatcagtgggtccagagggcaaaatagggagcctggtggagggaggggcaaaggcctcgggctctgagcggccttggcccttctccaccaacccctgccctacactaagggggaggcagcggggggcacacagggtgggggcgggtggggggctgctgggtgagcagcactcgcctgcctggattgaaacccagagatggaggtgctgggaggggctgtgagagctcagccctgtaaccaggccttgccggagccactgatgcctggtcttctgtgcctttactccaaacaccccccagcccaagccacccacttgttctcaagtctgaagaagcccctcacccctctactccaggctgtgttcagggcttggggctggtggagggaggggcctgaaattccagtgtgaaaggctgagatgggcccgaggcccctggcctatgtccaagccatttcccctctcaccagcctctccctggggagccagtcagctaggaaggaatgagggctccccaggcccacccccagttcctgagctcatctgggctgcagggctggcgggacagcagcgtggactcagtctcctagggatttcccaactctcccgcccgcttgctgcatctggacaccctgcctcaggccctcatctccactggtcagcaggtgacctttgcccagcgccctgggtcctcagtgcctgctgccctggagatgatataaaacaggtcagaaccctcctgcctgtctgctcagttcatccctagaggcagctgctccaggtaatgccctctggggaggggaaagaggaggggaggaggatgaagaggggcaagaggagctccctgcccagcccagccagcaagcctggagaagcacttgctagagctaaggaagcctcggagctggacgggtgccccccacccctcatcataacctgaagaacatggaggcccgggaggggtgtcacttgcccaaagctacacagggggtggggctggaagtggctccaagtgcaggttcccccctcattcttcaggcttagggctggaggaagccttagacagcccagtcctaccccagacagggaaactgaggcctggagagggccagaaatcacccaaagacacacagcatgttggctggactggacggagatcagtccagaccgcaggtgccttgatgttcagtctggtgggttttctgctccatcccacccacctccctttgggcctcgatccctcgcccctcaccagtcccccttctgagagcccgtattagcagggagccggcccctactccttctggcagacccagctaaggttctaccttaggggccacgccacctccccagggaggggtccagaggcatggggacctggggtgcccctcacaggacacttccttgcaggaacagaggtgccatgcagccccgggtactccttgttgttgccctcctggcgctcctggcctctgcccgtaagcacttggtgggactgggctgggggcagggtggaggcaacttggggatcccagtcccaatgggtggtcaagcaggagcccagggctcgtccagaggccgatccaccccactcagccctgctctttcctcaggagcttcagaggccgaggatgcctcccttctcagcttcatgcagggttacatgaagcacgccaccaagaccgccaaggatgcactgagcagcgtgcaggagtcccaggtggcccagcaggccaggtacacccgctggcctccctccccatcccccctgccagctgcctccattcccacccgcccctgccctggtgagatcccaacaatggaatggaggtgctccagcctcccctgggcctgtgcctcttcagcctcctctttcctcacagggcctttgtcaggctgctgcgggagagatgacagagttgagactgcattcctcccaggtccctcctttctccccggagcagtcctagggcgtgccgttttagccctcatttccattttcctttcctttccctttctttctctttctatttctttctttctttctttctttctttctttctttctttctttctttctttctttctttctttctttcctttctttctttcctttctttctttcctttctttctttctttcctttctttctctttctttctttctttcctttttctttctttccctctcttcctttctctctttctttcttcttcttttttttttaatggagtctccctctgtcacctaggctggagtgcagtggtgccatctcggctcactgcaacctccgtctcccgggttcaacccattctcctgcctcagcctcccaagtagctgggattacaggcacgcgccaccacacccagctaatttttgtatttttagcagagatggggtttcaccatgttggccaggttggtcttgaattcctgacctcaggggatcctcctgcctcggcctcccaaagtgctgggattacaggcatgagccactgcgcctggccccattttccttttctgaaggtctggctagagcagtggtcctcagcctttttggcaccagggaccagttttgtggtggacaatttttccatgggccagcggggatggttttgggatgaagctgttccacctcagatcatcaggcattagattctcataaggagccctccacctagatccctggcatgtgcagttcacaatagggttcacactcctatgagaatgtaaggccacttgatctgacaggaggcggagctcaggcggtattgctcactcacccaccactcacttcgtgctgtgcagcccggctcctaacagtccatggaccagtacctatctatgacttgggggttggggacccctgggctaggggtttgccttgggaggccccacctgacccaattcaagcccgtgagtgcttctgctttgttctaagacctggggccagtgtgagcagaagtgtgtccttcctctcccatcctgcccctgcccatcagtactctcctctcccctactcccttctccacctcaccctgactggcattagctggcatagcagaggtgttcataaacattcttagtccccagaaccggctttggggtaggtgttattttctcactttgcagatgagaaaattgaggctcagagcgattaggtgacctgccccagatcacacaactaatcaatcctccaatgactttccaaatgagaggctgcctccctctgtcctaccctgctcagagccaccaggttgtgcaactccaggcggtgctgtttgcacagaaaacaatgacagccttgacctttcacatctccccaccctgtcactttgtgcctcaggcccaggggcataaacatctgaggtgacctggagatggcagggtttgacttgtgctggggttcctgcaaggatatctcttctcccagggtggcagctgtgggggattcctgcctgaggtctcagggctgtcgtccagtgaagttgagagggtggtgtggtcctgactggtgtcgtccagtggggacatgggtgtgggtcccatggttgcctacagaggagttctcatgccctgctctgttgcttcccctgactgatttaggggctgggtgaccgatggcttcagttccctgaaagactactggagcaccgttaaggacaagttctctgagttctgggatttggaccctgaggtcagaccaacttcagccgtggctgcctgagacctcaataccccaagtccacctgcctatccatcctgcgagctccttgggtcctgcaatctccagggctgcccctgtaggttgcttaaaagggacagtattctcagtgctctcctaccccacctcatgcctggcccccctccaggcatgctggcctcccaataaagctggacaagaagctgctatgagtgggccgtcgcaagtgtgccatctgtgtctgggcatgggaaagggccgaggctgttctgtgggtgggcactggacagactccaggtcaggcaggcatggaggccagcgctctatccaccttctggtagctgggcagtctctgggcctcagtttcttcatctctaaggtaggaatcaccctccgtaccctgccttccttgacagctttgtgcggaaggtcaaa

SEQ ID NO: 1030 - DNA, 108054 bp, Homo sapiens
  misc_feature (1)...(108054): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcattcccttccctttttcaccttcaagtgcctgtattcctggggccccggccccttccttcttttttgaagccagtagctgagcatcactccaaaccgctcataaggaaatggcattctacttgagtagcagacaggtgagccaacaaatacaatctcatgtggtaagcgaagaacaggttcagggaagaagcatggtcaaaaaagggcccagtaccctgggtgagagagggatgggttctcagagggctgctactcaagccaaggcttatcttacctcctctacccaactgtggaaaaacttgaagaagtaattgggtataactcatcttcttattttccttgatgctaaattcactgctttgcaacctgtagacacccaataaatatcacttgcaatgaaccagttctcttctgagtcatttttgtcttctgggctacagttgcagacgggagatgagagaacagtgccaagctagagggctgagctagcatcctcaggacagagccctagctttagggcttggcagatttttattgtcatgcattttcttcccttagcagagatgaattccagaattgaggcaggaagctctctgtttagttgtgggacctcaccaggaattcaccccagacatcagggaattagatttaaaatctcgcccttgcgtttaagcagggctttaggatcacttgggggttgataattgatagatgtctcctcgtttgagtttcttcataaaataacatgcggggagcaagggaatgaaattgagcaagtgaaatacttggcagagtctcaggaaagacgttaagaatagatctatgagctgtgccccatggcgggggggggttgcttctgagtcgggaggtgcatgggttggcggcaggaggaagcgtcatggagcctctgtttctgagcccatgtgttgagattccagcctctagtcagaaaattccccttgcagcttctgcctggtccagcccctgagccatgagcatcttctggtcctcttgcctcagattgttccccattcactcttcccatcttctccttcacacaaacttcaggatcaggacccacagaggtcttgggacctgtaggctgcgggagaaggctgtggatgtttaaaaccacatgtcaccacctcctggcaggggctggctaaggacaggactaaactctcagtggtgagttaatgtttgctgagggaatgaatgaaggaatgacataggcaaaatgaagctaaattatccgttaaggttatctatggtactttccctgggccatgattctccctcttagatgggaggagctcagctccctagacccctcctaagctcttgcagggcctgtagcatccagggataacagagcagaggactggggcagcctactttctttgaagggccactctccatgccaccctttgaatcagcactggtgaccaattagtagagtgtgatatgagtagtggatgaagacctgtctagcattaaaaaaaagagacagaattgagaaataagggtattgctttgtaaaaatgtgctgctgttttgcacatgatagacagtatactaaaagtggcttgcaacgttaaatgtatttcttaccatgggtcaaggtcaaaaaagttagagcatccagcatctcagaattgctgagggctctcatgctccctgggaggagatgctaaggtctgaccaggcaacttcaattgtaaaataaagatgcctaaccatccacaatgacctcttcctgagaccttgggggcaagtggaggaggactggctgggagtaagaggccagggctctgagcctccatctgtgtgtacttactgtgagccttgggcacattgctaattcctcttccacctgttttctcctccaatgtggaggttacattgtgtctgtgtgcactgctgccctctggtggtgagctctatacttcactgcagccacggcatccaatttgggtttgttgactggcttgtggctgtccagattttcccctcttcttgttctcacaaggtgagccttacccccaggtggagtagcatcccacatgttaaaaaaaaaaactcacatgtgttgtgagttttctgcaaaggcctctgctgttcaaatgcgttgcctggagatactctcatgcgagaatgtaaatcaaagggcaagctaatagggaactactttgtagccaaagtttgatgaggtccacctgcttcagggtacgtagctgtatgccaggtactcttgatgcatctgccggctctgaacagtgttttatgaagctgttgagagagtgggaccagatgtttagaaagaagagcttgtcttgtcacttccctcagcttcttccttttttgatggtatcagcaactctttgcatttccaattaagactctagttaaattcccttcagcatttgactcaacctcttgcaagaggcaagataagtgatttaaaaaaaaaaaaaaactcttacttaaagagcatgttgcattgttctgagatttatttctagtaaatcaaagggggactgaatgtcccttagcattgtcctgggattgataaaggtcaattgtctgcagaaatatggacctgaagtctctccaaggttagaggtttcatattcatggtcaatgcatcttcaaatctcccatagcaaattatcttggaccattgcatttaataggtgcttaataattgtgtgttaaaaggttgaatggatgaatgaatgagtagagtctcagaaatggcccttcagatgaagtttccgagctatgaagtaacagtgtgcagtgcaccatgcatgaagcacatcgggcaagggaactccactgttacatggtaggattggttggcctggaatcaagtcaggatatttaatcaatgaggttgaaagacccaagtaaacatttagcaaaactggagtcaaagcacatttcaaaacaatcatttagactgttaagctgctatcttatagagttgggggcccaaagtagggagtgttttatttttaaacaacttgcttcccttctgacttcaagaatccccatgatggtttggttttgaggacattaccagtcaaccgcagccaagaagtgattagcaaatgcctgctccacagacgtgggtctgacttctgggctaagttcaaagcagagctcttagtttaataatgatacaggattcactttccttgaaaacttcctatgctggaaccattttgagaaaaacagaaataatcatggaaatttgggggcacaaatgaagacggggaggaaacattacatgcatatctgagtacttgtctacaaccctcacaatgcatcctggagaagatgtccctcccttattctcttgataggaaatggccactgtttataatgaggcagaacaaagcaggggcttacttcctccccgatgccaatcaatatgctgagagctggctccagtgctcccagagccatggatcagtgttactgccttgaaaatcgcttattgctgtgtcatttaaaggaatctgatgaaaggtttgaaagaaacgctataattctacaaaatatcttcaagtggcatttcccaaaaccatggacaagtactgatagtgttttgtgaaatgattttagccaaaacatagataaatatttttattttaatgcttatgtatttaacacatattacaaatatatacaattagcataccttacctgtgatttcatgaataatttttcttaggaaaagactaaataatctaagtaaaaataatacaaaacaaaatagaaaagacaagaaaagaaggcattttaacttaaaaccaataatagtagatagtaaaaactgtgaagctcgtgcttaaacaacgtggttcggggaacagactcaaagtgtgtgttaagtttttgcactactattaggagaaacactgcagtataattctgcagtgatttttggaacaaatattcaaaactaccacctagggaaagctcaggcactgtggttgtacagggaggaagctttggggccatggccactctcttcttttcacagggaacgttttgacaacggagtctttctagtgccaagtctctgtgctccaccagtgaagaccgtagcaggcaatgatgactgtgcttggagtctccacactggaaagtgggctttttccctgacttgagcccagcagccatcagagggaagtggacatccccaacgccatcccctctgcccacctgccggagtgtgacttcccaccagtgccatcaaacccccacagtgcttcagagtgtaggccaagctagcaggtaagtttcccatgaactcaggctcctctaccatctgggtatgcaggctagagcatgagcccccactgcacctctttcagcattaagacatttctgaggctttcctgatagagaagtggcctgggaaggcatttaagaagacagcttaactgtccaggttccttttctgtagaccctcaccctgaatcttgaatcttgactagggaattcacccctggccttgtgctggactctttagggacagaggtgggacatgagatgttggcgctgggggaagcaagtctcatctcaccgagtgctctcctagagaaggagctcaaacagtgcccagagctggtgctgggatgccatttggtggtctggaagttgctgattgctttctctgtcacaaagcctttgatttccaccggcttatgtgtacacatgtgggtattcttggtggcctggccattgagcataattaaaagaaatgattggctttctcttgatgcaaacatctggttttacttgaaacaagatgacttagctgtttcagaaacattcttgtaaccctggattcacattttcttcttaaaatatatattttctctgttcgggcagtatgttaatgtaaacactccttgtaactgacaaccgacagtttcagaagtacgtggggctccaagcactggaggaaccgcaagaatgattgcgtttttgatttgatcactggaaatctgtttcaacagtcactctgatttaaacaattactctgatttatactccaaatgctgtaatttgcagaaaatgtaaccatgtgaggacatttttgtagagtatgtcttggcaactttgtgttgttgtgatgtcattcacttcagttttaaggaagcacagaggaaagaaaagaaggaaaacagcgtcctttttgatgtgctttcctgaccgccagggaaaatgttctcaagtcttcctggcttaccattccttaccgctcccagcccccaaggccaacactgaagggctatgaatgacattgaggagagaagcgagagccaagatttcctgaaggccaaagaattaagtccaagagtgggggcagctggttttgttgtcctgtctgctgtctctacagttaagacagggtaggtgggatgccagctcttgcatcattcatcaaagcccaggtttgcagagctggaagtctagtggagagtgtgaggtttaataccttcattgcctagaaagaaagatccaggtaggttaaagaacactgcaaaggttctagagcaagttagtattagagtcaaggaagcaaccagggctctggttttttgattctttgcaagattgtacctgttgacatgtaactgcaggttggtcccacattatgaacagagaaggtatctcagcagaataagaacaaaaagtcctaagtcaaaataattaggtagtacacattttatagtttgcagcttaagggagctagcattccaagtattagttccatttataccctgccctcctccagtgaatccagccaggctaatgctgctggggaaagagccatgagggcacagaaggcacttctgcctctttgggagcagaacgcctctgtgaatggtcccataattctgagtggcagtggggtgctcagcccctctgatcacatcttcctagaccatgtgtcttcaacttagtcccagccccagagaaccaaaaagaggtgcttctatttaaagtttatctccttaacatctgtgtgcttcagttagttttgcagtatctccttaaaattgacttatttctgcccattgctgaggagcggtgtgctgtttcaagtcccagctccacctgtgttttgttgtgtgaacaagaaggcatcaggtttctttgctgtgcttcagtgcgcccgcccgtcagttaaatgagggacaagagcagaaagtgccaaaatctcttccagtttcatcactcttggaatctgtggctctatcattttgtgtatttgtgtttcttatttaaaaagtgatacaggctcatggtgacaattttttccacttgaacctcatattttggggacgtgaagtttttcatgtgcattgcccctttcagagagctttggggtgcagggacactcagccacaggtgtgccccatagcctggcactcctccctggactgtcctgaacaacactctaataccaaggtgggtgtctttcatgcttctgaatgatgggctcctgctaaatgatgggaagcccattaattcctcagcgaacacagaacatgtgacaggcggcactcaaaaattgtttgttggccaggtgcggtggctcacacctgtaatccaagcactttgggaggctgagttgtgtggatcacctgaagtcaggagttcaagaccagtctggccaacatggtgaaatcccatctctactaaaaatacaaaatttagccgggcatggtggcttgtgcctgtagtcccagctacttgggaggatgagatatgagagtcgcttgaacctgtgaggcagaggttgcagtgagccgagatcacgccactgcactccagcctgggtgtcagagcgagatcgtgtctcaaaaaaaaaaaaattgttttttgctaaacagcactggattggacatttgactaatgtgtcatgcaacaataagtttatccatgctaaccacactgaaaaaaggcatggttctttctttattttcctaaaactgatctgatattccacatgaactcctactcactgggtaatggggcaaaacaaaactaaagtttggttcagttcaataattccaaattgattcctttattgaagactttctttagctaaatgccctgtccttcagccctcctcccttgccctttatcttaccccacatggcattttggtgtgtgaggagggaggaacatgaggcattggtgagcttcggtttccaaggcagtgtcccttagcctggccactgcttgcctagctcgctttggtggccgaggccagcagttggcaaagcttgcattttttacctctcttttcctggttgtcctccctgtctgactcagggtctgctgccttcctcatccagctccaacctaagaggtccacctgtgtggttactgctgcagggtcactgtgccacttgccatgtggcccacacagactctctggctcccaactcggttgccatagaatccccccgtgaaggcctgcaagaaagtctcggtcccagacatgctacaaggaaacatggaggctcagagaagataacccacatttctgggcttcccttagcgctagcacacagcacaagatagattgaatttgatacagttgccaccatgttggtgacccagtagactgcaaggaacttaatccagaatttgcaatgggaaataaggcaaaagcctcttctttttggcctttctctccaaatttccaacatattagaacctgccaatctcagccccggatttttctgcatactcctccttctgtctctggtccttctggacaaggcggatggatttctggcatttattttcctccacgtaaattctccccctgaaatgggcagcaagtctcgcagcctatttatgttacaaaaaaagttgcatgatctgttttttcaatggatgtgtagatcactcttttacatttatacttatcccctgcctaaatctctactcagaaatccagatttgaacatctaattgccttctcaccctttccacttgatgtctaataggaactgcaacctcaacatcaccaaatcagactactttgctttgctgtccctgcaaccccatagcctccctctgctccaggcatttttcaaccttggtgaatggcattgtcatctacttagttgctcaggccaaaaactgaagaatcatccttaactcctctctttctttcacatctcacatccagttcatcagcacatcccattggctctaacttcaaaacatatcatgagtccagaacacttctcaccatactcacagttagcatcttattccaagctaccacctctgtcacttggaccacagctgtggccttttaactgggattcctacttcttcttttgtccccatagagcagaggttctcatccaggagcattttgccccccaggaaccatttggcaatgtctggaaacatttttggctgtcactactgaagaaaagggggagaaaggcaattgacatctaatggatagaagccagggacgctgctgaaaattctgcaatgggcaggacagggacagcccgtcacaacagagaattaactggcccaaaagctcaatagtaccgagcaactgccatggaacttattttcccaacacagtagccagggtgatttttctttctaattttttattttatttcattttattttaagatggggtctcgctctgtcacccaggctggagtgcagtggggtgatcatagctcactgcagccttgaactcctgggctcaagtgatcttcctcagccccccaagtagctgggactacaggcatgcaccaccatgtccagctaatttttattttaatgtttccgtcgaaatggggtctcactgtgttgcccaggctggtctcaaactcttggtcttctgaagtgtaaattagattgtgtcattcccatgcttgaaggaataaagctttctcttgcaatactaatacaactgaaattatttgctgggtacaaggccttacaggacccacccccatcaacttctgttttctacttctccattctgctcattcacaatattccagcagcaccggtccttcttctcctctctaattgcccaaacttcttcctgtctccaggcctttgcacttgctgctacttctgcctggaacactgtcctccaggcctttgcctggtttctgtcttataactctggtcccaggtcaaacatcgccctgtcaatgagtctttctgaccttcctatattaatcagccccttctgcctgtttctctgaaacatacacacctaccacatgacccaattttatcttcctcatagcatttgtcgatagctaagattatcttacttttgattgtttgtggtttgtctttctcccttaagttttttgagaataagactcttcttttggaatagtacagagaaggggcttaataaatattgctggctgcttgactgattggttgttaatatgttgaatagaagctaaagtgatttagcacatcctttctctcttgtcaatgccttgctttcaggctgattattttactgtgaaatcgtatttcaataatatgagctgaatattaaccctctatgcattcctgttctagcaatgctaggcaccctgaccccatcccacccaacaaatacatgccttagttggctaagaaatagatcatgtacaggaaaatgcaaaagaataaaaatagttttaaattgttatttttcaaaatagtgctctgttacaagtggaaacatacaaagtgttcatttattatgaaatgtaaagaaaacatcacttcctgcaagaggcaaaccccactctcccttctcttctcccaatgggtgacaggacctggcttagctgcttggcctgtttgcactggccctggtaactgaaagatagtcagctgcctgcttccctgtggcgcagacattacctaaggttatctctgtactggtgaacaggatttattttcttgcaagttagctgagaagactaaatgcagaaatgccggattctcaggaaccatttcaacgaaccagcactcctttgccagtgtagaagcatcctgaggtttcacccacgcaactaggcaaggctgggtgagtgtgctttttgtgcgtaagtgtgtatcacagtgagtgtgtgtgtacaggtctgtatgtatgcctcaggtgtatatctgtgtctacaaatataccccagaggccaaagattgaaaatgggaaaggtcattttgtggatcacccagggaagggcagtgggaggagctcatttcacaaatctagtgttggtcatgtgaactaatatcatggggataggccgcagttatttgcagctttttataatttatttgcaaacgacctaggttcaaatccattttttttgtttgttttagaagagctaggccgggcgcggtggctcacgcctgtaatcccagcactttgggaggccgaggcgggcggatcacgaggtcaggagatcgagaccatcccgactaaaacggtgaaaccccgtctctactaaaaatacaaaaaattagccgggcgtagtggcgggcgcctgtagtcccagctacttgggaggctgaggcaggagaatggcgtgaacccaggaggcggaggttgcagtgagccgagatcccgccactgcactccagcctgggcgacagagcgagactccgtctcaaaaacaaaaaaaaaaaaaaaaaaaaaaaaaagaagagctaatgagtttttctgagcctcagtttcctgatctgaaaattatcattgagaatttatttataatggtcccagaactatcaaaagcttagtgcataccaccatcagatgcctccccatgtcctgcccttcctggctgagaagcgtctgtgttttgctgatagttctggggtctttattatccagactggggagtgtgggtgagggcaaaacgtggaggctcagaggatttctattacaaacggctgaagaacaaggacaaagccagagggggaaggtggatgggagaaggagccaagacaggctcagttggaggcactcttcttgccactagggatgaggcaagagagaggatttgggggcatctgccaagatgtgagacacaataatagagggaaatagaagaagatgatttctaaaagattttctacgtgttaggatggtgacaccacttaggtatttcctcgagggactgcaatgctgattaatgttattctcctattactttggcagccagaccaaggtttctttcctgaggccttttacgagaggcctcagaaaaccagactttattcaagttagaacaaatctgtgctgttgtcgtgagggttatatatggattaagtgctattttgtgtgtaaatcttttgctaagggtctggtaaacattaatcactaaataaaatgacaatttttattgtacaaactacaattaggatgctaatccctgtgttgtttctcaaaagaccaacttgagtcttaagagtgcacactgtcctttatttatttaacactttctgtttgccacttatttagtaactgttttttctggtgtggattttccctcagcatctcccacccctggtcctgttggctcacagctgctcatgaatctaagactgacttctcaaggtcgtcttgagatgcagagaaatgaatacctagagttgaaccccagttccaccagttggcagctggtcaccttgagccagttactgaatctttgtgcctcaacttactcatctttgaaatgggaatattgatgatctctgcttcataaagatgctatgagcttaaatgagttaatatttgattctgcctgtcatgtagtgattgctatgtaaggtttgcaggggtgatgatggcaaggtgatgaggaagatgaagataattcttttctcttgtgcctggcagcatttagcacaggcctgggcacagagctgttctgaaaagatatgcaaagcctaggaggaccactgggaggcccatataatgctgaactgattcacgtggtaaaattcccaacaacacaagggactctttccatttggctatgaactctcattccttcctgggagtaggctgcctatgttattgtgagaataactaaaatatctctcaatccaaatatttagaagttgttgaccgggacggtcaaagggctgggcaagaatggttatgtcctactgccaggctctgtgtcctgagaacagtggtcagagctagcttgccaggtttccttggtgggggaaaattaaaaaattacaaaaaggcactccattcctgtgtcagaaggggactgggccctgctggggtggacagggtgggaggaaataagcagggggcccacagagggaggttggagccccccagaacactttttggtcttgaattaaagcaagcttcatctaaattcttattttcttcttcaacagacttttcctaaatgttgtggatttttgactcagggatttgctgggtggctggtgaccttgtgggagaaaagaaagcattcggagcatctaggcaagaagacgctagagtaagacccaggcctgaggctgagaactacagtggcctttccccaggaaggctgtgttctggttcttagccccacaacagctgactgtagagaggatctggcctgtcaacagtctttggggggacacagagttctaactaacactgatctgcattgactagagaatttatgtgtattgtttgacttcagctctctccggggacccaacacccctgctatggtccagtgaccccagctactttgctcagaattccattagggactttaacttctatggagttaaggtctgctatggagggaagatctgaggtatgttcctgggaatggctgggtataatctcaaccttagacaaaatgggtcacaaaggaaatcccagaaagagggatgagagaattaaaaaaaaaaaaatctcacattcacaggaaaggccaggtgaaatgtatgggaccggagggaggaggagatcgatgctgacttttctgaagcagagtctctggtctggctagttgaatgcagctttgatcccacagacagtgaacaggcaggagacatccaacattaagtgcaatgaatcacataacttcattctaaaatccaggggaccctttcttggcaaatgtggaggctctgtcctaaggggtcagtgtgagccaaccttaagaatacagtttctggctgggcgcggtggctcacgcctttaatcccagcattttggaggccgaggcaggtggatcacccaagattgggagttcaagaccagcctggccaacatggcaaaaccacatctccactaaaattataaaaattagctaggtgtggtggtgcatgcctgtaatcccagttacttgggaggctgaagcacgagaatccctggaacttggggggtggaggttggagtgagctgaaatggcaccactgcactccagcctgggctacagagtgagactctgtctcagaaaaaaaaaaaaaaaaagaagaagaagaagaaaagaaaagaatatagtgttcctggctgtgacagggccctacaagctgctctccagagtgttgtagagcttttgttggtatggttggatatctgtggcattttgtgattgacaatgatcctgcttgagtagtttcccatggtggcagcaagatatgtatacagtgaggagtggtcacaaatgcccaggggagaagtacaggctaagctgtgccagaggttctcaaaatttaaattttaaatgtgactcaaaacaacaactatttgtttacctcatgattctgtggatcagcaatttgggctgggattatctgggcagagctctgcttggtagattctggttgggggctcccatgcatctacaatcagagcctgagctggttgtctaaaatggctctgtgggatggctcgactctgttccatgtggtctgtcatcctccatcaggcaaatctagactttattaaattacagtggtggtagaatcccaagagagcagttggaaacatgcaaagactcttgaagcccaggcttggaacttggataacgtcacactctctgcattctattatccaaatcaaaccacgaagtcaagaagtacttctcgatgggagaggctgcaaagaattgtggcaatttttttgcaatcgatcacaggtgtcctctgtgcttttgttagctttaaggatttacttccagccttttgaagtccatcgaatcattcatgaaaggaaaatctgagaagaaccccagtgtttgagagattataagaattcctttctaatgtcaaaaatttccaagacccttagaatagttcatggatttctacatgaactctagaaccatactcctagagtttgaaaaattacttaataactaaaagttcctatacatttgaggaagttttgaaataaatttgtatcttttaatcataacatcatcagtatgcattaaaagtagtagttaacatttatatgaaataagatatataaggctacaggcatagattaatgtgcaaatagcctcatgggccgtttgtattaataatagctctgagatataagatccagagctcatagggtgggaaccactgttctaaaccaaatgaagaactggcctaatgtcattgaattttatgcatccttgtccccttgggccatggacacttacatgtactttccatttgtggagactgcactagaaactgccctgggtcctttatatccactctcttgactcccaaaccatctttccatcaaaccaaccagtgaagtctgacattccactatggaaaagtcatatctcaagtttacaatttccagggttaaggtgcaattctcctgggggtgcaagggcacagtgtgtggtcactactggtggcttactctgcaacccctcactagagtaggaaggtggaagcagctctacttggccactgaacagtggtgggagactggaagtcctctccccaactctgggcttctgttttcttgcaaagaaatgagaattgaaaaggcccttttaggaagatcaaggctgaaatgagtggcaataaagagaagtgttttccaggccaggcacaaataaaaactagttgtctctttctccttcatctttctatttgatcttattgctcttcccctccctaatctcctggcagtggtatagccacctcctcagttggaaaaacattgactctgagagtcatatcccttgaaaaaccttggctggcacatcggtgcttcacatttggggatttgactgtgggtttaatgcactaggaacctgcaattccaggacagagcatcctagtgagtgcctagggcctagtcaccctgtggcacagcctcctcagatatgcagggtgaagcagaggcagaagaccacaggaaaggagccaggaagacagcaggaaagagctgaggtctctgtttccatgggcgttccccttctcagctgtgtgtcttggcggccaagctacgcttctgctctttgatgccatgaaatactttgttactgtccaaatcatctcccttttgacttagggccagtttgagtggagttgctgttgtttttttttttcctggcaatcttgataaagacacattaacttaacaaattaagacatattcatttgacatttgtgcgtgccaggctctggcagctgcaacgttgaagccatggcctctgctctcctgaaataaagtctagtacaggaggccaacacatgaacagataattacagtgtagtgtgaaagtgtggcatatgggagtcatggattgatgaagagaagaaagcacgtagacaggaaaggaggagtcagacagctaggtttgatgggccaccaggagttcaacagaagcagtaagatcacaaacaaggagctgggaaacagcagttctcagaactgacagatatggaggttgggtattgccctggtgtagatgaaggcaagtgaaggtgttgagaagctgaggccaggttggcagagctaggtggtccagaactgctcagagaagcttcccaagcttgctcttggcttgtgactgctgaattacagagatcggaacaggtgtgatttcatttcccatattttcagcaaaggcatacaattgaacagtgttcttatctgaactgacaaaagaccatcaccaatttatataatagcaccctttaaaacattcctgccaaatgttctcaatattgaacaaaaagattttggaatcaaagcaaggtagaaacaggcctctttcataaatggtttccatctttgctgcttcacctccaccactcacagatatccctcgctttataggcaaagacaaatgtttggaaacaaaaatgaaaaatggtaaaaatgttcctatgttgggacactgtcatcatccagccacgtgacttggccagcatgctgtcagatgtttagggcagcagtgggacaagctctggaggctgcagagtgtgtgtccccaggtaagcaaccacacttcccaaagtatgaggctgttatgaagacctgggaaatgaatcccctccagcccccctcggagagtcccatttctaatgccacctctgtcagccaaactcatgttagcatcagtttatcataaaatatggagcagcctgtaactttcatttttctctttcaactgggatattaaaagaggctttaacatttcctccaaaaatgcatttcagagttcacatttcctcccgagggcctgctgtgaatgaagactcctcatttcaagcttgatttaatccaggaagtgcctgggaatcagataatgccagcaacaaccagcaagctaaaagaagctgctctaaagggcttctttgctgcatttctgctctaaagggcttcttccttgtgcatttaagtcagggggtggtcatctatagaatggttacctcctgctgtcatctgtataccctttattcctactgccaccaccgcctgtggcaccattcccaccatcacatcaggatcatcaccaccgtggactctatagtcctccctctgtgacctgccccatcatggaaggctaattaacacgaaggacacaccatctgcaggtctgcatccttcctctccccctcattctcctgcagaaacagaagcagcagaggttggtctagaaactccctggggtaccacatagaatgagcttccagatcctgtccccctgggaaggggatacaggttaagaagctgcacaacccaccttgcaaatagaggctgatcagcactataaatccttgaatacagcagcttcttgttcgttgggagtcatgagtactgaacccacatttcctggatcaaaaatggagtgacatatgttcattgatggggccaataggacagggtgtttaaatttcagctttcctggaaaatccaggatgttaggatattgaggagaaggccaagtacagtgagttctgctcccaagaagaccatggtggttgcaggcctacgtgtgacttctcagcttttggatctgggtaagttactggtggcagaccctctagagactattcagaggaggcaccaggctgacttcctatttcctgttggaaataaagctgtttagctcttggtgttttagacatgaagtccttgcccatgcctatgtcctgaatggtattgcctaggttttcttctagggattttatggttttaggtctaacatttaagtctttaatccatcttgaattaatttttgtataaggtgtaaggaaggggtccagtttcagctttctacatatggctagccagttttcccagcatgatttattaaacaggaaatcctttccccatttcttgtttttgtcaggtttgtcaaagatcagatagtcatagatgtgtggcattatttctgagggctctgttctggtccattggtctatatctctgttttggtacaagtaccatgctgttttggttactgtagccttgtagtatagtttgaagtcaggtagcatgatgcctccagctttgttctttttgcttaggattgacttggcaatgcggactcttttttggttccatatgaactttaaagtagttttttccaattctgtgaagaaagtcattggtagcttgatggggatggcattgaatctataaattaccttgggcagtatggccattttcatgatattaattcttcctatccatgagcatggaatgttcttccatttgtttgtatcctcttttatttccttgagcagtggtttgtagttctccttgaagaggtccttcacatcccttgtaagttggattcctaggtattttattctctttgaagcaattgtgaataggagttcactcatgatttagctctctgtttgtctgttattggtgtataagaatgcttgtgatttttgcacattgattttgtatcctgagactttgctgaagttgcttatcagcttaaggagattttgggctgagatgacggggttttctagatatacaatcatgtcatctgcaaacagggacaatttgacttcctcttttccgaattgaatggcctttatttccttctcctgcctgattgccctggccagaacttccaacactatgttaaataggagtggtgagagagggcatccctgtcttgtgccagttttcaaagggaatgcttccagtttttgcccattcagtatgatatttgtccaacaatgatggactggattaagaaaatgtggcacatatacaccatggaatactatgcagccataaaaaaggatgagttcatgtcctttgtagggacatggatgaagctggaaaccatcattctcagcaaactatcacaaggacaaaaaaccaaacaccgcatgttctcactcataggtgggaattgaacaatgagaacacctggacacaggaaggggaacatcacaccccggggcctgttgtgggttggggctgggggagggatagcattaggagaaatacctaatataaatgacgagttaatgggtgcagcacaccaacatggcacatgtatacatatgtaacaaacctgcacattgtgcacatgtaccctaaaacttaaagtatatatatatataaaaaaagctgttcagctcatagagacggagtcctgcccagggagatggcgagattgtgtccctctgaagcagtagttctcaatcaagggattttgttccccaggaaacatttggcaatgcctagagacatttttagttttcactattggcaaagagatgctgccagcctcagaggctggggatgctgctaaacattctagaatggacaggacaataggaaactatccagccccaaaaagtaaaaccaggggagggagactgaggcagtatagccaaggccttggaacagcgtaattagacagccagctttgaaaatgggaaggaatttacatagaaagaaggcgggcaaataatgaagttatgacagaaccctgtttttataagtgcctgaagggcagctggaagggacctgggtctggcctctgtgggacattaagagggcatgagtgtaatcagcttccagtgaggtctctatcaaatgagggcctggactctgactgatgcctggaaagttagcctcaaggagagctttcctctcatcaaaaagtcaagtggctggaagagatggcttctggcactacacacccaggagctggctattttcgagagtaggaggtatgtgggagaagacttggggatttgggtctgcatgcatgaataaataccaggtgtgtaccctgtacccccagatctcagagcctggcagagcacacaccccatggcagatattctcaacttggccaagacaatgcagcccctgctgtgcccttcttctgagccacacagacccagtgaaggactgggtgttgcaaagggcattttcccatttcctgggcttggccttatacctggacaaggaaaggagtcaccttgtcatatggtgtcagtagatgtagagtgccctgctcccacatctgcccttctctttgctgcctgaaaaccctctcctactctagggagagtcaatgtcagaatgaagacccctgggaaagaccccagtagcttatccctcctctgtttctggctacacctcttgggtgagatttgagaacactggcccctgaggaatgttatgtgggctcagattgtgaactctttgagtacaaggtagggactcggtgttatttcactttgtatctccaagcccagtgagtccaggaatggtgctctatgtaagattggatagatggatggatgatgcatgggtggatcagcggaagtgtggatggatggatggatggatggatggatggatggatggatggatggatctgtaatgaaacaatgaacaactctgcaagccacttgttagccacctgcagggtatgtgatatttgtctccttttcctggtaactcccatcccaggggtttccctgggtgacaggaaggattgaagtggaggagaaagagtgtcaggaagagagccaaggacgaggctgggccatggccaatattccaggattgttgggacagtgaacagatttgaagaagtaaaaatcttctcggagaatgatgctgctgctggcaaatgcctctgtgggttcctggacctgggcctggttggaggaggctgagatgagtggggcatgggaggtacatcctagttgcggagtcaggtcatgagcatgtaaaaagttaaatagccacactaagcttttggctccattgaggattatttgatgataggaaataaaaatcagaggaataaagagtaagaacaaagggctgctaaagtgctgcccggcctcctggaatgtggcaaactgtcaggtggtgcttgtccacctttgtccctctgtctccctctgggatggcattgctacccttctcttcttctttcagcttaggatccttctctggggcttcctctgcaaggaacttcatttctgtgctcttagaacttcagaatttcagctcttccaggatttgggtttgctctggcacctagtgtgaccctaactctacgtgacctttctgtgccagtgccttaaactttttgtactgtagcttctgtatcttttagttcaaattctggagtgagtaggaaaaaggaaagagatcaattagactgacttaccttgatcatatgctatccctctcctcccactaccaatcccagtcatgcaggcccacagctggggctgtgttgaaactcacatgaaagggacatgggcagtggggatatttcatcaaagacagatgcaagagacactgcaaatgcattttgaatgagggaggggaattcccaggagtttgggctgacctgtgacatggggggaggactctgaggtatgaaacccattagatagggagtatggagaataggaagttcactaggttcagggattagtgtttgggggatgatgggaaagtaggtttgggactcactgagtttgtcaaagtcttgaaataggtgcttcatttaattgagtgaagtttatagggatgcagaagctgcacgcacattcccttctgggggatgctgggatataagggcagggttcccaggacagacacctgggacaggtgccctgggatgcagagatgtagatttgaaaaggttaaaccacagtcactcgctgtgagtggggaaagaatcaggccacatggtttcctctagtctggccccaggaaacatgttccgagttccttaagagaccgttgaaatggaaagagtctgtttgttttgggagcccccaaaagacctccactcattgaggtcatctgaagtgtggctggaagcccagctaacagttcagaaaagactagtttcaaagccaattcagaggtaagagggtaacgacaaggaagaagtccaagaagcagagagagatattcgaggaaacacgagcggggcaagttctacaactatgaagaagagaatctgagctgcagggccccggaggaggggggagagtcctaggggcttggaatccagtgactttccaggatgggagcccagggtcacaggtcactgggattggtctctagggtctggagtagtgtcgaagaccaaggtaactcagagggaagattgaacctatgaccttccaaacactgtccaggaggaactctgtcctataccagaggaggccagtttaactcagaaaatattttagggaatgaactggtatcaggaagaaaaccaatggcatattgagcagttgtttgtctcctggaaaaatccatccagttcaggtgacaataatgaggagggcagaatgggtgcaggctttcccccagtctggaagttcttgggcatccagcccagaagcacctgcacagacaccagccccgactctttcctggctcaagtgactccccagggccctggacatgtaggggaagctgtaaggaaactctagctagcaatgcctgttggtggtaattgatctggctagagggtcaatgtgaatcattaactgagaacttatgacaaatttctgcatgttattatctcatatttgcgtttgaaagtcatcatcctgggttgtgacaaaggggtatgctcaatatagaattcctgctctggttgagaaagtagcttttggctgtgaaaacgacagactgtcaattatctgtgtttcagccttcacattgaatttcctgccctgctgtgaggcagtaactagccacgcaccccctctcagtctgctccatgctgatcagaaacattcctgtccctctgtcggagccatgacaattctgttgaggcagaggcctggattggagcccctctgcttccctggccaggcagaagctccacctgtggaactcagccccaaaactttttggcagaagaacaaaaagcaattctgattggctgagcatcttaggagtgttgtggcccaaataaatgcttattgtcatggtgacaagttcaagccaggagtgactgggcatgaggtggatggcaggggatggatggggagtgcatagacatagcctggaacaattaagaccacaggttctggagttagagttgcgtaaatccttgcttcaccatttactagctgtgtgtctttgggcaatttgctgaacctcattagccttggttttctcatttgtcaaatgggaataataacaccaacatcagacggttgcgctaaagattgaagggaaaaaatgcagacaaaatactgctcctcgaatgtactcaaaaagcattagctttcttagtgtcaacattgctggtgctacatttgcactctgcttgattctcaacgtctggtataggcagcgcatggaggcagggagagctagctgcatgctttaaataacagatccatgaagaatctgtcacgttttggagacgccagccaaaaaacatcttattttcagccaagcactttgtttatccagctacagagtgtgacctgtttatcagagacaaggacaccccagccccatttttgttacttctcaagaactacggctgggtgtggtggctcacacctgtaatccaccactttgggaggccgaggcaggcggatcacgaggtcaggaaatcgagaccatcctggctaacacagagaaaccccgtctctactaaaaatacaaaaaattagccgggcgtggtggcggacacctatagttccagctacttgggaggctgaggcaggagaatggcatgaacccgggaggcgggctttcagtcagctgagattgggccactgcgctccagcctgggcgacagagggagactctgactaaaaaaaaaaaaaaaaaaagtacagccagaggagaaaattaagttgtggcttggttgcatcccaagatacagatgttttcctttttgataggcaccttcgcccttccaggggcccagtaaaacacccaagaactgagaatcacttatggttgttggaggaactgataccctttgaaagagggttgagaacagtgcgaatgtcatgtgatctctgctatgcacagagtagaaggaacaaaccaattaactaatggaatgtggagcatctaggggaactgcaggggctcggaaaagccaagaagagcagcaaaacgatccccacgtggacaggagactgctgctgaagtgtggccagaactaaaactctagtggctttgacaaaatctggatcattctgccaagttctctttatttttgttctaggatgggcacatccctctttgaacagctaagttcctatatcagagcccaaatgccaaccttaattcctctctttctggaatcccaagactctgcccaggaaggctttgctttcatgctgtcttctgtagcaggtgcacctggaagtagctcctccactgaattgtcagcccaggctaaggacaccaagtctcacccagacttgaatccttgagacaggagcagatttttagtgggtgcctagcacatccaatgaaggatctctgggaaagttgtgcagtcctcaattagcaatgtcttccatggattggggcacaatgaataatgaataatgagtagaataatgagtaatgagtagatgaataatgagtagaatatgagtagaaatgaataatgagtagaaacagacaggtgaggctttcttagtgccaacattgctgcaggtcacttgagcagttgccgaaggtatagactagacagccgtctttggattggcagctaagaattctttccctttgtatgatttgctcaaactctcagctcaaagcatgggggtcatgagaaatcaccagcaaaaggagggtagaagaaagagggaggatctggtaaaggccaatgttctttctcagctcctgtttgatctggtcaaaagcagatgcatttggactcagcctggggaagaaacctctgcataaaagagacaagctaggccagggagattcctggcttctccaccactcaaaaaaaaaaaaacaaaaaaaaaactggatgcaagaatttccactgcaaattgctggccacatgtattctccatctagaaatcatttgttaatcaatgagtgcagtttttttcttggtatgttgaatcacatctggaaatgatctatccccataaattgatgctcaggagatgattaaaaaattctgattgtgcccaaatgagtatggaaatgtttaataaggagctgggatcctgggatgcctgtgaggcacattcttgaatcctcatagtctggacctcactttgggcaaaagagaccaagtggaggattagggaggtgctggctcagtttctgtttcccactctagtgtggagcaagagacccctgctcccctgctcgcccttctctgtccatctggagccctcctttctattgcttttttcccagggaggacgaaaggcagggaggagaacatggggatgacaaagcattggcatctcacagaaacaccacgaggatcttggcacatggggactatgattctgtttcacccttggagaggttaagccatgctgtaaatctttttgcgcctgcagtgccatagctctgacttgcgcaaggtcatgtaacaagctagagtcttgttgctagacttctagtgcagtgctttttgtgtgctgagctctttggaaccctctgtctcctgagcaggtccgtggggtggctcttcctgtcttaggaccaaactgttgaaatttggaggacactgggggtatgcatgtgttcatgtatgtgtgcatgtggacatggggggtgcatctgttcatgtatgtgtgcatgcatgcatacatttatgcagatatgtgtatctgcacgtgcatgtgtttgtgtgtgtgtgcacaagcctgtgtctgtatgtaggtgtttctgcatttctgtgtcctccgtgtgcatgtgttgggccaggagtcaatgtaatgtgtacacctatatgcctgtgtctatatgcttcggttaccattaccaagggccctactcaggatgtttagtacccagcctaccacagtcactgaccaatcagaataaacactgtcagtaactcagcattggctggagtcctgggaggccagagggtcctgcgggagaagccggaatgactggggtatgtgtgagagtttggggagcttggggggcagcccctatatacgaattggtccaaaagtacttcaatactttaacggctggcatggccttccttgtgctaattggaagaatatcagtccttctgtcctcagaaataaacctgggtaagtgattaggaagatgtgtgccggttaatgtttgattttcaacaaaaggaatgacacaattgaatttgacaagttagagtactctgttggctctagacaagttatttaatccccctgaaaaattgggatgatcatacctacctttgtataaggttggtgtaagggtgaaataagcttacacccatatggtgtgcctggcacgtggaagttgttactattattggtgtcatcagttttattataaaatggcacagtgaatgtttccaggtatgattttggagatcacacagatctggagtttatgcctactcggctgttcataagttttaaaagtgaagctacttaacctttttgagtctcagtttccccgtctgtaaaataaagacacaggatgttactatgcatttgttgcagcactattaacatggccttgcaagaagtgatctggagctgagctctgttaaattactcctgatgatgacggtgatggtaatgatgatactataggggctcccctctgaagtctgccagaatctgaaggcctttagagatcactcggtcctattgtttatttgcacagatgagactgatgtggtctgtggaggtgtgatgggggcctgacctcaggcctccctggggctgcgacctgcgggcccactgaggcatgagcaacctccagctgggaatggcctccccacgttgctgagccctgggctgcacagccgactttgggacttggagagacatcagtgccggatgatgtgcatttcattactttcaatagatgtgtaggttgttgttgaagactgataacttgctcctgttcatcacacgtgtgctgtggcagacaccctccagggatttgggctttgagtgacttcagggtgggagaggagaaaagagggcatcactggacctcttccctggtggatggaacagcggcatggcttgtccaggttagcaggctatgccggcctggtcccctgagaaacctcctccccacattttgaggcctgcatacatgctgcccttaagtatgtatggcagaggcagaaactcaacagagacataagcttcccagcatcaggtaccaaacatgacagaaacctattgcgactttaggagatggtgagagaggtagaggtgtttgatgggtactcagggatgatcagataaaagcacttgggcagcatttacattgcatgacactagtctgagaagtttacacaatgaacttctaagtcttcaccagaaccctctgaggtagtgcaatgattattcccgttttatatatgcagaagtggaggcacagaacagctccctaacctgtccaaggttacccctaagtgcacaagagagctggaattagaactcaggcagttgggcctggagtctgttcttttcgtgttctcagttggaggctgggacagaaggacacagcctctttcccttggtgagatttgggctgaatgctgggaaactgtgagcaaggacattttctccaggcaaagagaacagccctggagcttcgaggagggcctgggccactcactctgcattcctcagccagcagccacactcagttgcctggtgagcctctggagaacgccagggcatcatcaatcacagcatggcccctcctggggactggccccgcctcaccctgcctttcctcactcacttgctgagttctcacggagaaagggatgggaagggagcacagccttcccttgaagcactggctcctggcatccatgaagatgtgtggttgggaccaattctgccctgaagttgatcaacagggttatgttgagcccctgccaggagcttgggaccccagtcatgggctatggaagggatgagacccgtgaaacccaggcccagccaagggagggcacgggacaaactaataggaggaaagagggcagttggcttagagaagggggaggtctgcaggttgggagattgggggtcccagaggagggagcctctgggagcctttttggggcaaggaagtgagtgaaggggtggcatcccactgagaaaagaaagggaaggggtctggcttctgccaaagccctggaggcacatctgctgagcccttttccccagatgtcagaagggctggcagctgctcagggggcagggatcctgccagctggggctggccacagagccccttcctgtgtgcggcactgaacagagagcggtgttgagctcatttgcttatcctcatgtattcacctccctcagctcctctgtgtgcccccaaggttcatgatagggactggaggtgatgtattgagggaacaagaaaaactaaggaaaagtgaccaggggtctccctactctgaccttactgtcccagcagagcttgcctggggcagagggctggccatgcctggaggagttaggtatggcctttaccagtccccatagatctctagatctgtgtctgggggacacaggactattctggtggtgctgcaggaatgtgtcaggaggaagcctgagccctgaccagcacccttcactcttcagcttttggggaagggctctcctggtccagccttggtttacactgacctcagcgtctgatcctcaaagcagcacagtggagtttcctgggaggcaggccatggcaggaagaaggcctccacctgctccccgagggaagacacagataatcagggccatccgctttccctttcctcttcagagtctgtaagtgaccagaaaggagagctcatcaggcttttcacacgctgaaggactggaaggttgcttttctctgtgtgaacagctggaaaagccagtggagaatttccatctcagtgggcaatgggctccttcctcctgtccctgagcagtcctggtctcgtcctagcctgagcagtgacagaggagaggcccaagggtctggattctcaggggtttccagacctggaacggaacctttcctggggctgtctgacagtctcacctcccgctctctgtttcattctgaaccactcacattatactttagcacttaattcaacagtcattgaaaatatgctggttttagttttttcatcgttttgacctaagatcatgttggtgccaatttcctttaaaataattctctacctgtgggccactggcgtgaaatcccagcggcagcccccgccgaccctccctccgtaattccatggcctcccctcgctcacgctcccctcagggttccttggcctctgtgtttatacactaatgttttttctcacacattcattgtgcagctttccttaatttggtgtcccgccgggcgccagcaggaagccactcaaacattatgtcagtgatctcaaaattgaaccccagggctttcttctgccagcagatgtgtggcacactttattaactcaagtacccacgagttgaaaatttcattagtttgaggggagggctaagtcccatcaagagacctggtctggacagattctttgtgtcaacctgacccctagcaaaacggattattgttctaagtgagacaagtgacctaatgttctgcctattatgcacacatggtctgtaaccttttaaaatacgagtgtgggaaaacagcacattctgccacatccctgaccaaaaattcctgacaggtggcagccggcctcttagcaacgccaccaggagcctggagttatccaggggccacggtggttcccttaggccaggtacagggcggagttgggagacctcctgctgggaggaaggagcccatgaaggcagcgctcagcctccagagccaccctgtgacaggtcaggggacagccttggatgggccatgagagcccacctcctgtatccccttaaggtggtcccccggctttccaccagactgggagactcacagggaggcagtttgtttgctgtgctaagaaaatttcccaagactctgtgctgggcactgagtgcagccacatccctgcacaagactcccttctcacctgctcacccaggccctctcacactaccttgttccaagtggcctgatattctgcctgctaggcacacatagtctgtacccttttaaggtacaagtggggaagaaggacactttctgtcacgtccattaccacaaattcctgacaggtggcagctgggctctgtgggaaaaggaccaacatgctcagttgagcttagcacctcctgaggcctccttagcaaggctggagcctggcctgtggaggagacaggtgtcccagctgtggcccagaagtgtgcaaaggttgagggtgagaaggtggaaagactatggggttgggcaaggaggtataatctccgcttggagcatggctggaggagagcaggtaatggaggggtggggagggctcccaggaaggagggcctgagcagggcatgaacaggccagagaaacagggtgaggaagggttctgggaaggaacaggccaaggtgtgggccttgggtggagtttcgggggatgcgaagcggaggctgtaataatgcacagcacgcttgctctggactgttttgggctcggacacagagcagtccctaggctgagagaccccaatggagtggggacaggcaacattcttcgtggtacctctgtctccagtgggcctgttgtggggatgcatcttctgacaaacccgtctcttttggggtagatgagaattcctggagatccaggaatgcagccttcaggcctgggtttgttctccccggagtctctgtgacctggcctcccagagagctgagggtaggtctgcactggcccctaccttctgacagacacaaagcagagctggttgtaaaaacttaattaaatgaaatattttaacaagaaattcctagaacagaatgccctgctcgtaagcaagccatcacagaaataaaagctgacagaaagcgtgtgttctgtccaggaagagaaagtttctgcaagaaacaagatagtgcagagagctggcctgtgctggaccagtggctgagcaagcttgttcctggagtcaaagccaggcagactcgggacacagccctggggctgtgactacttggctcaggaatgcgtgaactccagaccataattcaggcattccacacacttttcctgagcacctactgtgtgctgggcagtgtgccgggctctgggtatacaatgccttcggcgttcaccaggtgctcctgtgagagggctattttgcaagatgaagaaatgggggcttagggaagtgatgcaacagggtaccactgaggcagagctgggactggaactcaggtctgcgaatcttcaagtccaagctctttaccacctcacctactctttacacaacagctcagttagcaaaggtgctgaagaggaaactcgactgcatttgcaggctgctaaattgtggctggccccatgcaaggccacctctggggctggagtgtgccattgtaccttcctgggggaatgcaaccaaatcctgtcctcacactggagtgagagtggacagagacactcattcccatactgaggaaagggcccgcagatcagagtgtgtagcttgcatagtggacttcctggaggaggtggcacttgagaggaccttgaatgtttctgtagagagtcaggggaggatgtgcccctacataggaggggaaagggagtaagccacacctgagagtgggcagcagagcatggagtgatgcgaagtggcaggaggagcctgcactggaggcgagagtggagcctggctcagggactgactctccagggaaatgttgccctctgcatgtgtcagtaaggatgaggtgacagaaacatctcttgctcccttgcccatctcgggtgagtgtgagagaaatgcattgcatgcacaagccaaggaactgccttgatttctcctgattgattatttcccaggctagaagggttttgggaacagcagagtcaaatccttcctgccacccggtgcctttgttccacaccatcttccagtggcctcagtaggacttggctcagggccaacctgatttaagaaaattccatcaaaaaatcctgacatgcaaagaagactcattttaggtaaaatggttcacagggtaagaggaaactttgttttacaggaatattctccatcaggttatcttatattgtaaatttcaaatattctttgatttattcaaggaaatgcccaaactttacaggatatggtgagcgcgtaaagtgagacagggctgtgttttgttcagaaattagcttacaagtgcctcttttttgcagcagagaaattatctttaaactctatcccctacactcccccaaggactcagccccctactgccccagggagtctggagaaggaaaggggagtctaggggcgggctagtcctatgtttggatgactctctgcctctggtattattggggagttgaggttgtatgtgcactccgtcccagcatcatggctttgccccattcacagagctgagggggagaccctgcatccacggcttatctctgtacctgtcataggaaagagtcagccctgcatgggcagccagacctgtgagtggggaggcagggtgcccgggacggggaggcagaggtggaggctaaacccactcaatagagcatgacagcaagccctcagtcagcctcatgaaactgcagccccttccatctcccatccaaacctttttctgagagaacaagcctagaaatgccactttagtgtgtgtgcttagccagtcagaggacggcagcacacaccagtgctgagtgagttgtctcagaggcatccatgcaagggaatgattgttttcagcaaactcagggaatccccaagaggaggcccttcaattacccagccactaggtgagacatggaggaaaactgacgagacctcaggggaagccccttggaagggcctggttgatttcagtttggcctggggagtgacacaggcgaggacaactagatcaaggcaagcacgtggcctgggtgtgcttcagcagggatcggggggtcttcaaggactaagagacattctttgctgggccttggaggatttttgtatagagaataaaaagaaacggtcacagaggcgaaaagcttagatggtatagaaggacccgggctcattcagttcatctggagcatgttattgttctctgagttcccattttacagatgaagtaactgatgaacagagaggtgaagtgactgtcccaggaccccatggctggcgagtggcacacttggaactcacacccacgtctgtctcccaagtgtgctctgtgacctcctgcctcttctgtctccgtgatcccagaatccctataagtcctcctcatttgggcccctcccagattgaacaccatgtccagcctcctacatcagtgccttgtttatttctctgccctgaatgcttaggagaatgcctggcctagagaaggggcttaacaaatagctactgaagcaataattttgccttgagaaggaagatttcatctgtccaaaaatctcaggtgaagaggagaaggaagcacgaaatcatttaagtgcttcataaaagccatgcacttaaaggctttacctttttctcctttgttttaattcattaaatacataatataactaagtcaattagtagtgccataagcacctacaaactcaccctccagcatgagaatgagggcatgagggtcacccacgttgacccatgagtcctcaccctcccttccctgcctctccccaccagatcgtaacctatccggaatgttgagtttagcattccctggcttcaaaactataatcctagaaaacaaagcattttgttcttgattttaactatattaaaagagtctggcagccgggctcagtggctcatgcctgtaatcccagcactttgggaggctgaggtggatggatcatgaggtcaggagatcaagaccatcctggccaatgtggtgaaaccccatctctactaaaatacaaaaaattagccgggcgtggtggcacatgccagtaatcccagctactctggaggctgaggtaggggaatcgcttgaacctgggaggcggaggttgcagtgagccaagatggcgccactgcactccaacctggtaacagagcaagactccgtctcaaacaaataaacaaacaaacaaaaacaaaaataaaaacaaacacaaaccaaaaaacccaaaagagtctggcactgcatttcatcttccaggacttgcattcttattccctattatgttgtggtcagattcctctaagtagttgagtataattgtaattgtacgtcatttattttgacttctgtcaatagaaaaccatcgatgcattcattcgctgtttgccaggctccatgtatgttaacctcatttaatctttgtaacaactctgtaacataagatggggccactttctcctcctgctcagagttgcttaacctatttttctcattgatctccattttaatgatgaaaactgaaggttaggaaactcaagtgacttttctgaagttaaataactcatgaatgatgaagcttgaatttgagagcggggacttcttttgagaggagggaagtattgactgccttggttcccagcctcagctcaacagagctatggggcagcagtcggccctctctattgttctttccaggatcatccaacatcccatgtgattatagaaatgttctaatgactctagctctgatcccacttcaaaggctttaggtctcctggagctatactgagctccattactccagaaagaccttggcaccagcctggatgagccccacctgatgaaaaagcagaggaatggagagagaattggtggagctgggctattggtccagctgtgctttccttaggcactgtttctgggttagaatctaaactctggatgcctctgctcactgtggtttggtgttcatgctgcacagctgacagcccaagccacagtttaaaaacaagggtggggacacaggtcttcagttcatgaaccagtccaccttcaaggcctgagtcatccctctcaccccaagaatgggctttggtggtgtcagtccagggagtaaaatggacacaagtgtcagtgttagcgcctagtgccctggcattgttgacttgaagcactgctcagatctggggaaggcatgagccagtctatgtagcagaataaaggcagggccctctccttgtggaaacatgtgcacctactccaccaacttttatgaggccctggaatgttatttgttggtgaccacccaaccatcccaccaacaaatggagcactctgaagggagttacagctgacctcttaatgtgaaacagcatacaaggagatgagctaagaggtagggtctgtttctgcacatttatctctggttattagacacttttagagggaacatctgtttgtccactctggctcccatattgcaggccccatttgagggccagcttggccccttctctgactgaattgggactaagtcataaattagattcagaaggggacctagaatagggagttagagggggctttgctcaactcaccaaaaaaggggaattgagctattcaactgaccgggcttcaagtaaaaagcagaagaaaatggaggtagctctgaagacatctggtggtgctgagtcccattggacccatttcttatcaggtttatcctgaggacagcaccactactctaggcgggacctgggagtcaaaccaaagcacacagcttgatcatgcttctgaagccccagggacttgggctgggctccattatttgatttctcctttggttgaaaactttagatatttgtttaatgggaggaatatctgtatttatagcaggactttccacgtcacctcacagtatgttcttagcagatgtacctgttgacttactcccaggacaatagggcaattaactgtacaaaaggaaaaactctttgttttcttgttaagtttctaaagatacttatacaaacataaaattaatgcaattattggttaaaatcctcatttttccctactcctttggatattgtttctctagcccacatttccaactggcctgctagatatctctgcttagacacatgattgcaaatggaaactcactatgtgatccagtagtcccattccagctgtgatagtcaatgagtccatgtcttatactaataatctcccactcaacacattcctcccatttctactgaggctccatagtccttcaagttacacaggttcggaatttcctaactctgaagtctgctttacctattcttccttgttcctatgttcctctctctctctcctgcaacccctccagttcccggcttcagtgacttaccaaggcaactccatttctaagagcttttgcacccatcctttgtgttttactcaatcagccacctgattctgtcaattctgccttcccaatcttcttctatcctaccctcctcaccattcccaaccctaggacttgactgaggtgctcctcatctgttacttggaccctggcacaacctcatagatgtggtttgggtctgtgtccccacccaaatctcacgtcaaattgtaatccacaatgatggaggtggggcctggtgggaggtgactggatcatgggggcggatttctcctttggtgatgttctcgtgatagtgagtgagttatcatgagatctggttgtttaaaagtgtgtagcacctccccacacttcctcctgttccagccatgtaggttgtgcctacttcccctttaacttctgccatgattataactttcctgaggcctccccagtcatgctttctgtactgcctgaggaaccataagctgattaaacctcttttctttttaaattacccagtctcagtatttctttatagcaatgccagaacggactaatacactcatatccagattcaccccattacaattcattatctataggttgtcatgttggttttccgaaatcacaatgcatgtcacccttctgctcaaaaacttttactggatgtccttcagcaaagagagtgtcatctttttactctgacattcgagccctctgcagtactatagatctgcctttccagtcctctctccttacctttcctgtgctttggctaaactagataatccagtgtccttacaacacacccaactatcattctttactcgtcttcttcctagaccaccctctctctcatctgtttattaaagtcaatgtatattcgagatccatttcaatcttttctataaaaatcccctgattcacaactttcctcttttaaatccctcatagtactttggttatatccaccatgagaaaacacgtttcacctttgacagataaatgggcagacagacctccaggaactgcatcttattgatctctgtctcctctatagagccactgcacagtgccttacacatagaggtgttttatcaatgcacactgaaccagacacgtagccctgcctccattctttcttcttgccataacgtcattttaataatcatctaatgataatggcagcttttctctacaggacattaaaggttgcagaactctcatatatgttatttcaactgattttcatgaaaagtcctgcaaggcaggcaggatagatattatctccatttcataggtaagagaactgaggcttgcagaggtgaaataagttgcactgagtacaagcaaataaaaaatgtagctattaattgaaccagagaagtatccagatatgcagtagaagacctaagaagggagcaggcaaagtccaagtccccacaaggatcccttgttcttcaaactttattcagtacaacaaagacattctgagctcatcaggggccctttgtatgagggacactggtcaaggaactgggcagtgggtaccatgtgactgcacaatcattttggatttgtggctatttttttttcttttcagcactagatagatatcaacaaataagcactgggaatcttggactccctctttccctccaaattaagccacaattccaggcctcctttcagtttgaacactcactaaatttttgctgcttatagctcatcagggaaactcttgcagaactattcctggaactattccatgtggtgccttgggatttgagtctaatttccatgtttctctcactctcaaaactgacccctcatttatccactcatttattcgctcacccacccatccatccatccatccatccatccattatccaacagactttccttgagtaccagattcatacactaccgtattatagctccatagactctttctcactcttcagttcagtacagaagaatattgttaaggctatgtgtttccttttccaggtaacgcctgtgcattttaacagtgggcttcaccaagagaatgtgaagctttatgaaagaatggtggaggttgaaggatttttgaattaaaaaaggaggtcttttccaaatagacctcatgtaggatttgggaggtggtgacctccaatttcttattgcccccaagttacactcttctttgctcttcagtgtcatggaaaagaatgcgctgttttatatctacccttgtcagtaatatgagtgcaagttttgttgcacaggttttttgcagctttctctttctagagctcagcttggaggctctgactggatattgccagtgtttaaaatcagagtttgaagtgagtggatgtggcaggagaaacccttgggtttttactacacttgggattgttggatattatatttggaaaaataaggatgcttaagagcctaaagagcatacatgtatgctgggtcacagaattgttaggaatctacatctccacccctcctctcccaatcatactttcttggccttgaatggatcctggcagagctccagggagacatctggggtccgtattgccatgaagcccctggggctaggactccctagccattccttctccactcctggcaggctgagtgaaataaaggacttgttatttcatctcgaggcctaccggagagccttgccttgcaaaggcagacagtcagtgaggaagactatgtggcacatgaagacaccagaggtgttcctcaggatcaaagtatgtacaagcctttgtgaatattttttccttctcacttggcaaatacaattcctgagatcaataacctcgtctttttaattttttcctcgtctttttaactatttataaaatattgaattataaaatatgtaattataaatactttaattataaaatatgtaattataaatactttaattataaaatatgtaattataaatactttataaaatatgtaattataaaatatgtaattataaacattttaattataaaatatgtaattataaacattttaattataaaatatgtaattataaacattttaattataaaatatgtaattataaacattttaattataaaatatgtaattataaacattttaattataaaatatttaattataaacattttaattataaaatatttaattataaatattttaattataaaatatttaattataaatattttaattataaaatatttaattataaatattttaattataaaatatttaattataaatactttaattataaaatatttaattataaatattttaattataaaatatttaattataaatattttaattataaatattttaattataaaatatttaattataaaaacacaattacctcatctttttaaatatttttgcaaaatatttccctccataatttctccgtttccatttttattctgttacttaaatcacactatgtgttctagaggttttgctgtgccagaacattttatcaatgccctcgtttcactgtctttcaatacaaatgagccacattcagtggtatgatacacaataaagactccatttatttgttcctcctcccccaagtttagcaaaataactcagatcctgattttctttaacttgcaaaaaatgccatccttctgagttcagagaccttccgagccctggtgccagctttggtgcaggtccagttcatatgtgcttctgcttatagtctactgcctactgcaaggctggctcactgtatggttttatcaatataggcagtttgaattttttctgtgctatgtgaaagttcaattggaaaagaagaataaatgaagatttcttttaaaaaattagaggatgatagtaagttctcctggagcaagcttcatgtaggggttcatgactgtggttgattgcagctttttcagtaactccgtgatgtatatcagaaatgtgtggtagttttgaatggacaggtcaatcaatcttttggattcagcaataaatttttcatagtaatcagagagttggtctgaaaaatcttgcagtttatatctaaactgctggtggtaatcagaaattattttcttcgtcgcaatggcctggcttttaattatttcctgagcagtggcagaaagctctgcaatcttctctttcccttttccatctggatcggtaaggatgctaagatattcctgaatatttctgtgcagaaattgctcaacttgacttgagagttgggaagtaaagttagaggcactgacaatatattcagaatggaagtccttaagagcaactaacaggttcttgatcagactgactatcttttcttcaagttcataatatttcactgtccagccaactatacttggatcaaaatattcttcacgaagggccataatgtattgatggatctgctgtaactcttgagaagcttcctgaagctcgttttgaataaattcattgaacttatgaagattaaggcataggttttctttcaacaatttaaaaacatatgggatataatcactgaagattgtgttgatctcatcttggatataattaataagataagtaaatttcatctctttcagctgtttaatgttatcttctattagttggaaaatgaattgtaaaaggtcctgaagattacgtagcacctctgtggtcttgagagactgaatggctttaaatacctcttgggcttcttttgataaatctttcaacagttccctatacatcgagattacatctattagtttatgtttccttaactcgaaaggaagtgtaatcactaggtcttggaaataggaaaacagtatttctgaaccattatggactttcgaatatacctgggacagtaccgtccctacctcccttatgaacatagtgcaaagttcctccctagtgtatatcccaggtttccccggaaactggaatctggggaagttcagaaaatcaatgagtgagtcaatcagatgcttgactttcatatggaattcttgagtaactcgtaccaagccatcaaacacgttatccttgagtccctggaaactggcttggccttcctgagtcaacagttcctggtacagattctgggccttgtccttccactcttggtaggtcccagtggtgccactggctgctttctggaacctcacgtcgatatcatcaatttgcctaatggccccttgataaacccactcagcattgttctgcagatttcttctcagctttgaagacacttctctcagggtgagccctgtgtgttcccagtggtacttgttgacataatcataaaggacccctgtggccttgggcacgttgtctttcagagaggttagcaagccagaagctgcctcttcttcccaattaactttgatctgagtttcctcatcagattcccggaccctcaactcagttttgaatatggtgagttttttatctggagaggactaaacagagagaaaaaaaaaaataacatgttttcaattactccaattacacaatatagtacactaaaacttcattagcagttaaaaataaagatcagagaatctttcatatactgaaagggatttatctttcatatgtcagttcatgtgtttgttttatggttaaataagtctactgttgttaatttctctttatcacatgccccagaaaggatttaacaaaaacgcttgctgtttgtcatttacattgtgacacttaaaattaaagccttcctaggactgaaaactggaagaggagtggggggaagagaaagaagaggagagagaagaagagtcaggaaatgacagataggaaaagaagaaatagcaaaaaaggcaagttggagcccaccctgcagagacccagaatcccaacatcagtacgcattctccaagcccatgacaaacttttagtaacagtcatagaaccatgtttggtcttctcctctggtaatgtcacccttgatttggccctggcagagcttgtaaatgacatgagaggaatttgatgtatctcatctagcaattctattgtggggaagaattttaaagttttaaatactacagaaaccagtcctctctgaaaaatataccctgcctatggctgagcttgcctatgatttagatgatgaggtataaccctcatcttcctggatttgcccagaattaataaataatagtgctgatgggatgtcatgtgtgcatctaaacattaaaatcaatcaaggactcattgtaatactttctagagaatatttcctcagagaagaagttgcttaccgcctgtctttcacctagtttggggaatctctgaatatttggtcctgaattaaatgtatctgccccaattctccactcgctcttgggggcgtgtcactcattaggtggtatttacctgagggctgtagtagaagttccatttagaaaagtcgtcatcttcatccatatccatgcccacggtgcctacggctggggaggctgctgaggtggagatgcctttcttgtctttctggtagcgcagatggagatcggtgaacgctgggcttttgatattgaggtgcgcttttccttcccattccctgaaagcagaaaaacagatgagctatcacgaaaggggtatggagatgaagaaaatcacaatgagttttcaaaaggtataaggtttcaattcaataaaagctccatactgaagtccttcatatttgccatcttcttcatattctgcactgaagtcacggtgtgcaaatgttcctttagtcttagaggctaacgtaccatcttcgattttgtgtgttcccaaaactgtataggagagattttgtattttattagattcataacagtaggacgttgatgttttcattgtgaaaactgggagaattctatcctaaccagatatttcacttgtgtttaaaatatgcaatgtacagctcacacttattttaaaataaatagttaaaagacattgttagtcctaaaataattacagaaaaatccattttctttaaagctgtttgtcttgaatgacactagattttctacagtttggtttttacgtgtagggtatacatgtatctcttttcttacttaaaattttgtgacattgagtaattgtacatctactcacaactaaatacataattatttactcataactctcattgaaaatatacagtatctaggagaggaggcaggatatttcttaccatttagttcatattctaggaactgtacggttgagctgcatgtggaatccaggactgtttcaacataatctgctttgtttttcaaactggcactccaagtggcattatacacgggagagtctacctcaaagcgtgcagtcagtgcttgaaaggaaggaatgacaattccagcaggtacagagaacttaatggagggaatctcaatggtctgctcaggcacgatgatggtgggcaactcaaagtctgcgatcttgttggctactgcatttagatccaaagcagcaatgccatctgaaacactttttggaagcgtgaactgggacacagttaactgagattcaggcacggttatctcaaaaaagggaatcaaggagtcttctggttgagaatattttgttaacacatcaacttcagggaattttacctcggggagtgttggtaggttgagggcaaatgatgaagttctcagcttcttatagatttgtatttctctgaagtcaagtttgcacgatggaacctgaagatctgtaaatgggacatggaacgtaggcatgacaagaactgaatttagatcatttagtttcagcccaggaataatgaatttatcagccaaaacttttacagggatggagaatgaatagccattggggtttttggtgtacacaaaggcagttgaaacacgaagatgctgtctcctaccaatgctggtggttacatccagctttaggaaatcccataagctcttgtcatagactggtaggatgatatttttgaggaaccttaggtgtccttctaaggatcctgcaatgtcaaggtgtgccttttcttggtcattggaaagctcgacctggctctggaaagacccagaatgaatccggacttcatttttccatctgatcttctggttcttagtgttagcattcagggccacttcctggccaaggtcagggaaatcatggaaggaactgggctgacttgcatggacctgaacaagagctgacatttgccatggagagagttccagggtggctttgcttgtatgttctccgttggtgaaaaagaggccctctagctgtaagtggtttttcgtactgtgctcccagagggaatatatgcgttggagtgtggcttctccagcaaaattttcttttacttcaaggttccagatatcatcaattttggaagtgccctgcagcttcactgaagaccgtgtgctcttggaattcaagtaagtgttggcctcactagcaatagttcctgaatattcccgagaaagaaccgaacccttgacatctcctttggtagatgactcaatggaaaagtaagaggtgaggctttccaagctaagcttgtggtcaactgctcctttagcggtagagtacagcattgaagaattgaaatcatacttaaattccatggaggaagagacagtaggttttgacttggtatttccattaagttcttgcttgaaattcattctcaaaattggaatttgggcttttgtggttgttgccactgacacttccatatttttcgtggttaagctcacagtactgttatgactaccctccacaaatttgttgctcagagacagagctgtggctaacttcaatcccctttttcttgtcaatcttgtggtgccctctaatttgtactgcagtgcatcaatgacagatgaagatgaagaaaggagatgagcaacaatatctgactggttaaaaagttcagcattggtattcagtgtgatgacacttgatttaaaggagaaatcataggtaatattgcccatggcaggaataaaaatatggcttatggtacacaattccttgaaatctggaagagaaagcttgagatttctagggacatgaaggactggcagctctaatgatggcaggattaatgtgtatgaaggcacacggacgtcagaacctaggatggagaaactaggcatgctgactgcttttgggaacacatagccgaatgccgacatctctatggtgaatggagacacttcaacattgacaactggaacagtgtatccaggaatttgaaaggtcctggggagctcgtcgtgagatttttcagctttgtacttatcaaacttaatttttgtttcattataggatttggtgacaaaatctaatgcattgtttctgtttttttcaaaatgcctgtcaaaggatttgatgctctgactgataaactcacaaagcacagccaaaggatttgtgatggaatgcctgtgtttgtttttcttatactgagcttttacacttaaatcaaatgattgctttgtcgttttcaagaattccttcaagcctgttttttcccatagagagaaatctttcagtggaggagttgtgattattgtgtaaggtagacgcatttcaggaattgttaaaggaatgtttaagaaatccagatttgcttctccatttattcctacatgggcctccataatgttctcgttgtttccagcagagaaattttggttgtacttatactgattgaacctagcacttacttgccaacttgcttgctgggcactgggactcagaaacagtgcatagttattcaggaagtctatcttccctgttaaccttaatggaaaacgaactttcaaattcccttcattgtttgtggatgccgtgatctcaaatggctgggctgaaaagaaaagagaatttttcaaagttccaataacctttccatttaaatgagcatcatgcctcccagtaaactctgccttcccttctccaaacagtgccatgcctttagcagttagaacactgtggcccacatgctgggaatcgacttgtgattgaatttcaagtttagaaaagttgagggagccagattcataaaccaagttttggtttactcttaggtgtttgctattgatcttattggacagtccaaaggaagtgaggggtccttctatggtgaaactaatttgtgattcatgtgttccctcatctgagaatctggggcaggcccatttccatgacccttttccagaagaagtccatgctatgtggccagctttcaacagtgtcttgatctcgttgcgcaggtcagcctgactagagaagtccagtttggggatgttcaatttgtggaagtatttagtgttgctatccagggtaagctgattgtttatcttgacaatcactccattactaagctccagtgtatttttttctgtgtgtaaacttgccactgtgtttgattttccctcaatagcatttccaaaaaacagcatttcactcccatgctccgttctcaggtacttgctggagaacttcactgactccttcagagccagcggattaatcttagggtttgagagttgtgcatttgcttgaaaatcaaaattgagaacttctaatttggactctcctttggcagtgatggaagctgcgatacctgcttcgtttgctgaggtggttccattccctatgtcagcatttgcatctaatgtgaaaagaggagattggattttcagaatactgtatagcttgccaaaagtaggtacttcaattgtgtgtgagatgtggggaagctggaattctggtatgtgaaggtcaggaacttgaaaatcattaaggttgagagttgggattatgaattctggaattgcgatttctggtaaacggaagtctggcagggtgattctcgctagaggaatgtcctccaccttcagatccctgagatatatatctggaacgggccactgcagctcactgttcagcatctggtcaatggttctgatgatctttactttcatttctacaaagtcaattgtaaaggaaggaatgtggaaggtgttaaggatggtaaattctggtgtggaaaacctggatgggatttttatattttttaagtctttgaagtttatctgaactgatggaatcctcaaatctgttagggggactataaaatcaggtgtctggaaggtagctttctgaagagcctgaagactgacttcaaaggcaggcatggtcccaaggatggtcttgatttcaggaacagtgaacccttgctctaccaatgctttcatacgtttagcccaatcttggatagaatattgctctgcaaagtcagtaaggttcttagcagcaagagtccaccaatcagaaatgtaggtgacaagtgtgctataaacctggcctaccagagacaggtatcgttgaagttcctgctgaatgtccatttgatacattcggtctcgtgtatcttctagggtctctcggaatttggccttcatgtgagccaaagatgctgaacttaaagcctcctgtaaccaattgatgattaaggttattttggtgtcctgtaggctttccagatacactgcaactgtggccttggtttcctctaaaaacagttttaatgcttcagctttttgtggtagttccagagcctgaatttcaccattgagtctctgagtcacctcacggattttgtcattggtttcatctacaaactggtggtaatcaaatgactttaatttctttatcaacatgtcaaggaatttgttaacatcttcaatgaatgttttaaaagataattcattaagcttcttgacagcatcatcaataaatccaaccaatttctcaaagtaatcttttatcttaacttgttgtaggacattgcttagcttctgaatagtctccttcaacttgtattggtgggccaactctactaatttatccattaaaacctggatttgttggtctacttcatacctctcgattaactcatggactttggctctgaaggcattgattttctcagctacttcaaaatccccaataagatttataacaaagtgtttgacatgctcaagaatgtcatttattctttcaaatgaaattgtagttcccaattgatctaaaagcactctaacatcaatagcctcaatgtgttgttttaactttccagctaggtgctggatgtctatattctgtatgtgtctcttaagctgctgcagtttttcttgtatctggattctgatttggtacttagtatccacattttgaatccaggatgcagtactacttccacttttgttaaaatcaatattttcaataaacaaatgtagatcatggattgtttttactaaatttacacggatatgatagtgctcatcaagactttttaatttttcaatgatttcatcaataatattagcaatagctattttcaaatcatgtaaatcataactatctttaatatactgatcaaattgtatcatatatgtctgcagttgagatagtttttcattaaagttgattttggcatcatctaatgcaatttgtatatcattttctgtaattctatacttttttgtgagagcagtcagtttctccttggcatgtgaaacttgtctctcccaattgaatgaattcagataatcattagcttgctgtgggagttttcccagggctgctctgtattttcttacaaattgatcaatattgatgtgcttcaggtttctctgtacgttttccagtacaactataatggtttgtcgattcctctcaaaatattcttgcaaggtctcaaaaaatgggaggttaatggagtgaacatcttggtttttatcatactttacaaaagcaacaattgtaaattcttggggcttctcaacggcatctctcatctctaaagcatcaatgatattgatgggctcactgagtaaaagtggcactttaattggggagtctagtagagttaggtcagccagagttcgtccagtaagctccacgccaattttatctttagtgttgtaagcatccaagtcctggctgtattcattgttgttaaattgggtcttgagtttccaggtgcctgtctgctcagctggagtaagcagggcactgactttgtgttcaagagctgcactgatgcttttcctagacacgagatgatgacttgtggagcctttgtaatcatgagagaaagtaaatgccagaggttctgctttcaacaggaatttgctatacagctgcccagtatgttctccccagagagcgagtttcccattgccatttgtatgtgcatcgatggtcatggtaaacggggccattacagaacggaagacattgctgaaatgcagtgagtctgaattatagtttgtgctcatgtcaatggctgaagccagcccagcgatgtctgtgttgagccgatggctaaactccacaccctgaaccttagcaacagtgtctgctttatagcttgctgataaggcagcagaagagatggcatagatgtgttttatttcattattttggtaggctccttttaggttaccagccacatgcagcttcaggggttctagccgtagtttcccattgttggtgagatccagagcattgtatttcaggtcactgtttaaagtagttaccagagaatagggctgtagctgtaaattaacagtttgcttataaaacttgtcagagctgtaaatgttgtcaagttttgaagagaagtccagtgataagcctgcaatgttcagactgtttgtgtggtcaaatttcatttcagcatatgagcccatcatgtcatttgagagcttaagtccttcttgactgaccttgaagttgaaaatgtttttgctgtcgacacccagaatcatggcctgataagcacttcccagtgatagctctgtgagggcggctttcccatccagactgaattttgcattgtgttccctgaagcggccatttgttgttaatttcatagatgccccagagaggccaagctctgcattcagctcattctccagcaccaggagactacacttcaagttggtcgttgcactggtagatattccatcttggccaatccttagtgtcgccttgtgagcaccactattaattttgtcagtgcctaagatgtcagcatttaactcaagaccatgggaatttagtgatccagaaagcaggctgaagaacctcaatgactcgtaatcagcctgatattcagaacgcagcagtgcattttgcttagagaaggtcatatccatcttgttagaagtggcaaagttcttatacttcccattggtgtcagattttaaagtcagctcgtagttctcatactttagggaagcagtatttttaatgatgccactttgcagatcagaggtggaggtgagggagagggttccatcttcatatcttcctgttatctggttggtgccttggaggtaggaggagttaaacctcaggttggactctccattgagccggccagtgttaggatccctctgacaagacaggccatatgtgcctttagcatagaacgaagagactctgaactgcccatcaatcttgacttctttgacaaacaaatgctgtttctttttggagtccaaatgaactgaagcagacatctgtggtccccaggaactagatgcatcgaatattagtaaaccttttgagactgggttgtttccaagtttttctacatgactgaatttgatattcgaatctagaaatttgtggcgtagagacccatcatatgatagtgtgaacgtattcttgtggtcatatgttgtttctccagatcctaacataaaaatgaaaagacattggttaaattaagcagtacatttccagagcaatctctatgttgaaagtctttcaataataaagccccatttttctgggccaattgtgcaatagactcctccatctgtaatgcaaagataaaatctgatagcaaaaggcattcctccaggaagccttgcctgaccaccacaggctttgtttaggttcccttgttgagtgcttccactctaccttatacttatatactacactttatcatagcacctctcacactgaattataattgctggcttatctgtctactttctgttactgcctactagaatatttaatacacgtgatatgtttaataaatatttctatttgttgaataaaataaaagacttccaagtagcaaggaagattatctgctagaaagccaaagtcctttcctccctggaggaggctctcctcttagagcctgccatgaactagcccggtgcaccctttacctgagcatagctcaccttgcacattgtaggaaagcaggtcaaccacagagtcagccttcatgtggtaacgagcccgaaggctgaaatggtctgtgctggtgttgccaccactgtaggaggcggaccagttgtacaagttgctgtagacattcgtggagaggtctagaacacccaggagaggcacttgcagttgatacaacttgggaatggtaaaagtagggacttggaactctcgagatggcagatggaatcccacagacttgaagtggagggctggtgtcctaacagtctctaacatctttagatctctggaggatttgccaccaaaaggcaaaggaatctcaattttcaaactgttcttgttcaaggtatatttgacccggccatcgctgaaatgaacaacaaagataacatccccacagtcagacatcagtcattcaaagttctctgcctctgaccttcacaacaatattgtacttgccccattcccaaagccactctgcacttttctttgtgctactcctatgcctggacccctttgcttttacctccacctgtcaaacactcaaatcctgacaaagctcttctaagggccactccttatcattaccatcccacctaagtcatagccaatttgtctcattcttacagttacatagtcccttgcacctttctcaaagagcatgtcataattttgcttatataattaattatttctcatttgttgatgtctccatggtatcttcttgaaagaaaaggctataccttacccagtttctatcttctcactgtacctagtctagcattttgcacataggggatacttgatacaaatttgctaaactgaattgagacaacttgatttgtggaaagaacataggtatggaagtcagtaagcctgggttaaagtattttctcagaatgctgcctccatttagtgctcaatggctgttctgactctctctagcttaacagcaagcctgtagtcaataacgcctctagccattctgaattcttcacagtcagagggagaatttgcttataacaggttgtactgaataaaatatcttagggtgaaagtaccagaatcctctaatgactttcttagattcttcctgacagggttggtgttctcatgtttactaatgcaaagatgccacagtgtttgtgctatagttattaatctccttaaaatgcttaaattatttcctttaaaaatttaaaaaaatgtctaaatcatgctatgtaaaatctttcatttactttgcatggttcaagaagccttgctgctttcttcttttacctttttaagaagaggttttctgggatgtggaagtctggcaatcccatgttctggaggttgaactccttcaggctattgaggtggtcttgcaaagtctgggtataaggaagactcccagatgccttctgaagccatgagctcattgcctacaaaatgacaggagatttttaaggtaatgggcttggatgagcctcaaagagcaatgaacattaggcaaaaataccgatttgacaagttaattattaagctggacaatgcactgaaagttaaaaataaataacagaaaattatgaatcttcgttgccagtcactgatcactgtccatatttataaaaggaatgtctaacatagtcagcctcctagctggtgtcctgaagcttcctttgataccactaggcaaagaactgttctacttagtagcatctctttgatatgtatcacattcagctttgtgtaactgggtaactacacacttgtgaaagtttttttttctccccaagaattccctggggggaaggaagcatgccttatacatctttggaaaccttcctgcacctagctcagagttgaggatgtaattagcacttatatccatgtatttattgactggcagactcatacttacaactattaatttggaacccacgtgccggaaagtcatgtctgtttgagggactctgtgatccaggagtctattagcatacatatgcaagctcttaggataatcggagagatccacagggaaattggaagtcatttttttggtatctacattggtgcctgtgttccattcaaattcaatcttctcttcatctgaaaatacgtaggaaatagttgtgaatggtactagttcagcctgtaaccacaggtctcaacacctgcattactttggaagtgctcacacaggggaagagacacataccataatgccatgccaccctcttggaaactgtggagccataagctgtagcagatgagtccatttggagaagcagtttggcaggcgaccagtgggcgaggatctcacttctggcttctgcttgcaaacggggtatggaaataacacccttgatttttctttcttcctttgtgtcacaactatggtaaagaaaatcagttggcaccaatgattttgtcctttcaatggagatatgcaggattaaacagaagttccatttgtggtgatcaaaaccagatacaaggatggttcagagaaacagccacagatcaaactcatcaacttctaaagccaacattcagcacaaattaaggactttgcaaacaggtttaggagaaagagaagttttttgaaaactgtttgaatcctgctctgctatttactagctctgtgattttgaccaaatgatttaacccctctgagctaccatttccttatccatgaaacaggaaaactcacagtgacctcgcagtttattgtgaggaccgagataatttctttaaagcacccagcactgtgcttgatacatgaatagtaagtgcctgataaatggtaggaaaatccaactggacatgcgcagagggttaaaatgttgagagcttggccgggtgcagtggcttacacctgtaatcccagcactttgggaggccaaggcaggtggatcacgaggtcaggagatcgagaccatcctggtcaatatggtgaaaccctgtctctactaaaaatataaaaattagctgggtgtggtggcatgcacctatagttccagctccttgggaggcttaagcaggagaatcacttgaactcgggaggcggaggttgcagtgagccgagattgtgccactgcactccagcctggtgacagagtgagactccatctcaaaaaaaaaaaaaattgttgagggctctctctgccactctgattgtagactaggggagaacatggcttggtcaggtatgaagtggaagaggaataatgaaaagaaccacccaggcctgcagtgcaggtcagatgaccctcggccttctttaccttaggtggcccatgagggcgacctcagtaattttcttgttctgaatgtccagggtgagtctgtaagacgttttgccctcagtagattcatcattaactctgaggattgttccgaggtcaacatcaaaatccggaatttggacttcactggacaaggtcatactctgccgattatatttgaatgtcatggtagcctcagtctgcttcgcacctggacgagtgtataagagaatcaagagatgtgtggtaagaagctatgttttgggccgggtgcggtggctcacacctgtaatcccagcactttgggaggccaaggcgggcagatcatgaggtcaggagatcaagaccattctggctaacatggtgaaaccccgtctctactaaaaatacaaaaaattagccgggcgcgttggtgggtgcctgtagtcccagctactcaggaggctgaggcaggagaatggcatgaacccgggaggcggggcttgcagtgagccgagatggcaccactgcactgcagcctgggcaaaagagcgagactccatctcaaaaaataaataaataaataaataaataaataaacaaacaaataaataaataaataaataaagaagctatgttttggaaggaaagagaggaaaaggtagagaaactccaaggaatcaatgtgcttaaacaaaaacacagttcaggattttactgaattttttttttctcattaaaattttttaatgggtctcatttactgataattttaaactcagttgtgttcatgtatgcaagtctttatggattgcctgttatgagcctattgtgtgctgggcactgctcttggtactggggaatccttgctttcatggggcttaccttctagtgggggaggtgtacaggcaataaacaagtaacttgctcatgtcagatggtaatgaatgttatgaagaagagtaaaactggatacaaggataaaagaaagggatagaagaagtgttatttcatacttggtggtcagagaaattctctctgataagggcacatgtgggcagagaccagaatgaaaagaggttggagccacgctgagttctgggaggagcacattccaggcagaaggtcaggaatgcaaaggccctgaaatggggagcacttagcttgtttgtggaacagcaaaggctcgcagcccttctgggccaggaagacacgacatctctatattactttctacccaagatgcctgtcctggttccttgctgcccttgccctgggctccatctccccaactccccctttctttgtaacaagattcccgggcgtccttcaatccataggctggtccattttatatccttcgtaaaacaatgtttaccaaacactatttccccagcgtgccctgctcctccagtgctttctatcatgggattttcttcctagtttaattctgtgatatgctatccctatataaaaatttttccaaagtgaacacctaaatgtgccccattccctaaaacctgctcctcgctatccctatataattttttttccaaagtgaacacctaaatttctcccattccctaaaacctgctcctccagtagccctttccatctcaataaatggaagttccatttttcagttgcccgggccaaaaaccttaggtttgtcttcattccccttttcctcttacactcaacatccactgtatcagcaaatcttgtcagcctaatcttcaaaatatggccagaatccatccccttctcatatctcttctgccattgccctgatccaaaacaacactgattcctgcctggattattgtgataacctacatattagtttctctgcccttgtctgcccatagtcttttctcaacataaacataaatcaaatcatgaggactccccaatggctttcgtttaattcatagaaaaagccaaagttcttaccatggcctatgagattatccttccttcacctctccatatctctctgtcctcatcttctacctcttttctccctggtctttctgctccagccatactgtcttccttcctttccttgaaacatggtagtagtgtgtcagcctcagggcctttgcacttgctggtccctctgcctgttaacagtcttaccacacggcttctcctcttatttctgataggtctccttatgctcactttaccagggagactttcccttattattccaaatgcactgctttccctgcccttcttcctccctcctactcctagccctccatagaccagtctacgctctgttttcctcctcagtacttatctgatattccaaatattaacttgtttggttgttcactgtaacttccatgaaggcagagactccattgttcactgttctagccccaggtcttagaataggcctgccgcttattgggtactcagttaacccaggtcttagaataggcctgccgcttagtgggtactcagttaacctatttgttaaataggttaaattacatgtcttctcctcatgaattctgaacctgagactgcgagcagagatgaggcagctgtgttttgaatactcaccttctgcttgagttacaaacttcagggtatccaccaaggctctgtcctctctctggagctcataggttgcgctgacagaatactgctcaatctctcctgtaggcctcagttccagctctaatctaaagacattacaatgaagacagtgcataatgttagagctttcaaggatggtgattatgttcccaaaacaattcagcctcaaatgcaacaaaaatatggtccttattttaacattgtctcttgcccttaactaagatgatctttttgatccctcagtcctacaagaacccaaggcaagggcagacaccaggattcccaagactttggacaagcagagcaggagttggctggttgtttcagcaaagctgagaacaagcactggaacttgggggctgaagacagggagccacctaagtacggtgaaggcttcaagcacattggtgggctccaggaagctcatagcgatgggtctggaggctcagaaacatggacactgaattaggagcaaattgggatctgtgctgtgatcccatcccatgcacaaggaagcaaaaggtgacacccaatgtgttggccagaggaccctgctttaaatacccaaagatggtgcaaacccagaaggctagtgacagggtcttacaacacagagtattttttcctgtgccatgctaggtggccatgatgtggaaggtgagaaaatgctgggtcaggcactgagcatctctaacctggtgtccccggtcagcggatagtaggaggcggagtctgtggagctggcgttggagtaagcgcctgaggtgcagtaattcaggccaggaaagacttgcttgcaaactgaccaggactgcctgttctcaatgagaggtgggatcacctccgttttggtggtagagaccaaatgtaatgtgttgctggtgaagaacaaaaatacctgagttattgccaagtcatgaatcaaaatggacatcacaaattctcagggtgcaaatacccccttatcctcctgtcttccctcagtccacacctatctctaactatttaatttactgagaaacaaataatattagaaagaacatcaacatgacaagccatgagagtgactctgaagcttctggctgagttctttccatctgttacctgtaatccccacaacagtaggcttatggttctcattttacagaagcagaggctcagagatgttaaatagctgatcactggggctgaacttcagtgtgccccttccttcctacaatgcagggcaagagaaactgtctctttcatatgaaatctcctactctctacctgcttccttccacctgcattaagcacgctcaagtctcttcccctgtgcccctcccctatgctcctttctttcttttcttgctttctcatcttcctcaccatcaagagttgtctgcctttgcagtctctacttcctcccaatgtgctctgactgctcactccatctcctgaaaatgctttcatcaatgtctctaatgccctccttgctcctacatccaatgggcatatttaggtttcatcttccttgacctcccagaagccttccatagagttgcgcactcatgaccagactaagacgctggagcctctcacatctgaagagatgatggcaccttccttccaagtgtgtacttaaaaacttagtacatgtaagaaagttcaacattggcctggttttttctaaggatgctttctttgaaatagcacattttcctccaagtattgtttctccaagttgggggtgccacaagaccaagctttgctgatgtgctggagtcctaatgccagctttcgcctacccatggggtgatctcccctgtggctgctctttggcttctgtgaccttttatggctttggttctccttctgcttctctggtcacttcttctaactcattgctggttattccccttcttcctttatatgtttgtcttctccatatttctgtcctcatctctcatgtctcactctataccagttgctgtttaaccacaacaacctctgtatactaatgattcccaaatccatatgtggagcccaagcctctttactgggctcagatccataggtctatttgacagctagatttctaaactggttgtttcataggaggacatcaaatacagcacatccaaaactgaatttgtcactttccttgaaaccagaagctctcccactgtagttcttattaaaatgaagggcgcctccttcctcttttcttctttcttttgccttgtccccatacccagttaatcacccagtacttatgattctgcctcttagaaagttgtagaatctgctcactcctttctatacctggcttttctccactgcaggccattatcagctcttagccacataggatcgtaagagatgtccaatggtctcttcgtgtccagctgtgcctccttctcacccatcttccacactagagtcagagtatttcttctaaaacatcacccctatcttatttctgctccccttttcaactcctgtgccttcaaaagagtccaaactccttaggatggctttcgcagctgggcatgctctctcccctgcctacctctccccatcatctctgagccccttaccattctgcacttcttccagttccttgaaccatattcctttaccttcaggccattacatgcttttccttttgcctggaacactcactcctttctcctttgcctaaatgactctgacacagtcctcagttatcaggtcaagtacacttgcttcagaatgcattccctgactagcacaggctacatgatataaaatttcatggtactctaatactttctataacttagcccttactctatgattactgcttgcttaattgtgtgtctcccttataaaatgtaagcgttcaaaggtcagggaccttgtgtgtctcactcaacatacgtggtatatattaggcaattaaatatactattttttgttttttgtgagacaggatcttgctctgtctcccaggctggagtgcagtggtgcaagcatggttcactgaaggcttgaactcttgggctcagttgatcctcccatctcagccttctgagtagctggagctacaggcatgtgccaccacgactggctaattttgttatttatttaattttttttgtagagatggggttttgccatgttgcccaggctggtatccaaacaccagggctcaagcgatccatccacctggggctcccaaagtgctaggattacaggcatgaaccaccgtggctggccaattaaatattatttttgaatgaacacatgaatgtgtctaaaatatgaaaactaaggcaaatcaatggttgagggtgccacttaaaatggaactctccaaaagaggctgtattccattatcacgaggttaggagtttcatgctttacctacctagctacctcaaatcaatatgttcttaggtattttttgggggggaaaatattaattttccaaagatgatctctccagagctattgtttcttcattctcaaaacaaatagataacaaaaaatcacaacttaataaaaactaattaagcagtaggtcttaataagtctcaaagcagaaagataaaggacagtttagtaaaatgtgaaaagtagaagaaaggtaattatgtagttatgtagtaagtctaggctagaattaaaataggtaacccggaatctttcctttctactcctctcctgcttcctcaggacctgaatgatctcaatcaactgtttagcctggcaaaattctgcaggtacattctctgttctctctttcaaactggctaggcagacttggctgaaagaattaccctccactgagcagcttgactggtctctttggggaaggaatgataaacttcagcttcccagcttttagggcaacatgagcctccagacccgactcgtggaagaagttggtgttcatctggaccccactcctagcgaagtccggaatgatgatgcccatatttgtcacaaactccacagacacggagggttttgccaccagttcagcctgcatctataagtcagaaaacaacctattcagattcattaaatacttcagtcccctgtcagtcagatcaaccaccctttctcacctccgggcaaagatttcctggataactcagacctttggaaacattactgggatttgtttggaagaaggaaagcgagttctcagttctctagagttggagtatactacccagaactagaaagcacctgagttaacgtgaggcaaaaccagattaaaaagatgataggaatactcatttgttgagagaactgagttcttgtcttatggccataccactactggagctagtgaggtagtgcattctggtggaagcttgaagtttttcataaaaaaataatgaggtgattacaatgatgaagcattttgtcttgaagtggaaacacatttttaaatatgttttaacaagaaatgcaccctggaagaaagtaataacctaagaaatcaaaaggcaaacagaatcttacgttggctacttccagttttactccagccttggctccgggagcaatgactccagatgaagatatttgcaactgtaatccagctccagtggggagttcaaaggcattctccatgaagatgtagtgaagaaaaaagtcattctttgagcccttcctgatgacctctccaatctgtagacccaacaagggagagcaaataaaagtaagtctttttaaagtcggttttgttaattacaacctcccatacattggagagtaattcctctttatctggaaaggaaggactagcatattttgatgagctgaatagtttgataaataaagatcaaactgatgtttttaccgttttcagtgaatcaggatataagaaatttcactagatagatatcatgtcattttcaagtggactcagaaggctcttaagaatattgctgggcctcagagctttatggactttaagtatcatatatgccatggcttaattctggtgttctggagtctgactgtaagtgaaggtgtacttgaaatgtattatattatgataaaatcaattttttgaaaccaaaggcctattgagatgatgtacatatcaatttgcattgggttttattttttaaataatatttcaataaaatagcttgagacctgttttcttaaagtcaacatttttttaatcaagccataggagtacatttatatatttccttttatgaattaataataaaaattatagcatatttagatagtgaattatagtttgccaaatactttcttttataatcattgtatcatttcaatcttaaaaggaccttcaggtcaggtgcagtggctcacacctgttattccagcactgtgggaggcccaggctggaggatcacttgaggtcaggagttcgaaaccagcctgacatggttgtcaacaggcttgtctctactaaagatacacaaattagccgggcatgctggtgcacgtccacagtcccagctacttgggaggctgaggcaggagaattgcttgaacccggaaggcagagttgcagtgagccgagattgtatcactgcactccagcctgggagcaagactccatctcaaaaaattaaaaaaataaaaataaaaataaaaggaccttcagcaaaggtagaggaaggtataccgaacattgttttccagatgaataaattaatgctcttaaaaatacagctaacattatgaatagcttaatttctaaatgttaacatttccatgtgatccaagagtcatcttcagtgaaattcaaggcaaacctccatctctgaagaaagtacaagcatcttttcgggcttgtgcagctgggatcgtaagggagtctgggcgatctaaaaaaaaaccaacgtctggtctcatgggcccccagtggggcctgctgacttaccatctgggggatcccctgcagagtgcgggcacccatcagaagcagctttcccaggagctggaggtcatggagactggcaaaaccaagctcctctcccaagatgcggaggtaggctctggcttccgggacttctttggatttcaaatctttaatcagcttctcaacactgagcattattccatttaccatatcctgagagtttagtaataaaatggccagtgagatgtcagcaatgtcaaacacctttcagttcccaatgtgggacctgtctgatgcagccaggatgggcctaaaaaatgctccaggtgaggaacagggagacactgaagtccaggctaattcctctaagcagagattaaagaactaaggtcttgtcagggatagtggcactcctaaagctattcttaattaaaaaatctgtagacatagtaagatgtggtgggatgagaggaggggtccctattctccagtatgccaggatcctcaagattagaagatcctctatcccccacccgttccctgcttagccttctcttctttgaccagtgaagactacaaggtgtttcttaagaaaatgtagctgttatataaattcaccagaagtttgaaaaacacttgatcctagacaagttcttctcagagagaagaagaatctcagagatggatgcccaggcattgggaaaaaaaaaatgtgaaactgacagactcaaagcagatcaaagatcctcggcctcaagtgggggtcaggaaattagaagatggagctcgtgctcaacagtgagcctggaggggtaaattactgccttgctctgcaaagttgaatgtgcatacaagtcacatgaggtcttgctaaaatgcgcttctgattcagtagattgtgggtgaagcatgagaagctgtatttctgaccagaccacactttgggtagcaaaaaattcaagaataagctccagatcatacaacctatttccctccttaaatgggggctcattgctagcttcaaagtggaagtttggtctcatttgctagtgcactgatgggagtgagagccaaagacagcagttaataataatgaaaatattaatttagaactcgtaatagtgtctgcttattgaacaaccaatgccagcatcaggcactgtgcttggcattttagatgccttatttcattgtctttaaataaccttgtgaggtttggactgttattagtagtctgggatacagacagaaacagatacacataatatcaaccaacttccccaagtgcgcacagcttcaagacagggaagttagaattaaatctatgcccagagttcatactttttttttttttaagatacagtctcacactgtcacccgggctggagtgtaacggcgtgatctcggctcactgcaacctccacctcccgggttcaagcaattctcctgtctcagcctcccgagtagctaggattacaggcacccactaccatgcccagctagtttttttgtatttttagtagagacggggtttcagtatgttggccaggctggtctcaaattcctgaccttgtgatctgcccaccttggcctcccaaagtgctgggattacaggcatgaaccaccacacccagcccagagttcatactcttgttatcctagagtacttattgtgagtctggtttctgggcacactgaattcaggagatctttaactgcagaggatactggcccttaccccagcaggtctggttgataaaaaccatagttatcccttcagttagatagtattttgaggacttccatgcttagaaaagaattgtttttgcattgagacccaaagctttccttaagaagatacttcacaaatacacacctgctcatgtttatcatctttggtatagccaaagtggtccactaagaccttagagacaccatcaggaacttgaccattaacccagtacaaagctttgttgacactgtctgggaaaaatccttgcttcccaaaaagagcttccaatgttggctcaaagccttttccttccaagccaatctgagaaagaaaatcagacaagaaaatggcatcaggtttctttgttgtatgccagcctagtagtccccactcttgatgtccatttatctaaacaagtatttgaataccacaggccaggagctgaccttagcatttcacaggagctgctttattaaaatctcactagaatcttgaccttattacttgcttttttctagaagaggcagctaaggttcagataggacaaataattcaacaaaggattcagagttgggagtgatttgagatttgaagcagatctgactaggcagcacatatgcttccttggctttgggacttaaagacgagacatttgcatttcaatttttttttttttttttttttttgagatggagtcttgctctgtcgcccaggctggagcgcagtggcgcaatctctcggctcactgcaagctcagcctcctgggttcacgccattctcctgcctcatcctcccaagtagctgggactacaggtgcctgccaccacgcccggctaattttttgtatttttagtagagatgggctttcaccgtgttagccaggatggtgtcgatatcctgacctcatgatccacccgcctcggcctcccaaagtgctgggattacaggagtgagccacctcgccaggcctgcatttctattaatgttaagaagtcatgcttcaggtgacccctagcggggagagaggaaggcggggaaggagggaaagaagaaagcctcagaatcatggtaggaagtgcctggtggttcttagttttcctctgggtagctcctggctcccagggactctctgtttatgatgctgtacaaaatgggctagagaacctcaaactcttcacacttacctcgatgaggtcagctgaagcaaatccaaaggcagtgagggtagttttcagcatgctttctttaggaaggtagttatttggatcaaatataagattcccttctattttggctgaggctgggtcaagtgatggaagagaaacagatttgtagagttgatagttccgagagaattttctgaagtccatgacagttggaagttgagattctttcagagcttctttcactaactttttcagactagataagaagaagtatattttgagctgacacaccatgttattatcctttgactcttgcaccccaagtaaatatggatttccaatcactaccaaaatgtcttgatttcattgaccctaagtctttgggtctagatctgctacacatttgcacaagtgtttgtttcagaagcaagggcagacagtggctatgccaaaacctagggttggaattccagctcagggccctcagtggtatatggggtgaatagctcttacttactcttggatatccaattcttctgagttcaagatattggcaatatgggaagccacaaagttcttcacttgctcattctgttcccatggtagaatttggacaattttgttaatatctgcctgtgaaggactcctcatcaacataagataggcagccagtcgcttatctcccggagaagcatcatcaaggaaagtctgaagaagaacctcctggtcctgcagtcaaaagaggagatggttatcactgtcctgtggtcagaacacagaacatgcctggcaaacactggcattgtctgctagctctttcttaagcacaggtctaatttctctgtaatcgttcttcaaatgctggtattgaatcttcttgccagtgtttcctagagcactatcaagtaagggttcccagaaaaagcctgtggaatgcctgttgaattcaattccattaaaacacataaattatggccaagttgtgatttgtttggagatccaccactaagtgaaaatcaagttgttttaacgtaagttattttaatgtgaggataaagatgagaaggggtagtaagagtttggggctaataaatagggtagtttccaaagttctggagtctttgcacctaagagggggccaagttggctatcctagcctaagcttattgggggaaaattaagcatgtttttccatgatgagagggatggtcaatctggtaggtggacggtaggaagcaaaaacatctcacgttctgcatgttgacatagcagcaaagtcaagtatttctctcacgtcacatactgctaggcagtcaagtcaataggcttgttgaaatttgcaattagaaaacagtagaggccaggtgcagtggctcacgcctgtaatcccagcactttgcaaggctgaggcaggcggatcacctgaggtcaggagctcaagaccagcctggccaacatggcaaaactccatctctactaaaaaatacaaaaattagctgggtgtaatggcacatgcctgtaatcccagttactcaggaggctgaggcagagagaattgcttgaacccaggaggcagaagttgcagtgagccgagatcatgccactgcactccagcctgggcaatagagtgagattccatctcgaaagaaggaaggaaggaaggaaagaagaaagggagggagggaggaaggaaggaaggaaggaaggaaggaaaggaaagaaacagcagaataaagtcagtagatgaaatctagagtctcattcccctagtaccttccaaatccttgttaataaactttcactttcagacctcttcttgtggactttaccttgtctttaggctccattttccgcagagcctggatggcagctttctggatcatcagtgatggctttgtactttggacacatttcaggattgaagacttgagttctggagttaactgctccatggtttggcccatatttccaatgacctgcattgaagaaaagaaacaagaacccatcagggtgcaggagagggaagtaaaaggtgtccaggaaaagtgcttctgaaatgatgtatgtcatataaaagactgagattacccgcagaatcaaataggtgtaatcttcatccccagtgcagtcatcttgaatctgttccatcaggtaattagcaatgtccagcagctcctgggtccctgtagggtttgtcttatgatagctacagaataagagaagagagtcaggacttggtaaccccagttaggtttgtcttaaaacccaaacttgtgaattagaaaaaataattataaaattcatatggaatccaaaaagagcctgaatagctgaagcaattttaagcaaaaagaacatagctggaggcatcacattacctgacttcagattatacaacaaggctatagtaatctaaacagcatggtactggcataaaaatagacacatagatcaatggaacagaatactgaacccagaaataaagtcacatacttacagtcaacggatctttgacaaaattgacaaaaacatacactagggaaaggacacccttttcaataagtggtgctgggaaagatggattgccatatgcagaagaataaaactggactcctatctgtcaccatataaaaaaatcaactcaagatggatcaaagacttaaatataagacctgagactataaaaatgcaagaagaaaacctagggaaaacttctctggacattggcctagacaaagaattcgtgaataagacctcaaaggcaaagacaacaaaaacaaaaaatagacaaatagaacttaattaaagtaaaaagtttctgcacagtaaaacaaataatcaacagggtggtaacctgcagaatgggagaaaatatttgcaaactattcatccaatggggtactaatatccggaatgtacaagcaattcaaacaactcaacaaaaaaatcccccaaataatcccattaaaaagtaggcaaaggacatgaatagacatttttttcaaaagaagacatacaaatggcaataggcatatgaaaaaatgcataacattactaatcattagagaaatgtaaattaaaaccacaatgagataacatcttacaagagtcaggagggccattattcaaaagacaaaaaataacagttgttggtgaggatacagagaaaaggaaacagttaatcactgttgatgggattgtaaataagtacaaccactatggaaaacaatacagagatttctcaaagaactaaaaatagaactaccaataaatccaacaatcccattactgggtatatacctaaaggaaaagaaatcattatatccaaaggaaacctgcacccatatgtttatcacagcactattcacaatagcaaagacatggaatcaacctaagtgtctatcaatggacgattggattaaaaatgtgaaatgtataggcaataaaatactattcggccataaaaagaataaaatcatgtcatttgcagcaacatggatggaactggaggtcattgtcttaagtgaaacaggacagtcacagaaagacaaatattgcgtgttgtcatttataagtgggagtgaaataatgtgcacacaaggacatagtgtgtggaatgatagacaattgagactcagaaggtgtggaagtggagggagatggatggtgagaaattacttagtgggtacactatatgttgtctgggtgatggataccctgaaagccctgacttaactactgcacaatctattcatgtaacaaaattacacttgttccacataaatttatataaaaatgtaaaaaagaaaaagccaaaaaatttcatcaaaggaaaaacctgctagcctgagcaacatggtgaaaccctgtatctaccaagaatacaaaaattagccagggcatggtagcatgcacctgtggtcccagctactcaggaggctgaggtgggaggatcacttcagcccaggaatttgaggcttcagtgagccgtgactgcatcactgcactccagcctgggtgacacagtgagaccatctcaaaaaaacaacaacaacaaaaaaaaacaaaacaaacaaacaaaaaaattcagaggaaaaaactgctaactaatattgaactgaagttaataatatgcaagctgtaatacttaggggaaagtgtgttgatgtttgcaatttactttgaaatgcttcagaaaataagatgaattaatggatggatgtatatgtgataaagcaaatataataacacttaaatagtaggagatagctggttttctaggggttttccctgtgaaattctgtcaactttgctatgttcaaaaacttttataatataatgtagagaaaatatttttaaaaattcaatttgtgtttgctgatttcttatttcaagtcattaccccaaaaatgatcaagaaaaaacacaagagtaaggagcagagtttgaaagtggaaggaggggttcagttttaatacagagatgcacagaggtgcaagatgttcctctgctcctaggaggagaaatacagtgtggaaactcacttgttgaccgcgtggctcagcgcatacaaggtggctcggctgcgctgatccctcgccatgttgaagatctctcgcagctgctgtgctgagggctcggggatcagggccaccaggtaggtgaccacatctatcagaagggggttggcatgcacacgtttcagccactggaggatgtgagtggagcactgaggctgtccacactgaaccaaggcttgtaaagtgatggggctgagaagaaagacatggataaagttatacagaccaccttcagggcacataaaatattgctcatggtgtgtcctctgccaggagagcccttaatcacctcattcactattcaaatctaacttcaaaacccaacttggagctcagaaccatgatgctttccttaggaatattacccacagaagaagcccaatcgagaaaagttccaagaggggactgtggatctgtagcaacaagaagactgttatcacagtcctttggccagcacacagaatatgcctggccaacattagctgggtctcattcctggcctcagtcccttctctcaccttcatagcacttaaagccagtgccttgaagggtagagaaatcatattatatttttcgtctgagttctctctccaccagcctataagcttctggagagcacctgcaatagacctaggaattaaaagttacccatcaaaatgtgggaactattctccttctgttttaacacacaaatacatagctgccttgaacacagtatgcgcgtgtgtgtttcatggaactcagcgcagcagctgatagttctctatccagcaatcatgaactgattgactaattgattaactggattgatatccaaatggtccctgagattctccatttggccaaggtttgaaagttcagtcagttaccatcagttttataaaaagttgagctgtaaccattagatacctggacacctcaatcagctgtggcaagagagatgtgactgcttcatcactgaggcctctcagctcagtaaccagcttattgaagagattagctctctggatattttgctcagagatggttagttttttcagttcctggagagtcttcaaaacagcttcggcctgctttggaggtgatgtggatttggtgctctcaaatgcgaggcccatcttcttagtacctggaagatggaaagtgtcaaaggaactctagctttcttcatctcaaccatatctttgtctactggaagctggaaattgtggagtatcagcacaggggaaaagggaaagaaactatcctgtattcaatgcctgctagatctggctctgccataggtgattgacttgttttcactgactcatcatcctatccctgtggggtggcattattgttcaatttaatgataaattcagccctgcttctgagacccacagagtttttgggccatgtaaattgctcatccctggatctcagctctgagtcccagagatgagacaaagagatgagacccagagatgaggaagtgtgacccagagatgagcaacttaggtttcccaagagctctcagggtctaagaggtagagctaaagtggaatccagacttgtctgagtctatcatcaggttacccttagcttgaaataattggtgaggaggtgctactgttgacatggttacaactgggaccaggcacatgggtgcttatcaccatttcttctaattgggtctaccagcagcttgtggggaggggagacacttttgtatcctctccaccacctactgtgacctatgccaggaagagaggtaaaagtcatcatggaaatgtggtgtaatgagaatagtcctggcttagattacaacctggcacttattttcccccctctaatattctgcggccttgactacatcaaactctaagcctctctgtgtcactgtctcctctgtagaataggtataaaatcacatctctaccacctgacatcacaggttgctatgagcaaaaaggacaatgaggtaatgtacaagaaggaatttggacagatataaatacaatacaatactgggtaagggttggacttgagattgttagagttccttctacctctaaagactgactcctgaggttactatctggccagactctgaaggttctctcccacttggtccacctcgtctgggacagctctggatcttatcacaggatgggtgatgtcagttctatcaaatatgtcatgttaaacttaggattccagttttctatttacaaatgcctaagtagctttgggaacttcttttcctttatgccattgcaacttgacatcatgaaatgagtttgctttctcactagaggtagccagaacaccagtgtctgtatcacttgttagtcagcagacatttaacagggctcagcaagtggctaagccatgataggcacatcttgagtagattttccagcaactatgtggacagaaactcttaccttcaccaaagaagcggctgttgatctttggtgtgtcttcaagtttcaaagtctgtgtcacttgtgctaccatcccatacttattcctggtaaccaaggaagcacaccatgtcacggatggccagaacatactattctttccatgttgaaggttttccctgtctctgcatctacccaagtcctgcccatctttcaaagcatgggtaaatccagccattgttggccctgaatgaataacatccacctcttcctggtcacgctagttatcctcccatcaaaaagacatgcgtgccttatactctccactagtctggagtggccagaggtaggaactagtgcaatgtctcaaaattctttcgtatcttccacaacatagagccaagaatatggcagttactcaatatatattcattgattatcagttttcaaagtggatttggatacacaagtttccagtcagtatcccaaatcttccatgaaaccttttctaaccagggtaccctgcagtgatcctcaggttttctggatctacagcccttaaagaatgggtcttagatatcttttgttggtcttggattgttttgcatgcctaggacttttctgccaaatggcctgttcgcttaaaaagggggacagggaggggcggcattttatccctctccattcctccctcccaggcacaggtttgcctggaacagagcacttgagaagtgttcagttcacactgacccattaaatgacaaatcaggggtgcatcacatgacctacttgtaggagaaaggcaggaagaggtgttgctccttgcagatggcttctgccacatgcttcctcttagcgtccagtgtgtactgacaggactggctgctgctgatcagagttgacaaggggcgggtctatgaaagagattggagacgagcattttgatcagtccctgtatcttctgttaaaagcatttaccttcaaggtagaagggagcaggagtcctgtaccactagataaactcagagaaagaagataactgggtacttgacatttagaccagggggtgcaacaagtcggcatccccaaagctgagtcaagctgtagactcctctttttccaccctcactggacaatgtctaaactttgtatcctccacatgcccatcccaccacatagcccctcacacacctgctcagtaacttttctttgcccaaaagcccattcttacatgtctctttcatttacatattctttgcattttttgggttcctgctccacatcttccatgaaatgttgcccgctgagctacatgaataattctttctccttcctggtcaggcccaggacttcttgtctgcactgttcagcttatcaccttattgagtataccacgtatactttattgacctggctcctgcattagactggaagcatcctgaggggaaggtccatggttcatctgccactgtcccttccttggtgctgcccagagtggggttgagcaaacagcagatgctcagaaaagacccctaagccagtgcattatcctcttctgactgtggcactcatggtcatcagactccctgttttcaaccctaaggacaatgaccaggaacagcgcccagcatgacagtgattgcccaagttattcatgttcactgagacaggctggggctcatatcagggaagatgttgcaggggtcaggcaggctcaggtaatatggtgctccatggccccagttaacagagaggagagggtgctccaggccggtggcagtggggccatgtttggtcagggtggtactgggggtggaaggacaagaagctggagcactctaagtcactccacttcatgggatgagggagagggggagaacacaggtcttgggacttcttcaaaggccagaggcttggagctggcacaaggagtccttgtgcagaaaagaacagaaggtggttttgctgccctacatccatccccggaaccttctcagaggtgagtagtcattactctcaagtgatgagattagaggcagtttggtgccagtgacagaaggacaggaggaaagacagagctctgggctgggagggaggagcctgactcaagccttggctcaactgatcccaggccgtgaagcctgggcagaccttcccgtgcctgctcagggtcctatctctagtctgtataaaaaacagccagggcaggctgtcctcaaaggtgcccactagctcaaaagttctggaattgtattaataagaggatgctccttgctgtgcacgacagtgctgacatgggacttaccatgcctttgatgagagcaagtgggctgatgcctgtgcggatgggcttgaagcgatcacactgccccaggtctctttcagtggatatttctgttgccacattgcccttcctcgtcttgacggtaaagtgagtggagcagtttccatacacggtatcctatggaggaagaagatgcaaccacatgtattcaacacgggcaacatccttgggtacttgggagggatggggtggggatcgtgaaagaaaaagcagaaggaatctagctttgggagggactttctttttcttcctatgcagagtgtggtcttgctagtgcctggccagcccaagttgggagagagaaaaccagttaaaggtgggtctgcagaaaggcctccgcaggttgcatcggtgtcttctcccattatggtgtcgtagagaaattagaacacacaaaagtgctcatgggactgaggtgaaatgaattctgtctcacagtgaaacctgaaattcgtaaaagagaccagcaacagatcccattatttttggtgtttaaaatacacacaggatttactgtgtacaccataacccagcaaacacaggtgaagcatcaaacaaaagcaggggtggggtggccaggactcctcaatgactgttttaaaattagacccaacctgataagcctgcttgggatgatctgtcagtgagcctaaggggcaggaggaacctcgggcaccagtatttcacgccaatccagggcttcctatgtaactagtcatggagctgactcagtgatctgctttgtatatggtaggactggtctctaacacatgaagatgagtttcaagggccactgctatcagctttctaaatcctcaccagaaacaacacttgcttggcttcttctgtctctgggggaaccaggagggcagaaatgatgcccctcttgatgttcaggatgtaagtaggttcatctttctccgggtaaaggaaaacctgcttcccttctggaatggccagcttgagctcatacctgtcccagagagaggatggtcacggaaatgtccttctccattacaacttgctggaagtaagctgggtggcactgaagtttcttttctcatatttttttaaccaattgttcttctgacatcatttatttgtaaatatagaatatagctacacatagacatacattttcaaaaaagtatgcacatatacataagttttggtgattctttttttttctttttttcttttttctttttctttttttgaaatggagtctcgctcggtcgcccgggctggagtgcaatggcgcaacctcagctcactgcaacctccacctcctgggatcaagtgattctcctgcctcagcctccggagtagctaggactactggcatgtgccatcacacccagctaatttttgtatttttagtagagacagttttcaccatgttggccaggctggtctcaaactcctgacctcaggtgattctccctcctcggcctcccaaagtgctgggactacaggcatgagccaccaggtccagctgtgttttaactttttttgcttggctcatccagccctgctctgttctccacccatatcagtctctttgcccatcctccccatacggacacccgagtggttgttccatttgtttctgcacactcatacaatcctctgtaaacatgggtgagtgcaaacagagtcatacaaagattttgccattgtttgttttatacaagtggcattgtattatgcatacttttatcttgtttttctcacttaattatacttcacaaaaatccttctgagtcacttggtacagctctaacagatttttttaaaagctgcatgcagaacattccattccatggctaaatataatttattcacacattgccccatttgatggcatttgccctctctctttctggattttttttaaaccacacaaacaataccaaaacaaacatccttatgtgcctatcttcacacattactgcttttattttcatgggctagagtcccaaagactaaaatatctgtgtcaaagggtattaagtattttaaattacagtagatattgcctgatggctctcgtttccaccagcagctcaggacagcacacttttcctcactggcctgccagcaacaggtgctatcactgttttccagttttgcagtatgatgggtaaaagcagataaatatcttgttgttacattaattcgcatttcttgactaccagtgaattggagcttattttcatacacttgttggacagtcattcttttgtatggtgtcaggccatggctgaagcccatgctgactttggtcttagggatttcccactgggtactctctgagtttctgaggacctggctgcagccactctggttacatcaggaggaaaaggtgacggacttatctcccacagcctacactctctcagaaagttcccaacacgaagaaatgataaatgtttgagatgatgggtatgctaattactctgatctgatcaccatacattacatgtatcaaaatatcactatgttctcaataaatatgtataattattgtatgtcaatttttaaaaaagacagttaaagtcatgaagatgcaaacatggaaagccctccttttcaagaacaggagtctcttctgtatttggagaagaccaaggaccaaaaaataaaccactctttcctcctgccaccatacccctctccctcatatacagttaagtcttggagaaaataaagcataggaaagaaagaagcctcacagcctattttggcaagaaaggactggcatctgaatctaatgtttagcaaaactgaaaaatgggcaaggatggtgatatggtttggctctgcgtccccacccaaatttcgtctcgtagctctcataattcccacgtgttgtgggagggacccggggggaggtgattgaatcatgggggcaggtctttcccgtgctgttctcgtgattgcagatgggtgtcgggagatctgatggttctaaaaacaggagtttctctgcacaagctctctttgccagccaccatctacataagatgtgacttgctgtccctcaccttccgccatgattgtgagacctccccagccacgtggaactgtgagtccaataaacctttcttttgtaaattgcccagtctcaggtatgtctttatcagcagcatgaaaacagactaatacagacagagttttctgatgctaccaagttaacaactctatcctgcctgtattcatacacacctaggaccctacaaactgtgattgaggatgaggcaggggtgatgttgaaaatatttacaatgggtgcgacatgggccctgaccagtcagcagagatgcagctgcagtggccgatcagcgtgcagtggctgaatgccagcctaggagggggagccaccgaagccttggtgctcctctgccctgcggtgaacagaccctgccccgccatgtgccggccacagcagccagtgcctctgggaccccacaccaaagaccaccaagcactagtcttgactagttctttaaataagaattcacttgtttaaacaaagcatctcagttttataatctcaagaagtttaaagcatgagatttttagaaacacatgaaaatgataattaaaggaacctaactagggaaggttaactaatgcttctctctttttgatgattgtgaaaactcagtaattccctgatccacgatggatacggaatacaaatacttacagtcacatccgtgcctggtgcaaacacacaagttcatacctcagcggacacacacacatgcgtgtgctcatgtacaacatgacttacctggacatggctgcagcaaactcctcagagttcttggttttcttcagcaaggctttgccctcagggttgaagccatacacctctttcagggtgcactggctggtcttcaggatgaagctgcagagctggggaacctccagctcaacctgagaattcagggtagcagagcattgaggttgtctatcaagaatgagaggtggcccctgaagcccagggcttaatctctaatcagagcaccaaagggaatggtgctgggaacaccactgcctgcgcctcaacaccacatgccttatcaacatgcctcctgggttctctgtgcaccaacctagacttagtcctattgctgacgttttccccctcccgggtaacacatttcttaagtttgcccctaggcatgggaaggaggatgtccttttattggttctaaagttactcactttaattataaagagctgtggttaaatagaagcgctgcagactaggagtgaaagtgaagaagaaaaacagaaagcaggaagagggccatccttcgtttccacagcaaatgtctccttaatgtcacccaaaaaactggttatatctattagggcctatttagagctttgcatatagctggagtttcaacggattcctacttattatccagcactattcaaataactttatagaaatgttgtacatgtgtgctgttcaatatgggagccagtagccagggtggctgttgagcagttgaaatgcagctaatgtgacaacgaatatgaatttttaatttcattccatttaaatagcccaatgtggctcatgtctaccatattggacagcacatacaagagctacggtactctctaaaaaaaggtgactgctcagcttgacttctcttccccacccaaaccccaatagcagcctgtagatctgctccacatgtatgtaacatgagtacaaccagtctcaataataagcaaagttttattttagaacaaactgtatgtttatatttttttcttctttccattcatttttcagcaacagattctgtttgacttaaattataaaaactgcatttcacagtgcgattccgagttgcctgcctcccatagctcacctactgggcctctctcacgctgaaatctacagacccacactgctgctaatctagatcatggattcctattgcatctgggaagttaacgggaaaatacttctgacttgcgaaatttggtgggggcagaccacatctcagcaatgtggctgacttacaaacagaggcaaagtcccagtgctttgatcagattacaacagttctgggatgttctgcgtttgctcagtacacaccctccgggaaggtcgcgtgttgggcgcccgctggaacagggctgggggaaagctgtgggctctaggtccctcctgcctgcatcctccataccttgcagttgatcctggtggcacttcttgaatcagcagtcccagggactccactggaactctcagcctcatagttgtatgtgtacttccggaggtgcttgaatcgggtcgcatcttctaacgtggggagaaatacgtcagccacatagcagaaatagctctcccaaggacagccaattctgggcagagaggggcagtggcatagagaattaaaaatggtaattcaactcaaattattttttaattgactttatacttaattttcctttatagatttgacttctccattatgtttttgctgaggctaatgtttaaattggctggcatgtcttgaatatctcatctgaggcacagggaagggagtgacaagtgtcaagtaatggggctcagaaaatctgcatgagagaccctctggcaaattaagagatgacaacattacgcaaatagtactatctctaatgcttttttagcttgaacacgccgtaattccgtgactctaagactaccaaatacttaaggcaaagttcattaagcattaagcgtaactaacttaacaaactcctagaaaagaatttctggaggtttccactgtagttgagaggaattttctgaacaattgaagaaaaagaacatctgggtcctgagtccagctgcagtgatgacagacggccactagatggcggtgctgccccatcagaagtccgccccgcggctccagcacacagggtcgcgcttggaggccagttcctttaacccccaggggtcaggtaaataggaagggggtggaggttcgatttcttcacaaaggttaaagtcagtatttcctcaccctcacatgcttcgaatcaatgactagtcactgataaacaggacagtgatgtttcttcaaagtgtgcacaggccagcggagagacaatcccttccctcccccgcccccaggctgaacttttgggacagaacagaaggccaggtagaagagagttggcatcccttgggtgtgggcagaggctcagggaacttgcttcctggggtcagagcaaggcacaccacgatgccatctcagccctgtagagtgggaggccctcagggacccgggtgtaggagagtgcacggggctgggcgcccttccacgccccatgcgcagatgccttacttggacagaccaggctgacattttccagcatttcctcttctgtaagacaggagaaagaaatctgtgagcttcccacgtcttcccagcgggtgctagggcccgacagggggaccaccggcacaggtttcacctttcaggagggaggcaggctccggagaccccctcctcagcccctccatcccgcgccccccatcctgagcctgcaggggccgccagctggtccaatccccccactcgccctggaccctgtggctgccctccctctggcctaggcccaggctgccccggccaacctcgtgccgccggctccctcccgctccctctgcgcccgcagagcggccgcgcactcaccggccctggcgcccgccagcagcagcagcagcagcgcaggcagcgccagcagcgccagcagcgcgggcctcggcgggtccatcgccagctgcggtggggcggctcctgggctgcggcctggcctcggcctcgcggccctggctggctgggcgggctcctcagcggcagcaaccgagaagggcactcagccccgcaggtcccggtgggaatgcgcggccggcgcccgcaccccatttataggaagcccaggctgcaagagcgccaggattgcaaaaggtccaaagggcgcctcccgggcctgacctgtttgcttttctacactggcttctctttgagccttgaagagcctcggggagggggcccacctgggatgcagccgcagccaccaggggctgggtcccaggtgggttcccttccccaagcgtcttcagtgctctggcgcggcccttcctgtgtctcagtggggccatggccagcgcctcagggtctgagaagcctgccctgaccaggggtgccttcttcagatgacccaccatggggacaaaatctctgcttctcctggactgaattgggagccacgaggagaaccagtcctgagcgctgtcttggtggagacgtgttcccatcggttacttcttttccattttggtggaccttggatttgcacccacaccctaatcctgatcagaatctgtggctgcggggttcagcccgtgctgggggaggagagagaagggggatgcagggaggtctggtgagtgaccagtcactgcccctgaggatgggtggcctgcctggtcccagcaggagtccaagtatctgtcttcaagaaaccccagcgaggagaggcctctggggaagagcaacctccgagggcgcacccctcttgtgcaaagtgttcttgggttgttgagaggaggatttcctgcaccagcttctaggtttcctccagtggtggggaggcggacgaggaaaagcagagtagtggacaggacacgtcatgttcctcatagacatctggaaccttctcatgcatcgtttccttctcttctaggcactgcccatttcccaccggaagcttcagccagcgctcgctgcctctgcccagctggagggaatcagcggtagtggaatttcagggacactcggtttactaacccaggatcactcagaaggggttattgatgggatggcactatgatgagctgagtgaatgtctgagcctggctgtgtccccaaggcacctccactctggttagggagacaagctgtgtacgcaggaaaccgctagtgagcaattgtggtaggatagagggggcgacaaccaggtaggtataactgctgggggaccacccaggaaggcgagtgggaggcggccaggagcaagccggtagagtgcggatgggaagtggacagcgcctgttgcagaagtcagtgtgtgctcattgttacaacttgtcagctttgtttgaattatgagataaccccagatgtaacaagctactggtgaagactgatgattccagaaggatcaattctgaaacagtaactatgtataaagacccagttccctcagaggagactcacagaaagaccttcgcctgcttcctgcacctgggctccacacctgtccttattcagatattgtcattagccatgaactcctatgggcagctaaactccctccagtgatcagttgctcatccacagcatattaatgttattaaagatggatattacagaggtctcaactcaaggctggtcatacctacaccactgatttgtgaaaggtctggaaaaagtaattgctctgaaaccccatttctctgaacactttatttgaattattctatgtggactgactttccacagggttcgctgctgctagtgtttgaggaaatggtcctgcttccatgcatattcacattaaggagagtgagtaagaatattcaggtatagagaagccaaaaggaggtgtcgagctttaatttacaagcacaagtccaagcttactctgttacgtgcagatgaaaccagggtccaatggtcagcatccatagagaatatatacatatatatatatatttttttttttaatttatttatttgagatggagtctccctctgtcacccaggctggagtgtagtggtacaatctcggctcactgcaacctctgcctcccgggtttaagcgattctcctgccttagcctcccaagtaactgagataacaggtgagtgccactatgcccagctaatttttgtatttttagtagagacggtgtttcaccatgttgatcaggctggtcttgaactcctgacctcatgatctgcccgccttggcctcccaaagtgctgggagaatgtaatttttatgaagtaggaatcaaaaatgaatttgatgacttggaggcagggaaacattgtgagatgcttggaggtggtgagaggactgtcaccatctctaaaggaagaaacctaagactcagcttccctcttttcctgatggtctttggcaagtcttccctgaactgggccccagccagcagtagttatcccctgacagggtctagcacaaccccacagagcaaatgttgaattgttgagctgacttgcgtacactcacggaaatgctgtaaagattagtgcatagatttttcttcaattacaaaatccacttagatcctttgtcaaagactacatggaaatacattacttgtgaccaaagatatcacccttcatcccttttcctttagatagagacacattctggtgtcacacagattaatctcagctagtgactgtgacttatcagctcataaatgcaaagtcctgttgggtgcaccatcaatctgggtagtcatagggctctgggtacccattagaaagccacctgactagaggaatttcaaggcgatagataatgctgaatgtcccagttacattatctagaagcaaaactatccattgtgcctatctgcagccgaccagaagggtcttggccaagttcagggaatcatggaagctaataaaggaccccagcagaccaatattctgagtttagtgctgttcacatactgaagtaggtgcttagaacataatttgctgaatatgaatgaatgaatctgcaccattcagctataccccattttccaggatatttatgcatagcgaccgtgatgcttaaataaatatttccagtgacataaagcaaggaaatacagtctataccaattattcccagccatgctgctccaaaatctcatctggcaaatagggatcagtattgacaacgattaattagcctatctcgtttctgcctatgacagcattataattgcaaatgatgcccagaagctggaaagtaaacttcaaacattgtagatggaactgtgcccagggtggcctgtttacccagtgacagcatgcatgtgtgagcacgtgcacacacacacacacacacacacacacacaaatgagaactatcaggaaagaaatggcacatttaggtgaatggttcaggaggaagatgatagggtgagccattgtcaaccaaatgtaggcattccagatggatgattaacccctgcgagaagcaaaaagaaactttccttctccatcattctgctacccaagagataaggtcagaatgttgagtcgcagttcctcccgggagagaagccagaagtcagcagggttcaatgtgcagtgaggagctgcgtaagtgaattatcaccctcttgcctatgtggatgtcatccttccacccacccagggctggctgcagccccacctactgcactgaatctttctctgggaacagcccagttagacttcatagcttgtgactctgattccctgtcattcagtttctaggtaggacaacgatgatgaaaggccttcatacaaacctgttgttgtcctgaatacatttttctcttatagcattatttgatttttcatgtgtttacctgttgccttgccaatgggagagagaagctgggagagcaagaaccatgtgtagttcacagattggtaccccttgtcctctcttcctcactgacacccttgctaggccaggcagatggtagtcaagcagtaaacactgtgattataatgtaatatggtccatgtgaataggtttctttcatatgcacacttcatttttactcttgagtgttgctgcttatgtttacatcttcatttagaatgcacagtgaacttggagctgtaggagagaggaagggtctgggaactggggccatgggacagtttctacggctctgggtggcagtccctcatctgtgtgatgagaagacaggaatggacggtctcttagccccattcagctctgactactttgattctatggaaattttggggctgaaaaaacaaacacataaattattttgggctcaaacctcatggctattaggagctgtggctgaggatccagaaccatcaagcaggaaggattttatgggaggccatcgacctctccaaagacctgtgcccacactgcccaagaaatagaacccttcactcattttacacagatttctaaatcagatgtgggcatgccctcctgaggatgctggggcacagggaattgcaactctccggaagttcttccccacgtctagctttaggtttcatatttgcctgaccttgggtaaactttcttagatataacttagcatttcttttgaaaggcttttggtcagcttttgtcagccactttttactacttttaaaaaaagttttctttatgttctctcaagactaaggctcagaacgtgttacctcagaaagctgagaccagtgctggtgccggatagctggatggataaacacacctcactattcccacaccagcactacttctcttcatgtattatggagcacctccgagagcttccagaccaggagaagggcataatcagacgtcacagccaataatgagcgtacgcaatgtgcccagtgtggggtctacaccacagttagactatagtggtacgatgggggtctcgggggtcctggatgggtgagattgaactggctctggaatggtgggcaggatttgggtaactgaagagggaggcacactgaaagtgcagtggcaggaagctgggaacatgttggatatgtctggcccctgtgatgacgccaggctactggagtctctggggagaagggagacagggggatggtcagtgggggatacagtttgccatgcccaggccagggacagagctttcaggctaatgaagcctttgacttaatttgacactaaatgtagtacatatggcactgaaactctggattgtgtagaaggccatgagaattgggctgaattctccttgttcagagctatgaagggaaatgtagcaacaggtatctgtagtctcaaacatagacaggatcttagaaaccaaatcgtgactaatattctcatcttatagagaaactggggtctagacaggctaagaagttttgttttgttttgttttgttttcatgacaagagcagaggtaaggcgagaacttggatctttagtttataatctaggttattcattctactctaattgcactaaatctacattggctacataaaattgcttggagattgctctttgggccaggcatggtgcctcgtgcctgtaattccagcactttggaaggccgaggcgggtgtggataacctgaggtcaggagttcaagaccagcctggccaacatggtgaaaacccatctctgctaaaaatacaaaaattagccaggcatggtggcctgcacctgtaatcccagctactcgggacattgaagcaggagaatcgcttgaacccaggagacggaggttgcagtgagccgagattgtgccattgcactccagcctaggtgacagagccagactccacctaaaaaaaaaaaaaaaaaagaagaatctttgaaatcagtgtattctcttgtgtattagtctgttttcacactgctgtgaagaaatacccgagactgggtaatctataaaggaaagaggtttaattgatttacagttccacatggctgggggaggcctcaggaaacttgcaatcatggcataaggttaaggagaagcaaagacctgctttacatggcagcaggagagagacgagtgaggagcgaaggggaaagagccccttataaaaccatcagatctcgtgagaactcactcactgtcacaagaatagcatgggggaaaccacccccatgatccaatctcctcccaccaggtccctccctaaacatgtggggattatggggattacaattcaagatgagatctgggaggggacacagccaaaccatatcatcttgtaatctattccttattgaaagtgaaaaatttcattgatttttttgtgggtttgtatttagaataaatatgattatgtaactcattacataggatcatagaggttcagggcctagaagggccataaggttattgaatccaactcttctccatcaatctgagaatccctgggcacccattaacaggctgcctaactggtggaattttatgaaattagatcatgttctaggcagcatgcagtgaagagtttctagaagggaaacctctccagcctgtctatctacagatggccagatggagcctgcacatgtggatcagtgctttgtggtcatatctcaggtctctgctatttctgtccccaatccggggcatagactgtccatcacagggaaagccaggaatggtcagtactgaggtggaagtttttctgacaccatctttatctagattctgaagtaaataccaaataactaccagaatggcctgacactgttttcatctgtatgttgttccctctctgatagcatggagaggcctcaggccattgccagagcccagactgcttaggttacttggtctccaaagaagaaagtgggtggaaatgggccatttagtatcaggaatttcttggttttctctttttagtggtgcacttaacttctaatagagtcatttaaaaaaaataatggccacctttaggtgttctaaggcccaccctgcagaggccacagataagtatattcacttatctgcgaatatgctaatggattcacaacaatcaattttagaatattttaatcaccccccaaagaactctggtaccaatcagccatcaccccttaagttccctacctgtccagccctaggcaaccactaagttactttctctctctacagatttgcctgttttggacatttcatatacatggggtcaaacaatatgtggtcttttgcaactggcatttttcacttcccataatattttcaaggttcatacatgttgcagccttttattcttttttattactgactaatattccattgtatagatatgccacattttatttattcatcaattgatagacatttgttttgtttctacttaacagctatcaggaataatgctgctatgaatatctgcattcaagtttttatgtacacacatgctttcatttctcttagatgtatatctaggagtgaaatttctgggtaacatggtaattctatgtttaatcatatgaggaactgacagattgttttccaaagtggctacaccattttacattcacaccagcaatatatgaaggttccaatctctccacatccttgtcaacacttgttattatctgtttttgtttttattatacccatcctagtggatgtgaagtggtatcttattgtggcttttattgcatttctatgatggctattgatgttgagcatctttttgtgttcttactgggaatttgtatatctcttttggagaaatgtctactcaaattctttggattttgaatttttaaattggagtgcttggactttttattattaagttgtaagagttgtttttgccttctggattcaggtttcttatccgacatagcatttgcaaatattttctcttattctgtgggttgtctttctacttttctttaaaatgcaaaagtttttaatttggatgaattaatgtttttcctttgttgcttttccttttggtgtcatatgcaagaaactattgcctaaaacatggtcaaggaattttactcctgtgttttcttctaagaggtttatagttttaggtcttatgtctaaggctatgatcccttttgagttaatttttcatgtataaaggaatccttttgccccttgctgttagaaattttcaggttctgtgagcctgtaagtggccctgagttacctcttctgcctccttgctaatagggcgtgacctgttcccaatgcgggtgacatcagccctattgctcaatgagcagaatcagtccttattagggactgttcctccctggggcttttcaaagaagtgaccagagctccagtcactgagaggacaggccccgaacccttgccttttcagagaaaaaaatagagatattcttggtctccgaagctgaaatcccaagcttcttttagagtctgtaatgtcctgataagctttcttcccttttcattcagaaagaaagtattcagtggctagagacataaggcttcctctgtatccaaaacagcttaacatgttttataaggaaacatacaaaactagcaacaaatacaagtttaaaaaagtgacatcaagcaccttggaatgattgcttttggtgtgaatgagaagaataagagttgggagtggggatgcggagtaaggatggggaactagaaacaagccaacaaaatgagatagcacccttcacagaccaacaattacagtgtgcagatgttgaagatggtgaatacttcatctctgctcctcagtggcagcaggaaattggcctatcattgtaaatatatatatttgtaaaccctagtatttctcaagcaccaaaaaacggacccatcattgtgatagttaactttcataaattatctcattttacattccaaaaaatctgcaaaatagattttttaaccagccatcttacaaatgagggagccagggctaagttttacataactaaccaaattctattgtcttcattatataagtacaggtacctagaagaggcagttatgaatatgtaagatcaaatgaccaacataagattgagtctcagtgactttggtgtaagcacatgagttgccctctatctggagaaataagctactgtcttattagcaagatctgcagtcacacaacgctttatgatttgtaaagggctttggtttccattatttcttttaatcctggtagctgtgagttttacgttacacatcacaggtgaggcacctgaacctccctggggttaaaagactttccaggatcacctggcatataaatagctgagctagaactcaaactcaggtgttttgactttatatcccatgcagctcatactacaccgtcctgaatctcaatgagaggattaggaaacctgagattctttatggcatttgttagagaaataaggcaggagggggttctgagcctcggtgggctcccagggaggagaggcaacacgaaaatatcacagcgattcactgccagagaaggagatgggaattagaggcatttcctaggggctgcctttgatagtatccagatttctgaagaaatgcgcttagggaaaagcataaacatacggaaatacctgtgcttgctgctgtttggatgtgttcttaatgtaaatgctgtttattacaatttttcccttctaaatgtcttcgtgcattttccccaagtaggtaaacaagaagctgggctcagccatctcagttgttttttaatacttatcctgcacatgtccaaattgtggctttacatggctgatcctaccagattaacaatctggaatgtgagatcctgcatcacactcagaaaatacctctgaaaatgagttggtatgaaatgatgtgtctgtcgctcatttggaacaggccctggcactggagtcccttggggaacactggccaatggccttctccaccactgctgacccctgggcaaagctggaggccagctcagtcatttaatttgaacaaatccaatagaaaatggtaaattgaggcaattaattaaaatcattcttttcctcttgactcttgcaccttttcagcctggacaatttagttgaaagtggtgatggatgcctgaattatccagataattacttctttctcacttca

SEQ ID NO: 1031 - DNA, 23612 bp, Homo sapiens
agtgatccacccgccccggcctcccaaagtgctgggattacaggtgtgagccaccgcgcccggccgaccatgcaagcttttctgacggttcctgaaaccaccgagttggttctaccccaggaccgacgcacactctgtccctgctgcatggaattcttccctctggtcttgacatgactgggaaggcttgcgtgcgcatgtcgccctctgtcgtccaccattgtccccatcttgcaaggccaagaggaggttctccactaagggcacatggccagtgggactccagtgtccctgctcttcacggcgccagcaaccccgttccctgtgccgcctcgctcgcctggtcctttcgtgctccccagcactggcctcctggagcccagggccaccagtgacgctttggtctctagtcctttccagtgcctcttccttcccccagacaccagtgagaacagggcctgccgtgtgccggtcagggctgagctctcgagtctcttgccaccaacagctccgacttgacccagggtgtctctacctccaggcggctctgtgacctccggcaagtggttccagcccttctgggcttcagtctcctcatctgtcacttgggcacaatagaagcaactacctcccagtgaaggagtccatgagagggcccgacttctcggcctcagcactgggccacatgcacagtcaccacttgctccactctggcatctccatggggacaatgcccgcaggcacccccatttcacagataaggaaagcgaggcccaggggtgaaatcagttgcccagggtgacacagccaggaagcagaggagctgggatttgaatggaagcttaattcaggagcccgtgagcctccccagcccctcccaatggtgacagctccttttctgcttcactctgagcacctcatgtgtgcccagccctgggctgggacacagcagtgaccgagacagcccattcctgccctcatgggggtcccaggtcaggcacagtggctcacacctgtaatcccagcactttgggaggctgaggtgggcggatcgcttgagatcgggagttcaagatcagcctgggcaacatagcaataccctgtctctacaaaaaaaattagaaattaggcatatggtggtacatgcctgtagtcccaactactggggacgctgagctggcagggcacatgcctatagtcccagctacttgggagcctgggaagggggagtggttctattctgaagctgaggccaagccatccaaggccttgcaggtgtgctgaggaacccatatcttctcagggcacgagggagccatggcaggttctgggcagggggtcaacagggtcaggtttgtgctttaacatgatccctctgtctgctgtctgtgaggtcacttgaagttggggcatgagactagagaggaggctgtgggtagagaaactgggggggtggcccaggagatgggaaggatggttagaaagatacttgagggtctcatggcctcagttccaacagtccctggaactcagaggccagagattctaagtcactcactctagatggctgcttttccctctgggcttcagtctcccccttgattgaatgaggggataacactgaccagagtggtaatggtagtgattttttttttcttttcttcccctgccccacctcacatacctctgccctgagacgcagtctctgttgcccaggccagagtgcagtggcacagtgtcagctcacctcaacctccaccttctgggttcaagtgattctcctgtctcagcctcccaagtagctgggattacaggcacgcactgccacacccggctaatttttgtatttttgcgtcgtggcacatgcgtgtaatcccaggtactcgggaggctgaggcaggagagtcacttgaacccgggaggcagaggttgcagtgagccgagatgacgcctttgcactccagcctgggcaacaagagcaaaacgccccatctcaaaaaaaaaaaaaaagagagagagagggagagatgggggtctcgccatgttgccccagctggtctcagactcctgggctcaaacaaccctcctgcctcagcctcccaaagtgccaggattacaggcgtgagctactgtgccccgcccgtgtgatggtgattcaacaaccagtggggggttcggggattcatttgcttcatctcctctgggaaggagagtcacacagtcgcttgcccgagcccatggggaccagctgcagcctacttctgatctcagcctccccagaagatgccaccagggcactggccatgaactcacggcctctctcacacccaccaggctcatcttgggggttgccgcctaacactcagcccctctgagagctccacccagccatgcctgcaggtatgaaaggcccctattcctgcagctccagagagctggctccaggctggctccatgctagcaggccagcctgctcccactgtggggcccctagtctgcccctctggtcatcttggtctgggaagcatcttcgcacctgctttgctctgtgctgtctcagcttctctgtgtgccctcagtctcgtggcccccaacctcccttcccttctccacgtgtcttcctctccagggctgcaccctaggagattgctcgatcgtggtggatttctcaactgtgaatcttcagtccctcttcccccttcatttctgtctctgcagatgtgttgtttctttttttttttttcttttttttttttttttgtctttttgagatgaagtcttgcactgtctcccaggctggagtgcagtggcacaatcacaatctcagcttactgcaacttccgcctcccgggttcaagcgattctcctgcctcagcctcctgagtagctgggactacaggtgtgcaccaccacactcagctaatgtttgtatttttagtagagacagggtttcaccatgttggccaggctggtctcgaacctccgacctcagacgatccacccacctcagcctcccaaagtgctggaattacaggtgtgagccaccgtgcccagcctctttttttctttaaaaattttttaggccgggcgcggtggctcatgcttgtaatcccagcactttgggaggccgaggcaggcggatcacgaggtcaggagatcgagaccacggtgaaaccccttctctactaaaaatacaaaaaattagccaggcatggtggcgggctcctgtagtcccagctactcggagaggctgaggcaggagaatggcgtgaacccgggaggtggagcttgcagtgagccgagatagtgccactgcactccagcctgggcgacagagcgagactccatctcaaaaaaaaaaaaaaaaaattaaatttcttattttttgaaacaggatctctgttgcccacgttggagtgcagtggcgtgatcatagctcagtgtaaccttgaccttctgagctcaagtgatcctcctgcctcagcctcccaagtagctgggactataagcatgtgccatcatgcctggctacgtttttaaatttatttatttgttgtttgtttgcttattgggacagattctcactctgtcactcaggctggagtgcagtggcactatcatggctcactgcagcctccacctcctgggcttaagcaatcctcccacgtccacccccttagtacctgggactacaggtgtgcaccacctcacccaactaatttttgtattcgctatgtttcccaagctggtttcgaattcctgggctcaaatgaacccactttggcctcccaaactgctgggattacaacaagcatgagccactgtgcctggccttgatttttttttttttttttatgataatctgtagttagatgaagtttttaaattttttgtagagatggggtctcactatgtcacctaggcttgtctccaactgctgacctcaagctgtcctcttgccccagccctccaaagcattgggattactggcatgagccattgcatctggctttttttttttttttttttttttttttttttttttgagatggggtctcaccatgttgcccgggctggcttcgaatgcctaggctcaagcaatcctcccttctcagcctcccaaatagctgggattacaggcacgtgccaccacgccaggcttgttttctttccctgtccctccctctctatttcccactctcttcctccccaattcttctggccctataaaatcacatttgtggcctgtaccctgctaggctcgaaagacaccaaagtgaatccatctccatcctgaggcttgaaaaggcagcccaaaggtggcagttctcttgttcagcaagcactccctacggtggagggacacaggaacgcagacttggacctcagtgcagcaagtcccagccacagctgagcactcgattcctcacaaccccaagaggcagttaggttcacagagagatgatgccagcgtccatggtcaccagccagcctgtggcagggctgggattcgaacccaggctgtgcatatttacccactctacccaatggcctctcagcagcagagtggctcagagcctgggtttgggaggtgtggaggcttggattctgcccttgacacattttgtgagcatgagtgagtgacttaccctgtaagcttctataagtggtggtgaccccctctgtaagtgggggtggataaatgctgaccacatgggcttgtgtcgaccagatgaggtccttcaggtaatgcagtcatagcagggcctgggacgctgacctcagcggtagggaacccctgggcgatgggttaggagaaaggagcccttgagggaggcctgagagcaagcccaagcctccagccggggtgagcctagagggcttcctggaggtggagtctagcctggcactcagggtgggtggaaactgatcgtcattttgcccacaggaatcctcgtagcccactacctccagagcatcacgccttgcctggccctgggtggagagctggtctaccaccggcggcctggagaggagggcactgtcatgtctctagctgggaaatacacatgtgagcctggcgcctgggtccgagggtggaggggctgggcccctggactcctcctgggtctgagggaggacgggctagggccctggacactcaggtctgagggaggaggcctgggttcccagatgcccaaatccccttggtaatgagaccccgcctccaccccactctctgacagtgaacaactggttggcaacggtaacgttgggccaggcgggcatgcacgcaacatactaccacaaagccagtgaccaggtgagtgggtgcagggactagctggtgctgccaggggctgctgggcctggaagtccaggtggggccacttgctaattctcatgtgttgctccggcccctccagctgcaggtgggtgtggagtttgaggccagcacaaggatgcaggacaccagcgtctccttcgggtaccagctggacctgcccaaggccaacctcctcttcaaaggtaaaggtctcggttcccctacgcgggaaacaggcaggaggtgactcaactctgagtggatgtgtgggccaccacaggtgctggaggacagtgtgctgccaccctgtgggcctccacattaccagggaacacttgttaaaaggtaggtggggccgggtgcggtggctcacgcctgtaatcccagcactttgggaggccaaggcgggccgaggtaaggagattgagaccatcctggctaacacggtgaaactccgtctctactaaaaatacaaaaacaaaattagccgggtgtggttgcgggtgcctatagtcccaactactgaggctgaggcgggaaaatggtatgaacccaggaggcggagcttgcggtgagccgagatcgtgccaccgcactccagcctgggtgacagagcaagactccatctcaaaaaaaaaaaagtaggtggacaaccctctactatgttttatgcttggaaaaaaaaagtaggtagagcagccaggcgtggtgactcacgcctgtaatcccagcattttgggaggccaagccaggtagaatacttgaggccaggagttggagaccagcctggccaacgtggtgaaatcccctctctactaaaagtacaaaaattagccaggtgtggtagcgtgctgcaactgtagtccccgctacttaggaggctgaggcacaagaatcacttgaacctgggaggcggaggttgcagggagttgagactgcaccactgcactccagcctgggtgacagagtgagactccatctccaaaaaaaataaaatgaaataaataaataaatgttaaaaaaaatctggtggagcatctgatgggtgtttgggccaagctggagctttgtccatcccctcttatttttctgcacttgactctcttatttttctgagactggtctccctctgtcgcccaggctagagtgcagcagtgcaactgcggctcactgcagcctccacctcccgggctcaagcagccttcccacctcagcctcctgagtagctaggaccacaggtgtatgccaccaggcccagctaatttttttgatagttttgggagacatgggggtttcaccatgttgcccaggctggtctcgaactcctggactcaagccttggcctcccaaagtgctgggattataggtgtgagccaccacacccagccagggtagaaggcactttggaagcctcgagcctgccccattcatcttacgttagtggaaactgaggcttccagaggtttcaaggtcacaactaaatccagaacctcatctcaggcacactggtcgtagtcccaatgtccagtcttaagtcttcttggatatctgtggctcacagattttgggtgtttgagcctcctgctgagcactgctggggccacagcggtgaccagccctgtcttcacgggactcagtgagaggaacagattcatccgcagagtgggcaggactaggttgggggaacccaggggtctagagggcttttcagagggcaggggtcactgagcggagagcagaggaggagtgagccatttgctccagcgtgaagttgttggtgtgatggggtttcagggtggcaggagcagtgtggttaaaggtctggaagctgtcggcatgtggctggtatccaaggtggccaggaactctgcatggatatggtgggaagctggcacgcctctcacctcagctcttccctgcaggctctgtggatagcaactggatcgtgggtgccacgctggagaagaagctcccacccctgcccctgacactggcccttggggccttcctgaatcaccgcaagaacaagtttcagtgtggctttggcctcaccatcggctgagccctcctggcccccgccttccacgcccttccgattccacctccacctccacctccccctgccacagaggggagacctgagcccccctcccttccctccccccttgggggtcgggggggacattggaaaggagggaccccgccaccccagcagctgaggaggggattctggaactgaatggcgcttcgggattctgagtagcaggggcagcatgcccagtgggcctggggtcccgggagggattccggaattgaggggcacgcaggattctgagcaccaggggcagaggcggccagacaacctcagggaggagtgtcctggcgtccccatcctccaaagggcctgggcccgccccgagggggcagcgagaggagcttccccatccccggtcagtccaccctgccccgtccactttcccatctcctcggtataaatcatgtttataagttatggaagaaccgggacattttacagaaaaaaaacaaaaaacaacaaaaaatatacgtgggaaaaaaaacgatgggaggcctccgttttctcaagtgtgtctggcctgttttgagcatttcatccggagtctggccgccctgaccttcccccagccgcctgcagggggcgccagagggccggagcacggaaagcagcggatccttgatgctgccttaagtccggctcagaggggcgcagcgtggcctggggtcgctatcttcccatccggaacatctgccctgctgggggacactacgggccttcccttgcctgagggtagggtctcaaggtcacttgcccccagcttgacctggccggagtggctatagaggactttgtccctgcagactgcagcagcagagatgacactgtctctgagtgcagagatgggggcagggagctgggagagggttcaagctactggaacagcttcagaacaactagggtactaggaactgctgtgtcagggagaaggggctcaaggactcgcaggcctgggaggaggggcctaggccagccatgggagttgggtcacctgtgtctgaggacttggtgctgtctggattttgccaacctagggctggggtcagctgatgcccaccacgactcccgagcctccaggaactgaaaccctgtctgcccccagggtctggggaaggaggctgctgagtagaaccaaccccaggttaccaaccccacctcagccaccccttgccagccaaagcaaacaggcccggcccggcactgggggttccttctcgaaccaggagttcagcctcccctgacccgcagaatcttctgatcccacccgctccaggagccaggaatgagtcccagtctctcccagttctcactgtgtggttttgccattcgtcttgctgctgaaccacgggtttctcctctgaaacatctgggatttataacagggcttaggaaagtgacagcgtctgagcgttcactgtggcctgtccattgctagccctaacataggaccgctgtgtgccagggctgtcctccatgctcaatacacgttagcttgtcaccaaacatacccgtgccgctgctttcccagtctgatgagcaaaggaacttgatgctcagagaggacaagtcatttgcccaaggtcacacagctggcaactggcagagccaggattcacgccctggcaatttgactccagaatcctaaccttaacccagaagcacggcttcaagcccctggaaaccacaatacctgtggcagccagggggaggtgctggaatctcatttcacatgtggggagggggctcccctgtgctcaaggtcacaaccaaagaggaagctgtgattaaaacccaggtcccatttgcaaagcctcgacttttagcaggtgcatcatactgttcccacccctcccatcccacttctgtccagccgcctagccccactttcttttttttctttttttgagacagtctccctcttgctgaggctggagtgcagtggcgagatctcggctcactgtaacctccgcctcccgggttcaagcgattctcctgcctcagcctcccaagtagctaggattacaggcgcccgccaccacgcctggctaacttttgtatttttagtagagatggggtttcaccatgttggccaggctggtctcaaactcctgaccttaagtgattcgcccactgtggcctcccaaagtgctgggattacaggcgtgagctaccgcccccagcccctcccatcccacttctgtccagccccctagccctactttctttctgggatccaggagtccagatccccagccccctctccagattacattcatccaggcacaggaaaggacagggtcaggaaaggaggactctgggcggcagcctccacattccccttccacgcttggcccccagaatggaggagggtgtctgtattactgggcgaggtgtcctcccttcctggggactgtggggggtggtcaaaagacctctatgccccacctccttcctccctctgccctgctgtgcctggggcagggggagaacagcccacctcgtgactgggggctggcccagcccgccctatccctgggggagggggcgggacagggggagccctataattggacaagtctgggatccttgagtcctactcagccccagcggaggtgaaggacgtccttccccaggagccggtgagaagcgcagtcgggggcacggggatgagctcaggggcctctagaaagagctgggaccctgggaacccctggcctccaggtagtctcaggagagctactcggggtcgggcttggggagaggaggagcgggggtgaggcaagcagcaggggactggacctgggaagggctgggcagcagagacgacccgacccgctagaaggtggggtggggagagcagctggactgggatgtaagccatagcaggactccacgagttgtcactatcatttatcgagcacctactgggtgtccccagtgtcctcagatctccataactggggagccaggggcagcgacacggtagctagccgtcgattggagaactttaaaatgaggactgaattagctcataaatggaacacggcgcttaactgtgaggttggagcttagaatgtgaagggagaatgaggaatgcgagactgggactgagatggaaccggcggtggggagggggtggggggatggaatttgaaccccgggagaggaagatggaattttctatggaggccgacctggggatggggagataagagaagaccaggagggagttaaatagggaatgggttgggggcggcttggtaaatgtgctgggattaggctgttgcagataatgcaacaaggcttggaaggctaacctggggtgaggccgggttggggccgggctgggggtgggaggagtcctcactggcggttgattgacagtttctccttccccagactggccaatcacaggcaggaagatgaaggttctgtgggctgcgttgctggtcacattcctggcaggtatgggggcggggcttgctcggttccccccgctcctccccctctcatcctcacctcaacctcctggccccattcaggcagaccctgggccccctcttctgaggcttctgtgctgcttcctggctctgaacagcgatttgacgctctctgggcctcggtttcccccatccttgagataggagttagaagttgttttgttgttgttgtttgttgttgttgttttgtttttttgagatgaagtctcgctctgtcgcccaggctggagtgcagtggcgggatctcggctcactgcaagctccgcctcccaggtccacgccattctcctgcctcagcctcccaagtagctgggactacaggcacatgccaccacacccgactaacttttttgtattttcagtagagacggggtttcaccatgttggccaggctggtctggaactcctgacctcaggtgatctgcccgtttcgatctcccaaagtgctgggattacaggcgtgagccaccgcacctggctgggagttagaggtttctaatgcattgcaggcagatagtgaataccagacacggggcagctgtgatctttattctccatcacccccacacagccctgcctggggcacacaaggacactcaatacatgcttttccgctgggcgcggtggctcacccctgtaatcccagcactttgggaggccaaggtgggaggatcacttgagcccaggagttcaacaccagcctgggcaacatagtgagaccctgtctctactaaaaatacaaaaattagccaggcatggtgccacacacctgtgctctcagctactcaggaggctgaggcaggaggatcgcttgagcccagaaggtcaaggttgcagtgaaccatgttcaggccgctgcactccagcctgggtgacagagcaagaccctgtttataaatacataatgctttccaagtgattaaaccgactcccccctcaccctgcccaccatggctccaaagaagcatttgtggagcaccttctgtgtgcccctaggtactagatgcctggacggggtcagaaggaccctgacccaccttgaacttgttccacacaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgaggtgagtgtccccatcctggcccttgaccctcctggtgggcggctatacctccccaggtccaggtttcattctgcccctgtcgctaagtcttggggggcctgggtctctgctggttctagcttcctcttcccatttctgactcctggctttagctctctggaattctctctctcagctttgtctctctctcttcccttctgactcagtctctcacactcgtcctggctctgtctctgtccttccctagctcttttatatagagacagagagatggggtctcactgtgttgcccaggctggtcttgaacttctgggctcaagcgatcctcccgcctcggcctcccaaagtgctgggattagaggcatgagccaccttgcccggcctcctagctccttcttcgtctctgcctctgccctctgcatctgctctctgcatctgtctctgtctccttctctcggcctctgccccgttccttctctccctcttgggtctctctggctcatccccatctcgcccgccccatcccagcccttctccccgcctcccactgtgcgacaccctcccgccctctcggccgcagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgcatctgctggcctccccctgtgatttcctctaagccccagcctcagtttctctttctgcccacatactggccacacaattctcagccccctcctctccatctgtgtctgtgtgtatctttctctctgcccttttttttttttttagacggagtctggctctgtcacccaggctagagtgcagtggcacgatcttggctcactgcaacctctgcctcttgggttcaagcgattctgctgcctcagtagctgggattacaggctcacaccaccacacccggctaatttttgtatttttagtagagacgagctttcaccatgttggccaggcaggtctcaaactcctgaccaagtgatccacccgccggcctcccaaagtgctgagattacaggcctgagccaccatgcccggcctctgcccctctttcttttttagggggcagggaaaggtctcaccctgtcacccgccatcacagctcactgcagcctccacctcctggactcaagtgataagtgatcctcccgcctcagcctttccagtagctgagactacaggcgcataccactaggattaatttgggggggggggtggtgtgtgtggagatggggtctggctttgttggccaggctgatgtggaattcctgggctcaagcgatactcccaccttggcctcctgagtagctgagactactggctagcaccaccacacccagctttttattattatttgtagagacaaggtctcaatatgttgcccaggctagtctcaaacccctgggctcaagagatcctccgccatcggcctcccaaagtgctgggattccaggcatggggctccgagcccggcctgcccaacttaataatacttgttcctcagagttgcaactccaaatgacctgagattggtgcctttattctaagctattttcattttttttctgctgtcattattctcccccttctctcctccagtcttatctgatatctgcctccttcccacccaccctgcaccccatcccacccctctgtctctccctgttctcctcaggagactctggcttcctgttttcctccacttctatcttttatctctccctcctacggtttcttttctttctccccggcctgcttgtttctcccccaacccccttcatctggatttcttcttctgccattcagtttggtttgagctctctgcttctccggttccctctgagctagctgtcccttcacccactgtgaactgggtttccctgcccaaccctcattctctttctttctttctttttttttttttttttttttttttttttttgagacagagtcttgctctgttgcccagcctggagtgcagtggtgcaatcttggttcactgcaacctccacttcccagattcaagcaattctcctgcctcagcctccagagtagctgggattacaggcgtgtcccaccacacccgactaatttttgtatttttggtagagacaaggcttcggcattgttggccaggcaggtctcgaactcctgacctcaagtaatctgcctgcctcaccctcccaaagtgctgggattacaggcatgagccacctcacccggaccatccctcattctccatcctttcctccagttgtgatgtctacccctcatgtttcccaacaagcctactgggtgctgaatccaggctgggaagagaagggagcggctcttctgtcggagtctgcaccaggcccatgctgagacgagagctggcgctcagagaggggaagcttggatggaagcccaggagccgccggcactctcttctcctcccaccccctcagttctcagagacggggaggagggttcccaccaacgggggacaggctgagacttgagcttgtatctcctgggccagctgcaacatctgcttgtccctctgcccatcttggctcctgcacaccctgaacttggtgctttccctggcactgctctgatcacccacgtggaggcagcacccctcccctggagatgactcaccagggctgagtgaggaggggaagggtcagtgtgctcacaggcagggggcctggtctgctgggcctgctgctgattcaccgtatgtccaggagctggagcagcaccctctcagagcctcagtttccccagatgtcaatgagagaatcagcatcagccacatctcccacctgaagaatcgaaccttgagttctcacctttaagaatttttttttttttttgagacagtgccttgctcagtcgaccacgctggagtgcagtagcacgatcatcaatcactgcagcctccaactcaagcaaccctcctgcctcaacctcctgagtagctggggccacaggcacccaccaccatgcctggctaattctttcttttttgagatggagtctcactctgtcgcccaggctggagtgcagtggcaccatcttggctcaccgcaacctctgccccccgggttcaagcaattctcctgcctcagcctcctgagtagctagaattacaggcgcacaccaccacaccaggctaatttttgtatttttagtagaaacgaggtttcaccacggtggtcaggttggtctcaaactcctgacatcaggtgatccacccgcctcggcctcccaaagcactgggattacaggagtgagccaccatgcctggccatattttaaacttttttgtagagatggggtcttactatgttgcccaggctgatctcaaactcttgggctcaagcagatcctcctgccaaagcttcccaaagtagttggattacaggtgtgagccaccacgccccaccaacctatgaagatgtctaagcagacagggtgccctatctcaccacatccccagtcagatccagaggtgggacaaggatgggaaggaggttccagaacaaaggctggcagggagtcgtatgggacaggagctgacccagcaaccatccacagagacatcctggagcctgggaaggagaaggacaaagagcccccttttttaaattttttttatgtttttgagacggagtctcactctgtcacccaagctggagtgcagtggcacaatcttggctcactgcaacctccacctcatgggttcaaacgactctcctgcctcagcctcctgagtagctgggaccacaggtgcacaccaccatgcctggataatttttgaatttttggtagagacggagtttcaccatgttggccaggcaggtctcgaactcctgacctcaagtgctccgcccaccttggcctcccaaagttctgggaatacaggcgtgagccactgcaaccagccagtagcccccatctttgcccctcgctgagccctactggatgttcttggttatgcgacagtttccccatctattaaagagaaacccctatagcagaggggaggatgaggttggaaaagcaggagcattgttatgctattcttgtggggtctgggaagcagacatctgggtggatgtttggggggtgctgggcttagttggggaagtaggggggcccctggggctgacagggactggaagctctgagctggccagagggatgttgcaatcctgccagggtcttgtctatgctgtccttttcacaaccatccccctactgccaggctgacacgtggttgcgggggcacaaggccagccaacctagagtctgaggctaggcggaggacaccctccccaccagctgccagggtcactggcggtcaaaggcagctggtggggaaggcattggactccagccttgggggacggatgtagtgatggtgggaagcaggcttggtgccaggaggggcgtcagagggtgaataaaagcagatagagtgtttgggggaggtagccagccaaagggggtgaggcccggtggaagggaagaagggacatacacgcagagctttgcagctgagggttttaattttttgagatggggtctctgtcccaccaggctggagtgcagtggcacaatcacagctcactgcagcctcgaactcctgggctcaagcaatcttcctacctcagcctcttgagtagctgggactacaggcatgcgccaccacgctcggctaatttttgaacttttttgtagagatgaggtctccctatattgcccaggctggtctcgaactcccaggctcaagtgatcctccctcttcagcttcccaaagtgctgggattacaggcatgagccaccatgcctggctaatgcaggtgaggtttttgcagtgtcatccagctaaggcgacccgttcccctcccaaaaaagggagactgagaaccatgaagttaagagcccagagaatatcacggtggtctggggtgcttcaagggctggtctggaataaattggaggtggcacgcagggtaggagcgccgggccaactgggagacccagcaacataaaggaaaagttgttggggctgaggaggcttgctgagagaggggaagtgagggaaagaggtgatctagggacacggtgtgaatgagggggggatgagatcacagggttattactgggagacccctgagggaagatggccacagggacaggacaaggctgtcttcttaagggaggagaccacccctcatattgtcttatgcccaatttctgcctccaaagaaagaaaaagtaaaaactaaaaggcagaaatgaaatccacaagcagacagcccgcgccacaccctgggcctggtggttaaagattgacccctgacctaatccgttaggttatctatagattacagacattgtatagaaaagcactgtgaaaatccctattctgttttgttccgatctaattaccggtgcatgcagcccccagtcacgcatcccctgcttgttcaatcgatcacgaccctctcacgtgcacccacttagagttgtgagcccttaaaaggaacagggattgctcactcggggagctcggctcttgagacaggaatcttgcccattccccgaacgaataaaccccttccttaactcagcgtctgaggaattttgtctgcggctcctcctgctacattctgagtggggaaagggactaaggtggtctgaggaccccacagagtcaggaagattgagaggtgagagtgctgaacggggaggggctttggggctaagggaagtgcccgggaccccacctgaccccaacgctcacgggacaggggcagaggagaaaaacgtgggtggacagagggaggcaggcggtcaggggaaggctcaggaggagggagatcaacatcaacctgccccgccccctccccagcctgataaaggtcctgcgggcaggacaggacctcccaaccaagccctccagcaaggattcaggttggtgctgagtgcctgggagggacacccgcctacactctgcaagaaactcaaaaagggagatgaggggatcgtgggagggaggtagggagggaggagggtgccactgatcccctgaacccctgcctctgcctccagagtgcccctccggcctcgccatgaggctcttcctgtcgctcccggtcctggtggtggttctgtcgatcgtcttggaaggtaaaagtgggatgggagaattgcggagttggagatttggaagagtgaaggtggctacaggcctggggtcccggcttagaggacctctgagagctccggggccccttctgggtcgtggttgcctcatcgtggtcgggtgggtctccaggttctcccaggctcagtcccgcaggcgccaaatctgcgcaggagagcactagcaaccgatgacgtattgaggcccacacctctgggattggctgtcctgcttcgacagccttgaaagtgggtaagctgggtggggggctctgggagaggtcagtgctgagtaaggcaattcccagcagcttgagccccaccaggtcactccagtattcctccccattctttttttttttttttttttttctcttgagacggagtctcgctctgtcgccgaggctggagtgcagtggcgcgatctcggctcactgcaagctccgcctccctggttcacgccattctcctgcctcagcaggactacaggcgcccgccaccgcgcccggctaattttttgtattttcagtagagacagggtttcaccgtggtctcgatctcctgactttgtgatccgcctgcctcgacctcccaaagtgctgggattacaggcgtgagccaccgcgtccggccattcctccccattctaaccacatgatccccaaggatctctatccatcccggtatcccaacctaagggggttccaataacaaatttttggccgggcagggtggctcatgcctgtaatcccagcactttgggaggccgaggcgggcagatcacttgaggtcaggagttcgaaaccagcctggccaacatggtgaaacttcgtctctactaaaaatacaaaaaaattagccaggtgtggaggcacgcgcctgtaggcccagctactcgggaggctgaggcaggagaatcacttgaacccgggaggcggaggttgcagtgagccgagatcataccactgcactccagcctggctgacacagcaagactccgtctcaaaacaaaacaaaacaaaaatagctgggtgtggtggtgcacacctgtaatcccagctacttgggaggctgaggcaggagaactgcttgaacccgggaggtggtggttgcagtaggccgagatcatgccactgcactccagcttgggctacagagcaagactccatctccaaaaaaaaaaaaaaaaaaacaaattttgaacccctgcccatcttcctggcaggcccagccccagcccaggggaccccagacgtctccagtgccttggataagctgaaggagtttggaaacacactggaggacaaggctcgggaactcatcagccgcatcaaacagagtgaactttctgccaagatgcggttagaacccttcccagggcacgggagagctggggtgtgtttttgggtggagccctggcagatggtccaagatgaacagattgaaaaaaaaacaagtcctggagaggctgacaacatccctctggtcacacagctagatctcaaggtgctcagacttcaaggacagtttccctgactcccatccaggccatattttaaaagatggtcttgggctgggcacggtggctcatgcttgcaatcccagcacttagggaggccgaggtgggctgattgcctgaggtcaggagttcgagaccagtctgaccaacatggtgaaaccttgtctctactaaaaatacaaaaaaattaggcaggcatggtggcgtgcacctgtaatcccagctagtcgggaggctgaggcaggggaattgcttgaaccaggaaggtgggagttacagtgagccaacattgtgccagcctgggtgacagaaggagactctgtctcaaaaaaaaaaaaaaaaaaaaaaaaaacaagatggtcttgcccaggtatggtggctcacacctgtaattccagcactatgggaggctgagatgggaggattgcttgagcccaggagttcgagaccagcctgaccaacatggcgagatcctgtctccatttaaaaaaaaaaaaaaaaagatggttttgtgaggtaatgaaaatgaaggccccaagcttggccagacctgggtccccaggctggagtagcaccccttcctgtgtgatcttgacagaggggcattactgtgagcctcagtttcctctcctataaactggtggttctacagggaagtaaaggagcaggcctacagggtgtctggtacatgtagatgctcagtatatcatgaaacccacccttgccccctttggcaagttagagagtcattcgttctttcaaaaatatttactgagcatctgctaagtgctggaaactgtttcaatgtggggaataaaacagtgaagaacgtgccgagcacggtggctcacacctgtaaccccaccactttggaaggccgaggtgggtggatcacttgaggtcaggagtgcgagaaccccgtccctaatagaaatgcaaaaaaaattagctgggcatggtggcccatgcctgtagtcccagctccttgggaggctgaggcgagaggattgcttgagcccaggagatctaggctgcagtgcgccatgtttgtgccactgcattccagcctgggtaacagaatgagaccctgtctcaacaaaaaaagaaaagaaaagagaagaaaagagaaaagaaagacagggagggagggaggaaggaagggagggagggagggaaaatagagccaggcataaacttagaaagatcgtttggaggccaggcacaatggctcacacctgtaatcccagcactttgggaggccaaggcaagcagatcacctgaggtcaggagttcgagaccagcctaacatggagaaaccctgtctctactaaaaatacaaaattagccgggcgtggtggtgcattcctgtagtcctagctactcgggagcctgaggcaggagaatcacttgaacccgggaggcggaggttgcagtgagccgagatcatgccactgcactccagcctgggcgacaaggcgagactccatgccaaaaaagaaaaaaaactcctggcgcggtggctcacgccagtaatcccagcactgtgggaggctgagcaggcggatcacgaggtcaggagttcgagactagcctgctcaacataatgaaaccctctctgtactaaaaatacaaaaattagctgggtgtggtggcaggcacctgtagtcccagctactcgggaggctgaggcaggagaatggcttgaacctgggaggcagaggttgcagtgagccgagacagtgccattgcactccagtccaggtgacagagcgaaactccatctcaaaaaaaaaaggaaggcattggtagcaagagatggcaggccttgaaagccaggccagggtgaagtgtttcttttttttttttttttttttttctttttaaatttttttttttgagacggagtctcgctctgtcacccaggctggattgcagtggcctgatctcggctcactgcaagttccgcctcccgggttcatgccattctcctgcctcaccctcccgagtagctgggactacaggcacctgccaccacgccagctaattttttgtattcttagtagaatgtagaatttacttagtagaattttttgtattcttagccagcatggtctcgatctcctgacctggtgatccacccgcctcggcctcccaaagtgctgggattacaggcgtgagccacggcgcccggccttattttttctttttgagatgtacccagactggagtacagtggtgcgatctcggcttactggaacctccacctcccgggttcaggcaattctcctgcctcagcctcatgagtacttggaactacaggtgtgtgacaccacacatggtattttttgtatttttagtgaagatgacatttcaccatgttgcccaggttggtctcgaactcctgacctcaagtgatcagcctacctcggcctcccaaagtgttgggattacaggcgtgagccaaatgcccagccaagggtaaagtgtttagacttcaacgtgctttggtccatctgggaaactgaggcacagaagttggcccacccagcccagcggtcctcctaatcccacagacagtggggatggagattctgcaaggggaagaggtgggagtcaggtagcaggcagaatttggacagcctgggaggtagctgcacacagtgacccccttccttattcctccccacagggagtggttttcagagacatttcagaaagtgaaggagaaactcaagattgactcatgaggacctgaagggtgacatcccaggaggggcctctgaaatttcccacaccccagcgcctgtgctgaggactccctccatgtggccccaggtgccaccaataaaaatcctacagaaaattctctcctgagtgcttctttactctggggaaggggctgcgggagag

SEQ ID NO: 1032 - DNA, 37380 bp, Homo sapiens
taagaagaaaaacacttgaaaaagggaatctacttatggcacaaaatagaccacataatcactaaatagaggggctgcaattgggcagtttctaccgatggactcctcaaatccaaattgcctcttccaattacaaaaatagcagatttttatttctgtgaaaatacgattaaatgagaggaatcaggactatcgtctaagctctaaagtctgctctgattatttttcagtgatccaaacctatccagccccctaaaatgccttccagtgaacaaaatggcacaaaacacaaccttcaacaaacttgccatatcccaggagcttctttgtagaataggctggggaagggaggagtgttggaaaagtgctaagggtttaaaacagaagtgctgaggtgtcaaagttaggcatgctgactatctggtgctatcaaaatgcagacctaattattgtgtatatgagtagtgcatgtgtacataaatatgtgtatgtatttcctagctctgtctgttgaagaagacctagaagcagtgatgcctctgtatcaatgagcactacacccagacacaatgcagaccttgatttctttttttttttttaagacggagtctcactctgtcacccaggttggagtgcagtggtgaaatctcggctcactgcaagctccgcctcccggttcacatcattcttctgcctcggcctccagagtagctgggactacaggcgcccgccaccgcgcccgccaccatgcccggctaattttttgtatttttagtagagacggggtttcatcgtgttagctaagatggtctcgatcttctgacctcgtgatctacccacctcagcctcccaaagtgctaggattacaagcgtgagccaccacgcccggcccagaccttcatttctaaacaccgttatcttcagttcattggggaaatggctgaggtttagaaagctgaggtttacaaattatgacaagcttggagtattgtgttttaaccaaaagcatggtggtgcacacctgttgtcccagctactggggaggctgaggcaggagaattgcttgaagccaggaggcagaggctgcagtgaaccgagatcgtgccactgcactccagcctggctacagagtgagactccgcctcaaaaaaaaaaaaaaaaaaaagaagtggtggagcaagatggccacatagagacctccagtgatcatccccctcacaggaacaccaaatagaacaaccatccatgcaaaaaagcaccgtcataaccaaaaatccctgtacctggctttaaaattatatcaaggaaaggggcattgaagaggctgggaaagacaatctcgagttgtcgacaccacccctcgctcttccccatcagtggccatgtggtgcagagggagaatctgtgtgcttgggggagggagtgtgaactgtttgttggactttgcattggaattcagtgctgtctgtcacagcagaaagccacacagggcagaattcacctagtaaccacgagggagcatttagaccagccctagctggaaaagaatcatccatcccagcagccagacagaacttgagttccaactagccccactaccatggggtaaagtgctctggggtcctaaataaacttgaaaggtggtctaggccacaaggactgaaattcctaggcaagtcctagtgctgtgctgagctggagccagtggtctttttgtgcacacaacctgtgagacaccagctggggtggccaagggtgtgcttgtgttacccctcccacgacctcaggcagcacagcttgcagctccaggagagactacttccttctgcctggggagaggagagaggagggtaaagagaactttgtcttgcaacttgcattccagctcagtcacagtagaatagggcaccaggctgaatcctgaggcccccgttccaggccctgtctgctggacaacgtttcttgacacactctagccactgtcttaaagagaagtaccggttcaggcaggattcattaccggatgatccaagagtcctcggacttgaattaacaccaccagttgccaggcagtactcaccacaagacttgagtgagatcccgcgccatgccgacttcaggtgtgacccagcacatttccagctgtggtggtcacagggagagactccttctacttgaggaaaggagaggaaagagtaaaggggctttgtcttgcagcttgggtaccaagtcggccatagtgggatagagcacaaagcaggatcctggggtccctgattccaggccttggcccctgagtggcatttctggacttgctctgagccagaggggagcacagtgcccagtgcatgaaggaagagactgaagcctggcagccttcaccacaagctgactgaagagctcttgggccttgagtgaacatcactggtagccaggcagtgatcactgcaggcctgggattgtggtgactagggggagagactccttctccttgagggaagaagatggaagagtaggaaggacttcatcttgcggtttaggtgccagctcaggcgcagtggaaagagcaccaggtagattcctaacgttcccaagtccaggccctgcccagacagcatttctggacctgccctgggcttagggagagctcaccaccctgaagggagggacacaagcctggctggattcgccacctgttgactaaagagcctttaggccttgagtgaacaacagacggtagccaggcaagacccagtgccgtgctggcttcaggtctgacctagtacagtcccagttgttgaggccacaaggctgcttgtgtcacccagctccaagcagttcagcatggagaaagagactctgtctgggtgaaaataagagaagagagcaagagtctttgcctggtaatccagggaattctcttggatcttacttaagaccaccaaagtgataccttaagagctctgcaagagtcatcattgctgggcttagggttctcctagtgcacatattgttgcagtgaccaaagacttagatcacaacactcgattgcctttgaatacttggaaagccttcccaacaaacaagcccagactgcaaagactgcaataaatacctaactctttaatgcccagacaacaattaatatccataagcatcaaaaccatgctggaaaacatgacctcaccaaatgaactaaataaggcaacagtgacctatcctaaagagagagatatgtgacctttcctacagagaattcaaaatagctgttttgagcttcctcaaaagtcaggataatacaaagaaggaatacaaaaggataatacaaaattcagaaaagtacaaagaaggaattcagagtcctgggccgggcacggtggctcacacctgtaatatcagcactttggaaggccgaggcgggcggatcacctgaggtcgggagttcaagaccagcctgaccaacatggagaaaccccatctctactgaaaatacaaaattcactgggtgtggtggcgcatgcctataatcccagctactcgggaggctgaggcaggagaattgcttgaacccgggaggcggaggttgtggtgagccaagatcgcaccattgcactctagcctgggcaacaagagagaaacgctgtctcaaaaaaaaaaatttgttttttaaataaaattaggaagtacccaaaggatatggagacatatcaaaaagacacatgagccacttgaagtggctcccactgatcaattctgtgacaactcaagcatcaaaataattaattatattagtgaatcataactcactgaataaggatccatgtgttcacactaatattaattaactaattaatttggggaaatgggaaagtactcccttacagcagaatgagaaataataaatgtagaaggagtgataaatttaaaaattacttgttggcaaccatcacaaaaacaattgatttaggtaaaaatctaaaattactggatgaaaatttgatgaaaaacaggatatccacatagttgtgaagtatctccccatgagatactgattaattaattacaaaggacaatatagtaagattacaatgtagaaatctggcagacatcagatttctagccaagtaatcatagttaacattaccaatagtaatggcataaattgatatcatgtacttcctgatatgatgcactaagaagattacaatctcacttctcttgtaatcccggcaacaatacaactgaaatcgcgtcataacataacttcagacaaacccaaatgattgtcctctactctttaaaaatattaagattgtgagggggcacagtgtctcacccctgtcatcccagcactttgagaggccaaggtgggcaaatctcttgaggtcatgagttcaagactagcctggccaacatggtgaaaccctgtctcaactaaaaaaaaaaaaaaaaattaaataggcatggtggtgggcacctgtaatcccagctacttgggaagctgaggcaggagaagttgcagtgagtgagatcacaccactgtactccagccaggacaacagagcaagactccatctcaaatatatatagattgtaagaaaggaggaagaaaaatggaagaactcttctagatctaagaagactaaaaagcagggccatctcatctacagtggagaattagatgccacttgagaaacaatttctaatatactagatgcttggcaccaagtgaccaggcagttacagctgcccatcaccagctatattctgtcatacccaccaagtcatgaggtcaagtgtgcctagcaacaactcatgataagatgataatggatataccctgaagctacgtgatcagaaggtcaaaactccacatcatccatcactgttgtactaatggcattcctaagtgcacatctatagccatatgaccccatatgatcccgtaggaccagcttagagcggaggaaaaagcctgagcttggttcatggatatgaaggtctgtacatgtgtgtaggtaaaaaaaaggatgacagctacaatacagcttattcaaagagcatcttgaaaaacagtggtgagaaaaagtcctccccatgggaagaattttggatggtcatcttccttgtgtggaaaaagaagtggcttatgattagaatatatatgaactcataggtagtggcttgacagagtctgagaggtgagaagaaagatgggtagatcaggtacaaagaggactaggagtagaggcatgtgaatgaataaatggggtgggcacaaagtgtgaagatctttgatgcacatgttaactcccactagcaaggtactacataaccagatagagaaaaagactcagccagttgacagcatctggcctctaacactggccaccccagtgctggcataatggccacatgactgaaatggctatggtaacaaggatggagataattcataggcccaacagcatggtctcctacttatatagattgatctggatgctgccttggttgaatgtccaacctggcaagcaacagagaccagaggccaatgttgagcctccaagatgacactatctcacaagcagatccactggcacataaggtatcaagttgactgcattggacctacttctactgaaggagtacagatccattatgctgggaatcaatacttatttggatatgcatttgtttttcctgcatcactatctgaggacttacggagttcgaatccactgatacaggatcccacataacattgtatcagaccagataacccattttatagtaaaggaggtatgacaataggcccctgaccacaggaccaactgatcacattacctaccaaaccatccagaagctgccagctgatagaaccttgaaatggcctgttgaaagcataatcaaagcaccagctttgagatatgatcctctatgatgaagtatatactttaaatcaaacatcttcattgtctccccagtaggaacaatacatgggtctgggaatcaaggatttgaagcagcagtggccaagttattatctctccccttgactcacttggggacacttatgcttttgttccacatctgaaatctataaatagtttaaaaggccttgtttccaaaagggaaacacttccactaggggcacagcaagtcctattgaactataaactacagatggtgcctggcaactttgggctccttttgccaaggaaccagcaagcaaagatctcaccatcttagaaagggtcattgactctgatcatcaggagcaaatagggctgctgcctcctcagtactccttgatacaattttgattataaaaatcatagaaacatcagaaaggcatagaggcctttcagacccctcaaggatgaaggtctttgtcacaccaccagaagagccactgagaccaacagaagagccagccaaggatgaggagaatacgaaatggatggtggtggaggaagaagatgagtatcagttgcagttcgaaggccaactgcagcatcaggtgttgtagtttatctcactaaccttactctactgagtttcacccaagaaaagaggtctatcagaatcctggaggagctattctcagaaagcatacaaagcagtggatcaagcaaaaaaaaaaaagagtgtattgtcatgggtactgtactgtgccatccaattttcctttaaggactgaagggcaatgaattgagggaagtcacaggtaaacagtaaaaaattgaggctctcttccaatagcccaaagggaattgaatcatgccaacaaccactgagtgagcttggaagtgaatcctcctccacttgacccttcagataagactgcagccctggccaacccctgacattctgtagaaaatcaattgactataatgtgtgagtttatttttgaactgcctattctcttacattggtctatgtgtctgtatttttaccagctgatttgattactatagctttgtagtatattttgaagttagataatgtgatgactgtagctttgttcttttcattcaagatcgctttggctcttcaggggcctttgtagtttcatacaaattgttttttctatttctgtgaaaaatgtcattggaattttgatagggattgcactaaatctgtagatcactttgggtaacatggacattttaacaatattaattcttccaatctatgaacattaatattattccatttatttgtgtctttttaaattcctttcatcaatattttatatttttcagcatacaagtctttcgcctccttggctaaatttcttcctaagtatatttatatatttttgtagctatgtgaatgggagttttcttaatttgtttttcagacggtttgctattagtgtatagaaatgctatgatttttgtatgttaatttcatatcctggaaatttactgaatttgtttattagttccaacatatattttaaatttaaaaacaataaaatgaattatgaagcatttgcaacaaaaggtgggataatacaaaaatattctctcccctttttcagagccaatgcagtgactatgtgtgggcaagagaagacattctaaatgcttactgccctccttccatgtctagagctgttaggtaggataagagaggtctatttttaaactgacatgcaacaaattaaagaaaacaatggttctaaagctttgtgctttgagaggaggaaaccagagcagatggttttttgtttggcaaaaatccctaaatagggcttttggtttacaaaggggaaataccacaacctctcaaactccaccttcaacacacacacacacacacacacacacacacaacacacacacacacacacgcacacacacacacatacacagagtctgaaggaaagaattgaggaagaaaaagtaaaattttgttgttgttgttatttgtttgtttgtttgttttgagacagagtttcgctcttgtcgcccaggctaaagtgcaatggcgccatctcgactcactgcaacctccacctgccaggttcaagcgattctcctgcctcagccacccaagtagctggggctacaggcacctgccaccatgcccagctaattttttgtatttttctagagacggggtttcaccatgttggccaggctggtctcgacctcctgacctcagatgatccacttgccttggcctccaaaagtgctgggattacaggtgtgagccaccacacctgcccataaaattgttttttaaggttaagtaaagggaatttggagcttttgaatgaaagcctagaagggaggggagccactctggtttctgtaaaaggaggaggagcagagaagcatcttggagaaaagatctggtccacatcacacggaatcgggttaagttctgagaaagaggcatgggtggggaaatcctatggagaatgcagattgtggagaagtgatgggtagtacctagtgcagatggcagaggaagtaactccaggacttttgtaaaaacagggactaaagagttggagcagtagctggaagaaagatgtgaagtaacagggcttctttttttaatgggtgatattactgtatatctgtatgctgattgaagtgttccaatagaaaggaaaaaataaacatggataagcattaattagaggagtaaaatccttaagtaggagagagaaaatgggacctagcacataaagagagggtttgtccttagatgttcatccattgtaacctgacagaaggcagattctgtggttgccgatgctggtagaatgatggattcgggagtggaaagattaaaaaaaaatgatcttttgatcttttccattttctcagtgaaataaggagccaagttatcagctaagggtgaggagaaggaaggtggcttgagaaaggttgagaagtgaaatagccactttagagagtaagggagtgaacaaactagagaaatataataggattgtcgggcagagctggaggcccatgtaaagtttgtgtttatgaatttaaaatgggacctattggcatggttgtgagtttctctttttttccagccacgttcagttccttaggtgcaggcataaggaaggcagatggtgccagggatgagtttggccagcaaacactaccaaaggagagaagagcaagggagttgaatatatgcaaaggaacgacgtcaatgatgggtcatggaattgtagtggatacagaaaaaattttttggcactatgtaaacccagcatcaaggatgcaaattcagtcctattgacctggaagtccatgcttacttctgtatggcaatgcttctcaaacttgaggatgcgcaagaactatctggaaactttgtcataaatgcagaactctgggccattcttaacaattctggggcacaacacttgttctttgaaataagcagataggtaatagtaacggaaggagggggtctgtggcccattctatgaaaaatattgtattgcaggtgttttacgtgaaagtgcttgaaagtaggatttgtttgtttgtttgtttgtttgtttatttatttatttattgagatgcagtctcactctatcgcccaggctggaatgcagtggcaccatctcagctcactgcaacctccacctcccagattcaagcaattttcttacctcagtctcccgagtagctgggattacaggcccacatcaccatgcccagctaatttttgtatttttagtacagacagggtttcaccatgttgcccaggctgctctcgaactcctgacctcaggtgatccacctgcttctgcctcccaaagtgctgggattacaggcgtgagccaccgcacccagccgagatcagggttacgcacaggaaaagtgggacacccagacaattgtttatactgccaacttcacagccatagaatgatgacgttccaaatatttgcatttcttaaccaaatgacataactaaaagtaagctaccatgaagctaacactgcaatgggtgcggcaataaattcagtagctttatttttaaatttcaattaggttccttggatgaacaagaaacaagtgtgacattttgtgtggaatctgaaaaccaccttagcatggctttacatcggatgcatcagttttccaaaaagccagagaactgtgttctgttgggggagaaaaagataaacattctaagagaaacaatcatttcttaaatgtggtaaatagctaagccaaaccaaatacattttacgagtatatagaatacatgtgattatgtgaatgaaaccatttagtgtgaggtttaagtgatgggagaaaacattagggaaatgataagaccctcattttctttttctttttctttttcctttttttaagacagagtctcgccctgttgcccaggttggagtgcagtggcacaatctcagctcactgcaacctctacctcccaggttcaagtgattctcctgtctcagcctcccgagtagctgggactacaggcacgtgccaccatgcctggctaatctttgtatttttagtagagactgggtttcaccatgttggccaggctggcctcctgacctcaagtgatccgcccgccttggcctcccaaagtgctgggattacaagtgtgagccactgcgcctggccaagatcctcattttcaagagataaaattaaaggttctatatacagtgaagactgttctataacagtcaagattaaaggggaaaaaacagtatcggccctttacagtactgcatctgtccaaagaccataagggagaagatcctgaagaaatatatcaacaaagctaagacttttttcaattattcttttctcacattttttctactgatttttatttaagcttattgtattttgtcatgttttgtatttaacatctcaccagggctctgctgtcttttgaataatggcaatttattcagtgcatttgtaactatttacaattaaaattatattcctccatgtcatgcatatttctaataatcaaaccaaccccatgaggtgggtatttttaatcagttatcattcccttctctcccactagctggacacttctcagactcctctcttcttagctttgtctgctccctactgtcctctcccacctgctaaaacaagattgtcaatgtttttgaaagatttctaaacctagagccaaggacagcttcagcctctggctggttcttactttctggcatcagagacatttcaaccctaaatctgaaaccttaaaaggttagcagctctaaacgctggccattacacacttctttatctcacacaaacctggtatcattctccttaaaatattttgctctaatggatactttgctctaatggatacttttcaaactctacgaattgcttgagaaaggggaaatgttagatctttagaccaattatcattgccatgagttgttttgtcacttggggtgagttctctataatgtgggaccaagatgaggtagatattttattattcaatatttggttcattattattcaagctcaacttggaattatacaagatggcatcattcacctcagcattcattgaatataaccacaaccctgagttttacagaaaagacttagaaaagaggctgggcgcgtagctcatgcctgtaatcctggcactttgggagactgagacaggtggattgcttgagtccaagggttcaaaaccagccttggcaacatggcataatctcttctctaataaaaatataaaaaatagctggacatggtggtgcgtgcatgtaatctcagctactcagaaggctgaggtgaaagggtcacttgagcccagaaagtagaggctgcaatgagatgtgatcgcaacactgcacttcagcctgggtgacagtgagaccttgtctcaaaaaaaaaaaaaattggaaaggaaaatgcaagtggggacgccatctgcagctcactgcttcatatcattgtttctccctctcacccctctttttaaaaacccagtggccaaattcatctgtgttttgtttgtttttgttttgagacggagtttcgctctgttgcccaggctggagtgcaatggcgcgatctcggctcactgcaacctccacctcccaggttcaagtgatgctcctgcctcagcctcccaagtagctgcgattacaggcacccggcaccacagcaattaatttttgtatttttagtagagacagactttcacctttttggccaggctgctctcaaactcgtgacctcaggtgatccacccgcctcagcctcccaaagtgctgggattacaggcgtgacccaccgcacctggcctcatctggtttttgacaatcattatagaacaaaggctctgattatgatgacgggcaagtgggagtcctagctaaacgttccaatgcagacttacccttgaagcatttggggacttcgatagtgccatctatacactgagcatcctctgtatagctacacttcttttccttatttttgcagaagaaagaaactttatcaccatgtagcattccattcttaaatttttcctgaatctttactctctctccttggtacaccacagtggcttttttcacaggtactttacaagatgctgaaagagagaatacttgtaatcaggacttaagagttcaggaagtctttctgaaagagagtatagcatttgaaacagtagatgagtacacctacacaaattggtcaaggcaagaaaaatccaagaatatatatagtaagtaatggtaatatgattgctaattgcagttctctgtcaatagaaccattattcatagcttccaagatggccttctcttcccctacagtagccacagaaggtcagaacagaagcatcagagcctccatttcagtgaaaaaaaaaaaaaaaagcaactaacagatattgacatttcatgtaagcctactctgccctctcagattgcattcattaagcaggtgcatctatccaccagccattgtgagtgttggctgataacagctcataaatactctgaaaaattgccttcagccatagggaagccacctctcccaggagtttatgcaaaccacccccagggtcagggaagggagcagctcaaagccaaagactgactgatgagggaatataaaaagcaggtccccttggctcttagtgggattaactcaagggtggaattcacactccagagctcccagtgggatcaaactgaacctcattttagcagagaccacatttctccctggctcggcagcattagcatcaccagggaacctggcataaatgcaaattgtcaggccccatcccagatctaccaaatcagaaactctaagagtggagctcaaaaatcctgtgttaaaacaagccttccaggtgttgctgatccacagcgaagtttgagaaccggtgccttaccctcgcaaatctgcctcactctttcttctcctgagacattcactaaatcaactgtactcgaatccccgtctcaggctctgcttctagggaactgtaacctaagatgctagttatttgtcatcttgcctgctgccccagagttcctctttctgcttaaactgtccagcccatagtgacctgagcagagttctaatgctaggctgttgttgttctttacttatgcatgacactgatgggatcaagggtagacacctaactcaaaaggaaccagtgtctccaggaaagatgccagttggtgatgaatcctgtaactgagagggtctggtgtatatcaagccatgttcaagatgaataagcagagagacggaaatgggagagaccattgagatacggaaaaagtaggaatagttcctgcctttcagttccaatcttcaggagtatcagttgtatttcatgtcttcatcttcaatgcccacatgatcgacttgcctgttgcctccttataatatccccaatttccttgaactcactcgaatgtgtggttggtttttgcaatgagaagagccttggctagacagagcacaaaaaggggtgggcatggtggctcacatctgtaatcactcgaacctgggaggtgaaggttgcagggaactgagattctaccattacactccagctaggcaacagagtgagactccatctcaaaaaaaaaaaaaaagactccatgtgtctacaataatactaaaaaatgatggatggaagaaaagctcttctctacagaggccgaggcgggcggatcacctgaggtcaggagttcgaaattagcctggccaacgtggcaaagccccatctctattaaaaatacaaaaattagccaggtgtggtggtggggtgcctgtaatcccagctactcgggaggctgaggtaggagaattgcttgaacccgggaggcagaggtggcagtgagccgagatcacgccattgcactccagcctgggcgacagagcaagactccatctcaaaaaaaaaaaaaaagagtgctcagaggcaaagacttaaaagcaaataaagaaagcccacatgatctcccaccatatcaccaatgcttacaaaggatctgtttatttcatactgtttaaggtcaaggatacttcctaagcatgaggcttccccatgcacctgtgagtcctgaagtcacatgccagcagtttcctagcaagtctgagcaacaagtggaaaagtgttggaacaagaaaatagcaagtaaaggtgatccactgtatcaattcagagatcttacaggacctcgcctatatttccatacctttacaacttggcatggcagaccagtttcccagtttggtacattctatttcttccgggccatccagagaatatccatcatggcagccaaatgtggctttatccttgtaataaagtgttggttttgcaggatagttcacaaatccattgtctggtcttgatgggaatgggcattttacttctaaaacatttattcaataagacatattagtaataaatagtgctatccaatagtcatgaaatagttacatccttgtctctgtcacaccactgaatcactgtgtgttcctgtaactggaatgcaatttatagttaccttgtgcttaattctgtccccactcctcttatatctgtggtaccctggatattaaaaaagaaacaaccacactttgaaagtaaattaatgagacttcactaagttctctgggttttcacatataatcataaggtattatttattgcaaacttcatctctacacagtctaagatggtgggtttgaaagaagaaaagcaaagtctatttctaacaaaccataaaattaaaatgcaaagactgaacccccccccccattcacacttagtacaccattatttggctttaaaatagtaaatcttactgttattcaattcagactatggaagaagccagcaggaaatacgtcaaagaaaaatggtgctgcttcctggcctccttaagatcctcaacagtagaggcccaaacccacgtccttatgagctgcagtgcgagaaagcaaggctggagccaggagcacaatattctcagaggtagtttaaggaggtaattaagggtacaaactccagagtcagactgcttggctcaattttggttctaccacacattaaataaaacagaattcatgtggccaggcacagtggctcacttcggtcatcctggcactttgggaggctgaggtggatgctgaggaggtcagaagttcaagaccagcctggccaacatgacaaaaccccatctctactaacaaaaattagccgggtgtggtggcatgcacctgtaatcccagccactcaggaggctaaggcaggagaatcactcaaacccaggaggtgaagcttgcagtgagctgagattgcaccattatgctccagcctgggcaacagagtgagactccaactcaaaaaaaaaataagaatccatgtgtctataataatactaaaaaatggtggatggagggaaagctcttctctatagagggaagccagtgaataaatgtagaaggaaaagatagaattagaaagtcaccatttttcagcctccaatgtcataattgacagattcaaggatcatcattggattctaccatgactgcccaacagtggatattcacatggtttcaaagtatcacccacaggttgcttactattccaaagaaaaagcagtgcctttaccaaaaggtgatctagcacccctcaactgactaagtatcaaactaagcatggccagtgatggaacagctgacactatgtgcttcctgatatgacagaatgtattttttttttttgacacagagtctcactctgttgcccaggctggagtgcagtggtgcaatcttggctcactgcaacctccccctcctggttcaagcgattctcctgcctcaacctcctgagcagctgagactacaggcgcacgccaccacacccagctaatttttgtatttttagtagagacggggtttcaccatattggccaggctggtcttgaactcctgaccccatgatccacctgcctcggcctcccaaagtgcagaatgtattcttaacagtaatatttaacatgaatctaatcatgagtaaataaccaatcaagttcagattatggaacattctacaagacaactagcctgtactcttcaaaaatgtcaatgaaagacaacaaaagaggcaaggacttattcttaattataggagactaggctcacgcctgtaatcccagcagtttgggaggctgaggcaggcggatcattttagttcgggagtttgagaccagcctggccaacacagtgaaatcccatctctactaaaattataaaaattagctgggcgtggtggcaggtgcctatattcccagctacttgggaggctgaggcaggagaattgctcaaacctgggaggtagatgttgcagtgagccaaaattgcaccactgcactccagcctgggtgacagagtgagacaccatttcaaaataataataataattattattataggagactagagagacatgacaactaaattaaaggtgtgattcttgattagatcctgcataaaacaaaactcatgtataagagatacttctgggtcaattgggaaaatttgcatctgagataaatgttgcatgatatcgttgttgttatgttattagaatggtttggattattattgttaataatccaaaacatatgaagtgatgatataaaatgtccttgttcttagtatattcaggctgaaggctttatgggcaagtatcgtaatatatacaacttattttcagatgatgcaggaaataaaagggatctttctatggagaaacagagagaaaaatgttacaacatattaacagttgatacgtctaggtgaaattgaaaaaaaaaggaacctactttttaggacttgggagaatgaggtcagatgacacatatgtagcaggagaccagtgcctggcccatagttgagtgcccagaaaggtacaagttactactgttattggtagctcctccatgctgaaaatcacttatgttttgaatcgttcactggatatctgtaatatctaccactggagaagttaatagtcacgagaataactcttggccaggagcagtggcttacacctgtaagcccagcactttgagagactgaggcaggcagattacttgaggtcaggcatttcagaccagccagatgatcatggtgaaactccgtctctactaaaaatacaaaaattagccaagtatggtgacgggcacctgtaatcccggctacttgggaggccaaggcatgagaatcgcttgaacccaggtggcagtaagccaaaatcaccccactgcactccagcctgagtgacagagtgagactatctcaaaaaaaagaaaaaaacaaactatttgtgcacatgataaactttataatttgtctgtttgttatgcagctgacaaacttgaagatagtaatgacaggtcaagttagagacgaaataattttcataatttcttaaaaatcaaatatttctgtgattcttaaacttgggtaaagatttttaaaatgtgtaacaatcagacagcaacccagtcttaaccttcatctcctaggactctccaatttaacccaggaacttcacccagaagagaacttcaccagcctcgctgaaatgtccagctgtccatggatacatcctgcctttcatgtctcccccatgtgtggtatgccttctcctcattctctactgctcctccaagacccatttcaaaggtcaccacctatgggaagctgtcccaggcagctccagacagttaattgcattatttataattcccttgggtcagaagccaggtctcattcatcgggaatccacagtgcccagcacactgcctggcacatggtagatgctcaataaacagctgttgaatgagttcattggaaacactccatgatagtcagaattttcaatacctttcacaaatgggatcttgccctaccatgcgtattttgtctgatcattgcacttacccctgcattctggtaatttagtccaatttccatgtgtcgtgcaggtaattgtatcatttccaaacatcgcatgttgtggcaaacattcaaaaactgctgtgtcccgatagagggaattgtttccagctgatggcttataaacacgaagtgttgcaaacgtaggtatggatggtggagggcagatgatggctgggaaaataaagaactatcatttctatgaaaatagttaaggcttttaaatatactctttccagaaagaaaaaaaaaaccctaaggataaacttgagaaaatgcaaactgatcaaattagcagggtaaaaattgtcaattgtggatgcctaataggaaaatatgacctgccgggcacggtggctcacgcctgtaatcccaacactttgggaggctgaggtgggcagatcactagaagtcaggaatttcagaccagcctggtcaacatggtgaaaccccgtctctaccaaaaatacaaaaatgagccaggcatggaggtgtgtgtctgtggtcccagctactccagaggctgaggcaggagaatcgcttgaacctgggaggcggaggttgcagtgagccaaaatcgcaccactgcactccagcctgggcaacagagtgagtctgtctcagaaaagagaaagaaagaaggaaggaaataaataaataaataaataaagacagaaagaaagagagagagagaaagaaaggaaggaaggaaggaaggaaggaagtcagaagggagggagggagggaagaaaggaaggaaagaaagaaagaaaggaaagaaagaaagaggaggggaggggaggggagggagggaggaaggaaggaaggaaggaaggaaggaaggaaggaaggaaggaaggaagccctcaagtcagatgtccaaaccagtcaaaacaccaaaaaaatgaaggaaatttaagtcttgccactgccttttgcaacaacacaatggttaggttttataaaatcttttattcatatactaccttggaagatgcttctggaaggcagaatttgtccctcagtgctgagggaccatcctgaaataatggctggtgacagcaacttggtacatagtagtttgggaatgagttccattaccagttcagtctgtttctgctgaatacctccctgcttttggattcttggtatggatggagcttacccaagtagcttcaggaacccagagagatagtagtggcttgtcaccctgacctgagtactatggagcttcaacaagttatactagcataaaagaagatagtgctgaccaaaatgcgatttaccttgacttccctagatccctgctgctcaaaatgtggtccaggggctagcagcacgggcatagcctgggaaaatagcttgttggaaatgcagaagctcagaccccactgcaggtgcctgaatcagaatctacattttaacaaggtgcccaggagactcatatgtgcattcaagtatgagaaatactcatttaaattagattaaagctcaagcagtctttctatttacaacccttttggaaagtgagtttatggctaggcaccgtggttcacgcctgtaatcccagagccctgagaggctgaggcaggtaaggttgcttgaaaccaagagttcaagaccagtctgggcaacagagcaagaccctgtctccaccaaaatttttaaaaactagccagatctggtggcgctcatctatagtctcagctgctcaggagactgagaggatcacttggccccaggagatcgaagttacagtgagctgtgatcacgccactgcactccggcctgggcaacagagcaagaccctacctctaaataaagaagcaaatttacataatcggtataaatctgttttaagtgaaaactgtaggaaccatcgtgattcctactgctgagtgaaaattttacttaatttgtcctttaaaaactttcgtttttgcttgttcaggtcttcttaaacaattatttatttgaaattgctttactttccacttgctttttttttttttttttttttgagatggagtttcactcttgttgcccaggctggagtgcaatggtgcgatctcagctcactgcaacctccgcctcccgggttcaagtgattctcttgcctcagcctcccaattggctgggattagaggcatgcgccaccatgcccagctgattttatatttttagtagagacggagtttctccatgttggtcaggctggtctcgaactcctgacctcaggtgagccaccctcctcggactcccaaagtgctggcattacaggcgtgaaccactgcacctgccctcctcttgcttttgctaaagacagacttcactgacatgttgaagaactataattagtattgaaatgcctgggcctcctggtcaaagatgtataaatcacaagttggggaacataagaacgtccttccctacataagcaaagcccagagatgactctgacagcttggctgaggatcctctgaaaaaacaacagtgctttttggaggaatgccaatcagctcctaggatgcaagcccctttgatgggctgttggcttactgtgagggtgactttcctcctcgtctgtcccgtaagtcactaggcttactctctgaaggcaaagctgcctcctttggccttgcagcctcagtgctaacaagaggatccagcatacagtagatcctcaattcatgtttattgaataagttaataaatgaatgaatgaattccagagtgggaggaagatgtttgtttgatctcactgtttgcagaagttcctctagttaagtggtgacagtccctgatataccaatgccacacatatccaagccacttccaaagcactatgagagcattggagtcaacacacccagaaatgactggcttagatagagtaatgaccgcgaggtggagaatacagaatgtgtccgtgagtaaaatgcttcccttctgtcattccaaagtggttgtttcatcttctagagcaagataccaggatgaatatcccccacaagggtgaccattcatctcattgagctgtgactgaagagattccagatgtgagactttgagtgctaaaaccagaaaggttctgggcaaaccagctgatcaccttgcccacagacttacgagcacagacaggaagctccgggctccattttccttcctcagtgcacttggcagaatcagcgccattcagataaaacctgcaaaaggaaaattcattctatcaaggagtaaaataatccatcactgacatctcaaatatcttctccattgagcattgcttcatgttaatgctattgacttcttttccatcgtataatgctgtcttcctgacaaacttagtactcatctatggctcatggagcctcccaaccaatgatgcaggtgaatcactgcagggttccacagctggtgagtggagaatccaaacccttaaatccctcatctttaaagagttggccaagatgactgtttctaatataaagcaaagaaccatctctttttcaggatgacaaaagtgaaccaaactgagtaatcttcattattcattttcttacagcctactgacaccaatgaataaaagcaatgcagtctatttccaatgaaaatatagcattctgactgggtactttggctcatgcctgtaatcccagcactttgggaggccgagatgggcggatcacttgagcccaagagtttgagcctgggcaatgtggcaaaggcccaatttctacaaaaagtcaccaggccgtggtagtgtgtgcctatagtccaagctactcgagaggtagaggtggaaggaaggattcaaaaggatttaacctgggaggtcgaggctgcagtgagccatgattgtgccactgcactctagactgagcaacagaggaagatcctgtaaaaaaaaaaaaaaaaaaaaagaaaagaaaagaaggaaaggaaggaaaaagtaaggaaggagagagacagacaaagaaagaaagaaaagaaaagaaagacggaaggaagggagggagggaaagagaaagaaagaaagaaaaagaaagaaagaaagaagaaaggaagagaagggaagggaagggaagggaagggaagggaagggaagggaagggaagggaagggaaaggaaaggaaaggaaaggaaaggaaaggaaaggaaaggaaaggaaaggaaaggaaaggaaaggaaaggaaaggaaaggaaaggaaaggagcaggatgccatggtggctcacacctgtaatcccagcactttgggaggccaaggagggtggatcacaaggtcaggagtccaagaccagcctggccaagatggtgaaaccccatctctactaaaaatacaaaaattatctgggtgtggtggtaggcgcctgtaatcccagctacttgggaagctgaggcaggagaattgcttgaacccaggaggtggaggttgcagtgagccaagatcgcaccactgcactctagcctgggtgacagagcaaaaagaaaggaaaaaaaaaaaaagaaagaaaaatgtaacattatgtcttcgaagccaattttcttaaggtcatttgttaccagacccattggtagattggtgtttcagatgaaaggtgtgtatttctctctcacatgtagtattccttaacctccaatcccagtagaaacttaccctagtggatagccaatgtgctctcaataatgtcacaggggtgcctttgctccttatgagtctatgcccaccgttaagtgactgcctccctttgctcccagatgagcctgtgcccaccacaagtgattgcttcctggggatgtggaactgcattgcattctccactgtcacactcccaaccttctccatagaattctcttctagagactaccaggttggtcaatcaaattagcctaataactaaagcccaagtcttattcctaaagtattttaaccctatccaagatttggcccagagatcatatggaattatcatccaggttcaatcattttaatgtacctcctctgagataattaatcaggagcagaaaaattagatacagtggtgactacgtattgcactagttgttatattctccaatccttaccccaccctcaatgctacaagaccatcctggctaacacagtgaaaccccgtctctactaaaaacacaaaaaattagccgggcgtggtggcgggcgccagtagtcccagctactcaggaggctgaggcaggagaatggtgtgaacccaggaggtggagcttgcagtgagccgagactgcaccactgcgctccagcctgggcgacagagcgagactccgtctcaaaaaaaaaaaaaagcaggactaaaatcgatttgcatttgaaagtccaacctaaaggctgaaaacaaaatatagaccagtcttgatgtttagcttaaggatacaaaaatgtgctcagtctgttaactgcttagttccatgaaagttcttacccagtgttacaagaaaaactgatcgtgttgggatattcaaaagtcgtatagcgtacggctccattttctaagattccagcaaaaggacatactctggctgtgatacaaagataaaaaatgttacttttctttgggctaaaaaaaaacataaacaggtaaatttctatttatagaatttttcattaaatgaaacatataaattcattttcatcctttggttcaataactttactggtaactattctaagaaagcaattcaaaataagacaagtgatatatgtacaaaagcgttcattatactgtttctcctaataacagaatttggacaggcggggagcagtggctcacgcctgtaatcccagcactttgggaggcagaggagggtggatcacttgaggtcaggaatttgagaccagcctgaacatggtgaaaccccatctctactaaaaatacaaaaattagctgggcatgatggtgggtgcctgtagtcccagctactctggatgctgaggcaggagaatagcttgaacccaggaggcagagggtgccaagatggcaccactgcactgggcaatagagtgagactccgtctccaaaaaaaaaaaaaaaattggatagtctaagggttcatcaggggactgttttaattaatcatggtaaatcaaaagttgaactattatgtagccaataaaatatgaattgtgaaatatgtggagatacaatttttatgatatgctgatgaaaacagaaaaatacaaaattatacctgctctctgcagtaatgcaaaaagatatgcatggaaaataaaaaaatgaaatttttagtgttccagagttatagctgatttttattttatttatttatttatttttttttttgagacagagtctcactctgctgcccaggctggagtgcagtggcacaatctcagctcactacaacctctgcctcccaggtgattctcctgcctcagcctcctgagtagctgggactacaggcgcatgccagcatgcccggctaattttttttatttttagtagagacgaggtttcaccatgctggccaggctggtcttgaactcctgacctcaggcgatccacccaccttaggttcccaaagcgctgggattacaggtgtgagccaccgcacctggccctgatttaaagaaaaattttccctaatgatgttacattggctttttactaaaaattatgtttaggctctttaagcaaaaaagcatagtaaaatcaacttgcatgaacatgcataactttgacaaaggtcctgttcatataaccaaaatcaccagatccatacatctatttttactgcttaacttctacatataattaaatgtaccataaattcaatctggttgattgcataatacttgactgtaaagaataatgctagcatgatatcatagaaccatgttctaagaaataaataaaagcaaccatttacagtaaagccatagtgagattgatatattttacgttatattattattttaatttgacctcttttcttgtatttcattataatataatatatacataatgtagatgaaatttgtattcatttcagtaactattaagtccgctttcattttcaggtgaagtccaaagatatgatgattccccaaattttgtttttccaaatgtctctttggcatcagttgacatttcaaagcctctccactgttcttttaacttctgtagtgtttctttctccttttgccacaccagatctcatttttaaacctaccctagtttcaggctatgatcttctcctcttctatcaatagcacctattacccttactctctttgcacagagagaactccccaagaccttctcatttctctccaacctggctttctgcagcatctactggccctctgcactctgagcatgacgaggtagcttattcctccaaaatacccagaatccaaatgagggaagagaatgtgagagaaggtactgacttacgtgtacatttcagagtgttgatgggccacagtcctgtgagagggcagataaactttctcatccctcctcgggacacatagcccggcttgcaggaatacgtaatctcttctcctggctcatagaatgtttttaacgggaccactgtggaaaatggtaaatcatctggcttgggacaggctgaaagagggcacaaagcagatggttaacaaatctctatttgcattttaaagttcagctaagcccacaaatgaaaaatgtgtgtactgttaccaattataagcataccaagttgcatgccaaatacctcatatacactatctcatctaatcccctcaacaaccatttgaaggaggtattataattatccccattttacaggtcagtatgctgaggcttaaattggctacgtatcttacagaggagctttacacatggcaatattaaagaatcagtatcaatccagtccctccagcatccactctaaagagaatttagttatcagctgggcgcagttgctcacacctgtaatcccagcactttgggaggctgaggcgggtggatcacgaggtcaggagatagagaccaacctggctaacacggtgaaaccccgtctctactaaaaatacaaaaaattagccgggtgtggtggcgggcgcctgtggtcccagctactcgggaagctgaagcaggagaatggagtgaacccaggaggcggagcttgcagtgagccgagatcgcaccactgcacttcagcctggcgacagagcgagactctgtctcaaaaaaaaaaaaaaagaatttaattattcttcttcttattattattattgttgactgagttttgctcttgttgcccagactggagtgcaatggggggacctcggctcactgcaacctctgcctcccaggttcaagcaattctcctgcctcagcctcccgagtggctgggattacaggcgcctgccatcacgcccggctaatttttgtgtttttagtaaagacagggtttcactatgttgcccaggctgggctcgaattcctgacctcaactgattcgcccacctcggccatgatgcccagctaatttttgtatttttcataaagacggggtttcaccatgttggccagactggtctcgaactcctgacctcaggtgatccacctgccttggcctcccaaagtgctgagattacagatgtgagcaagcacgcccggcctacttatcattattgatccctgacatatacgaaggggttggatatattaattattttttcaaaagcaaaaagtacttactccgtcctgcaatagcaacatggcagagaaaactcgagaacaagatgagcactggagaaatcattgtggatgagtcacactggcactaccaaagtggttttcgtctgctaaaaagacagagccaaatatgaaagcgcttaaacattaaccattttctggtgtacttttatctttgtaaatagaagataaagtatcatgatttgaatggaactctgagacccacattctttaatcatttactttccacttatgtggctctgttatgaaatctttgggagatggtttctgtcttcataacgtttttgttaatggcacaaaacagttcattattgcttttgacagaaacttgttgtttccggggttgcctggacttctcattctccatcttttgttttgtgtatgttgtagatggaacaccaaaagatcgaagctcctgtttcactcacagccttggcatataaactttggacaaacacctactctctgttctcagtctccacctctctaaaatgatgttccagttttcagatgtataattacaaagaatgtcttccaggaggcacttacaactttaattccctacaaactgagctcaacatcctctcttgcaagctcctatagctccagttaggaccttagagctatccttgaattctctatcttctcttacgtcagatcaatacaaagtcctcctcatccattcttaatatgtcttggatctgtctagacaggtttctagatctgtttcaggaatttgaaaattgatttgaaattaacaacttgggactcgaagaagaaaaaaaaacttgagtaggataagataatgggccagtgctgatgttgttgcttgagagggttcggaaggggggttgtctttgattccctagttctcttctacatcatttgctctaaaaaaaaaaaaaaggatatataaatggacaatagccaggccatatgtgaaaacagaactctgacccacacatctgtagcaacaggtctagaaagccaaacctacaacctctatagcagttggcccaacttaaggccaaccagagaaatccaaacatatttctctaaccaatcacatggacacctcacttctagttagtttccttccatcctccccataccaacaatccgttggagcacacctgaagcctttccttttttctattataaagctttcccactcctctgtctgactttgactttgagtctctgccaaacacaactgttaatggctgcctcccttcctatagcaagctctgaataaataacctccgcttgctctcatttgggtgatcttggtttatatccagaggtctaaaattccctgagacacatcagcttgagaaatctccatctgtcaggcagatgattcttaaattacgatcctaatgaacattgtgttccatgataagaagagtgtgctgccactaatgtgaaataacagtggtccttccctatttgtccttctaaggggaaggagattcttgttctctggataattcccaggttccgctttattgtggagaatctccttgatgaatgaagaagaaagaaaactaatgaagtcaggaggagccaagtcgttctgtatagtaagatctgaagtagaaggggaaaaggagagagaaaccaaagaggtcgggcatcagttaaagaaaatttgagaaaaggttaaaattgagacgagaatattttcagcaacagctacaaactgagtgcctgatattgagagaggacaaggagaagggtttttaatgatgtttcctggtggctgggctcccttgcattaggaaacttggggtaggggtgtcgaaatagtttatattctattttaggtggttgttacttggctacatgcaattttcaaaagccatcaagccaaatatttaagatctgtgtgtttacttgattatacttcaattggaaaactatgcactcctttcctccttcttccctccctcccttcttccttccctccctcccttctccttccttccctcccttctcccctccctttttccctcccttcctccctccctcctttcttcccttccttccttccttcctccctcccttcctctctttctcctttcctcccttcctctcttcctcccttcctccttcttttcatcctaactcagtctaaaagtcacaaggaaggcctcaaggggaaagtcatgcttatctgtgtaaggatggcagcgtgatggtgtcacaagcttagctacatataggagattgagcaaacaagcaaatatattgaggataatgggggtcaggtttctcactaacaagagaagtaacaatgcggaaagaaggaaagttagcatgaaccttgaggtgttggattgaaaatggagacagtacaaattgtgcgtatatataaacagatacagaaatcaatatagatataatggtatgtacatgtgtgtgaatgtatgcctgaatatacatataattcttagttctgtccactaggataatagcagtagtacatccagtagcaatgagcacacacagtgcctaaatattggttgttaaatgcaattcttggccaggccgtggtggctaatgcctgtaatcccagcacttcaggaagaaagaaagatcgcttgaggtcaggagttcaagaccagcctagccaacagggtgaaaccctgtctttacaaaaactacaaaacctagccaggcatgatggcaggtgcctgtaatcccagctacttgggaggctgaggcaagataatcatttgaacccagaaggcaggggttgcagtgagccaatgagattgcaacactgcactccagcctaggcaacagagcgagacactatctaaataaataaataaatgcaatccaccatcgaaaggcaccaaagctccttagaaaattggctgattcttgaactgggtcaaggaaaagtacaagatgagcctggaacaccatcttgaacaacttaggtaatgctcagagaatgatagggacatgtccaaaggacagagaagccatttgaaagtggctttcttgactgggtgcggtggctcacgcctgtaatcccagcagttcaggaggccgaggtgggtggatcacttgaggtcaggagtttgagaccagcctggccaacatggtgaaatcccgtctctactaaaaatacaaaaattagcagggcatggtggcgtgtacctgttatgccagctaggaggctgaggcaggggaatcacctgaacccgggaggcagaggttgcagtgagccaagatcgtgacactgcactccagcctgggcgacagagtgagattccatctcaaaaaaaaaaaaaaaaaaaaaaaaaaaaaaaaagcggggggcggggggtgctttctctggtcaaatatgtgacagtttgtccaaataagtaataatagtaatggattatactccactgaataaaataggaatcagtgagtccacagtgatagtaataaacacattaacaattatgtgaagagataagaaagttattccttagagtataatgccaagcaattaatatagaggaatactggacttagagaattgtaatttggaaataattatgaaacgatttaattctggcaaagaagtatcaattgatgctagaatcaggggatacaagtaggatgagaaatgttcatacagccttaaacatgtctccacataaaataactatttattataaaggagacaaagagaaacttagaggggaagaacctggcagacaccatcttaattaagtaatcaaaattaatgtcaccactaatgggataaattggcatgtatgtcctccaccaagaggatgcaatgagaaggacacagcgtcacttctgtgatattcctgccaaaagcttagtaacctggattgtgtcatgagaaggcactgtacacacacaaattgaaggacgttatgcaaaatgactgccctgtcatcttcaaaagggcaaaagccatgaaaggcaaagaaagacttagggaacccaggtggacatgagaactgggtgcacagtgtgggcccgaaggggcatttggtgacacttgaatggaagggtctagggtctctgggtaaagagaacaaggaagtttttgttctattcttacaacttttctgtatgtttgtaatttgaaatcatttaaaaaataacgaaaaagaaaaagaagaaagaaagagagagaaagaaagaaggaaagaaggagagagagagcacaagaaagaaaaagaaagaaggaaggaaggggaaggaaggaaggaaggaagaaaagaaggaaggaaggaaggacgctttttgtggtttccttgaaagtccttctattgagatgtgatttttaaactggatcatacgaggcctcaaattttatttgcatcgccccctaaagaggaatacaagcttggcccccaccccaccgccatcattgacactcagctcctatttgccagctactgagctttgaaaaattatgcaaaataacagtgacaggaaaatggagaaaccactaaatcaaacttagtttgacggcttttgtgggctgttacatgcatttgtaattacaactttcatgtttactcttcggctggtaaaaatttcccttgtttgaacaattaaatacaaagataataaatggtaatctgcataattaataaattatgagtataattatgattaatttattcataatcataattttgggattatgatgattatcagctggccaccatgctcagctaatttttgtatttttagtagagccagagtttcgccatgttggccaggctggtctcgaactcttggactgaagtgatccgcctgcctcagcttcccaaagtgctgagattacaggtgtgagccattacctccggctgaacttgaacatgtctgagaactacagggtattcctggccgggcgcggtggctcacgcctgtaatcccagcactttgggaggccgaggcgggcggatcacgaggtcaggagatcgagaccacggtgaaaccccgtctctactaaaaatacaaaaaaaaagttagccgggcgtagtggcgggcgcctgtagtcccagccactcaggaggctgaggcaggagaacggcgtgaacccgggaggcggagcttgcagtgagccaagattgcgccactacactctagcctgggtgacagagcgagactccatctccaaaaaaaaaaaaaaaaaaaaagagagagaactacaaggtattcctaaaactcttccagaaacacacatggccctaatgaagaagtctttggagagataagatgcaattgcacctttcaattattttcaccttccagtttgtgacacattgggccacataactttagcaccatctggttgatcagttaactgatctatcttccctccacgcacttcgattcacattcccaaaactaacctatgataataactgaggagctggctgcttaccaatgttaaatgacagttttaaagacacatttaaacttaccattgaagttttatttggcagagcaagtggaaaaactgttaaaaaatatggaattttggcaaatcaagtggctgtcttgtattttcagggtttatactcatcagtaaagattggcaactcttgggtttaatgttacacttaacatgctattaatatattttaacaggccgggtatggtggctcacacctgtaatcccagcactttgggaggatgaggcaggtggatcacttgaggccaggagttcgagaccagcctggccaacatggtgaaaccccatctctactaaaaatacaaaaaagtagccgggtgtagtggcgggcgcctgtaatcccagctacttgggaagctaagacaggagaatcatttgaacccaggaggcagaggttgcagtgagctgagatcactcattgcactccagcctgggcaacaagagtgaaactccatctgaaaatatatatataatatatatgtatatataatatatataatatataaaatatacgtatatatatatacaagcatgatcaagaatacctgagaatttaagaatatataaaataacaacatttttatcacaagtaacatgggacctcgtcttttgaaactgttaatgactttatagcgtttcttacgctaatttgtaaattaaactatagagacctggattcagagtccaaggtttttgtattcctgaaaccacattgcatcacatgttcaaaaactttcttatttacttcccaagcagagactttgaccatgatattaaacatttagcaacagtttagattatttgtttaaaaacctactttcaatgttgtctccttctgagttggaattctagtcaatatctaccaaccacatttcagagaaaagattcaaatgccttctctttatgataaaatatgtcaggaactagatatgcatttataaggggtataaacatgtcacagggcttaatgggcatgattaaatatgtctagaaatcaataatgggcctaagtcagcactgggacatttttgtgtggacactgggatcctctgaatacaggtagcttttaccttgaaaaaactaatatccatatgttgcaatttctatttttatctagagtagttagtcttatccttggctgcatagtagatgttcccaattgtttgttaaaaataccaatactcataatttctgggtatagtgctttttttttttttttttttttttgagacggagtctcgctctgtcacccaggctggagtgcagtggcgcgatctctgctcactgcaggctccgcccctgggtttacgccattctccagcctcagcctcccgagtagctgagactacaggcgcccgccaccgcgcccggctaattttttgtatttttagtagagacggggtttcaccgtgttagccaagatggtctcgatctcctgacctcatgatccacccgccttggcctcccaaagtgctgggattacaggcgtgagccaccgcggccggccggtatagtgatttttaaaacaattgtccaggtaagtatgattgaagtaaggataaagatccactgatctagcacgtcaatgttcacctaagacaagttcagctaatacggttctaccacatacattttctcccttgccaagtgagactattttctgtactttgaatatgacacagctctgagtctcttgtgcattttctcctaagtgccattaatgcttttatttatttatttatttgggtgttttttgtttgtttgtttgtttttgacagtgtctcactctgtcacccaggttggagtgcagtggcgtgatcacaagtcattgcaccaccatgtctggctaattttttgtatttttggtagagacagcgttttgccatattgtccaggctggtctcgaactcctggcctcaagtcatctgcccacctctgcctcccgaagtgctgggattacaagcgtgagccaccacgcccagccttatttcttatttctttattttttgtagagatgggggtctccctatgttgcccaggctggtcataaactcctgatctcaagtgatctgcctgcctcagcctcccaaagtgctgggattacaagcatgagccaccgtgcccaggctttcttttttattttattttatttttttacaaactgctactaagcccttactaagctgtaatttgtggttgatagcagaatttcagaaataaacaagagttgactactggctataaggagttcgcagtttactaagactgaggtacaatgctacaattacaatcatagaagaaagtgtcagatgcatgtgtatccccgcacataaggatgtagtggcaatgatgaggatgttccaggttgttgccaaagagcaaaggcataaaacagcatcatgcacccaacagttgcaaattgttgagtgttgctggtgcagaatatttcaggtaaggaatagcagcaaacaaaggtggagagtgggtaggaactagatgataaaggctcttttgttttttttgtttgttttttgttttgttttgttttgttttgagacagtgtctcactctgttgcccaggctagaatgcagtggtgtgatcttggctcactgcaacctctgccttctgggttcaagcaattctcctgccttagcctcctgagtagctgggactacaggcatgccagcacacctggctaatttttgtatttttgtagagacagggtttcaccatgttggccaagctggtctcaaacttctgacctcaagtgatctgcctgccttggcctcccaaagtgctgggattacaggcatgagccaccatacccagccccaaaagtcacacagatattaaccagaaagtactcattctctaagccaggaatcgaacacgggccaccactgtgaaaggagagaaccttagctacggagctacaacactgggcctaatttttgtatttttagtagagacggggttttgccatcttggccaggctggtctcgaactcctggcctcaagtgatccacctgccttggcctcccaaagagctgggattacaagcatgagccaccgcacccagctggcaaaggctcttgtaagccacgtttaggaattagaacttatcttgaaggcggtgaaggggaggaaccggatcaggtttgtattttcgaaagtatatcgatagcagtgtagaagacacactgggatcagagagtagtgcagggagaaagagagactggaagaagaaaaaccgtagtatgttgccacataaactcatcttccattcattccactctccaaaccaatggcatcttctgtggtgttcatctgtgagatgaacaatatgaaactggccattctgatgaaccagaacatgtgctgctcttgtgaagcatacattagaaggaaggaatttccttccccttttccccgaaatcaaggcctgaaatgccagaggaacggagtcctagctaggggccaaagtctttacttagaaactggcaggaattttgctaggcaaattcaccaacccatatgttacgtgttagattggatttggagaaaggtgcttagatataattgtgatattgagtctgtggaggatggtgtgcaccaaatagaaaaaggagcatagtctctggctcttcatagagtgaccccatcagagaatgggggcaagttcatcactgtggcaagaccatggtgtcatggctaaggacagaggttttaatcaccgtatacttgagttggagtcctggctctgcctcttagtagctgtgtcatcttgggcaagtaacattctctagtcaagttttcatgtctaaaatggagataataaataaaacccccagccaggtgcaggtggctcatgcctgtcatcttggcactttgggagaccaacaggggtggctcacgaggtcaagagatggagaccatcctggccaacatggtgaaaccccatctctactaaaaatacaaaaattagttggacatggtggcacacacctgtagtttcagctactcaggaggttgaggcaggagaatcgtttgaacccaggaggcggaggttgcagtgagctgagattgcgccactgcactccagcctgacaacagagcaagactctgtctcaaaaaataaataataaataaataaacaaatcccccttcaaatgggtgtagtcaggattcaattagaatgcaggcaggatacttaactgtagctttattcataatggtgaaagtaagcaccaaaatatcccaaagcaaagaaatggttaaaatagagagcatctccaagatgtaagattatgtagtcattaaagaaaaaaaagcaatctttgaaaacacaaataatgatctgggaaattgcttatggcatgaaaataaaatacataattatatactgaatatggttccaattttgattatgacatatacaaatgctgaaagaaataaccctaagtggtgatattataatgagtgtttaatgaaagttagttctcattaacattcttcttgtcattaatatacatgcctctgatgtcttactccaaagaatttgaaattcctacacaaaatcacacaaaggtaggcatgtggttcatgcaggtt

SEQ ID NO: 1033 - DNA, 24210 bp, Homo sapiens
tctccagatgcctattgagttcttcaagcatccaaatggtttggggaaaggcttcaggttctaaatgagaggctttgtgggttaccagttggagagtcagaagatctggatttgaattcactcagccatgaaatagttgtgtgatcttgggccagacatggtggctcacgcttgtaatcccagtactttgggaggccaaggaaggtggatcactagaggtcaggagtttgagaccagacgggccaacatggtgaaaccccatttttactaaaaaatataaaaattagctgggcatgctggtgcacaccagtagtcccagctacttgggaggctgaggcaggagaatcgcttgaacctgggaggtggaggttgtagtgagctaagatggtgccactgcactcttgcctgggcgacagagcaagactgtctgaaaaaaaaaacaaaaaccagaaacaaaaaattgtatgatcttggggagttctaaggcccactagcctcatctgtagaatggaagcaatagtactattttgcagagctgacttcaggaccaagagatctaacgtatatgaagcagggtacttccttccatttgtcaggataggggaggctagtcctgtgatgaatgggaatgaaggatagaagagacagagattgggcaaacttcagattctgtgctcatagcctgctcccagacattctcctgttatctctctgtttcctagcctacacatgtgcacagacagtagatgctgttcaggaattgagctaatggtttttgtttgtttgtttgtttgtttgttttgagatggagtctcgttctgtcacctaggctggagtgcaatggcgctatctcagctcactgcaacctcggcctcctaggttcaagagattctcctgcctcagcctgctgagtagctgggattacaggtgcctaccaccatgcccagctaatttttgtatttttagtagatacagggtttcagcatgttagtcaggctgggctcgaactcctgacctcaagtgatccgcccacctcggcctcccaaagtgctgggattataggtgtgaaccaaagtgcaaaatcttcacaatttatatttaaatattacagtaaagacaggcataacaaattataaaagtattaatttggggaactaataaatgtccataaaatcttcacaatccacgttcttctgccatggcttcagccggtccctccgtttggggtccctaacttcccgcaacagtctcttccttatctttgctggggacaggcagtagctgcacagtggcagtgtgcctatgcagacagagggagcagtgaacagcaacagggtgtttccaccatggtcttcactcaggccccggctgaaatcatgggccacctccggatatgcagcctcctggcccggcagtgcctggcagagtttctgggtgtgtttgtactcatggtaggtagggtcactgggggaaggaaagaagggggttgggcaaaagttcctggctccttctggtgtcctcatctctttctcttggcgtcccccttcctctcaactccctatcagttttcatttgcatcctctcgtctctcctaatctcctttcctctcctacttcatcatttttattcttgtcacttttcttccttttttcccacattctttccctttcttcttcctccactttccccatttcttttcccttccctccttctgcttttctccttcccttgcttgtcttccgtgctcattcatctccttggctgctcccctggccttcccaacctttctccctgttggactcctgggctccctgttcctcatctctcctcttctcagcagctcctcacccaaggagctgtggcccaggctgtcaccagtggagaaaccaaaggcaacttcttcaccatgtttctggctggctctctggccgttacgatagccatctacgtgggtggtaacgtctcaggtgaggagggtggggtctggtcatcagagcaggtgggacgtgcatgtgagcgtgtcggtctggcgatggtggaaacgcaaatccttctgtgactcatggacattatctccttgagcttgaccagtgccccggactgagataagcctttggccacaccagcccgtcccctttctgtatctctccatcccgcttcctcacactaatacttggctcacctagacagaaatcaatggcagggcacgaagggcaggtgctatcctcttgtatcccccacctgaagtcctctgggggctcatctccactcaggacctctcctgcttttcccccagacatcagtgtgcctggctggagccttgagacatagtgtgttgctgtggaaaaagcagacagacttagggtgtttgcttgttcgtttgtttttttgagatggagtcttgctctgtttcccaggctggagtgcagtggcactatctcggctcactgcaacctctacctcccaggttcaagccgattctcctgcctcagcctcctaagtagctggaattacagatgcgtgtcaccacacccggctgattttttgtatttttagtggagatggggtttcaccatgttggccaggctggtctcaaactcctgacctcaggtgatccacctgcctcggcctcccaaagtgctggggttacaggcgtgagccaccgtgcctggcccagacctagatcctaaccttggattcacagtgtgactttgataagttgcctaacatcctggagcctcaatttcctaagctgtgtgatgggaataacagtatctgccttaagagctataggaagaacagctgggtgtggtggctcacccctgtaaccccagcactttgggaggctgaggcagatggatcacctgaggtcaggagttagagaccagcctggccaacatggcgaaaccccgtctctactaaaaatacaaaaactagctgggcatggtgacatgtgcctatagtcccagctactcggtagtctcagacaggagaattgcttggacccaggagacggaggttgcggtgagccaagattgcaccactgcattcccacctgggtgagagagcgagactccatctcaagaaaaaaagaaagtcataggattaagtaggaggttgtcacaagatacaggtcataaagaccttgctgataaaaaaggttgcagtaaagagccagcgaaaactcaccaagaccaagatgaccacactgacccctggtcttcctcactgctacactcccaccagtgccatgacagtttacaaatgccatggcaacaacaggaagttatgctatatggtctaaaagggggaggcatgaataatccaccccttgtttaacatgtaatcaagatacaaccataaaaataggcaaccagtggccctcggggctgctctgtctgtggaatagccattcttttattcctttactttcctaataaacttgctttcactttactgtatggactcgccctgaattctttcttgcatgagctccaaatgctttcacatttcatcctatttgtttttgttgttgttgttgttgtttttgttgttttttttttttgagacacagtttcgcttttgttgcccaggctagagtgcaatggcgcaatctcagctcactgccacctccgcctcccagttcaatcgattctcctgccttagcctcctgagtggctgggactacaggcatgtgccaccatgcccggctaattttgtatttttagcagagatgaggtttctccatgttggtcagactggtctcgaactcccgacctcaggtgatccgcccacctcagcctcccaaagtgctgggattacaggcatgagccaccatgcccggcctccttcttgtcttgtatgtccttagcagcttgaccttgtaaccatgtggccatgctttctcttttcataatggcagccctggtttaaagtccaattcccagtttaggggatgatccttatcttctgtctgtctgtgtatttatatgtattatgtgtgtaatgtttatatatggaaaagctttaattaattggtttaacaataagaattgcttaaatcaaacattttatcagaaaagtaaaaagtggaataccctttatttagttcatgtgacttaagtaatctttgggaaataaatacagttttaaagattattggtaaaataaaaaatcttcaaaaatgtaaacattttgtccgggtgcggtggctcatgcttgtaatctcagcactttgggaggccaaggcgggcagatcatttgagctcaggatttcgagaccagcctggccaacatggtgaaaccccatctctactaaaaatacaaaaattaggtgtagtggtgcaagcctgtagtcccagctacttgggaggctgagggaggagaattgcttgaacccgggaggcagaggctgcagtgagccgagattgagcgactgcactccagcctgggtgatggagcgagactctgactaaaaagaaacaaacaaacaaacaaaaaaaaatgtaaacatttggtctaaattatacaggtcagatattaagtttgctaaattctttaaggtcataagctgcttctttgactattaaaaattgttcaattttaggctgggtgcagtagctcacgcctgtaattccagcactttgggaggctgaggcaggcagatcacaaggtcaggagttcaagactaacctggccaacatggtgaaaccccatctctactaaaaataccaaaaaattagccaggcatggtggtgcgcacctgtaattccagctactcaggaggctgaggcagtagaatcacttgaacccaggaggcagaggttgcagtgagccgagatcatgccattgcactccagcctgggcaacagagggagactctgtcttaaaaaaacaaaaaaacccaaaaaacaaaaaacaacaacaacaaaaaaaattgttcagtttatctactttggagcattagattaaatgtgttattggtacatgttccaaaattatgagaaattcctataattctaatatgacttagcgtatgttattaataattgttacataaaattttgtatgcaacagaagtaaccaaaatttcctagttaattgtggctttactagtggctgtcctaagacttttttttttttttttttgagacagattcttgctctgtcacccaggctggagtgcagtggcacgatctcagctcactgcaacctctgcctcctgggttcaagcacttcctctgcttcagcctcctgagtagctgggattatgggcacctgccctatgcggctaatttttggatttttggtggtgacggggtttcaccatgttggccaggctggtctcaaactcctgacctcaaatgttccacctgcctccgcctcccaaagtgctgggattacagatgtgaaccactgcacctggccctaagactttttatcatccacagacaattgttgtcttgttttgatcttctttagaaggtagtttataatcagccataggactttaacaggtgcacttaaatgcaggtttctgataactttggagattgtgacattagaatagaggaaacaactttcagaactctcatggggagctgaaatgttcatagatatcaaacaaaagttaactgcataaactaaagaagactaaagcaatctttttgcctttgcttaaaacattgctgatcctttgttttattttttagagtcaaggcaacttttcttttcagatatttacagcttttaataatcgagtaaagtatactcctgtgaacaaaatttggagtatatgcatctctctacttgatttctccagaatttggaaattatttgtgtgtattcttaatttatggcaatgcagttatttgcataagggtaataagaatctgttttcttttgcaacaggacacaattggagaaattgtttattttatgaagggtttgactggaatggtgtgctttccattaaggaatcaaacttgacttgtaaagcctataaaagccacttagcgacctgggctcataaccttgcctacacagtccctgtacagggtttctgacctgtggtaagtaaagaatgtcaccttctaaaaggtccaggagccccaagttatctggggacctcaaaaggagaggaagaatttacccaactcaaaggtatttgagggcacaaacccatggcagggctcagctttaaaaagtcttatccaagattctttctatggaacagagttccatcaaagccaattttaaaagcctacgtgaaaaataattattcttgctgcactttatacaatcatcaggccaagtataataaagcacattggtcttaccataaaaatggtctttcataaaaatgggaaactggagagagaaaaattatgtttcaagaactatgatacacttgttattaaattccagtctcatcagttgtctttaagtttgtttctgcaatttaggctaaccctgcttagtcctgtgaaccaaccagtggcctctgactgctgctcagaagaaacaagagggatgggtaatgtaaaaatctgcatcaatattctaattctgggcatgtactggaatcatctagcaacctcatatcagcgtggttccaacagttcctcagttcatggaaagccttctagtttagtttacttgggataattttacttattttgctttatggttgtggaatgtatagctgttgtaatctttgtataggaatggaggacaagcttactgaatgtttccttaaactgaacacttatgaatcttccagagtatcaccttttgtcagaactcatgagttatgaatggccctcaagataccaatgctttttcttcccttcccttcccttcccttcttttcttttctttcagatggagtttcattctttcaggctggagtgcaatggcacagtcttggctcactgcaacctccgcctcccaggttcaagagattctcctgcctcagcctcctgagtagctagggttacaggcacccgccaccacatctggctattttttttgtattttttagtagagacagtgttgcaccatgttggccaggctggtctgaactcctgacctcaggtgatccgcctgcctcagcctcccaaagtgttgggattacaggcatgagccatcccgcctggcccataccaacactttccaactgagctcctctctaccacgaatatgagagattctaagagttaggcaaaaatatcatcgcccctattcatcctgaagaacttacagaagatggaccttcgtccctctgcaacccttaggattagtgcttctcttataaaaggaaggggggaaatgtcagaggcacgtgaaccagagcaagtctattttgaacaagagctgagtaaaatgagaatgagacttactgggctgcattcccagatggttaaagcattctaagttacagaatgagataggaggttgccataagatacaggtcatggccgggcatggtggctcatgccatgacagtttataaatgccatgacaatgacaggaagttaccctatatggtctaaaaaggggaggcatgaataatccacctcttgtttagcatatcatcaagaaacaaccataaacatgggcaaccagcagccctcggggctgctctgtctatggagtagccattgttttattcctttactttcctaataaacttgctttcactttactctatggactcgccctgaattctttttttcttttttttgaggcggagtctcgttctgtcacccaggctggagtgcagtggtgcgatctcggctcactgcaacctccacctcccgggttcatgccattctcctgcctcagcctcccaagtagctgggactacaggcgcccaccaccatgcccggctaatttttttgtatttttaatggagacggggtttcaccatgttagccaggatggtctcaatctcctgactttgtgatcccgccttggcctcccaaagtgctaggattacaggcatgagccgccgcactcagcctgaattatttctagtgtgagatccaagaaccctctcttgggatctggattcagacccctttcctgtaacaagattaggcaccaggagaaactgacacacatggatgatataacagatgcctaaatggatcctatgggggaactggagctggaacagccctttagagttgtcgcaaagtgaggcaaagaggctagacttttatatccctccatcaatcagtgtttgacatgggccccataggagggcatgtaaccttcggtgaggcatctttctgacttgaagggcattgcccaatgagggaggtagctatgtggtatcagcagctggtatttcctacatgtagcgaatgggcatattggctcccaagggggaatctgggtggagcactatagtatccattaaacctagtaaagaaatattatttctttactagtcacacagatgtgcccaggacagtggtagagcccacagggttacataaatcataatggtagccctcaagaacttcataaactgtatatggtattttaaaaagttgcatattgtctgtttccacctactagaacataagctctaggagggcagagactatgttttgttcaccactgtttctccagtgtctagacgtagattctttgaatgcatttaattggagccttgagatatgaagaagtaggatgcggttacttcatgcagagcaagagtggcatgcacccagagaaggccaggtggagctcagcatgagtgtgaaggcctcatgtcaagccatgtcaggggacacaaagatggagtattctctaacctatgtgacactcggcataagggaagtacaagcactcaatatgtgagtttcattcccacagtctgtggtctttagcccagtctttccagatgcctattgagttcttcaagcatccaaatggtttggggtaaggcttcaggttctaaatgagaggctttgtgggttaccagctggagagtcagaaaatctggatttgaattcactcagccatgaaataattgtgtgatcttgggccgggcacggtggctcacgcttgtaatcccagcactttgggaggccaaggaaggtgaatcactagaggtcaggagtttgagaccagcctggccaacatggtgaaaccccgtctttttttttttttttttttttgagacaaagtctcgctctgttgccaggctggagtgcagtggcacaatctcggctcactgcaacctccgcctccctggttcaagtgattcccctgcctcagcctcccgagtagctgggactacaggcgtgcaccaccacgctaatttttttgtattttagtagagatggagtttcaccatgttggccaggatagtcttgatctcctgacctcgtgatctgcctgcctcggcctcccgagaaaccaagtctttactaaaaaatatcaaaattagccaggtgtgatggacctgtagtcccatctacttgggaggctgaggcaggagaattgcttgaacctgggaggtggaggttgcagtaagctgagatggtgccactgcactccagcctgggggacagagcaagactctctctcagaaaaaaaaaaaaaaaaagtttgatcttggggagttctaaggcccactagcctcatctgtagaatggaagcaatagtactactttgcagagctgacttcaggaccaagagatctaatgtctatgaagcggggtacttccttctatttgtcaggatgggggaggctagtcctgtgatgactgggaatgaagggtaaaagagacagaggttgggtaaactccaggctctgtgttcatagcctgctcccagacattctcttgttatctctctgtttcctagcctacacacgtgcacagacacgtagctgctgttcaggaactgagctaatggttttaaagtctgttccttatctttgctggaggcaggcagtagctgtgcagtgacagtgtgcctatgcagacagagggagcagtgaatagcaatagggtgtttccaccatggtcttcactcaggccccggctgaaatcatgggccacctccggatacgcagcctcctggcccggcagtgcctggcagagtttctgggtgtgtttgtactcatggtaggtaggatcactgcgggaaggaaagaagggggttgggcaaaagttcctggctccttctgttgtccttatctctttctcttggtgtcccccttcctctcaactccctatcacttttcgtttttatcctctcgtctctcctaatctcctttcctctcctacttcatcatttttattcttgtcatttttattctttctttaataacaagtgtatcatagttcttgaaacataatttttctctcttcagtttcccatttttatgaaagaccattttcatggtaagaccaatgtgctttattatacttggcctgatgattgtataaagtgcagcaagaataattatttttcacataggcttttaaaattggctttgatggaactcttccatagaaagaatcttagataagactttttaaagctgagccctgccatgggtttgtaccctcaaatgcctatgagttgggtaaattcttttcttttttcccacattctttccctttcttcttcctccactttccccatttcttttcccttccctccttctgcttttctccttcccttgcttgtcttctgtgctcattcatctccttggctgctcccctggccttcccaacctttctccctgttggtctcctgggctccctgttcctcatctctcctcttctcagcagctcctcacccaaggagctgtggcccaggctgtcaccagtggagaaaccaaaggcaacttcttcaccatgtttctggctggctctctggccgttacgatagccatctacgtgggtggtaacgtctcaggtgaggagggtggggtctggtcatcagagcacgtgggatgtgcatgccagtttgtctgtctggtgatggtggaaacgcaaatccttctgtgactcgtggacattatccccttgaacagtgtcccagactgaaataagcctttggccccaccagcccctcctctttctgtatctctccatcctgcttcctcacactaatgcttggctcacctagacagaaatcaatggcagggcacgaagggcagctgctatcctcttgtatcccccacctgaagtcctctgggggctcatctccactcaggacctctcctgtttgtaccccagatacacactgcatcggtgtgcttgggtggagccttgagacatagtgtgttgctgtggaaaaagcagacagacctaggttccaactttggattcacagtgtcttcttcttttttttttttttttttctttttttttgagatggagtttcactctgttgcccaggctggagagcagtggtgtgatgtctgttcactgcaacctctgcccctgggttcacgcgattctcctgcctcagcatcccgaatagctgattttacaggcacctgctaccacgcctggctaatatttgtgtttttagtggaaacggggtttcaccatgttggccaggctggtctggaattcctgacctcaagtgatccactgcctcggcctcccaaagtgctgggattacaggcgtgagccactgtgcctggcccacagtgtgactttgctaagtcacttaacatctgtaacatctggagcctcaatttcctaagctgtgtgatgagaattacactatctgccttaagagctataggaaggagcagtagtgttgtctggtgacaatgcctggcagtgacacttaatagatgctctttttctttccttgatacttgaaggggcccacctgaatccagccttctccctggccatgtgcatcgttggacgcctcccctgggtcaagctccccatttacatcttggtgcagttgctgtctgctttctgtgcttcgggagccacctatgttctctaccatggtgacagagggaacagagggagctgtgccttgagagcacctgtgggtgggcaggggtgcctcagaatggttttggatgaatgagcaaagagggaaatcctgggtgttcccttcctccacagatgccctacagaactatacaggtgggaacctgacagtgactggccccaaggagacagcctccatttttgccacctatcctgccccctatctgtccctgaacaatggcttcctggatcaggtaagtgtgagggggagacctggggacactactttggtcctgttcctcggcaccccagcctattgttcagtctctgggtggagtgtgggttgggtctatcttggcactccccaccatccccaactgcctgtgttgcacaaagccagatgacatggaatatttggatgagagagggcagatggagcacctggcagctgacagggaaccctctgcctctgttgactccaaggttctgggcactgggatgctgattgtggggctcttggccatcctggacagacggaacaagggagtccctgcgggtctggagcctgtggtggtggggatgctgatcctggccctcgggttatccatgggtgccaactgcgggattccactcaaccctgcccgggacctgggcccacgtctcttcacctacgtggctggctggggtcctgaagtcttcaggtgggagacagactctcctggtgctggcctccactcaccttcctctgctaagggctctgtccctgggtccacagcactctgcctttaaaatagctctcttggcttcttaggacagtgttctttctccaagtcatattctccccctttctcccttgcttccctcccaacttttcactgaaacagtaagatttagaggttgtgttcttaggcatgccacattacttccatgcacattagtgacttcatcagcaaaattaatatattcagataattccctaaggcaagaggctggaccaagctctcctggggttccctcttctaaatactatgctttggtgacaaggcaatcctcttcctggtgtctaccaccctgggaacaactttagggcactctcttgttactgccccccgtccttggagaggggaaggctaagggagtcactcctgataccttcccactgtccttcttttgcagtgctggtaatggctggtggtgggtgcctgtggtggcccctctggtgggggccaccgttggcacagccacttaccagctgttggtggctctgcaccaccctgagggcccagagccagctcaggatctggtgtctgctcaacacaaagcctcagagttggaaactcctgcctcagctcagatgctggagtgtaagctatgattaggacaaccctcacttcactcatggaccctggagccagccactgaccccgcctgggaacaacagtcattcttcctctttgttaatgtgccagaacctgggaggcttctctgtttatctgtttggcatcccttcctcctaaactaagaaggatcctggacagggagaagtggaggaggataaggtaccaggactcaggcttctcatcccctcctcccgcaaagcggttttctgaccctcagggcctctcggaatgtagttgctcgaggtaaccgctagagggtgcgcacctggatgctggatggggacggctgcgggcatctgcagggtggagggggccaccatccagtgtagggcacaaccctggggactgccctccatagcctgtcccgactgccgactcctagctctcatcgcctcggcgcctcccaccttcaccctctcggggatgcctccccaagagggtagttaggggtggggaagccgcctccacccagggggcgtggtgggggcggagggaaggagggcggcggggcacagagacagagagcaaggctgtgaaactgaggcaccgttcctagacatctcggtgctgtgtcgttcattcaaggagagttgagatacagtgaaatgagccagggcgaggagggagggtgaaggaacggagggcgggcggctccgaggagcgagagtcgggctgagggcaacctggcgccagggaaaattctggttattcaccacttctacagctctcctgccgctccctgcagaggatgctcgttttgcagagaaggcagtgttcctctattcccttcttccgaattaaaaataccccctcagagcgatctagcctcccgaattgttttttcttttaagatgcggatggacgtacgtgtgggggcatcccagcccagccacgccgaggctcggaagggctaagaccctcccactgccccgcacaaagatggctgctccctcctccccgctccttctcccctccccaaaaccccctcccgccccccggcccccgccgccggctccgtcacttccgccccgccgtggccgaaactgacacaaagtagcgggccgaggccccgggggagcggggccgcagctgggggggcgggagcccgtggggagccgagccgagcgccccccgccccagcccccggcatgggcagtacggggccgccggggcgggcgccgagcgctgagcgctgaggtgaggcgaggcgaggcgaagcgggggcgcccgggagcgcggggccaggagggcagagggagatgcggccgcagccgcggggctggaggggccggggagcgggtgtagactggggagcaccgggggccaagatttgggagctgcggccagacggggcggggatggcggccgactggagacgaggggctgtcgggttcccggggacggggcagagcgggggtctgcgtacaggatgggaggatggggtgccgaaggggcgcgtggagagcaggagagcggcgcgagtgccaaggagaagctcgtgcagccttggccaggggagacccgcccagagagttgttgggcgagaggagtaaccgggacccgagggtttggtgcctggagaagggagtttgggctggtaggctttgtctcagtaaggtggaggtctatgcctgaggaaaactgagggtgtcaggaaggggcagtagctctgggagatgatagctgtgccgggagccctgagttctgtccttggtgagggaaggtggcccgagctcgtgttggtggccagtgagctggaggtctcgagttccatttcctcctgtttccctgacctgccatcctcctctgaaagaagtggccagcctttggggctcttgcttgtaagggagcagggaccggacctataggaggagctgttttcctccatggagcattgcctgcttgccggggctggctatttttatcccaaatgtggccgagagggggctggggctgggtgacggggcagggcaacgtggctgatgggcctgacctgctcagaaaacccaggctgtgtgagactaagaaggaaaagtgagaggggatcccagttcccaggtctctcctctcttccccttggaatgatggcccccccagaggggatgaggtctggggccaagcctgcttccagtctccccagggtctcagaggtagaacaactttcctggtccatatccagactcctgactcctgatggcgtgtgcagctcctacattaactctttcatgggactcaaactcagatgtttaggctgatagtgtttcttgatcccttcctccccaagggcggggctgcctgtagaacttgtgatgcccactcttgcatcctttaacctctccctgtgctccccaccctcccgtgactcatactcagactgggtggagaccctggctgggggccctggaggagggcttggcatctctaaaatatggatgaggtttttcttcctgagccaggcaccctggactgccatagttggagaaggtcagggatgaaaaggacttctggctttcaggattgcctgacttggtgtaagggcgggatctgagctagcgaagggagaactggtgtgggtgactgggttgtggccagaatctgtaattatagagcttagccagacaggcaattagtatctcttggggctgacaggttggtggggtgtgcctggtaggctaaaggcagagggaaccaaagaggatgaggaggtgaaaggccttccacccagacaaggaaagaggaggtgactgactggcagtttcctttgggccaggctggggagtaaggatgaggctctgccttgtaaggccaggccttgaaccttttaggagaaaggacatgggaaggcggaagcaggcagaggcttgtctcactggtgctccctaagcctgcaccctgtgccatactgactggactaggcttggggtgggagggagggaggggcaaactccccaccagggttgggaagacccctctgccagcccagaagggtggctgacccaggctgaggggaagctgtttagggactgtctgtgcagaaagtgagggccatgcctctaatgtgagctcccctggaggaggtgataatggaagccctagtaatggggggtggggatggcagggaacttataagcctttcgagaagggtggagcctgcccaccctgtttcctgatgccctgccaggtgtttcctggctcatgttccctccaccccaccctttggggaaactgctttctagtaagcacaagcactactcattgccgccagaacacatgagagcctccattgtccctgggatggataccttgagagctgttccccttttttcaatatctggcctcttctcctttccctacaggcatgggcttctgtaaagtctcagccccccatgtcacccaaggcaggggcatgatgggaggtggtggggaagtcccctctttcccaggaacccatcatggcagtaagaggagagactgggagaaggaggctgggggaggggcagggtcagagctggagaagagggtcttcaaaagaggtctcatgaggggagggaagggttatcctcagcttcctgacctcattcgtctgtcacttcttgcagggtctcccatgggattgctgggatcttgctgggtgagatggcagtgtgtgcaaaaaagcgccccccaggtaagacaggcaaggaggggagatcccgggaaccatcaagagtgggtgttgttatggctcagggagcaaaaggaaaagggacaactggtatgggtctgagggagggtagcttacagcagcccctacccagcttgggggcagcctaggaaaccgaattcttccgcttgatcccaaagctgggttatctgccaggacagcgcagagcaccagccccacgccccgaaacacctgcagtcttatcttcgggcacctgcagctcctgctttctggcctagggagctgtgttctcatctctgcttggtcctctcaccccttccctgctcccctcgtttttccatctaccggttctcctggtttttccgcgggcgggggtgtgtgtgtgtgaaagcggttgcccccgacaacgccggcagtccgctcacccgcattggcccggcccgggggtgggaggggaggcggggctcgcgcgcgagctttcgcctacgcggcgcgctggcaggctgcggctcctgcagtcggggagcgggcgggggcggaaccctgggcgtgctcggcgtgtccggggccactcagcgcacgctggcatccgccggggggcatggggggcggcggcggcggcgcagctgagctcgcggtgtccccgagcgccggcggccgggaggatggcctgggctgcgggtggggcgcgcgcccgacggctggggctcccctctgagcggctgcggctcctgcacctccccggggagccgccccgtcgatgccactaaggccaaggacatatagacggtctgccctcccccactcaaaccgggatcatgacggtccccaaggagatgcccgagaagtgggcccgggcccaggcgcctccctcttggagccgaaagaagccctcttgggggacaggtaacgggaggcagcgcctggcagctctcccgcacccattatttcccccctccaatccctacattcacttgtccccagcctccccctacctgccttgatcctctttccagacccagagatcctggctccgaaggatccagtccctaccttcttcgtttgcatggtctttggtgattgcgcaggggacttggcccaagagagcccctctagggaagtttatgggagtgaagtggcttggtaggcagggggcactgtggcctgggttttgttactgcagtgtgctctgcaggggtcctggggtgtgtagaaagggttctggaatgctgtctttggctcccggacaggcttaaggcattaggtttgctgcctaaccaagttacccctttttgcagcatgaggtcatggtgacccccggggagacgggctggggaatctattataggacagctccttgttctgggacatgaatttgatgcctgcagtcccagacctgcagaggtttcagataggtttagctagataggtgtcactaactgagtgacagatgagccctttaaagctaaatgtgtgcagatggtacaaggaaggtccagttagagagcaactgtttcaattacatttcattcctccctcctctatctctatctcagtctgcatgacccatatccctgaaacgcaccccccacacctttttctacttgaagatgagctttgaaataaggtgatgtcatttcgggccagtcagaagcagttgctggtgacatgtgacaaccagaggctcctgtaggggggactgcacatggggctgggatgctcccgcagagcagctccagggcacagggagcctccttcttgccacctaccccactctctaaataagggagagagcagtaccgcgactagatctgcagtggtccccagggggaaggaagctttgcgttttcagcgctactccttgattatgacaatgtatgcattagtaatagcagcaaaaggggctggggaatcccaggactgtcagtggctcagattcctctggagtgggggtgggggagacaaactgggtgcttccagtggaagaccttgaagtttggtggtgaggaaaagagaacatgtcctgtcctgtgaatgtaacctggagagccgtgtggtcaggctgctggtgagaggtggactggagggaagaatttgatgaccccctcagttgtggagctaactccttaaaatgatattctgtggaaaaaaacagggaaccccccagcaaagtgttggtccagacctcagtttgctcctcctgactgcagcatcattttgttgcagaagaagaaaggagggcgcgggctaatgaccgagaatacaatgagaaattccagtatgcggtaagcgactctagaccacctgttccctctctctgtttggagaggggaatggggcaaggacaacctaccgttgggactgagggctgcctgggaagagtgcttgggggaggggaagcaacctcctcagccactctccatctgctatcgtgctgaatttttcatgccttcacctgtcagtgaagcagaatacattgacccccttgagactcccttctctcctcctctttccccctcccacacctgtgtttgctagcttttggggtagaggtctggggaagtataaagatgggggaggcagcctcagtctggttctgggttgggactggagactgctcattatcttctctcctactgccatagagtaactgcatcaagacctccaagtacaatattctcaccttcctgcctgtcaacctctttgagcagttccaggaagttgccaacacttacttcctgttcctcctcattctgcaggtaggtgacccatagtagattttttgcagctccccaaactgaataaagccaaggaagaggaaagggaatgaaggcatcagatggggcctcagaggcatacttctctttctttttttcagttgatcccccagatctcttccctgtcctggttcaccaccattgtgcctttggttcttgtcctcaccatcacagctgttaaagatgccactgatgactatgtgagtggttttcattcttctattttgtcccagtcacccacccctactcccagccccacccccatctcatggccaccttcatccagcacaatttcttggtgaccttgacatcccttacccggtccagctagatccatgatgtctttttgctgagcgtggggagagggaatcagggagtgaactggtttgtgatggggtgtgtatgaggcgttaaccagcatgctctgagttctactgatcaacgaattccttcgaggcgggggaaggtgtcttacctttcagttttcttcttttcagttccgccacaagagcgataaccaggtgaataaccgccagtctcaggtgctgatcaatggaatgtgagtgcctgttggagacaagagctctggggacgaagggggtcccttaggaacctctttagctcctgacagcctcttcactgtcttctcgttgcctcagcctccagcaggagcagtggatgaatgtctgtgttggtgatattatcaagctagaaaataaccagtttgtggcggtaagggacagggtacccctctaggcctgtaggttcttcctcttctttgtgagaaaaggatgaatctttcctgatttactgttgcctcttaaacacccgtggcaggaatctttctcacaccaggggcttctgtgtcatgctgatatgcctggaactagccatttatgcacctggaactaagcaaaccaagaatgcttagtggaaggagccaccattacagcccactgggggtggaggtttgcatatttggacttctcattagtttttctctctaggcggatctcctcctcctttccagcagtgagccccatgggctgtgttacatagagacagcagaacttgatgggtaagtggcatgctcagtgtcagccctctccttctgtctctttggaggtaaaaagattgtctttgaatgaggttctcaggcctgggctctgtctgaatttggaaaaattaggggtaagaaaggctttggatgggatgtgtgaagtgttattcaaccagtatttgctgggctgagcagttatgcaccatgcttaggtgtcaccaggtagaatttagaggatggggagaggtgggcatggtgactcactcctgtaaatcccagcactttgggaggccagtgtgggaggattgcttgaggccaggagtttgagaccagcctgggcaagatggtgagacttcatctctataaaacaaacaaacaaaaaatttaaaaagtttaaaacttagctgggtatggtggttttaatgcctataatcccagccacttgggaggctgaggcgggaggattgtttgagcccaggagttcgaggctttagtgagctatgattgtgcgactgcactccagcctgagcagcagagcgagaccccatctgtgaaaaaaaacatttagaggatgaggagggagcggggactcagagatactgtccttccagcgagaccaacatgaaagtacgtcaggcgattccagtcacctcagaattgggagacatcagtaagcttgccaagtttgacggtgagtaattttggaggagcagcctgaaggtagaggagtggggttgggttttgtttgggggcgttaaattatacattttcctttgggctttttgttgttattatgcaactccctggactgttttggggaggggagtgtttgtaatgtcatgtggctccctcttggttttgagtttataattatttcaaggggactttgtggctgatagctccccacttgctatgcatgttgagagaaattcagcttattcttttagcttattagctcagaataataatatgtgttccttataagacaaaccatacagagtgtataagaaaaagtgaatagaggtcggtaccatggctcacgcctgtaatcccagcactttgggaggccgaggtgggcggattgcctgaggccaggagttcgagaccagtctggtcaacatggtgaaaccctgtctctattaaaaatacaaaaattattagctgggcgtggtgctgcatgcctgtaatcccagctattcaggaagctgaggcaggtgaatcccttgaacctgggaggcggaggttgcagggaggcggaggttgcagtgagctaagatcgtgccactgcactccagcctgggtgacaagagcgaaactctgtctcaaaaagaaaaaaaaaatacaaaaattagccgggcgtcgtggtgtgcatctgtagtcccagctacttgagaggctgaggcatgagagttgcttgaacctgggaggtggaggttgcagtgagccgagatcgggccactgcactccagcgtgggcaacacagtgagacactgtctcaaaaaaaaaaaagaagaagaaaatagctcttccttcctcttctaccctgctgaagtagccacattaattgacagtcagtgtgtgctcatccacacttttcatacatgtttgtacaaacaaatattaggtcatgctgcagcttttttttttttttttttttaaatactcctgcccaggttggagtgtagtggtgcgatctcggctcactgcatcctctacctcccaggttcaagcgatcctcgtgcctcagcctcccgattagctagaattacaggctcccaccaccacacccggctaatttttgtatttttagtagagacagggtttcaccatgttggccaggctggtctcaaactcctgacctcagctgatccacccgccttagcctcccaaagtgctgggattacaggcatgagctgccgcgcccggcctgcttcattattttcctgaagagttgcatcagctcacactcctcccagcagcatatggatgggcccttgcccttgcatcctcttcgctcagctcattttctctttgttttattgtcttgtggttaggctgtagactggaccttaagcagtggaattcttgtctcctgttcaggtgaagtgatctgtgaacctcccaacaacaaactggacaaattcagcggaaccctctactggaaggaaaataagttccctctgagcaaccagaacatgctgctgcggggctgtgtgctgcgaaacaccgagtggtgcttcgggctggtcatctttgcaggtgagcctcctagcatccaaagaaagaagggtaagagtgactcagccagccctcactcaggagtatgggatgaggtgggagaatacctaaggtaaaaaacctccagctgtgtatacaggcttcttatctagccagtatctctattccaccctggtgtcctgcagtctggggatcagggcagaagcccagaggcagatgtgttatttggctttcccagcccttcccattcttttccaggtcccgacactaagctgatgcaaaacagcggcagaacaaagttcaaaagaacgagtatcgatcgcctaatgaataccctggtgctctgggtgaggcgccccacatctggctccctgcccctgccctctcttctccttgggtgctccttttcctttcctctttcttctttggtcagtagacttcaggtttggctttaaagctgctagcaggtcagctacacaaaggcagtgtttattttaggctccttttagttggaagatgttatttaaaaaaacttcaggaacgtgcatgaatcaacaacttaaagctaaaacaaatcatcccttctctgattccagttatgatgatgactttgtgaagcatgtgaccttctgtttgcttttgccagggacaaggaggccttcatggggatggagagggaattaaaagaaaaatttccatttggaagaggttggcagggtcttttccccccaacttctaagaacgaaggatcccaaaggaaaagtttctgtttaagtttttggcagttcctgaatccttctcttgtttagctagaaatctgaactccttgttgggctctcctccccttcctgtgccccgactgtctgctgcctgcccgccacatgccagcttgtgaaggctggggctagcctctggtgagcttgtttccgccctggctttaaagagtgtgcggaaacccagcctggtgggcgaggttgtctatcacataagggctccagtcgccccctggtggccattgggcaccaatctcctattttgtttcaaagcctaaacagcggaggcagctttggaaatagatgta

SEQ ID NO: 1034 - DNA, 212769 bp, Homo sapiens
ccttattaggcttttttgatttacctattttcctggaatatcagtttgtctttaaatagctaagaatctgacttatatgctgtcaatacacacagttagtaatacagcatgaaaatcctaacatgcttttctatactttagccgtgatcattttcatttgaagtcctaaattacaaactgatttaaaagctatatatatatatatatatatatatatatatatatatgccacatccatgaaaccttccttaatcaaatctcaagcttcacttttctcccttcaagctccctgaatacaacattcttcctatgagataattgtagtctactatctattacagtaaatttccaatgcattttatctcactgattagattataaactcaacgtggggatcgtgtcttgtttttatatcctatattgattgccaaagataatgatttgttttgtataaaagtgaatgaataaagtaacacatttgctttatttcagcttctttgcccaaaatgcagtgccaagttgggttccttcaactggtatggtgaacagtgctcttgtggtaggtggataacacctgcttttcaaatacataagaatagagtggatgaaatgaaaatattgcctgttttgggatcacaaacaggaaaaatatgaacatgatattttatagcttgggaagaaacttgcagatgatatgtgctgcctttgcttcttatcattcatggcagattgtttgtgctttcaacatttcatttgaaatgggagaagataaaatcacttgatgtaacctggaaactatgctttacatggcaatcaaagccttttgatcatgtacattttatttgatattaaaatcttttataaccagatactgtctgtgtttcatatatttttaaaagttttgattgttggaatgttatatgatcttaaggtctgtatagacaaaattatgtacaaaaatttgaaactattatatttaaatgggtattcttttatttccagacacataaagcagatttgtttggacatattttggaattatttcactttctttcttttaagggacattagtaaacccatacatgtctggatttttttcttggaaatggaaaggccattagtaaaacgctgattaaaaggcaattttcctattactgttcagtaatcccaattatctatatttttagaaaagtgtttgagatcccttttgaagtgatctacataaagaaatacataaatgttagatgtgtttctaatgatgaagaaaacaaatgtagagttactatatatcaagtcattttgtagcccaatatgtgagtattggaaaaggtaatacgtccagattagttttttaacctgatgtatagaaactagaattattttactcattattaataattacaattggacctaattagatatttgaacatttacaagaatcagaattaactaataaaggccaggtgcagtggcttatgcctatgatcccagcactttgggaggccaaggcaggcagatcatttaaggtcaggagttcaagaccagcctggccaacatggtgaaaccctgtctctactaaaaataaaaaaatcagccaggcatggtggcacacgcctgtagtcccagctgcttgggaggctactccaaaaaagaacaagaattaataaagaaaaatattctttatttttgttgtaaattaagttgtaaattcactagtcatgctccccaccatttgcagggttccaacaatagtacacattgaggcttatatacataaacaccgtagtgggagtaatttttaaatgcaaaaatatgttgtgaataatgatcctcttaataaatgcctagctcagttttttaaaggtataggagtgttatggaaaattcttgagaaaaatcttaacattggacctgaaggctttggcagtttccatgtaataatttttctttctattttttttttttttttttgagatggagttttgttgttgcccaggctggagtgcaatggcatgatctcggttcactgcaacctccactgcccaggttcaagcgattctcctgcctcagcctcccaagtagccaccacatctcgctaattttgcatttttagtagagatggggtttccatatgttggccaggctggtctcaaactcctgacctcaagtgatccacccacttcggcctcccaaagtgctgggactacaggcgtgagccaccgctctctgccataattttttcttttgagaaaaaattactccatttgttttagctttcataaaatctacttttttgcttcatactattattctctattcatatattattctctagaaagttttaacaaacaggttgaggagctcaggtgtggtggctcatgcctgtcccagcactttggaagacaaaggagggtggatcatttgaggccaggagttcaagaccagcctggccaatatgtgaaaaccccgtctctatttaaaaaataataacagtttgcggcacatgaagttaccccttttgtaggtaaaaagtagttacatagctgcagtttaatatgactcaatgcctatccatcatacactgttgatcagattataaaatcaaatagtatggatcaaatgcaatgttaattaagttgtaaattcactagtcatgctccccaccatttgcagggttccaacaatagtacacatcgaggcctatatactatttgtcttaactttgtttttgtttttgtttttgttttttttgagacggaatcttgctctgtcgcccaggctggagtgcagtggcgcaatctcgactcactgcaagctccgcctcccgggttcacgccattctcctgcctctgcctcctgagtagctgggactacaggcgcctgccaccacgcccggctaatttttttgtattttttagtagagacggggtttcaccgtggtctcgatctcctgacctcgtgatccgcccgcctcggcctcccaaagtgctgggattacaggcatgagtgtcttaacttttaaaacataaattggccgggtgcagtggctcacgcttgtaatcccagcactttgggaggccaaggggggtggatcactgcaggtcaggagtttgagaccagcctggccaacatagggaaaccccatctctactaaaaatataaaattagccaggcatggtggtgggcccctgtaatcccagctacttgggaggcggggaggcaggagaattgcttgaacctgggaggcggagtttgcagtgagccgagatcgcgccactgcactccagcctgggcgacagagcaagactctgtcttaaaaaaataaaattataaatcaagctatctgttaaataaaatgttttattctattatcttgacaaatatcccttcataatgacctgtcagaccaggtttgaattcagaattctctgattttatcagattccatgacaaagcatggcaatgcagggagaggtggcccccgcccactgggtgcctcctttatttccccaccccttgatttgttctgcatcatgaagagcctggtgcatatatatatatgtgggtcccccacctatatgtataagatctggctacagccctggtgtataccattagcccatttcactcgtaagaggtatgaggccagagcaagccctggaagccggcttggagctatttgggctatttgggtgttagatgcacttctagaagggggcatctgttctagctgggcacatcacgttggcagtatggattcttatcctgtggggcagagccagaggtcagagtaaagtcttctaaagtgtcggtccagggtaggggctcctcttacctagaccaaagagtggtattgtctctagacataaggttctttttcaaattgtatttctattccaagggtttaagttgaaaatgaatgagtagattcaagaaaaagaattccataacatccaacatttaatgatttaaaaagaaaagcctggtaactagagtggaaggaagcttccttaatcagagcagctgtgaaaaatatatgggaaaaaatcttatttagtggtaaaacttttcaaacattcacattaaaatttagaagtaagttaaaagatgtctagcccctaccttctgtatcgtattagagggcctaaccattgcagtaaaacaaggggctaaacagtttaagacgtaggaaaaaaatctgaactcactaataaatctcgacatctctaaaagtgggacagtatgtatatgccttctgctatgatgcaaggaagtacctatgaagtattcttgcaaaagcaaacaaaaaaccaaaaactaatcaagcctctagatgtcactggcagtttctggaacaaattaagcatcaccatgaagatgtaatcagcagaatcatgaagtgggaaattctataggaccaatgacttagattcttcaacaaatggcaggggggaagaaatggagagggaattgtcatgtgaactaaatgcaatgtgacaatcttgttggatcctgattttaactaactgtggaaggaagggcatttttgagacagaaaactgaacatggaacaggtatcagatgatattaaggaattattaattttgttgggtatgataatgggattatcagtatgttttttaaaaataagaaaaggcaggctaggtgcagtggctcatgcctgtaatcccagcattttgggaggctgaaacggatggatcacaaggtcaagagatcgagaccatcctggccaacatggtgaaaccccatctctactaaaaaaatacaaaaagtagctgggcgtggtggcgcgcgcctgtagtcccagctactcgggaggctgaggcagaagaatcgcttgaacccaggaggcagaggttgcagtgatcacgccactgcactccagcctggcgacagagcaagactccatctcaaaaaaaaaaaaaaggccttgtctcttagagatatacattgaagtatttatgggtgaaataatatatctagatatgctttaaaatactccaggaaggctgggcaaggtggctcacgcctgtaatcccagcactttgggaggccgaggcaggtggatcaccttaggtcaggagttcaagactagcctggccagcttggtgaaaccctatctctactaaaaatacaaaaattagctgggcatggtggcaggcacctgtaattccagctacttgggaggctgaggcaggagaatcgcttgattgtgggaggcagaagttgcagtgagccgagctcacgccattgcactccagcctgggtgacagagagagactccgtctcaaaaaaaaaaaaaaattctgggaaaaacacagaacaaaatgaaaaaagttgtggagaggagaggtaggatagataaaacaagaatggcaaattgtttaagctgaagctggatgataggaacacagggatttattatatcatctcttgtatttgtttgaaaattttcatactaagtttattttacaaattaaaacattaaataaaatagaatttaaaaggttggtgtttgcataatgttctgctaaataaaaaatcctaaagaactttagacaaatttttttaaagtcatttttattttatcacatactagtttccatctaccataatatgatttttttttttagagacagaatcttgctatattgcccaggctagccttgaacacctgggttcaagcaatcctcctgcctcagcctctcaagaagctgggattacaggtgtgtaccactgttcctggcacagacaaaatactagaataacagaattcaacaaggtttttggtacaagattgctgtacaaaaatccacagtgttgctataccccaataatagccaaatagaaaaaaaaagatgtgaaaaacaaaactataaaactatgaaaatgaaaatgaaaatcttagtgacctcaggagagggaaggatttcttaagaaagctacaagtcagctatcataacaacagattgataaatttgactacattgaaattaaaatctagagaacaaatcaccgtaaacaaagacgacaagtgtcaacctgggagaaggtatttataacatataccaagcgttaacttaaaaaagcccaacaatgggctgggtgcggtggctcatgcctgtaatcccagcactttgggaggctgaggcagaaggatagcttgagcctaggagtttgagaccagcccgggcaacaaagcgagactctgtctctctctctcttttaaaaatgtatatattaaaaagccccacaatgaataaatttagaaaagaaggggagactttatggcctgcaaggtggccatcctgcaggctgggaagcgtgcctccagaaacaggcgctttgaaggaggagggcttggagtgtagttcaggctgaacaggttggctaaacctacattttcaccaggttacaggaagagctatgaatattcatgaaagtggtcctgacacatgcgtattgaacaaaaactcatgtaacatatgacccatattcactttgggatggagacttaacttttttgttgttgttgttcagacggagtcttgctctgtcacccaggctggactgcaacgatgtgatctcagctcactgtaacctccacttcccggtttcaagcgatactcctgcctcagcctcctgagtagctgggattacaggaacctgcccccacgcctggctaattttcgtatttttagtagagatggggtttccccatgttggccaggctggtctcaagctcctgacctcgtgatcttcccacctgggcctcccaaagtgctgggattacaggcgtgagccaccacacccagccaagacttaacatttaaatgtattacgagccctatacgtcaaaaggtctttcaggacatgaagccatgcaaatgtgcgacctctgtagaccagccagaaccagtccatggccagtggtcttcttacctggagaaagttactgaaatcaacaaaaagttgtccaatgaaagctgtagctatggctggtggaacggggactgggggtcagtaagtcagcatctcgtggagctgcacattattttaatattgtttatctttaggccagtacttgtttagctgctagagaagaatcttgtggcagttagaacacagtttattctttaagtataggggtgtgggactaaaaccttgcctggaatggctttaggtcttttttataatttggcatcttattgccagagtctgttctgtcagtcttatcatctctgttttaacattaatgctggccagttgttgtgttaaactacaaaagggagggagtataacaaggtgtgtctaacctgtcccatcgtggtctagaactcagttttaaggttttctaggatccccttggccacaagggggcctattctgttggtggcggacttaggagtttagttttactttatacaggtgaatgaatagagcaggctatctaatgacgtacacatcatttgtgaaagaaaactccatagcaaactttataaaaggtaagagtggacagttcacagaagaggaaataaggtttcataagtatggaagaatgcaccactttgttagggaaatgtaaattgcaattttcacagcggtaaaaatggtaagagtctgaccatatcttgtgttggagagaatgtggaacaaagagaactcatcaatgctagtgagggtgtaaactgataaaatagtacatacattatttaagacattcttgaggctgggtgcggtggctcacgcctgtaatctcaacagtttgggaggcagaggcgggcggactgcttgaattcagaagttttgagaccagcctgggcaacatggtgaaatcctgtctctacaaaaaatacaaaaattagtcgggtgtggtggtgggttcccgtagtctcagctattgtggggagaggcatgaggatcgcttaaacctgggaggtcaagctgcagtgagctgagatggctccactgcaatccagcctaggggacaaagtgagcccctgtctcaaaaaaaaaaaaaaaaaaaaaaagagggagagagagagagaaattgagattcattcaaggaaataccatgggtagatccttaatatccaataagaaaaatgatttggagaacattaaagtttacatacattaaaaaaacccaaatgacactaaatgcatgtgtctataaacatgtttaagcaccgtaaaactaaaaataaaagtggactagaattacacttttatttttataaaataaaattttatacccataaaattcatggtagaagtggcctacgccaagggaggaaaatgaagcagggaggaaagaggaattcaattctgtagtatttaatttcttatgaaaaatctgggacaaaaatgaaaaatgttaaatttttaaattcttggtgataggtcacaaatgtttgtttcataattacttgcactttttgaataaaaataaaatcttttggaaattaaaaaaattggcgatttgtcatggtgattttcttaaaagactaaggtgtctagtgggatacagaagactcgatgattttattttattttaggttttttttttttttttttttttgagacgcagtctcgcaatgtcgaccaggctggtgtgcagtggtgcgatctccgctcgctgcaacctctgcctcccgcgttcatgcgattctcctgcctcagcctcccgagtagctgggattacagctacttgcccgccaccacgcctggctaactttttgtatttttagtggagacagggtttcactatgttggccaggctggtctcgaactcctgacctcgtgatccgcccgcctcggcctcccaaagtgctgggattacaggcgtgagccaccgcgcccggccttattttagttttttatgtcaatttttgaatttgtaattgggtgagaattaaagtgttataaatttcaccttaagtgaaaatttattagttttctaatgacaaaagtagttacatctgacgtaaggggatttaattatctttttctgggcttgcgtcccggaacgctgctgcattatgtaatctgtagtaatatacccacgagcagtttggagggttctgggaagcacatttgttttgcttacctaccatgggaaagattccacgtggtcctagaagcatacgtattcgtcggttacagtattttaaatattcactggccgctgaaatttaaaatggatgaaaaagaaattctcttaagtagcgttcttgaaactgctttatcaaactcagttcatattttcagttggagttcgtgatgtatgtgattttcctttaaataaaacccgaatctttagtaatacaaatattgggaacttcgattactgtaggtcttagggtagactcgcttggactttgactaaatactatgctttagaaatttatctttaggagataaatttggggggtttatctttttatatttgctttgtttcaatttatttaaataaaagtagtctttctagaagtatgttttatagtaccacttacctcggttactgtcccagttaagcagttttcacgaatgtggaaaaatagtagtgtttttctttcatacacgcgtatatgaaaaatttttacattgatagagaattattcgtaaaaattaaagtaaatttactgttagtctctaattttgttctgagatagccacgctgtggcattaagaaggataatcaaggaataagccataatgttcagaaaggggctttactttttatttttaatattattgataaactttgtttagtcgaattgatgtctgcgtgtcttcccccgccttccccataaaacagcgggacagaaagtcctgaaaactccaaaagggaaatatttactcagaggtctattcaaatttgcttagtctctgacgttttcctgtgtcgtacaaatccctcgtgcggcaaaagtagtttgtctttactaggccaccgtctcgtcagcgttacggagtattttgtccgcctgccgccgccgtcccagatattaatcacggagttccagggagaaggaacttgtgaaatgggggagccggctggggttgccggcaccatggagtcaccttttagcccgggactctttcacaggctggatgaagattggggtgagtgggatctgagaatgtaccagggtggctcgggttcgcgtctaaaggtttcttcctccctacttccgcccactcgtggtgacaggtgtggaccaaccctgcctggggagtgaggcccctcgtcactcctgttcgtgcccctggaagagtctgggagtatcgttcggcttctgtcctggccacagggagagtagaatattgtctaactggagttaactgtcgtttttcactattcccactggggaagtaccgggtgatctttttgtgtggctaacactggacgtctttaggaggtttagagcaaaatggctgggaccgccaaaaaggctacaagctatttcctgagtgtgaaatgtgggcggtgagcacaatggagtgggtttttgtgtgtttggtgtatatgagagaatgtggttatatacaagaaattctaatcttacagcttttactattggtttaagcctgatgtccgtcttggcagaaaagcaaaacacccaagcacctgacctcgggtccctgcttagctacacctaatacttatggtgtaatcctgactgctctccagatacagctcttaattttcttgttaatggatattttgtttggttttggtggtcaggaagggtggaatgggatgaagtggaaatgagaatgaagaaactttgttatctaagtatttagaggagacttttattctcctcttgattgcaagatataatagtaatattgttcttaggttccaatatgaatttgggattgtgtaggttcccaaatgggcccgctagtgagcctacaccactcatcagccttggaactggggggaacccagtttatctttctcccttggatcagcattctcaatagcaggagtggaaggaatctcaactttttattgaacaaagtcatttaattgtttcaaggacagatgttctctaaaactatattctattggagatttattttaatccttgggtagattttttaagagttgctggaaaacttaagattttttattcccattttcccaagccaaatgcattagtgacagtaaccatttatttagctctttgtgtcagggaccctgttaaactcttgacatgaagtattttgtttaatcctaccaacagtccaatgaggtactgtttattttagagatgaggaaactgaggctaacagaatttgtgctcagattcttagagctagttagtggcagaagaaggatcagaccaggtttttctacctccaaagtctgtacccctagcatctattctataatgctttcctaactcatgtctacagattttattcttcctaagatccctggttattaataagactacttgaatatattgggtagttatgatttattttgtcagctagtcagctattatattttcatgacatttcttttctttacctctttttttgagatggagtttcgcttttgttgcccaggctagagtgtaatggcgcaatcttggctcaccgcaacctccgccactcgggtttgagcgattctcctgcctcagcctcccgagtagctgggattacaggcatgcaccaccacgcccggctaattttgtatttttagtagagacgaggtttctccatgttggttaggctggtctggagctctggacctcaggtgatccgcccacctcggcctcccaaagtgctgggattacgggtgtgagccactgtgcccggccagtgacatttcttaaagtataactgtgggacacttcctggtagcataattttatgtcgtcttctgatacccaggctgcattttccagacttatctgatcacttgacttaatgttctctaacagagcattcagttctttgtagtcagttcaccgactcacttctatcgggtatcctgccctgtccctccctgaatgtgcccatttccattgttttccaggtttcccttttcaaactgttaacagtcttctcttctttgaagactttaatttaattccttaggtgttcagtaagtaggatagattttgttggcaatagagtgaaacactactgtctgatagtgtttcgttctgtgacagttgctgttttggatgttcaagtacttcactgatttacttgattttgttgttgttgttgttgtttcttttagagacagggtcttgctctgtcgcccaggctggagtgcggtgatgcaatcatagttcactgtgacctggaactcctgggctcaagtgatccttccatctgagcctcctgagtcgctaggactacaggtgcacaccgctaccatgcctggttaatttttaatttttgaattttttgtagagacaggggtcttgctgtgttgcccagactggtctccaactggcctcagtcatcctgcctcaacctcccaggtgatgggattacaggctcaagccactgtgtctagccttgatttttttttaatattagacactatctagttaaaatttaaaaatcagattatgtaattagtatgtcctgtgattttaacaactctaaataatttaaataaagtgattaactcagaacagcctgtgagggatgtgctttcctttttctttttaacttaggtaatgaaatttagagcaagagtcttcaaacattttctgtaaaggttcagatagtaaatattttaggctttgtgattacatggtcactgttgcaactactcaagtctgctgtgatagtgcaggagcagccagagacagcataaacaagtgagcatggctgtgtttctataaagctttatagacactgaaatttgaatttcacataattattttaaataataagcctacttttttagtataattatagatttacacaataattgagcagatagtacaaagagtccacatacttccccttcatccccagcttctcctattggtaacatcttgcattagtgtggtacattggttacaattgatgagccagtattgatacattattattaactaagcccatcatttaaagttcactctgttgtacattctatggcagggatccccagccttttggcaccagggactggtttcatgaaagacaatttttccacaggaggtggggacagggaggcacaggaaatgttttcaggatgattcaagtgcattacatttattgtgcactttatttgtattgttattacactgtaatatataatgaaataattatataactcaacataatacagaattagtgggagccctgagcttgttttcctgcaactagatggtctcatctgggggtgatgggagacagtgattagatcatcaggcgttagattctcataaggagcgtgcactctagatccctcacatgtgcagttcacagtagggttcacactcctatgagaatctaatgctgctgctgatctgacaggtcgtggagctcaggcggtaatgcaagtgatggggagtggctgtaaatacagatgaagcttcgctcactcacccacctgctgctcacctcctgctgtgtggcctggttcccaacagggttgggaaccactgttctatgggttttgacaaaggtataatgacatgtatccataattacagtattatatagaatagtttcactgccctaaaaaagccctatgctctacctattttttcctccttcctcttccctacctctggtcaggtaaccactgatcttttcactgtctccatggttttgccttttgcagaatgtcatatagttggaatcatacagtatgtagcatttttgaattggcttctttcacttagcaatatgcacttaaggtccctccatgtcttttcatggcttgatagctcatttcttcttagcactaaatagtattacaaaaatactatttacagtgttacaaaaaatagtatgtatgttctatagcctattagtctgcctaggctgccataagacaacaccacagactgcgtggtttaaacaatggaaatttattttctcccagttctggaggttagagttcaagatcaagatggccgcaccttcaggttctggttagggctctcttcctggcttgcatgcacatggctgccttcttcttgtgtcctcacatggcactgagagagagaatcttcttcttcttataaggccacagtcctatcagattagtgccccactttaatgacctcatttaactttaattacctcctaaagactgtatctctcgatatagtaatatttggggttagggcttcaacatacgaattttggaggacacagtttaggccataaattcacagtttgcttatccacttacctattgaagcacatcttggttgcttccaacttttggcaattatatataaaactgctgaaaacatttgtgtgcaggtttttgtgtggacatgcattttccaattgtttgggtaaatatcaaggagcacaattgctggattgtgtggtaagaacatgttttttgtttgttttgtaagaaattgccaaactgtcttccaaagtggctataccattttgcattcccgctagcaatgaatgagcatttttgatgctccacatccttgctaacatttggtgttgccagtactttggattttagtcattctaataggtgtgtagtggtatgttttaatttgcagtttcctgatgacatatgatgttgagcatcttttcatatgcttatttgccgtctgtatgttttaccctcctctctccttctctcttctcttttactcttgcttgaatttgtgcaaaagctgctttattctgctttcttctttcttccctcctcctcctcctttctcctttctcctttttccttctctttattcttctgtcagctgtacttaagatatgtgtatcaagatcagaagctttcgtctgccactgtggtttcgtttatgtcttcagtctcttctgtgaaggttctcttggctttctagcactaaatcaaaatctggtgctcctggatgacacaacttcccgtaatgccccggtgaacggttgctaattttattctcaaaaccttttcaccatagggcctctgttggtgggataggtgtctccattgtccttcactgctattctcctttcctcctccctaaaaatatctaagttgaaatctcattttgtcacaatatcccatcctctacctctcctgattcctggatcactctctttcacttttctttttttcttttagagatggggtcttgttctcttgcccaggttggagctggagtatgcggtggagcaatcacagctcactgcatcttcagacccctggggtcaaaggatcctcctgcctcagcctcccgagtagctgggactacagacacatgccaccatgcctggcttctttttggctttttgaaaacattttgccactagcttactgttactttcttcaccattacttccatcatgattcttggatgatttcagtatccttagagaagatccttcagatacactgacctgtcattttctggacctcctctttatcactgatcttaccttttacccagtctcagccatttgctttcctgatcataagcctaagtcttgtcactaccaataacatctcactttcaaacatcctgctctgactgccttcgcctgttttaccagcttacttcctttagtattccagtttcaatagttgttcagtccttctgagattttgccatgtttccagtgtctctcattctcttcagttcatcacgtccctcttacccagtttaaataccatggacagtcattgtcactatttccttcctttcacctttcatattcatgtctgtctcttttctggtaggtttctcttggataaacctattagttaaattcagttttgcccacttcatgcctgtcctagtatagctgaatcagctgaagaaaacacttcaactgtcctgactggtctcaatttaagtgttgccagaccaatcatatttccctggtcctctcactgtcccattctgatgattgctttataaagtttcttctatcttcaaacctccaacatctctcccatcctttgaatcagaagagaacttctacagtctcccactacctcatttacccacctatcaacatgtttgctttctcttttgttggtgagaatgagtggcttcttgctcctagctagagccagtccttccatatgtgctttagattcttcctgttttgttcaagaatattgctcaagctattcttcctcctgtttcctgcatcagcatttcccctctctactagatcatctctgtcagtaaatgaacatgttgttgtttctcctagaagtactgtttctatatctagatagtactctagctagagttaaaaaaaaaaaaaacaaaaccaacaaactcaaaactctcttcagatgttacttcacctcttgctgttactgcatttctctactgtatgttacagcagaattccttttaaaaaatgtccacgttcactgactctagttttttatttctccttgtctcttgaacccagtccagtcaggtgccaccactccactgaaactcctgttttttttttttttttttttttgagacagagtcttgctctgttgcccaggctagagtgcaatggcacgatcttggctcactgtaacctccacctcctggattcaagcgattcccgcctcagcttcctgagtagctgagattacaggcgcctgccaccatgcccggctactttttgtatttttttttttttgagacggagtctctctctgttacccaggctggagtgcagtggctcactcggctcactgcaagctccacctcccaggttcacgccattcttctgcctcagccttccgagtagctgggactacaggcacctgctaccacacctggctaaatttttttttgtatttttagtagagacggggtttcaccgtgttagccgggatggtcttgatctcctgacctcatgatccgcctgcccaccttggcctcccaaagtgctgagattacaggcgtcagccactaatttttgtatttttagtagagatggggtttcaccatgctggccaggctggtctcaaactcccgacctcatgtgatccacccgcctcggccttccaaagtgctgggattacaggcgtgagccatcatgcctggcctgaaactgctgtttttaagggcactactgatttccacattgctaaacccagtgactgtgtctgatcttattaaacttataaggagtaaatgaataaataaatgggcaaggtggaggtgaggtgggaaagtttgttgagtacactaaaaatagtaactaccattatttactactgttgagggaaatctaatagtgtgggactggtgcaaaggatatagaaataggcaataggttttaggatactttggggtaactgatgctaacagtttcttatggattcttttggaatgttctataaatatacgagtatatttatcaacccaccttcagttatttttttaaccacagaaaagtcaaaagatcagtacactgataaacgtgcgttttccttatctagatttaccaactgttaacatcgtgccacattcactttatatcttaatattacccacactttcctcctttttcacatctgaaagtgggctgcagataatatgaaactcctaaacacttcaccatgtatttcctaagaatgaggaaatgtttatttttaaaaagcatcaattcattttaatatgctttatacttcaaagctaacatcacagggttctttttcaccttcttgcaccatatgcttgtatttctcttctgccgctatgagaatcctgattcccaataacatcctttgtttttataggctcacttcagcagctctgttggaaataaactgaaagaggggcaagggcagaagcagggagacgttttggaggctgttatagcaatccccatgagttacaatagtagcagtggagtaatgagaagtagttggattatggatatgtacacacacacacacacacacacacacacacatacacacatatatatacatacattttaaaattttgaaatagtttgaaatctatagaaaagttttaagaacagtgcaaagaactcttgcatgccttttacacagactcctcagttgttaaattttactgcatttactcaatttctctctttctccctttcaagagagagagatgtgttgacccatcacctttaaatactgtagtgtatactctctatcctcctgcctcccaaaagaaggccactttcctctattactaccctatatttcttccagtcaggagataaacattgatacaacagtgtcatccaattcaaagacaccattcaaagtttgccatctgtttcaataatgatttgcttttctagtctaggattttacttgcaaacactcattgcttttacttatcatgtctcatcagtgtcctttaatctggaacagttctttagtcttttcctgtctctaatgtccttgacagtcttaaagagtagaagtcttttattcgacaagatgatcctaaaccactaaggggttccttggaaaaatgaccaattccagggctgggaaagtgcagggaaagtgcaaaataagcctggaaaatcttgggccagaaattctcagcaaatgaacatgttaaaaagaacaaaggccccaatatgaatgaactccccgtggtcaaatctgggaaaatttggcatcagaataaaatgagggtatacattatagtgtaaatactatgcgatgttcctatgccatcatatcatcctgtgatatagtcacatgatcacttggtcaagttggtatcttctaggtttcaccactgtaaagccactgcttcccattttgtattttattgctattttgggggagataatctgacataacaccaatatccttttcttattaaacctctaaccacgagccctagcctcattaataaccccaatctatatcagttaccactctaatggttgccaaatggtaactatctaactctatcattctgtctatcattctatcattgttgattgacattgcactataagaaccaacctacctacctaccttccttccttcctttgttccgtgatgaactcattgattccttttttatttggtggttggtaaaccgctactctcattttattctgatgctcagattttcccagatttgaccactgagaattcattcatattggggcctttgttctttttgacatattcctgtcatttgctgagaatttctggcacagcaagatttccaggcttattttgcactttccctgctgcaagccctggaattggttatttctccaaggaaccccttagtggacttctgtttggtggaagatggtatttagtatccaagatctggtcacccagtattttcattgctactgggatgtcattgcttctaggacctcttagcagacagaactaggaaatatatatacatgtgtgtatatatatatatatgtgcatgtgtatatatgtatatatgcataatacaaacatctgcatatgtgtgtacatatatatatacttccacagctatctgtatgtgttatattttaaatgagtttatttactaatacttctagttctaatccaacatcttaggattcttttagtctcccgactctttccatgctcttaaatcctttctcagactgtgagaaatctgactccaattattttagtaaaaggcaaaagattcattcgttctgaagagaaaccagagcattctaattattttagatatattcaaccatttgctcagtcacctaacatatttgttcagtatgaccactctcctaaccactcagcctgcgttttccatctgctactccattccccctcccactgggctggggcatgctggcatctttgctgggcaatagtctctcccacaccatcctatttccttggatatgaggcatattgctggagatgactgtgcacaaaaccccatcacctttgttgccctgcttctttggaagctgacatctctgtgttgggaggggtagggaagaaaaggaaggttgggaagggaaggaagaatgggaggaaaggtaggaagccacattacagatatatattttgagaacagagctgacagaattttctggtagattgattatggagagtgaggaagagaagtaaataattaagtaataatgatcccaaggtttttggcctgagcaactgggaaaatccaattgtcattaactgagatgaggacaaagcagtaggaggtttggtggggttgatgaggagctcattttggatatgttaggtttgacatgccttttaaacatctaagaggagatgtcatactcactgcacatgcatcttgaagtgtgggttggagatgtatatttggaaatccttggtatatagattttatttaaagccgtgagctcagctgagattaccaaggaagtaagatagatagaaacgtttatgctgagcccagggacaaatttgtgttagggagatgaggaagaaccagcaaggtaggtcaaccactgaggtgggaggaaaactgggtaagtgtgatattctggaagtcaagtgaagaaaatgcttcagttaaaatgaaaggatcaactatgttaatgctgttgataggtcaagtaagatgaggactatgagtttaccattgaatttagcaatatggaagtcactggggacattaataattatgtgtatgtggagcggggagcttgattggagcaggtttagaacgaatgggaggaaagaaatgagagagccagatagagaactctttaaaggagtttcagcctatatataagccgcagtcctctgcttatatgtttcttggctctgcacctgagtagtcttttctgagagtcatgtgagtaaccttttgttattactacgtatacatttttttgctaaatactattttgtcttaggcggtgaaatgttactgtaattggtcaggttaataacagactgacagtgcagttcctacacttgtgcactgaggaaatcatcagagcagtttcagcagcataaaataggtagagagtacaaaggaagacctagttttgaaaaactcttcaaagtgcttaaagttttgaaagtgtcagaggaaataggaacttcatagattctatggtgaggagccttcttgggccttggtcaacaccttaacctttctttacaaaaagttttcagtatagtgtattgaagaatgttttctgtatccacatatttcttgatttgtaatgaaacctcattaggaaattggaatatagttagatttgctgaaatgaatttgatggtttagatgaatgaatcctttattgtctagatagaaaattggttgcacccttaacttaaggcatggataacaaatacgcagtgtgtatatactttccacagccctctcctattgcttatgaaccatgtctactttccacagttgtctcctattacttatgaaccacattaactcttcatgctgaacccagatgtagcatcagaattcttgttagtaatgttccataaagccactaccaattagtcttacatgacatatgacataaaaccttttttgatccctggtgtaagaattcagttcacaagataaaaattatgcagaaaacaacacataaattggaaatgagcattgaattgcttattcacattactggagtttatcaataatagtaatggctaatgagaaaccttaatagaggtgacatagggacacagtgcttgtttctttgtcaaataattgaattgacagttcatttctattcttttcctttgtccaaagattctgctctctttgctgaactcggttatttcacagacactgatgagctgcaattggaagcagcaaatgagacgtatgtaagtatttactaaggttgaataatgtgatatttagtctttaaccctaattattgcaagaaagtttcaggacaacaggttcaggctagtaatttaagttacatacttaatggtaaatagcttctaccattaagtatgaaagttagtagccattttgtaatcagtaaatgtaggacagtagaaattgcattgtattgcaattctaggcccacctttggccctagggatgggtgactttggaaaagtcactaatctgcctacctggtttttacagatactttgctacataagggaattggcaggtgactttggaaaagtcactaacctgcctacttcttggtttttacagattctttgcttttaaaaaggaagttggtaagttctgcttgactaagttagtcctttttaaaagttgtgtattcatgtagaaagctctgaaaagtaggtgtatccttacctttgattggttagaggtctgtgtgaaaactattataacactgagtccccgagaatatcttagattttcttttcttgattagtacatataaaactctttgccctatagaactttgattttgtcttattctttaatggatgaggtgctgtttcacttaagaagtaattcaagtgagcagagtaatttgtcaatcaggttgaatatcacatcattttaggctcttattaacttgagtacaaaatatgtaaagattgcttagtgagtttcagacatttcttaaacaatgatttagcagttgtttttaccattaatcgacagaagagaatgaaggacatgatatattttaaaaaatcagtactagggattttaatggtttcatttactccatgagatactttagaatgtggcccattgattaaactgccttttaatattggctatttgaataagcaactgatactcatatttcataacatctagaatcctaaaagaaaatgtttcttttaaactatgtcaagaaactgtgtgctcaattggaaagattaagggaaatatattcctgattttacaactaacattctattattttatgcaaatcactcaatctttcagttccttagtttttctagtatgacatgaagggattgaatctctgagacccctcatgtcattcttcttccaaacggcaatagaatttcccatgctaaatcactgaagagttagagtatataagtgccagtatgtttcattttgcatgaactgggcctgttaaatttctgatgtgataaaatctttatgctgtagaaggtatttgacttatttggctgaagattgagtcagaagtttcctcaagtagatcatgcccttatttaaaagtgttgctggcactcaggcaagcaacattggtaactttacttagattaagaaagtttaaggattttttggttgctaaaacaaggctgcttaatttttttttttaagacagagtcgcactctgttgcccaggctggagtgcagtggtttgatctcggctcactgcaacctctgcctcccaggttcaagcgattctcatgtctcagcctcctgaatagctgggactacaggtgcatgctatcacgcctggctaatttttgtatttttagtagagacggggtttcactacattggccaggctagtctcaaactcctgagctcaagtggtccacccacctcggcctcccaaagtgctgggattacaggcatgagccaccacacctggctaaggctgcttaattttttgatgtgaagatccaaataagagaaaaaagtgaaggagattgattttttaaaaaatggtttttttatgatttaaatacttttttttcatgtgcactttcacatgttctctttatgtaccttgtactaatatttactcagttatgggcatcataagaaaatagtttcccttctgtgtttctgttacattctcaataaaaatgaaccatatagtagtcattttgaaatgataatattcttctagaaattgttaacaaatggtcgttaccaattactagatacatttttactttttttgcctgaggtgtatttttttatttttatttttattttttttttgagacggagtcttgctctgtcgcccaggctggagtgcagtggcgcaatctcggctcactgtaagctccacctcccgggttcacaccattctcctgcctcagcctcctgagtagctgggactccaggcacccgccaccacgcccggctaattttttgtatttttagtagagatggggtttcaccatgttagccaggatggtctcgatctcctgacctcgtgatccacctgcctcggcttcccaaagtgctgggattacaggcgtgagccactgcacccggccgaggtgtattttattgttgctgtttttgttgttgttgttgttttgttttgtttctttgacagggtctggctctgtctcccaggatggagtgcagtggcatgatcttggctcattgcagcctccatcttttggactcaagcgatcttcccaccccagcctccagaatagctgggaccgtaggtgcacgccactatgcccagctagtgtttgtattttttttcttaggtagagatgggttttgccatgttgcccaggctggtcttgaacccctgggctcaagcaatcctattgttgctgttttatcatttgtgacattaagttaatatttactgccttttgactttattgcattatttatgtattaagtttacttttctttttgtctctgtgactccagacacttaatttaaaatagtactgtttggtactaacttgatctcagacttacatgaggactctgaaattatgtgacacttctttattcatgtatatagtataaggtggttatctggatgacccagaatatgcttatattttggttagaaaaaccacctaaatgaaaagaacttaatgcaggctttaagaagtttgctggaccctgttttagaaaattagttttattttataggattaaaaagtggtgttttttttgattcataaaagttttagaaatttaagaagtatagaactgtagaaaaaaggaaaattactcagtgattcataaaagttttagaaatttaggaagtatagaacagtagaaaaaaaagaaaattactcagtggtaactatcctctttatgattcttgcctgtcttttggatatatctatattctttctattgtatatagagattatattatgaatagcatttactttgtcttgtttttcttaatggcaatgggaaaatgtattttgctggatttcccttaagataaaagacacatttttgactcctgtaatggtcattctcatagaaaataatgaagccaactaaatgttttaaatactgaatcccttacctctttcctagttgttgctgctgtgcttcaagtaactgaattgattttatctctaggctatccaagatgtattctcatacaagactgacttagagtattctttttactaggttggctaatagcagttaaattatttgtgccaaattgtgtctcacagtttgattttaagatgtgtatgttttattcttttaatattcttttgctgatttgaaacctacaggaaaacaattttgataatcttgattttgatttggatttgatgccttgggagtcagacatttgggacatcaacaaccaaatctgtacaggtaattatgtgtttcactggtaaaagttttaaaaagatcaattttattttgtagtttggtcatactcaaaattaggtggggttattgggctattctggtaggttaaaagattcctggtgttatgcattctacttctggtatggcaattatgtaaacaaatttcttgccaaaaatggatatgaggagtttcatagttatgtttcagtagtgtaatgaatgaacagttcatatcagaaatagaaatagtgattttgaattatgaataatgtctctgtataagattaacctgagaaccagacagggcttagggaatcaaagggaagagcctgggttaccagaacctaggaacttggtggaggagtcccatgcatttaatacatgtacttctaagaaggggcagcacctggctgatactaatatctttaagggggcctgatgaggtcggggttgagtatactgaaagaagccagaacctggagcaaattgccagtgctgggatacagctgatggtagaatgaagaaaaatcccttctcctcccttctagctttttctagtatcccctattgacaggacctaaaaggatgccagctgggaataatttatatcaccgattatagaaagtggacttagtgctgagagacagtgaataaataaccagcacattctcctatctaaattcctctctacctctgcactacctattcctcttcattttatgtatttacttatactgtttcatgcctgtttgccttcatagaatgtgggatacacaaagtcagtgttctggttttatcgtttgacaaactaaatcttagttgcttaaagcaacaaccattttattagattgctagaatctatgggtcacgaattttgactgggtgcttacgaattttgaccgggtgctccaaggatggcttgtctctgctccatgatgtccagaccacaactggggagatttgaagattgtagtagcttgacatttgggggctagaatcatcttgaggtttcttcactcatatgtgtggcacctggggtggaatgacttgaagactaggactactaaatggagtgcctgcatagggcctctttgtgtggcgtggtgttctcagtcatggtggtctcagggtagtcagacttcaaaggctccaagtatgagtgttccagcacacaaagcagaggctgcatttccagcttcagaattcacatagcattacttctatcttctcttgattgaaggagtcaagcccacctaaattcttggggaggggaaatcgactctacttcttggtgggaaagtggcaagatcacattgtagaagatcatgagggaagatcatgaaggatggtagatatcgtatggctaattttggaaaacacagtctgccatccccaccctattctatctttgacaccaagggatactgcctgggccatagttgctcagtacatttttataggataaattaatagtttaaaagatatgaacattttttatgagtttgaattgtattgtcaaaaatgctttccaaaatatttcctgtttcttatttttttaaattttttgggaagctataatattttgcatatggtaaaatattcaaaaggtacaaaaatctgtatagtagaaaaatgtctcctgcttttattcctcagccaacaagttctattttccagagacaaccactgttaccagtttcttctgtttacccttccagagaattagtgcagatgcaagtgtacacatatatatacacacacacacagacatacatatataccccctccccacatatatatataatttgtaacacaagtggaaacatactagatatattgttttctgcatctttcattttcactcgttatattttggtgaccttagcttccatatctgattgaattttaaaagtagattttaccttctttcttgttcattttattataagtttttattgtccagtgggtaaaacctttcctccatgttttccagttaaagatattaaggcagaacctcagccactttctccagcctcctcaagttattcagtctcgtctcctcggtcagtggactcttattcttcaactcagcatgttcctgtgagtagccagtcttttacaatgattttggttataatatgctatctggaaaatatgtatatggaggaggcagttaacatttattgaatactactatgagttatattgtctcatttattgagggaactgagactcaagaaagagccttgtgggagctagaaagttgttagtgcctttggttttgctctcttttcccctctgttcatgcctccataatttcattgtttcatttgtttcattgcattttaacagtatccagtatttgtttattggcttactgtcctttctcccaccctttctttctcctccctattaggatatacattctttatatatggacatagaagaatgtaagatggtcagtttttatatctctttagtcacagcatctagaatgattgccttagtttgggaatgcctagtgctaccttttgaaggggctcacgtttttatagaagtctggtagctcttttaagaacacttctgctctgtgtccagacaaaagccctgaggccaggaaaaggaagtacctgatttaggtactttttagaatggggaaagggaaagtataagaataaaaaaatcaaataatattttagtatattatatgtgctataaattgtggtatctttgttcctgcaggctctacatttagttactaaatcctggtggttatatgcacatattaattcaaggatttatcttttctgcccctgccaggccatcactatctcacctggattaagtcaataggattttaactggtcagccttacaactcctcaaacctttcttagcagtggaatcttcaaagagaaatctttcagtgtcacaagctttactgtatcagtcatttgcttaaaactttttagtaacttcccagtccttacaaggatgaaatttaaattcccagagtactaggctttccatgatctggcccccatttacttttccagtctcttttcttgctatcccctcctacttccacattccccttaatttgagccctgtgagagttcctctctgagagctcctatgcactctactcattcaaccgctgtgccaggcactgttccagatgctggcagtgaacaacagcagtgagattgctgctgttacagttctaggtttttgcacatcctctttcttctgcctagaatagccccatttttttcttgtcttggaaaactcatccttcaagtcccagttcaaaaactacttcctttatgaagcttttctctgattgctgctattggtagctctctgaggtcccacaatttctccaaatgatttaattttttaaaaaattaataattacaaaaggtagcatactgtataccctgtcctgtaccttgtttttttagcttagcaggataactcttaatttcagagtatataattttcccattatgctacataatgtttcattgcatggccttatcatgcttaatttagtgatttccttattgatgagtatttgtgttgtttttagtcttttccagacccaattaacctgtacataagtcttttccagactcaaataacctatagtaaataacctggtacataagtcactttatatttttaccaggatatttttgggatatatttcaagaggtgggattgttgacaccaaggtaaatacacttgaattttgctagatactgccaaatttctctctataggggttgtaaaattttacatcctcatcagcagtatgtaagagggcctgttttcccatcatcactccacaataggttttgttttatatctcttttattataagtatggttaaataatatctattcatatgttttatatgtttaaggcctatttgcatttctttttaaaaaatgaactgtcatttcaaatttttgttctttttttttttttggagatgaactctctctcttgtctaccaggctggggtgcaatggcatgatctcggctcactgcaacctccgcctcctggcttcaagcaattctcctgcctcctcagcctcccgagtacctgggattacagggattacaggcacctgccaccacacccggctaatttttgtatttttagtagagacagggtttcaccatgttggccaggctggtctcgaacttctgacctcaggttatccacctgcctcggccccccaaagtgcttgggattacaggtgtgagacactgcgcccggccgttcattttttaattgaattgtattggtctttttctctttaatattttaggtgctttattatatattaggattattagtccttagtttgtgaaataagctgcaaatattttttccccaatttttcttttgtctctttgctttatttctggtgtttatttttccccaggtgtactgttttctatagccaaattattgatcttttctttaattgcttttttgttcactcaaaggaaggttttcaccactgagaggttataaaataattcactcatatttttactctttttttttgcttatgttaattttttgtttggaacaatctcaaattcacagaagtgttgtgagtaccttgcaaataacttgttttttccttatgcatttcagagtaagttaccagtccgatgcccctatcactccaatactttagtgtctacttcctacaagcacagatatttcttagccataatacaagcacaaaatcgggaaataaacattaatatgttactataatctaaccttcagctctcgtttaaattgtgccagacatcccagaggtgtcctttagactatcaaaaggacccagttcagaatcaagcattgcatgtggttatcttgtctttttaatcttgttcagtatgaaacagttcttcattaatccttgactttcttcaccttgtcacttttggggattaggagttagttattttgaagagcatttcttagtcgggtttgtctgatgtttctttaggatcatattcaggttttatatctgtggcaggaatgtcacagaagtgctgtctgtgtccaacttttgatgacccaattttgattttttctaatactgattattttcactttgatcccttcatagatgttatctgccaacctattccattgtgaagttgctttttctctctatgccatacatattttgtgagaaagatactttaagactatgtaaaaatatcctgttcatcatcacactttatatttgttcacttatttgttaatatctgtatggattcatcgtttcttattttattcaacagattataatccgttactataattatttattctgattcttacattgttctggatttggccagtgggggtcccttcacaccagctcttatgttcttttaacatgtctcctttgggctctgatgtccttacactaggctgtcttcccatgcggatgccctcctcactctgctgtgactcctcatgccaggccgcctgccatatcagtgccctctctacccttcttggaccctgacattccaccaggctacttctctgcgtggatggtggtcttgctttaccccatctagtggcttaggataaaattattcaggaaggaatattttctaagtgactatgaataagtatttatcatgagatattatttttagtgtttagatctcggatccatttgaaattacccttgtgtattatatgagatacaaatccaattttatgtttttccaaatgactatcaaaatgattattctagtaccatttatcaaaaagttcatctgatttcaattatatgcatgtattttaaatttatgtaaatggcattatagtagatatctttatattatttacttttaaaaatcagcacagtgtttttaagataaattcctattgctctgtgtacatcaaatctgttgcatctaactctgtacaacattcaagtatgcattcactacatttttacctacaccataatgaatattttaaaaaatgttcccttgcggacccatgtgagaaatcctttagaatatatgcctagaattgctgggtagtagaatgtgcaggtatttaatttgacaagtgcttccatatttctctccaggatcatcatagtactctgtgggctggcagcagtgcctgaggatccctgtgacttctctcctgatacttggcattgtctgcctttttaatttttactccatggcacaatgtgtttttttgttgtttgcttttattttgttttactttgtatttctttggttattgttttcaacatttatttacattcttatgagctttttggactttttttcttttatacattgtttattcctgtcctttgccagtttttctactcagttgttgtcttcttgtttatcagcaggaattcctcatatacttgaaatagtaaaactcttgttggatttagacattcaaattgcctatatcttttccctttctattatctattaactttgtagtctttattaagtataaatagttaattttcaattactcaggcttatctttttttttcttttcctttatggcttatttaagaagtccttctatgcttttagagcacagaggtattctgcattttcttttattaaccatatggtttacctttcacatttaggtttcttaatactcttagacaccactttaatatgtggtattatgtagggatctagcactaggtagggatctaattttaattttctctataaaatgaatcagttttcctaactgtattgtctttataatcacttgtaatcactcttttcaacaatattgtatatctctctgtttactgaaatcttttatgccttagttcagttgtgtagttttcttcatatgggtcctgcacattccttagaaaatttctaggtattttgtaattgttattgctattgtgagtgaaatatttatttatttgttttatttaaatcttttttatttttaactttttttgggtacatggtaggcatatatatttgtggggtacatgagatgttttgacacaggcatgcaatgtaaaataattagatcatggaaaatggggtatccatcccctcaagcatttatcctttgtgttataaacaatccagttacatactttttgttattttaaaatgtacaactaagctcttattgagtatagtcaccctgctgtgctattaaataatatgtcttattccttctccttttttttttttttttttttttttttacccattaacaatccccatctcactaccagcttctcagtaccctccccagcctctggtaaccatccttctaccctatgttcatgatttcaattgttttggttttttgatcccacaaataagtgagaacatgtgatgtttgtctttctgtgcctggcttgaaatatttattttttattatgttttctaagtgtatattaatacaatattttcaagtcaaatttttttttcagtggattgttacatgtgcttcaagtatatagcatattaccttgctaaaaggcacgctgtctcttttgttttaatgttttttaaatttcttcttttagtgtaattatactagaattacagaaaaagcaggtatctattttttatcctgactttaattgtaatgcattcagcattggacttggctgtataattactgatagctttttaatgttaagaaagtattcctcggatccttgttttctaggattttattgaggaatacttgtcgaatattatcaaataccttttaagcatcaaaggccgtgaagataatagtctcctcccgtgttaccttgtactctttggtttcttggaaatgtattttaatacactctacatattgctcagcttacatgctgagtaggtgttaaggatgaaggaagatgcaattgtcacttgtcactctcaccagtgagactgagagcatttctttctcccatatcctctcaaggtcatttaaatttttttttatgataaaaaaagtttaaatttgcctttgactaccatttgcgtttccttttcagtgaaatggctgttcctgccttttgtctatttttcgcaaatattttctaccaatatatatcttttaactttgtttatggtctagtttttattgttaaatagtttacttattatttgttcaaatctatttcttcttcctttgtggcttctgtgtgttctgacttaagagggtctgcaacaccctgagagtaaacaagtattctcttaaattttatttttatattataatcttatagattattttgaagatgttatgaagtagagattatgtctattgcgtgatcatgcatgccatcttttctgtctgaattgaattgctacttctatgttgtttctttattctaacaaaatgagatagattcactgaatattaaaagactttgggaaaatgcgaatgttatctttatgtatctcaatcattatgaattcacctactaaattaaagaaaatagcactgttggctgggtggggtggttcacgcctgtaatcccagcacgttgggaggctgaggtgggtggaccatatgaggtcaggagttttagagcagcccagccaacatggtgaaaccccctctctaccagaaatacaaaaacttagcaaggcgtggtggcacacatctgtggttgtagctactcgggaggctaaggcaggagaattgcttgaactggggaggcagaggttgcagtgagctgagattgcgtcactgcactccagcttgggcaacagagtgagactctgtctcaacaacaacaacaacaacaacaacaacaacaacaacaaagcactgctccattcatgcatctttcttttacaacatttggaacaaaggcagtattacaaaatagaaaacagaaaagaatacaaataaaattattttgcttttgatattcttttaagaccaaataagagagattatggagaaaggatattggcattttaactgcaaccttatactgatactgaatgtttgtatgactacgaaccaagttttatatgtgtgtgtgtgtgtgtgtgtctctgtgtgtgtgtgtgtgtctctgtgtgtgtgtgtgtgtgtgtgtgtgtagtttgtaggaagaaatgtagcaacagatcaatgattcatatctttaacaggatggcatagacttactctgcattttgagttatttttcctttggtatagatggatcatgctgatagtcacttattacttaatatatatatacagtttctaatatacctttcctttgaagttaccctgaagtgtttttctgtttatatgtgggtctcctccttttctatgcaatttgctgcttaaggattatactcattaatttttgtttttattatgctacaggaggagttggatttgtcttctagttctcagatgtctcccctttccttatatggtgaaaactctaatagtctctcttcagcggagccactgaaggaagataagcctgtcactggtcctaggaacaagactggtattactctatctcctaacttctgttatttctatttcagattgagcttaggttccatttcttaaaagaaaatgctggattaaatttatgtttattaggctggcttgctgttttttaattggtggacctatattgtttgttgtgagtgattaccgtggagaggaaaggggagaaataatctttggttgtctctgtctttacaggtgaaagatactttaaaatagactcagaccccaccatcttcaggagagatttcaaagtttcagttaaagataactgaatggagctatgacatttgttacctcattaatctctgggtgttatcccgtgattttagcaattctcctttaccagttagtgtgtcccattcccaaaactgcagcttggttagaaaaggaggtaacagtttaagtacttttcttcagttcattcaggtatatgtactgtagctatgcttaaactccagttaaagattgttaatcgaagttaagataatgtgtagagaaaggtgtgtgatagaatctgttttttagggcttgcgtaattgctttcacattgacttgtggtttgtctggtttttctccagaaaatggactgactccaaagaaaaaaattcaggtgaattcaaaaccttcaattcagcccaagcctttattgcttccagcagcacccaagactcaaacaaactccagtgttccagcaaaaaccatcattattcagacagtaccaacgcttatgccattggcaaagcagcaaccaattatcagtttacaacctgcacccactaaaggtacctgagcagaatttaaggctgtgtaaatttatttggagggcagtaagggttgtgtcatatgatttgttttaattcaggttataatttctgagcacgtgctgtttgtcaggaatgtctttggttatgaggacgttgcagagatgactaatgtgtggttcctgtcataacaagggatatagctctccagaccagttacatctgatggttattttgaaaatctgggacactttcttggtgccattttattctggtggataaaatacaggaacacaaattttaagctagttgaaggcagagttcaggtcagccagatttttgtggctgtgaactttttttgttttgaaggaatatttaaaataatagggtccatttcaggtgtgttatagcaatagaatcacacccttaatctctgaggaggctgcatggtttagtaaacagtatattgacctggtcatgaggagacctgaactctgctttcaactagctaagaatttgtgtgtttcgtattttatccaccagatggcctcatacacttgtgattctatgagaggtttatgtcattattgaaagaagttcaagtctgaggatttggtactattcagatatgggagtcatttccgtatggagatctcttaggtagattagtcatcattgtactcatactgatatctgtatacactgggtacaagaaaacttttgcagcattcttatctctggatttagtttgttggcaccagatatgactaggcgataatggggtatgggttgtaaataaacaccaatgttacatttgtactgtatctccaattgtgaataggtagctcgttttttggagcatagttttaatgagggtaaatttgataaatttaatttccagatactcttttagctttgttctattacatggtcatagacaatatgacattgataaaaagaagacctagatgagagaatggatgaatcagtgaaaattcatccatcagtcccaccaaaaataaacagacaaacaaacaaacaaaaaccagtttgaaatgcctgctctctcagtacaaagtcagaactgctgccttttccatctgaaaagtagcattcctatagaataggtattcttgtgatttataaatgtgtattaagggttcatgaactccttgaaacaaaatgcaggatttaatgtatgttcatatgtggattattctagggatagtctccaaaactttcattaggatctcataaggatctgtgccttcccaaaggctaagaatttaaactaatgaagaacctcattgtagttcccataagctattaaaatacgtctatacaaaaagtctgacattaatatgactagcgtataaagcaggggtattcctaagaatttgcccttagcagatcattgactatgtttgagtgatggaagatcttacctataataagaagacaaactgttcttttctgagcagtttatcagttccagaaacctgaattacacattatttgaaacttcaatactttcctgtcatctgaagactatagttatttttttgtgagcatgtgctaatatgaggaactgcaccttgcctgttttttttcttttatttgagacagagtctcgctgtgttgccaggctggagtgcagtggtgtgatcttggctcactgcaacttccacctcctgggttcaagtgattctcctgcttcagcctccagagtagctgggactacaggcacgtgccaccatgcccagctaatttttatatttttagtagagacagggtttcaccatgtcggccaggatggtcttgatctcttgacctcgtaatcgcctgcctcggcctcccaaagtgctgggattacaggtgtgagccaccgcgcctggtgccttgtctgtttttatagtacaatctaaataggtggtattattataataacatacagatttaaagtatgtttttcatttatttgagaatggggaggaagaagggaagtatgggcaagacattatacagttaatcatgttaatactagtagtaaatatgttaccattgaaaaagaagaggtaatttccacaggtttaagactgagattctctagcttggaatgtaaaactcttcacaatttggctctagtttagttttttgtttttttgttattgttgtttgtttgtttttaatagagacaggatctcactatattgctcagtctggtctcgaattcttgggctcaagggatctacccaccttgatctcccaaagctctgggattaaggcgtgagccaccatgcctggcctcctagtttagttttcgaactttataatattactcttttctataaatcccttcttctagctcaactaatctgtcattgtcctttgaattctcttgtttttcctagttttttggctcaccattttctaccaaccagcaacaacttatgcctacttctacttctcagtcctccatgtcctttaagactgttttgagtagtgtagatgagagataatgaaagcctggaatatcaatgaaagtggagaaccaggatgaagagtagagatgttaaaagtgtagaatcttagagattggtaattggattgtgtagaaggaggctgaacgatagagaggaaggtgtctaggatgacttccgtttttctatcttggggctttttgggtagatgatggcgaaaattattgaaatgggagacagaggtaaaatatgttgcccagatcactctgctaataagaagtggagccagaacttgagcccaggtggtctggctcggagtctatgtgaataatcactatactgtatcgccttaaaaaaaaaatgacagatgtattccttgctctcaagaattctacactttaattgggggattaaattcacataaacagttaaataacagtcactgtgataactaataaattaataactcatgcagtgcccttatggaagctattattatatagaaaaggagattaataataataataattgcatttaagttcttactatgtgccagacactcttctaagtgcttaagtgcattatcttatttcaaataatatttacacattatttgaaacttcagtatgtttctatgatttatggtgatgggttgtgatatctccattttttagatgagaacgctaagtacagattatttgccctaagtcacacaccgatgctgtttcagacaaagtaggcattcaataaatgtttgatacatagtttaaaatctttgaagaaagtttaaaagaaagaactatcaaaatcagtgagttacacatagtcaaaaaaatatatggcattgaatccagccatgttccgttaagggggatttgcatgtaatgccagagaggattttgagcatgctaaaatggataaacagcctttggaatgtcctttttaactgtttccacactaggaacagtagtaactatgttcagctgctatttaaggccccaaacaattctttgcattgtagtttgtggcctggtcagcatttaccaagtcaccatgagagttttttgttctttcacttgaacatattgtcatagaaatttagttgtttcccctcattctgtgttgaacccaaacatgcctagaatatttagagtatccctgatttagctgctgggtaatttgaggatagttgggtactctgggatgaaaaggcttgatacaatatgggaaaaaaaggaagcagcagtggcttggtaggactcaagccacatttggccttgccttggtattcttccatctcctttgtgtgatgcggtcgtctcagcaaggagacagtggtaattacacaattggtagtacagatttggattatttttcttaattagtttaagaaatattacaaagccctctgtacatgttatctgctagggctttaaatctgtaactgtagctagaaataggattctttcttataagttgcctaattcattatatttacacctcttctgttctttaaaatagtcccaaagttccctgaacagtgtttaattttggggagggatcttttaatcataattttaaactcagaggatgtagaacatggcttcctataatactcttctcaaagtattggtttaagtcagtggttctcagtctgtatattgtggaccctgggatgtgggtgatgggggtagtagctttatggcattttgcaaagcatctgcaaatccatacttgaagcaagcattttctgtagaccaaataatttatttcatatatctttgtacagctcttcaaatttttatagctatacttctgactaataaactccaagttcattttaaatcttcactaaattcttagcagcctttttccatcatgtattttctcagtacacagaagctgaaaggacaaccttgatggttttgggtgaccaggatattattttatattaaaagagagcccttatattcaggagcctttggggagagactatgggttttctaggtgtagaattatatcatctgtgtgagagatggtttgacttcctctcttcatatttggatgccttttatttctttcttttgcctgattgctctggctatgacttgagcacttgggaattcttgttttttggttttttttttcacattatgataaatatatattttcatagtgccagatttactgtaatttcttattgttattaaaacctaacacttggtcatatgctatttactttatgtgtttctaatttttatttgcgtatttggcctaagcatgtttatatctgcttctgagtaatttctgcattttatatgtttttacttcataaaagatggaggccacctcaaaacaaattaggcatcaaaggaacatacctcaaaataataagaaccatctatagcaagtccacagccaacattgtaatgagtgggcaagagctggaagtacattccctttgagaaccagaacaagacaaggatgtccctctcaccactcatattcaacatagtgctggaagttgtagccatagcagtcaggcaagagaaagaaataaaaggcatccaaataggaagagaggaagtcaaactacctctcttcacagacgatatgattctatacctggaaaacccatagtctcagcccaagactcctagatctgataaacaacttcagcaaagttttaggatacaaaatcaatgtacaaaagtcagcagcatttctataccccagtaatgtccaagctgagagccaaatcaagaatgcagtctcattcacgatagccaaaaaaagaatataaagtacctgggaatacagcaagctggggaggtgaaagatctctacaatgagttacaaaacactgctgaaagaaatcagagatcacacaaacaaatggaaaaacattccatgctcatggataggaagaatcgatagtgttaaaatggccatactgctcaaagcaatttacagatttaatgctattcctatcaaactatcaatgacatttttcacacaattaggaaaaactattctaaagttcacatggaactgaaaaagagcctaaatagccaaagcagccctaagcaaaaagaacaaagccagaggcatcaagctacctgatttcaaactgtactacaagactacagtaaccaaaacagcatgatactggtataaaaacaggcacatagaccgatggattagattagagaacccagaaataaagctgcacccctgcaaccatctggtctttaacaaaaacaaacagtggggaaaggactgcctattcaataaatggtggtaagataactggctagccatatgcagaagattgaaactggatcctttcctttcagtgtatacaaaacccaactcaagatggatgaaagacttaaatgtacaggctcaaattataaaaaccctagaagaaaacctaggaaatatggttctggacataggccttgtcaaagatttcatgatgaagactccaaaagcaatcgcaacaaaaacaaaaattgacaaatgggatctaattaaactaaagaggctgggcgtggtggttcacacctgtaatcccagcactttgggaggctgaggggtgcatcacttgagatcaggaattcaagaccaacctggccaatatggtgaaaccccatctctactaaaaatacataaattagccaggcatggtggtacatgcttgtaatcccagttacttgggaggctgaggcaggagaattgcttgaacccaggaggcggcaggtgcagtgagctgagattgtgccactgcactccagcctgggtgacagagctcaaaaatcaataaataaaaatcaactaaagagcttctgcacagcaaaagaaactatcaacagaggaataggacagcctacagaatgggagagaatatttgcaaacagtgtatccaacaaaggtctaatctccagaatctacaagaaacttaacaagcaaaaaacaaccccattaagaagtgggcaaaggatatgaacagacactttcaaaagaagacatagacatggccaataagcatatgaaaaaatgctcaacatcactaatcattagagaaatgtaaatcaaaacaacagtgagataccatctcacatcagtcagaatggctactatcaaaaagttgaaaaatatccgatgctggcaagattgcagagaaaagtgaatgcatatacattgctggtgggaatgtaaattggttcagccactgaacgtagtttgtagatttctcaaataacttaaagtagaactaccatttgacccagcagtcccattactgggtatatacccaagggaatataaagacacacgcacacatatgttcatcacagaactattcacaatagcaaagacatggaatcaacctagatgcccatcagtggtgaactggataaagaaaatgtggtacatatacaccattcaatactacacagccataaaaaagaatgaaatcatgttctttgcagcaacatggatggagctgaaggccattatcctaagataattaatgcaggaacagaaaaccaaatacttcatgttctgtcttataagtgggagttatacattgagtacacatagacataaaaaggggacaatagacaacaggggctacttttgagggtggaggatgcaaggagggtgagaatctaaaaattacctgttgggtactgtgctcattacctgagtgatgaaataatctgtatgccaaacacctgtgacatgcaatttatccatgtaacaaacctgcctgtctaccccctgaacctaaaataaaagttgggggaaagaaaaactgaatccaagggaaaacgagaaggtaaaaatgtttaatgatcatttatgccgaagtattaatacattgtatctactccaaatccatgaaattatttttagatcttcttatctgggataaaatgctgtttattgaaattctgctactttcagtgtgttttttgaggccatctgaaacaagggctttgcttttataagttatcttttttagccaagacagatgttcttgacaaacaggtgttctgaagctttattttgatttttagttttccccgatcctttgaaatattgagctgagttttacatgggtcaacctgtctgaaagcataatgctttttttttcttaaacaaattataaatttacatgatattttagttgccagttattttagtaccttcattttgttagataggctcaagcagctgtggatgttaggcaaggctttcagcaccttataaaaatctgccagatctgaaaggaaacacttagcaggcaagtaaaatttttaatagattagtgttatgagttgtataagtctttaggttaatggtacaggtttagtaccccttaaatgaaatgcttggaaccagaagtgtttcagattttgggtacttttggattttagaatatttgcatatacataatgagatatcttggggacagaacccaagtctaacatgaaattcatttatgtttcatgtatatctcatacacatagcctgaaggtaattttatataatattttaaataattctctgcatgaaaccaagtttgcatacagtgaaccatcagaaagcacagttgtcactatctcctgtggacaatctgtagttgtttggcaccaccatcattcctggctctgaattcatatgctactgacaagcaatcattttcttacacttattcacaaattcacacctaagaacttaacaaaaattatgacataccattaatacagtgaaaaaataatgtgtgcagagtaacaaggcaggacagtagaatcaccagaataccagtgtcagctactacacaacagcaacaacaaaaaatggcagctttcagtctctgcctttgatgctgttttcattaaaagcctactgtaccctctattttatgtcttcaggtgagaagaaacatcagaagcagttgagagactggaagtgggtcctctagggatgaggaggcattctgctggatgacttctaaaaatgttttctatggagtcatctgcctcattaacaagtttttgttttagaagtctctttttgattttgtaaactgacatgatttctttttctgttatgactgtatgctgctttagtccttcactaggcccatcacacatttttaccatgtcatctataggcactttttctgcagcgttaacagcatcatcttcattgtcattattatagattgagtatcccttatccaaaatacttaggaccagaagtgtggagttttccacttgtgaagttgtgtcagcactcaaaaagttttggattttggagcattttggattttgggtttttggattaaggatgttcaacctctaataattctcgtcagattagcataaatttaaaataatgatacctctgaatactcagaaaagaattgaaggccatttttgggggaagagggaaagggctggtatcatctacagactattttgaatcacagatttatgtttaccgtgattgttagctaagatttaatctcaaatggttttaagttttttggtatttgtagtctttttttttttttttttttttttgtcctttttagggatctgcctgcctcagcctcctgagtagctaagactcgaggcacataccaccatacctggctaatttttaaatttttttttgtagagacaggctatcactatgttgccttggctggtctcaaactgctggcctcccaaagcactgggattacaggtgtaagccacagtgcatggcctgtagctccttcttcttctaatattgagttactaagtttatgttcagatatttttggtattgtatgcatttgtaaatcctattaatttagaatacatgactctccatattcagtgtaaaagatttgttatttataataagacaaatccttttagcactaataaatttcagaggttaattcttagaaatctagggattacagcaaatttgatagctgtttagttgagaaagataaataagaaagtatattaaagtatattgttaatgataactcaaagagatgaatttagttggtcacattaaaaacataacaaagtcaccataagcgtgtgctgctattgatccaatgttttaattgatggtgtccaatcccttggtgttgatcttacccattacgtctgcagaaaagacctaattataagctgcttcccctgccacagtagttgtgtaccctttgattccttttcttttttctaacgcaggccagacggttttgctgtctcagcctactgtggtacaacttcaagcacctggagttctgccctctgctcagccagtccttgctgttgctgggggagtcacacagctccctaatcacgtggtgaatgtggtaccagccccttcagcgaatagcccagtgaatggaaaactttccgtgactaaacctgtcctacaaagtaccatgagaaatgtcggttcagatgtaagttttgaaacttagtgcttctcttaatgcctgatttaaaaaccaacaaaaaaacaccttttgcttttgttgccttgtttttgttttttttagagtttcttatattgcatcaaataaaagagtgtgctgaattgcacatctagtctttggaggaaaattagggtaaggcttactacgttagaatctaagtgaaaaggtttttgaaagtgaagtggtttgatgaaaagcaaagtatgcatacctccctcttctttactccttctttagaaccaaccctcttattattctcttcaagcccttacaccctcaacccagtcatccactaatattttacagattcaacgtttcctgattgaaatgttttagcgatcttcagataagagtctatagattactttttaggtaggttttatatttagctttcttccttgccgttttgaagtattttcaccacttcataatgatgactagctactcttaggaattctgtctcttagtgattatttggtactttcccatttttgcaaacctttaaattttctagcatgttgtagggatttcttataatttataaatcacatagtttcctaagacctgtcactctctaaagccagttactgcacttgccaactaactcttgctttctttcaaaatgattggaaataacttatgtattaaattgaacatcttggtcctaaaatttaatgaatgttaaagctatatagtcaaacagtggattctctaaagttacgattgggaaagcaaagtgtgtatgttttctttaaaataaaaatggatactactagttgttaatattactacttcatcctttctttaggtagaatgcatttgaaaagtaattttaaaatcctgtgggttatgcaaggttgtttatcagactactgtctgatctgtctgccagaatttattaaccagcatgtcagtgacccatttaattataaaattgctccacagttgcataaacagtaatctcagccagcaatattgtaaaaattcataacaaaggaatattgtctggtgaaagtagaacatccagtttctagaataagagtcccatcgtttgtataggtattgaaaacaatgcatgtcaagacatggaataggaaaattagtgttgctatgagactagagaccatggacagtacaggattaggcttgactgttatgttggtttgttttgaggactagaagaggtaagcacaatgcttatggcataataggctctaatacatagcgtgtgtttcagttgaagatgaaacaatgttgctgggatgggaaggtggtgagcacaggatagaggcaactggattggcaaaatgttgataatgatggaagctgggtgtttatttttctatccttttggtgcatggaaaaatttctacaatatgttaaaaaaatgacaataacaaaaatccaaaagctttctgtgatattttcaattaaaaagttgtgtgaccaataagaaaagagtatgattttcatgggagaccaaccaggttaagaatgatgaaaaaggatttttaaaaataatgctttgaaatttctttttttttgttttattatactttaagttttaggatacatgtgcacaatgtgcaggttagttacatatgtatacatgtgacatgctggtgcgctgcacccactaactcgtcatctagcattaggtatgtctcccagtgctatccctcccccctccccccaccccacaacagtccccagagtgtgatgttccccttcctgtgtccatgtgttctcattgttcaattcccacctatgagtgagaatatgcagtgtttggttttttgttcttgcgatagtttactgagaatgatgatttccttttaatactcttttaaattatgaacttgaatgtttcttatataatacccccaaatgaaacttataatagaaaatatccaaagttgcctttatgtaatatgttaggacatttaaaatatttttatgaaatattttagacatgaaaaaaagataaagactaattagaactttaaaaatacataggtcaacagtatatcactgttgttaaaaaatattaacaatattaatctaagtcatcccaaacatggaaaagtccagaaaagcatagctaggatggggagagtatctagaaaccatggggtagaggagtgggttaaaggttggaatgattcagtaaactgaagaagagaggatggaaagtagacctgggagccatcttccaggaaaggaaggttgttatgtggaaaatagaattgttctgcttgttccagaagagttatctggaacaggtgcaggaaaaatatagaaaggtttcttctaaacataaggttttttgatacaatcattgtatttaaaaaccagaagagcaacccccctgcctttttttttttctacttttaggcttactatctgaataatgagcatcttaatgttgacaatcatcactgtatgccattgacccattttataatctctaaacatattccaattaattatatgttggtctattagtcagacatcctttattagttctctggtgtgaaagactgtgtctgttcagcttttgtactcttaagggggatctgtaaatttaaagtatttttaatgaaatattttagacatgaaaaaagataaagactaattagaagttaaaaaatatataggtcaagagtatgtcactgctaaaaatatgagaaaatgtagaaccaataaatactgctagaaacaaaagctaatacttattggttctatgttttctcatctcacacatcccccagttcttcaacgttaattgagactttgtcagcaaagtctcaatgtatgaatgtctacatttattgtatgaatgtatattcagatgaggttaatttttttaacaatgatataccgttgacctacatatttttaaagttctaattagtctttatcttttttcatgtctaaaatatttcattaaaaatactttaaatttacagagcccccttaagagtacaaaagccaaacagacacagtctttttgaagtttagaattgacaggattataaagaaagattcaaacactttatgtttaatgcaaagagacctaaggacaattagaataattttctagtcaacctgcattgaggtttttgtgcttatttttacttggccagcacatcgagacgtgagccaagcctttcaatatgagtttttttggtagaaattttgactgaatgtttatttcaagtaaagaagcattagtctgtcctagcagcaggccaacccactcaggaacccaaagtaaatctgttccagaaggagttgcagagaagaactttgatcagcttgtatagccttctgtgttagtaacttggttgacctcagtattacatgtgtctgttaaaacacaagtcctattaaattaggataaattaatataaattcctaatttaaaatgatcaaaaaaatattttttatcatataccttttgtgcctttaaaccaaaagtatggtgaaagaattgtaatccaccaaaaaaaaaaaaatcatatcagtttttttgtggctttgtaatgctgacatggcttctttttctaccttttttagttcttttgtttggctggtttcactctccagaggcctgctacagccataagtagcgtttttagcataccatattctgcaaactgcattaaatgccacattttctgttatgaaacagtttgcctggttcaaattatatcttactcttcctgtcttttgctggtaaatctgttttgtttaactcttggagacctcacctaagttttcaagaaatatggtttgtttttggctgtgatcctgatggaaaaaatgaacatgatctctcatttcagtgtagaagttctctgtgcagtttcttagtaaatggcaatcttggaactacaaagttgactttataggacagcatgcttatctttctttaaagggctatttagtgttgccacacatcaaaccaagggcttaaaaacaagcagtctgtttaaatctgcattacactcactacttccacctacccatcataatcgcataaactttatgaaacattactgcccttgttttaaggttataggaattacattgttttagttattggaacaaaagaccagaaaaacaagtggtaaaattctacatcttccacagtgggccacattggagcaaatactcttagtggaaatcagtaggtgggaataatggaaagaaaagtatccagaactgatatagaactataaataacctcagatgtgaggttgatgaagggatacaaactactgttaggagtctccttccttccggctcagtcaccccactgaatatcttccaaactctgtatcaccttttaccctgtttctaaatcctatagttaggaaacttgatcccttccatcccaaaatgacttccctttgggagtccctgtcttgggttcctagagtcatcatgagaaggtaggtgctggggggaatcctttgctactggtttgcaggtattagaaatggtgcgaaggggattctcctgtcataccaaattagaactttgtatttcctttctctagaattggtgtacagttaatttagggatttcaggtatttttagtattgttctatgggagtgatgtgacatgggcctagatggatgccctgcacacagtgttcctctcttgcagtggaggaacatgagcttggagaatctaccatgtgtatagcaagcagaaagcaagcctcctcattgtctagagggagattttatctcatccttcaaggttgcttgttggaaactgaaccttgagaatggcctgggaaaagagtggtccggaccttgcattctttgcatacccaataagacgtgtaggagcaaaactcataagagactccctggaggtgtgtttctcaagaaaaatatgtctataataatctatttgcaatgcatagcaactcagaaaaacagagactgcctatgttctatttcagaaaaaaagcaaaacttcaatagacgttgaagttgcttatctgtaacatccaagaataggacgctggttaggtcaaaatgtgagctgaatctccttaaattatgtggctagcttagatctcagaagataaataatgaataggcacttcttaataacttctaacaacaaacaagttgagatcatgatatttctttaggctgcaaagtagaggaatctatcagaacaaatccaataggaaggatttggagagctggagttatccagggtttagtaaaaaaattacttctgtgctgactgcattgtggctttgctgctaccagggactctgcaaataaaagaaaatatgctttgtttaaatatttgcagtatctctttaaatgtaggtttggagcttctaaaaatttatcttgaatagcagttcagtttcatttgaggttacagtagctttggaaggggaagtgaacagcttttttttgttgttgtttatttttccttcctgatgcattgcattaggataaatttatgttgtggcaacctcagcattctttattctgtactttttgtactttttagtttgtcatcttttttttttttttttttttttttttttttttgagacaaagtcttgctctgttgcccaggctggagtacaatggcacgctcttggctcactgcaacctccaccttccaggttcaagcgattctcctgcctcagcctcctgagtagctgggactacagctatgtgccaccacacccagctaatttttgtatttttagtagagatggggtttcaccagtttggccaggctgttctcaaactcctggcctcaagtgatccacctgcctcggcctcccaaagtgctgggattataggcatgagccactgcgcccagcagtttggcatctttataagaataataaataattatttttaaggattctgatttttatcttaataaacaatgaaatacttctctctcctttctctaatttcccttctcaaaaccttgtggggactcattctagggagacagtccttttataccccagagactttcttgcaaatcagtttccttgtctggtagtcattcttactagttttgtgtgcattcttctggagacagttctttaatatgtaagtacttatagttttatttattgacctatttcatagaaaaggtagcatactgtacatgtcatcctgcaacttgcttttctcacttataccttagagatctgttcagatcagtactaaaaacttttctcattccttttttaaatttttatttatttatttatttttttaaagacagtctgttgctctgttgcctaggctggtgtgcagtggcatgatcatagctcactattgccttaaatatctgggcttaagcaatcctcctgcctcaggctcctgagtagctagatgtgtgccacctggctaaattttgatttttttttttgtttttgtagagatgggggtcttgttgtattgcacagggtggtcttgagctcctggcctcaaatgatcctcctgcagtggcctcccaaagtgctgagattacaggcataagccaccatgcctggtctttttcttattcttttaatagctgcattttaatggctacatagtaacctacttcataggggtgccataattattgtaaaattttgcagtccttttcattataaacatttcttcattgaataacttggtacttatttcattttgttcatatacaaatatatctatgggagaaattttattttatttttattatactttaagttctagggtacatgtgcacaacgtgcaggtttgttacatatgtatatatgtgccatgttggtgtgttgcacccattaactcgtgatttacattaggtatatctcctaatgctatccctcccacctcccccaaccccacgacaggccctggtgtgtgatgttccccttcctgtgtccaagtgttctcattgttcaattcccacctatgagtgagaacatgtgtgttcggttttttgtccttgtggtagtttgctgagaatgatggtttccagcttcatccatgtccctacaaaggacatgaacttatccttttttatggctgcatagtattccatggtgtatatgtgccacatttttttaatccagtctgtcattcatggacatttgggttggttccaagtctttgctattgtgaatagtgctgcaataaacataagtgtgcatgtgtctttatagcagcatgatttataatcctttgggtatatacccagtaatgggatggttgggtcaaatggtatttctagttctagatccttgaggaattgccacactgtcttccacaatggttgaactagtttacagtcctactaacagtgtaaaagtgttcctgtttcactactttgtaatgattgcctgtttcctgactttgtaatgattgccattctaactggtgtgagatggtatctcattgtggttttgatttgcatttctctgatggccagtgatgatgagcattttttcatgtgtctgttggctgcataaatgtcttcttttgagaagtgtctgttcatatctttcgcccactttttgatggggttgtttttttcttgtaaatttgagttctttgtagattctggatattagccctttgtcagatgagtagattgcaaaaattttgtgggagaaatttttagaattggatttgctgggccagaaggtatgtacttgttcagttttgataggttttaccaaatggtcctccattgaggtagttctaattgagaagtcagtcacagggcttaatggagtccttgggtgggtttcagtgtttccataatcagcatcctatattagtcagttctcacacttctataaagaaatacctgaaactgagtgatttataaagaaaagaggtttaattgtctcatggttctgcaggctgtacaggaaacatggctggggaagcctcaggaaacttacaatcatgactgtgggtgagggggaagctggcacatcttacatggctagagcaggagaaagagagaaaagagggaagtgctacacacttttaaacaaccagatcttatgagaacttactatcatgagaacagcaaggtggaaatctgcctccatgatcgaatcacctttcaccaggctcctcccccaacattggggattacaattcgacatgagatttgggtagagacacaaatctagatcatatcacacccctttaccccacctcacctcatccctcatatagttgttagcaatgtgcaagtgcatttgtctggggagtccataagctcttttgttgtctttttttttttaacagcttcattgagataaaatgcacattacataaggatcacccttttgaactgtacaatttagtggtaccatcactgctgtctaattccagaatatttttgtcaccctaaaaagaaaaccccatagtcattagccatagtctttcctcatttctcactccctgcagcccctggtagccatttaatctgttttctgtgtggagttgtcccagacatttcatatgagtggaatcatacactatgtgcccttttgtgtatggcgtctttcacttaccatatttttttcaagcttcagccatgttgaagcatgtgtcagtgtttattcttttttatgactgaataatattctattatatggatataccacatttttgataatccattcatcagttggtagacatttggcttgtctccactttttgtctgttatgagtaatgccactttgaacactcatgtacattttcacagtcttttaagaacgatttttaatatatagagtataaatcagtgagaaaaatgcaaattaattcaaccatcaatggacaatatatacgaatagataattcacgaagaagagtggtaaattttaaaaatgaaagtatcaatggctgtgtattcctgaagggatattccctctgaaagattactattttataactatgtgaaagaatattaattgttagcaggagagatcttgtggctggttacaggtagttcgagaatgatattcaagaatttaaagtgttatggttagacttttctgtggctcttacctcccttgagtatgagatctaaaggaaaatgtcttatggcttcttataacttcccagtgtgtatacactgcggttgtgtgtgtgtgctgacacatgttaaactttggttattgtatgggtacacatgttaaactttatatttagttataattttaaatttcaaaaagtacaaaaacaaaaaatagtacagagaacacccaggtattcttcagccagattcacctgttgttaacattttacccaatttgcttgcttattctttatctacctacctacccatccatccatccatccactatccatccatccatccatccatccactatccatccatccatccacccacccatccacccaccatccaaccatccatccatccatccatccatccatccatatacacacacaatttttttcctgaactattttagggtaagttacatacctcacagtattttacccctaattttttcagtgtgcattttctaagactaggtacattcttttattaacttcaataatttacattaataaaatagttcaatcacctgtcaatattacaattctgtcagtcgaccaaatatttactggattttcacaaagtctttgtgaaggggacattatttattcccattttactactgaaggaatcaactagctaagtgattcaacaaatgtcatattgctaagatggctaatattaataaagtactatgtgccaggcacttttctaagtgcataacttgtaaatactctctttaaatcttataacagctctttgaaatgaatcagggccctgaggaatacagagtaaggaacagacagagtgctcagaggaatgttaagttttaggctctttttctgcttctttagtgattaaataacatttcatgctttgtgtgtgtgtgtgtgtgtgtgtgttttaattttaaaacttaaaatctgaaaatgggagctggaatgggagcaggtattttctttttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttgtatttttagtagagacggggtttcaccgtttttagccgggatggtctcgatctcctgacctcgtgatccacccgcctcggcctcccaaagtgctgggatcacaggcgtgagccaccgcgcccggccaggagcaggtattttcaatattgctttagttgcatggtatatcagagcagctgtgaggtacattgttgatggaagtaataattttgcctcctctgtgtgtgtgtgtgtgtgtgtgtgtgtgtgtgtcacataattttcctgaaagccatatttgtatggtacattatagcttacagagaaccttcatgtctgttacacagttgattctcaccccaatcatttgaccacttataattgagttaggattcaagcctagctcaattataactggtcttctcctaatccagtggtgtcatcattactctgtgctccattaatagagcctttactttcaaggtagtcctgatgcagctcagactttaaattacccacgtcctttgcttacaactttatgggaaaagaaaaaagaaaaaaaaagaacaaattacccaagtctcgaaacttgctgataccttttttctccctttacaaatgttttttcttaatttataaaaattaagatagttttaagatttaatttttaaaaattaaggtagcagatagttttaagtcatgagggacaaaggtttagaaagattgaccttatttgaataatttggtggtatcaaatgaaacctgtagcaaaaataatcagatccatatttcattatatagtagtcattattgtgctatgtcgttgtgccaattaaattaagtgtatctatttagcatcagccccagaattattttgtttttggattggatgagacctttagaggactaatgaagtggctttaaacttttttgtacacagtccacagtaagaaatgtatttaacctctctttctctcttatactcaatctcatgaaacaactcttactaaatataatgcaccctttttcttttattctgtcctgtgcttttctgtcaaattgtttttgaaggctgtggtgatttactaaattgataaacctgatattgggttataataatgtcataagcactattctggtctaactctctctttttactaatatgtaaatacaccctacaaggtgacgtgatttatttttatttttatttttagattttccaattaattcattgcaatgctgggccaagaattaaggactcctaacttccaattttgtattttcatttaatgacttaaattactattacttttatttagttgcatcaagtatttcttttctttctttttttttttttgagatggagtttcacttttgttgcccaggctggagtgcaatggtgtgatctcggctcaccacaacctctgcctcccaggttcaagcaattctcctgcctcagcctcccgagtagctgggattacaggcatgcaccaccactcccagctaatttttttgtatttttagtagagatgggttttttccatgttgaggctggtctcgaactcctgacctcaggtgatccgcccgccttggcctcccaaagtgctgggattacaggcgtgagccaccgcgcccggcctccatcaagtatttctgaagacacgtgaagcagtggagtcattaactgaaataacaggaaaccattttgaggctcctttgaagatccctgtgttcaggacttgggtccctctattcttcaagaggctgtgcccatggtgtggctttgctgagagcatctggtgcatacttctgcttttacctctcttttggttgttctttatcttcattcagaagatgagattggtagggtttccccatcctataacctagcagggactttgtctattatctgttctcattctggaaactatactacatatcagaaggcattcttcattttaaaaaatagaaggaaatagtttgcaggatgaagattatttccttgataatctgccaaataaatggttcaggttgccagtatgaagcttctttaatttttggcaaatgggagctggttatatgcatacatacacacaaaacttaatagaaagagtaaaataaaattttgactgtcatgagattgagaagagtagagatagtgaaagtctaaattttctctttttttctgctttaaacaatttaatgagaaaaataagtgtacgtaagattcttaacaaaaatcaaattaagttttttaatgtatttgaatatttaaagtaggattgccacaaattaaatttgccaatgattttaactatgtgtgttttttaagaatgtatctataaatatgtttactgcaatacatatgcaataatgtatgttatgtaatttttatttaattgaaagattgtatttttatttttggtcagttacagtgaagaggttaatcagtaatggcttccactttatctatcagtttagagggcaagattcagccaaatgagaataagaactgttagaaagatgtgcagcaagtcaatgattaccatgtgattcatccataggttatcaatacttgatctgacttgagtttacatgagatattcgaatgtatttcttagcataaaaatcccattttaatttttttttttttttttttttttttgagataggctcttactctgtcacccaggctggagaacagtgatgcgatcatggctcactgcagcctcaacctcctgagctcaagtgatcctcctgcctcagcctctagggtagctaggactacaattgtgcaccacgatgcccagctaattttttaattttagcagagacgaggtcttcctatgtttcccaggctgttctcaaactcctggcctcaagcgttcctcctgcctcgacctaccaaagtgttgggattacaggtgtgagccaccactactggctcctatctagtattatatctaatttaatttatggtcattgagctcatttcttagcaacatcacagaaacaaggctttagtcaattttattaataaaaagagactataataacttacagtgtttatcaatcaataaggtttttagttttaaaaaccttattgattgataattaaattgataattaaattaaaacaagctgggccagcactttgagaggctgaagcaggaggattgtttgagcccaggagttcaagaccagcctgggcaacatagagagatcctatctctacaaaaaaataaactagccaggcacggtagcatgcacctgtagtcccagctactggggagcctgaggctggaggatctgttgaacctgtgaggttgaggctgcagtaagctgcaattgtgccactgcactccagcctgggtgacagagtgagattctttctcaaaaaattaaattaaattaaactaaaaacaaaatgtggacgtacttgaaactttgactcttacattgattcaaccttcaaaggaacttgtccatttgtgaaagttttccttttatataagtctttcttacagtcaaataagtgtttactaagtgaaatactacattttatagtgcagtggcactcaaaggaaactattttgcagctgtagagttttttcttttgtcctttttactttttccaaggcaagatgcctggtgggagagttgtctggaggcaggatgatcagaagcaggacctggccagctgttcgcttatttcagtctgtatgaaatcatctgatatgcccataagagagatgtgtcaattggctaatgggtcagagtattgattttatgttttcagattgctgacagagagattaggcttccagatacaagcagttccacaagtctctgttttcagacaggcacataattaaagtaaccacacagttctctgaggttagagttccatgctgtgatgcaagcctctctatttggtatttaaaagcagtttgaagctgttgtgtaagtatcactggacttggagtcaactgacctaagttctagccttggcccttctactgtcttaacagtggattaaatgatgaggcttattttaaagaatcttgaaaactatagtaatttcaacaagaggagattaattgaatatattatgaaacatcaagataattgaaaatctgtgctgccattattgcatgtcaaaggtcattttgatacactgtatgtgcaaaagcagtttaccaaacagaattacatacagtgtaatcctttttttcttatataggaaaatacccacttccccccacttaaaaaaataccaaacaccacaatgtgtgtatgtttagcctacaaatcatattttttttgcctaggaagtattgaataatttaaatattttatattcagatagctaaagatggcttgctgagataaaacattggagccctgtgtttggtgatagccgtgggtttcatttatttttactgtctttatcctctgtatttattgatagtattgaatatttattttcagaactattatagtgtatctgtttctatgggaagaaatgaatatttgaccacagatggttttcatttttttagtatggggcacgtggattgacagcctttgaaacttgaatgctgtgtaatattcaggtgcttttattgtttatagaaatgcctaatccttgtttgaaatttattaaatggtatgccatctgtaagcccctctaaattccacagattaattagcctttaaagtaaggttgccttttgtctaacttttagtataaactcttccatctgggaactttcacttttatgtccctgttcagtgttctgtgtacttcagcactctagtattaattatggacactggcattctaagtaacatgaagaacactaaaaataaaagtagactgaacaaagtggcaatgtccggagaatagtttgcatttggtgaataatcaatccatcatggctttgccattgctctttgtatgtgcgtgcgtgtgtgtgtgtgtgagtgtgtgtgcatgtgcgtgtttagcattacttaagagtgagatagttattcttcagggaaatttttacagatgatggtttcacaaaaatcagcctttttgtagtttaaataaaaaaacaccctttttgacatttcatgtaacatttccttgtgggttctgatttaaaggttgttgaaaatatttggtgttggcagatcacttggttggctttggcatacttctctttctaggaaatgtagtatcagggtgggaattgtgttgttgttttaaaagaaatagattacaggctggcacggtggctcacacttgtaatcccagcactttgggaggccgaggcgggcggatcaggaggtcaggagattgagaccatcctggctaacacggtgaaaccctgtctctaccaaaaatacacaaacaaaattagccaggcgtggtggtgggcacctgtagtcccagctactcgggaggctgaggagggagaatggtgtgaacctgggaggcggagcttgcagcgggccgagatctccccaccgtactccagcctgggcaacagagcaagactccatctcaaaaaaaaaaaaaaaaaggaaatagattacattctttaactttatttactggtctcagtaagagttattgaacactctagagtgtttactttttaaagtccattgcaaaatatatagaaattagtaattcaaccatctgtgtactcatactaatcaatgtaatataggttggcgctttttatgcacttaattttgccacctctctcacttccccaaagaaattagactaatgtataacaataggcttcataacttaatttagaaaacataacaaaaataatttcgctcagtaagtttctgttgtagtagatattgttggtattaaacaaaaaagtaggatcagatgtggtttggctttcaaggtataaaatctaggtggggaaagagagagagagttaacattcttgaaacaattgagagcattagagtgttccagtatatcctccaaattctaagggtataagatgttcagagaaaataaaaaatcagggtgggttagaataattgagttcaaatggaccttggaattaggttagtggaggagatagcattccaaatggaaataaacaatgcgaataaggaaacatgttagacatgtatggagattatgaagtagccttaaatgataagattggaggagtgtggcttgaatagctgtagatttagggcagaaggtctggttaggccgtgggaggtcacaatatggaagaccttaaaagaaaagatgggtagcagggatacatgactagcttgtttttgcaattgagtagtaagataaaaatattttcttaggagaagttatcttagaaatggtggacaggatgagatggaacacaattgaaataggagtctgttgcagtagtatagggatgagttaatgagtgcctgtattaggagagtggaagagggaatagagagaaagtaattactgagacacattttcactggaataaatttggtcattagtatatacttttaacatattcaatgagtgaatgagggattgagaaggactgaatatagtgaataaagtaaaataatagttactattgatagaaaatggatagatttttaaacaatctagttagagggagatagttcagtttgcacataatgaatttgaagtggtaataactgtaagaagtggccttataattaattgaatatatggttctggggcatagccatttaagggccagagatacagatttaagatgtatgtatatatgcatatatatttaaagatactttctgagggagtttctaaggggaaaattggaagattaataaacgagccttagaaaacataagaagaaattatttaacatttgggttttagaaggccttatttaatcatttgattttaacttatttagtttgagcagtgtgttttcaaacctcttttgaaacaactagtaacctatgctttgaaaaaattgttggttaaaataattgtaaaaatgagtatattctgatctattttgatctgattttaaaaccagggtattctgattcattataactttttctagattgctgtgctaaggagacagcaacgtatgataaaaaatcgagaatccgcttgtcagtctcgcaagaagaagaaagaatatatgctagggttagaggcgagattaaaggctgccctctcagaaaacgagcaactgaagaaagaaaatggaacactgaagcggcagctggatgaagttgtgtcagaggtaagtgttagtaatacggctgagtcgagatgggctaaagtatcctctggattaataaatagagaaacttttacattttaaattaaattatgtaaaataatagtgctaggaaaaggagggtataataagtcctaaaacatttgcagtaaggataaagcatttgaaggggaccctttgaattgtactccccaatctacatagaaaagttgtctccttttcctaggtttctcctcattcattgccttagcaccctcttttctggctaagtgaatcacactgaggcttctaaagtgccctgccatattttcccttttaaaaaagaaaacaatataaaagtgtttttattttttctcagtccacctaacaactaatgtgatttttgcattctgttactatgctgactccaagaggttttaatctcctcagttctattcgggaaatttgctgttttcagaatttctcactgcagtgctgaaccatatagatgcctactgaatggggcttcttacactctttttctcttggccctgagtacatgggaatactcctatattttactgaaaacaatgatttaaaaggttagggaggcaaactatagaagtgactcaaaattctttggggatccgtaaaaatataaaaaatgttgaattctggtcgggcgtggtggctcacgcctgtaattccagcactttgggacgctgaggcaggcggatcacaaggtcaggagatcaagaccatcctggccaacatagtgaaaccccatctctactaaaaatacaaaagttagctgggtgtagtgcacacctgtaatcccagctactcgggaggctgaggcagcagaatcgcttgaacctgggaggcggagattgcggtgatccgagatgatgccactgcactccagcttggcgacaaagtgacactccgtctcaaaaaaatatatatacatatatatattgaattctttcctcttgggtgaagaggcaactgcaatggagtggctgctgtgtttttttctcttctgcttctctccttttctctccctgctggaaaagggaacctggaagtctctgctctagtcttgaaaagtgttatttcctcacctttgattttttttttttttttaaataagacaaggtatttgtaagacaagagatttacgtaaccggtaaagaggaaaattctaatcttaagcgttgctttttctgaaatcgatgttagtttaattgtatttaatgtggtcatttcctttagaaccagaggcttaaagtccctagtccaaagcgaagagttgtctgtgtgatgatagtattggcatttataatactgaactatggacctatgaggtaagtgaatagatatttattttggacactaatgctaaaaacttaaattctcattattctttagcttttgtcataaactagagaaaaaatgatttgtttttcaagatgtgtaaagagtaatgagacaggagccatgccttcaaagatctcatgatccagctgggaggagagacaagtagaaggatgactatggtataatgtgatgaacataataataacagtgtgaatgagtcctaacataatatagagtacgagttccttgaggtgaaggttcttgtcgtattgatgggtactcgatacattttttgttgagtgactgagttataagggagatacctacgaaggaagctgaacattgaactgtaatatcagtttgccatgtgcaaagtatgagaaaggcatgccaggcaaagggaacagcatgtttaaaggcacagttatgaaatggcatgacatgttcataaaaaagtgaaaagttcagtgtatcttgtatatgtggggagtgtgcctgaggctagatatatggttagaagtataggtgctgctgtgtacaatgaggcatccctagcttttaggtggagggtaacataatcagctttgcatattaggaagaggactttgtgtgttgtattgagtatagactgcagtgaggagaaactattggcagagaaagcattagaagactattgaggtgtttcaggtaataaatgagagtctgaacttacactatggttataaaaaggatgagcaatcttagggtacctctctgatgtagcttttgtgggatttgttaactggtataatgtgggacatgaggaagaaaagagggaagttaaggataattcaaaaatttctaccttgagggaccgaatggtggtgctgtcatcggaggaagcaaacatagacagatggatagttttatgaagaaagacaatagtttttattttaagtataggaagtttgtggcactgactagatattgagaattaacattatagataggtaggtagactgacagacagataatgttagtggtgtagatgagattatccaaggagaacaagtagaggaaggaaagtaacaagaatctgggggacaccagtatgaatagtagatagccttgggaaaagaaactcacagcatattaggggcagaactgaaagaaagtagctttttgaagccaaagtaaaaagagcttcaagcaggtcttgggcagtggtatcacatgctgctgagagcttgggagatgtagaaagctgaatttggcaattatcaggtcagttgtaatcttggaaagcagatttagtaggggtaggcatgaagtctgtattaaaattggttgagaaattgaaaggagttaaaattgaatgatctcttttttaaaaaaaaacattttttatgaagattttcaaacatataggaaatttgagaaaataatatgatcaaccccttgctctcatgaaatttataatctaatataggtgacatatactaatcaaaatgatcacacaaataaatgcaaaattgtaacaatgttaggtgccatgaaggaaaggtacatgatatcatgaggccacataatagggtcacttgacctagttagggaagtaaggcaaggtttctctgagaaagaggtgattgtgttaacatctaaaagaagattaggaattatttaggtaagatacaggaagaacatttcatatagaatatataaacatctattcccacatttgtgttgtgtctttgtgtttatatgtatttagtttaaaaattttggttttacatgaaacaattatatacaaattgtgctttctttaaaatatgtgaatacattattctcttttaatactacatagttttttgtagtgtaaatgtgccataatttagcaattctctttaggtcttgggaacccctttgtacccttaaaagttaccaaggatcccaaataatttttgattttgtggtttatatatactgatatttattatatgagaaattaaaactttaaaaataaaaaatttttaattcatttaaaaataataaaccgtaaaccattactttacatgttaacataaataacatgttaatgaagaataattatatctcccaaacctccaaaaatttagtgagatacagaagagtggtactactttatagttttgtaaaaatattttttttggggggaagctcaaatacatcagttttagtttttctctatatacacatttatttgctactaaaaattgaaatagcatattgaaatttccttttgttgcaatccaaaattttgaaaaccagaaaaccaaattaattattattatgctgtggccagactactcagtattttctttacattctttcctccaagttactttccttcaaattcttaatgttgggttttatctcactgacttcaggcttctaaaacacatggggatacttgagacctattgttgcttctttaggtcaaatcaatagtttcataaaaatctttgatgtccgacttaacaggatctggcaggattatctgttttttcatgtaatctgttatgatatattgtttgggttgaaataaatgaagaaaatttagactcacatcggtatgcagttggaaaagggagaactttgcagactttgaaagacttttaggatccccagagttccttggactgcttaaaaccccagtgcacacttgcccaactgctgccgtaatttatttaaccatcttttgataggcagctagggtatttccagttacttgttgatatgtgtacataaaatgtatttccatatatttatgtgtctgtatgtgtatgatagaatctagactagagctagaggttacgattatctgaaattgtgatagagtttgccaaattgccttccaaaaagactgtatccgtttacattcccactagcaggagagaggagtatccattttctcgcatttcctaacactggatattgtatttttaaaattcttgcctatcttgtggatcaaaaatgttattgttagcctgtcacattggcctgtgtgctcttcctcaaacactctaagcctgctagcacttcatggtcttcactttcattcccactgccggcagtgcccttccctcagagattctttctgtcaggtgttaagctcaaataccatgtacccctgagcttcaaataaaagttttaaaaaagtgattaaaaaacatcaagtttttttggtcaaaattaaaaaaaaaaaaaaaagctcaaatgccacccctgtgaggctttcctggactaccttttctaaatgtctatcccagctcctgccattgcattccctatcgcctttctttcttcatttttctacatagcacctctccccttcaagtatgctatgtaacttatttattttctttctctccctggaggtatttttatctcttttgttttccagtgcttagaacagtggctggcacatagtagttactcaataaatacttgtagtatgaatgaatgtctccctcacccaattagtaggaattatatatgttcataaactatttctcaaaaaactgtgtgttcttttagttcctcatttcttatctggtatacgtggtacttatttatttagtcagacatacagcaaatatttatagagcacttaatgtttgccaggtactgagcaaggaatcaaggatgcaaatatgaataaaagtacagtctagtaagagaatcagatatgtaaacaactgttgtatgagaaagaattatatggatgtcatataaacatataggcattaaaaaaatgaaaaactttttgtttacacacttctgacaccagatatgtggattttctacactgagcaattctccaattctctggacaccaactggatgtcctacaatttgactcaattcttttttaaattttaattgtaaaatattttttattgagacagggtcttgctctgttgcccaggctggagtgcagtggtgtgatcgtagctcactgcagcctccatcttccaggcttaagcaatcccccgatcctcagtctcctaagtagctgggactacaggtgcacctcaccacacctggcaaagttgctcaggctggtcttgaactcctaagttcaaatgattctccttccttggccttccgaagtgctgggattacaggtgtgagccattatatctggccaatttaagtcatttctgacactacctggagctagcacaggctcccacaggttaagggctgagtatccaaagactgcccctgacttcagtcaccagttgcaagtcccaggttgtgacctgtaacttctgactaagtggctataagttgagggttcccacaattccctcttgaggtttgataattttctagaatggctcacagaactcaggaaaacactctatttactattactggttttattataaaggatatgtggggcaagctaaatgggagagacgcatagggtaaggtataggggaagagtgcagagctttcatgccctctccaggtgcaccaccctcctagtacctccttgtgtttgctaacctggaagctctccaaattccattgttaggggtttttatggagcttcattaggtaggtgtgattgattaaaccattggccattggtgattgcacttaaactccagccccctctcccctacttggaggttgagggatgggactgaaaatcccaacccactaattatgtggttggtttctctggcaatcagcctccatcatccaagagtcacctcattagcataaactcaggtccagctggaaggggcttattacggataacaaaagatgctcttcttaccccctatcactcaggaaattccaagggttttaggagctctgtgacaggaaccagaataaaaaccaaatatattatttcttattatatcgcaaattcacaggcatattcttgagggaacatagaagtaaccagtaacgctgctagtggcaatcatgggaggctttatgcagtagtactcgatgaaggaataaagaggattagattatgctacaggaagtgacagtggggttaggggggacatctcattgtggaagccctcatgaatcaatagaattttaggaaagaaaagactggaacaaaaaaaattttttgagtgcccccacccaccagacaaaaaatttttaaaaatgaattaatgatcttcacagctgctgaagtaaaggtggggatggatctcatttccatggtagattgattgattatgaaaggaagagatgatggtccctattttatcaagaagtggtttgtgttcaaaaaggagttagtagaaagaggggattaaaaatcggagaaagcttaaatatttgaaaatcttgaggatcaatcagttaagatctgtatctttctctgtgtgatgctttaggaacagccagcgaagaagtagtgggaatattaggaactattcaagttaaaaaaacatgttaaaaggcttaacttgaagaaaagcatcaaggagaaaagctggaaggaatgaggaagtgtaggaaagtatcttaacaagtcagaatatctttgacaccaacaaggaaatatggaggaaactggctgtgaaatttataaaaaccaagaactatttcttgtagacaaaatttggcatgaacagtgaaatattaaagcccagagaacaacagtgatttgaaagactgaaatttgtccctgaatcaaatgttgggaattgagatgtttcatcatttgtgttattcaaaagaattttttgattggccccattttttttttttttttttgagatggagtctcagtctgttccccaggctggagtgcagtggtgcgatcttggctcactgcaacctctgcctcccaggttcaagcgattctcctgcctcagcctcccgagtagctgggattacaggcacctgccactatgcccagctaattttttgtatttttagtagagacagggtttcaccatgttggtcaggctggtctcgaactcctgaccttgtgatctgcccacctcagcctcccaaaatgctgggattacaggtgtgagccactgcgcctggcctgttttcagtctttttactgcaaggctatgatcttctctggtccgggagtctgccagaggagcaggaacttcccagttgaaccttattagtaaccacctggaagatatttattgaacaagtgtcacatctgtagtcttgtgtatctagaaaccttaagcatgcattattatgttttaattggaaaatgcataggctttaaaaaaaaagattgtgagctctatctgaacttttgttaagtaccacaaaattaagtttgtcagacaaatagacatttgaatcagagatttccaaagtattttaaatttaggaacctaaactcttttagaacagatcacattaccgagtaaagtgattaatgtggtttcagatgttcagcgtagaactgaatgtttgtgccttattggtatgggccaaatgaaaaaaaaaaaataaaacacacaagtttgccaaatattggtatgccttaaacatttcctgaaggcatttggtgatgaaatataaatatatctaatgtataaagtaagagagttttgtcaaaggtaatatgcagcaaagctgactagtttgaagaggtttgggttactgaatagacgtcacacaggaaaaaaaaataaactaaatggacttataagggttaatttttctgaccttatcgatattttgtggatagtaaagaagtcatctagctatttttggcataggattcaaggagctggcccactctgggtggtctataaatagtaactctaggtagcagggactggctaaacaggacaaatgtgaattggttaaaaagaaaatcctcttcttattactcattggggttaattctatgattattagtcatattttattgttgagaacctgaaatttaacccaggttttttttcttttttttaaattatcactacagactctgccttttctactatgctgtaaagtgttactttattttattttttctaccttaaggttaaggaaccttaaccttttgtttttggcaatatggtaggctaaaggtacaggaaactcattgcagtttagcacactaaaaaatgatggattgaaaaaataaatcaaaactcttatttcctggctccactggagacaaagtaagggcttctcagaggccagaaataataaaagataagatgagtctataatgataagctagcattggaagtggtgcttgttctggatatagttcctgatccttgcggcgtagtgtctggggatgggaaagaaagctgtggacccaagtgaggtgggaagtcacaactgaggcctcccttttcctctacccaaataaagccagaacttccaaagaatgacactcttggttgccaaaagaggggaacaaaagttgccctaccactcagggagactgttattaagtacctatcttggttttggctttagttagagtggaaacaaatgaaaagtctttcctgataattctttactcaaagcccctacctaatcaggttagagcctaaatttatactactagtgtgatccccccaaaatcaagacaaaaatgcagtttaggtgggcttatgttggtggtgcctgtaggcacctgagggaattgaatgcaaattcttctcagaagagacactttataaaagaaagtgtccatcctagaaaaactggagacccatctcatatgcagagacacacacaggctcaaaataaagggatggaggaagatctaccaagcaaatggaaaacaaaaggcaggggttgcaatcctagtctctgataaaacagactttaaaccagcagagatcaaaagagacaaagaaggccattacataatggtaaggggatcaattcaacaagaagagctaactatcgtaaatatatatgcatccaatgcgggagcacccagattcataaagcaagtccttagagacctacaaagagacttagactcccacacaatcataatgggagactttttttttttttttttttttttttggtgagacggagtctagctttgttgcccaggctggagtgcagtggcgcgatctcagctcactgcaagctccgcctcccgggttcatgcataatgggagactttaacaccccactgtcaacattagacagatcaacgagacagaaagttaacagggatatccaggaattgaactcagctctgcaccaagcagacctaatatacatctacagaactctccaccccaaatcaacagaatatacattcttctcagcaccacatcgcacttattccaaaattgaccacatagttggaagtaaagtagaccaatatccctgatgaacatcgatgaaaaaatcctcaataaaatactggcaaactgaatctagcaacatatcaaaaagcttatccaccatgatcaagtgggcttcatccctgggatgcaaggctggttcaacatacacaaatcaataaatgtaatccagcatataaacagaaccaaagacaaaaaccacataattatctcaatagatgcagaaaaggcctttgacaaaattcaacagcccttcatgctaaaaactctcaataaactaggtattgatggaacatatctcaaaataaaagagctatttatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaagaaataaagggtattcaattaggaaaagaggaagtcaaattgtttgcagatgacatgattgtatatttagaaaaccccattatcttagcccaaaatctccttaagctgataagcaacttcagcaaagtctcaggatacaaaatcaatgtgcaaaaatcacaagcattcttatacaccaatagcagacaaacagagagccaaatcatgagtgaactcccattcacaattgcttcaaagagaataaaatacttaggaatccaacttaaagggatgtgaaggacctcttcaaggacaactacaaaccactgctcaatgaaataaaagaggacacaaacaaatggaagaacattccatgctcatggataggaagaatcaatatcgtggaaatggccatactgcccaaggtaatttatagattcaatgccatctccatcaagctaccaatgactttcttcacagaattggaaaaaactactttgaagttcatatggaaccaaaaaagagcctgcatcgccaagtcaatcctaagccaaaagaacaaagctggaggcatcatgctacctgacttcaaactatactacaaggctacagtaaccaaaacagcatggtactggtaccaaaacagagatatagaccaatggaacagaacagagccctcagaaataataccacacgtctacaaccatctgatctttgacaaacctgacaaaaccaagcaatggggaaaggattccctaagtaataaatggtgctgggaaaactggctagccatatgtagaaagctgaaactggatccgttccttacaccttatacaaaaattaattcaagatggatcaaagacttaaatgttagacctaaaaccataaaaaccctacaagaaaacctaggcaataccattcaggacataggcaagggcaacgacttcatgtctaaaacaccaaaagcaatggcaacaaaagccaaaattgacaaatgggatctaattaaactaaagagcttctgcacagcaaaagaaactaccgtcagagtgaacaggcaacctacagaatgggagaaaatttttgcaatctactcgtctgacaaagggctgatatccagaatctacaaagaactcaaacaaatttacaagaaaaaaacaaccccatcaaaaagtgggtgaaggatatgaacagacacttctcaaaagaagacatttatgcagccaaaagacacatgaaaaaatgctcatcatcactggccatcagagaaatgcaaatcaaaaccacaatgagataccatctcacaccagttaaaatggcagtcattacaaagtcaggaagcaacaggtgctgtagaggatgtggagaaataggaacacttttacactgttggtgggactgtaaattagttcaaacattgtggaagacagtgtggcaattcctcaaggatctagaactagaaatgccatttgacccagccatcccattactgggtatatacccaaaggattataaatcatgctgctataaagacacatgcacacatatgtttattgtggcactattcacaatagcaaagacttggaaccaacccaaatgtccaacaatgatagactggattaagaaaatgtgtcacatatacaccatggaatactatgcagccataaaaaatgatgagttcatgtcctttgtagggacatggatgaatctggaaaccatcattctcagcaaactatcacaaggacaaaaaaccaaacaccacatgttctcactcataggtgggaactgaacagtgagagcagttggatacaggagggggaacatcacacactggggcctgtggtggggtcgggggaggggggagggatagcattcagagatacacctaatgtaaatggcgagttaatgggtgcagcacaccaatgtggcacatatgtatatatgtaacaaacctgcacgttgtgcacatgtaccctagaacttaaagtataataaaaaaaaaaaaagaaagaaaaatttccagagatacagagccagttgaacatgagcacatgtctgcttctttccctcaaaagtcattaaacacaccaggaaaccataccaccatgaataagagttagaaaaaataaactacagaatcacactctgaaagactatagatatttgaattatcagatagagaatataaaatatattaaaagacagaattaaagtctggtaaaggaacaaaagactaccagaattggccagaacattttgaaaaaaaatctggaaataaaaatttaagttaaaattataaaaacaatgaccaggttaagacagcaaaataggtatacttggaataggaacagctccagtctacagctcccagcgtgagcaatgcagaagatgggtgatttctgcatttccaactgaggtacagggttcatctcactggggagtgccagacagtgggtgcaggacagtgggtgcagcgcaccgtgcatgagctgaagcagggtgaggcattgcctcacccaggaagtgcaaggggtcaggtagttccctttcctagtcaaagaaaggggtgacagacggcacctggaaaatcgggtcactaccaccctaatactgtgctcttccaacgggcttaacaaacagcacacgaggagattatatccagcacctgacttggagggtcctacacccacagagcctcgctcattgctagcacagcagtctgagatcaaactgcaaggcggcagcgaggctgggggaggggcacctgccattgcccaggcttgagcaggtaaacaaagcagctgggaagcttgaactgggtggagcccaccacagctcaaggaggccttcctgcctctgtaggctccacctctaggggcagggcacagacaaacaaaagacagcaataacctctgcagacttaaatgtccctgtctgacagctttgaagagagtagtggttctcccagcatgcagcttgagatctgagaacgggcaggctgcctcctcaagtgggtccctaacccccgagcagcctaactgggaggcaccccccagtaggggcggactgacacctcacacagctgggtactcctctgagacaaaacttccagaggaacgatcaggcagcagcatttgcagttcaccaatatccgctgttctgcagccaccgctgctgatacccaggcaaacagggtctggagtggacctccagtaaactccaacagacctgaagctgagggtcctgactgttagaaggaaaactaacaaacagaaaggacatccacaccaaaaacccatctgtacgtcaccatcatcaaagaccaaagatagataaaaccacaaagatggggaaaaaacagagcagaaaaaccagaaactctaaaaatcagagcgcctctcctcctccaaaggaacgcagctcctcacccgcaacagaacaaagctggacggagaatgactttgacgagttgagagaagaaggcttcagaagatcaaactactccgagctaaaggaggaagttcgaaccaatggcaaaaaagttaaaaactttgaaaaaaaaattagatgaatggataactagaataaccaatgcagagaagtccttaaaggacctgatgtagctgaaaaccatggcacgagaactatgtgacgaatgcacaagcctcagtaaccaatgcgatcaactggaagaaagggtatcagcgatggaagacgaagtgaatgaaatgaagcatgaagagaagtttagagaaaaaagaataaaaagaaacgaacaaagcctccaagaaatatgggactatgtgaaaagaccaaatctacgtctaattggtgcgcctgaaagtgatggggagaatggaaccaagttggaaaacactctgcaggatattatccaggagaacttccccaatctagcaaggcaggccaacattcaaattcaggaaatacagagaacgccacaaagatactcctcgagaagagcaactccaagccacataattgtcagattcaccaaagttgaaatgaaggaaaaagtgttaagggcagccagagagaaaggttgggttacccacaaagggaagtccatcagactaacagctgatctctaggcagaaactctgcaagccagaagagagtgggggccaatattcaacattcctaaagaaaagaattttcaacccagaatttcatatccagccaaactaagcttcataagtgaaggagaaataaaatacttcacagacaagcaaatgctgagagattttgtcaccaccaggcctgccctacaagagctccggaaggaagcactaaacatggaaaggatttataatcccaaaggattataaatcatgctgctataaagacacatgcacacgtatgtttattgcggcactattcacaatagcaaagatttggaaccaacccaaatgtccaacaatgatagactggattaagaaaatgtgacacatatacaccatggaatactatgcagccataaaaaagatgaattcatgtcctttgtagggacatggatgaaactggaaactatcattctcagcaaactattgcaaggataaaaaaccaaacaccgcatgttctcactcataggtgggaattgaacaatgagaacacatggacacagaaaggggaacatcacacactggagactgttgtggtgtggggggaggggggagggatagcattaggagatagacctaatgctaaatgacgagttaatgggtgcagcacaccaacatggcacatgtatacatatgtaacaaacctgcacgttgtgcacatgtaccctaaaacctaaagtataataataataataacaaaacaaaaaaatagatatacttgaagaaagaaatagtgaatgggacgatggatctgaagaaattatatagaatgtaacacagggagacagagagatagaaaatgtgagagatattggacaagaggttatgccaccataactaaggaataaagtaacattcccagtcatgagacatattgacatctgcagctcctgatgggatgcactgagaagggcacagtatcacttctatgatgttcttgtcccaaaaaatgtataacctgaattgtctttaattttattttttatttttatttttagagacaggatcttgctttgttttccaggctggagtgcagcagcatgatcatgactcactgcagtcttgaactcctaggctcaagcctcctgagtagttagtactctagatacacaccaccgtacctggctcatttaaaaaagtttttttgaagtgatgacatcttattatgttgctcaggctggtctcgaatttctgggctcaagtgatgctcctgcctcagcctccttaagtgttgggattgcagatgtcagccagcatgcccagccttactctggaatcttaaaaatattgctaactgagccctacccaagacctatgaagtctgatagggtaggtcaaaggcatttgtttgtaaaccaaacatttttcccaggagattctgaagtatgtctagggttgaaaactgttgtgtgtagttttgtatttctttcttcctatacattgttttgtatagttttgtatttctttcttcctatacattagccactatggaaattgtaaaagcacttattcattagattataagataatgtacgtaagggaagtttttattaaaatgtctctagacagacacctctgtatagataggtttgtctcatatacttgaggacatttatggacctctgttttggacagagtaggggccacagcataatctgtgaagggaacttcttcctggcacataggattgcagattatagattcctttgttatgttttcccctttctattttaaaggtcactatagtcatcctcctttgctgcaaatcataaatgaacatactaaggaggttttaaatatgttttagttaggtcttaaaaaaattaacaaatgtttggaattgacagtgcttttaccctgtttttgttctgggttaatgctgcgccctcactaggtctggaatctttatagtttgagacatcagacttggatgaggaagggtaaatcatgctactagtgggccagttactctgtggttttcttatgagactgtgctttaaggaaaaggtaaccacggagcatatggcattgagtttgagtcatgtggaactggttagaagtaaaatgtttctattccagcattctctgagtttgtcagcttttcattattttataggaagaattctagcttcttatcctgagatgagcttgtctccaaatctggttccaattttttgttgttgttgttgagcacatttcgccatatgatatcactattggctgtaggttaaaagttaccgtgtaacttaaacgtcagaattcaaaccaccaagtatacacggttttgttcagccagatttttaaatgaaatctaatttgagtttttggctaaaagtactttccacatttatcaaagtgacacatgaactgaagaaatacaatgtatctgagtaccaggtgttactgaatctggaattgcaggagggtaacagagccaaaggcagtcctttcctcaaatagtcttaacgtattcatgtttgtcaaaaatgtgtctacacaaagtaattggttctcttttctctgtagatttcatcctttgttgaaaaagatgtcttagaacctatcaagtgcagagctgggttttgagggcatggaaaattctgttgatgcttttctctagttttggctttcatgtgagttgtacatagggaggcttataaggagcatcctagtggctttaccttgtatcacttggctactttttccccacacttcattgttgtaatgaagggaaaggcagctgaaaccagaaacctacatcccttgccaacttaagagataaaaggaaatttatctcttctgctttctacctagtgagaaggggtcggtgagaaactaggccaggtgagaaaactactatcagagtttaagttgagtacttcgatatgttcttcagaccatacatcttagttaacataaaacaaggactagtggatagtttgtgtgaaatagcattttcaaccaccattttcagtacttaatatagctgggtggaatcatgctgtgtaagtgctgcagaacataaataataaaggaaataaacatcttaattttgtaacaagtgaaggtctaggctaatattaagggtagtataggatacttttgaagcttttgaatgtacagaagtacatatgtaattattatatattgcttagacttctaggcagtttgccattcatgtcttttttgtctccagattgagctgttttgtcacattagtgagcatttgaaacataattttaagtgtcattctacaaatggttcttaattgatttatgactaatgtcagtatgaactgcaggtgtgtgccgtgcctttggactttttggtgtctgtgtgttctgaacataaattggccttagtatgttatgcacactgtcagtttatcacaatccatggcctctgaggagccagaagtacggaatgtacagacgatctatgtaccttatattattttctgtctcagccctttcccagaattcccaataaagcagatttctcaattacttgcttttatttttcctttctcccatttttttttttttggtaaattaacaatgagagataaatggaaataaggcagttggaagaaaagaggatgaaaacaggtgaagattcttagttgtggaataagctaggttggctatgggttgataccatgtgtgcttgggtagtaaaggtagctagttttttctgcgtgttgtattaagccattatttatcaaatactaattacgttttatgcactaaatactagtccaagtattctatttgatatatggattaattcatttgttcctcctagtgccatgaggcaggtattattattcctgatttacagatgaggaaaccgaagacacagctaatatgtggcagagatcagaatcacaatctgcctctggagccttggcttaatcactgacagagcaacagccactcaggcagagaaaaaggagttggcatttacagttagaggagttaggactttagtaactctgcccgtttccctaaagcttaggattggctgtgataggggaaagtagcttatgaattgactggattgatgtaagtataacagaaaagagagattgtactcaaatttacagccatgttttttgacatttagaataatcagaggatacttttctgtagtgagaaatatacaaagagttgttcacacacacaccttttatattaaacactgactcagtgatgtcagcaatctaattactatagagtatcagttatctaatactgtggaacaaaccaccccaaaacctaaacgcttaagacaacagcagttattattttggtaaagaaatctgcaaattgggcagagttcaggacagacagttcttctttgcctccgtggagtgttagctggggtggcttaggttggaggacccactttcagattggctcattcacatggccagtaagttggtgacggctttcagctgggacctgagcctgggatgtgggccagggttcttggtttttcttcatttggacctctccacagctgcatgggtttcctcacagtttagtgtctgggttccaagaataagcatcatctattagaatagtgcttgctttataattgcttattgaatgaatgaaagaatctcaggttgttttcttgctcatgttggcccatttggcaaatagccactgtaaagtgcaggtttcttcccagagcacggtaatccctggctctgagaactgctatttagagggttcttttatcttgacttgaaggtctatttcttcatttaaccacatttatgtttctaataaattacccccagttactactaggctgcaaaaatcatctctgaaccattcaataaacagagaaaagaaaacctttttaaaatttggaaactaccttgaaaactccccattttttcctccttttagtctcagttgcattgaaagttaacataatgttctgttcctggatctggaaatggtgtaatagtgacttcaccacctgccattcttgagttgtgggttagtttccctaaaatgtagatcttgacaagaggcagatggtgcatgaagtttatttatttgtttattttttgaaaaaggaatacctcttatgaaccaggaactagaacaccccttagcttacattctaacaagaagagagacaataaacataagtaaaatgagaaaattataaattctttggacaaagggataaagtatagtagggtaaatggttttacatgttgaagggtagttgttgggactgtagttttatttacttatttttaattttttttgaggcaaggtcttgccctgttccccaggctgaagtacagcaatgcaatcacggctcactcagccttgacctcctgagctcaagcgattgttccacctcagcctcctgaggagctgggaccacaggcacactccaccacacccagctaattattgtattatgattattattatcgtagagatgaggtttcactgtgttgcccaggctggtctcaaactgctgggctgaagcagtctgcccaccttggcttcacaaaattccgggattacaggtgtgagccactgttccctgccaggactgtagttttaaatggtgatcactgtaaggcaggtgtttgagccaaggcttaaaggagaggagagggttagccatatggatatctgaggaagaacagcattcttggcagaggaaacagccattgcagggatcctggggtggaaatgtgtcttgcatgttcaaggaaaaacaaggtggctttgctaaagagagagtagtaggagatgatgtcagagaggtgagatacagggagaggtcaattgaggtaagacttctgtcgttttaaagatttgggcttttaccatgatagaaatgggaagccatcagaaggttttgagcagaggtgacataataatctgacctagattttaaaaggatcactttagttactatgttgccactagcctgaacctggtaggcaggaagacaagtgtcctgctctgtgtcatctttgggctttataaaccatgttccatctgttgtctcatttgaatctcaggaaaaccttgtgaaatatttgttatttttcatgttttacatgtgaggaattggaggcttagagaagttgaccaagtatcccagacatactcaagtgagcagtctcagagtaacatcttgaacccagatctcctgtctccaaattttgtgctcattccactatttcacattaaaacctgaagatctccctgctcttttcatcttaacgtaatttcagctttttgtgtgtggctctccaagccacagagcagcagcagcttttgaggataagaagcagtttcttttaaggataagaagcagtatggttcttacctggtaagatggcttgaattcaaaattgacctacttgtaccataagaaagcaggtttgcaaggagtagaatagacttggagatatgccattttttgttcagctacttggtatgaagactgagtatctgaaaccacactgtaaggattaagtggcttcataaataatctaaaacagttgttggcttttagaatttaataaatgaaaaagtaaggtaacaattcttataatactttttccagactttcggggaaattgaaatcatttgtgttttattaatccatgcttttcaggaccaatggcccataatgtgagcaaggtttattggtgtaatgattattttgtggcctaaaactactgtgactctttggactagcatgtttctgatcatagagacagctagagacttcttcttttttcttaatatttgtagcttgttttaaacgtactgagtagaacctgatttaagcaattatacaaagtttggttagattgctttattaatattatgaactagaaacagtcaccaaatgcgcattcattatactaatccttactatgattgagtcatttctttgagttcttggaaatctaatttttctaaaattaacaaaaggggacatttgaatgatgcaaaagcactcatggcaagaatctaaaagttcatataaataataattttctcatactcttttatacatttgaccattacaagatctgtcaaattcctttcaatatttgtgatgtcacagtcgtactaaaacaatcttgaattctggcagcgaaatgaagttcttacctgtctttcagatgttaataaaaataagggaaatacaaacctgtagttattcagatggttaaaattagtttctgtgggtcatttcatagagttcaagtatttaaatgtttttttagctgaattggacaatcaacttgtctgtaatttagcttaagagaaattccattttaagacaaaaaaactacagggaatgtaggccaaaaaataataacaaccaaaaacaaacaagtgaaaaacgttaaaagattcttagcagaatttattaatatattacctcttcaaaatatattctagccaatggatagataataaaattgagacccacagactatttggatcctaaattttgtttcatcatgactcccttgttgaaaatactttattgactctgtgtaatgtaaataagataatttttgtgaagctcattgaatgcgtctgagctccttaactcaaaaaaggctaaaagttactgaaatagctatggttaagggtatattgtcattacaatgtgataatcattaccaaagtgggcacttggaaaaatagtgaccacttatgagccaaaccaatcaacattaaaactgatttccagtaagtacagctgccaagtgattatagagcagcctggatacagatgggatagactacaaggatagttaagctcaaagcatttgcctgttaacagccatgaattgtgaggtgaaatgccagtttacatagtgttagtaaaatcattaaaagaacaatgattagtagaagaattctttacaaaccttaaagtatcaatagttctgaattaattcaatttataaattatccataagtcatacaaatagccactttgtactttttcatgtccctccaaactcccccagtccctatttccaaactgtccacttctgttgaatctattgtaaaaatgtgtaccttttagggaactgagataggaaagatgtgaaaaacaggattagtttagaataatggttctcaaacattggtaaagtcacctagactagtacaaccactgcggaaaacagtgtggagattccttaaagaactaaaagtagaactaccatttgatccagcaattccactactgggtttctacccagaggaaaagaggtcgttaaacaaaaaagatatttgctcatgcatatttatagcagcaaaatttgcaattgcaaaaatgtggaaccaacccaaatgcccatcaatcaacaagtggataaagaaactgtggtatatatatatgatggaatactactcagtcataaaaaggaatgaattaatagcattcgcagcaacctggatgggattggagactattctaagtgaagtaactcaggaatggaaaaccaaacagcgttatattctcactcataagtgggagctaagcttgggatataggtgcaccaaaatatcacagatcaccactaaacaacgtactcatctcaccaaatgccacctgttccccaaaaacctatggaaataaaaaattttaaaaaaagataattattaatccagtttttggtgaatcagtgagtgacagtggttatagtagtggtggtttaaatcaaggaataaatgttttcaaagtgaaaggagcacatcctaccacacagttcaaaaacaatcacaaatatggcaggcttgctgagagctttcatacatcatttattgtcatgcacttgtatgattattgtatactgtacacatttttattttacaatgatttgtattttccaatgcgtttattgcagttcagtgtggtagatggctggagcctatcctggtagctcggcgcacaagtcaagaattaaccctggacagggtgccatccctttgaagggtgcactcacgcatgttccgcacactcattcagactggagccatttagacgtgccagttaacttaacatgcacatctttgagatgtgggaggaaactggagtacccacaggaaactcatgcagacttggggagagtatgcaaactccacacagacagtgaccttggctgggaattgactttttttttgtcatcagtgttatcacaaaatgacattgcatgaaccagcattgtttgaagacttgctgtattctgattttttttatctttcatctttgagtcattagcaccaaatatagttcttggaacataataggtatttactacatgaataaattaatggatgaatcattcattctgggaaatgttgtcaacatagtgcagtgatggaattccaatcctgaatccaaatcctgactttcttagttatttagagcataaacttgggcaaactgtttaaactctttgagcttcaacttcctttgagccttcatttccttagtacatagtaggtactcaaaagtggtagctactgttaaaatatactgtatttgcatcttagaagagcatttaacattcttgtgatatctttatggtcaagatgggaaattttgacctaggtggtatttcagttaattcataagtagataaacctacgtttttacagatttagaaggagctttttattttaataacaactcagtacaggatattgatggcatgctgatactttcttggaagaatttcttttgctaatgaggagcctaaaagttcttgattgattagtaggtaagtgtttttaaaggaattgatataaattattcagctggatcctaaaactcagttacacaaattcagagttgaggtgggataggaagagaagcaaaagtaatggttcaaaatcgatttgtgtgaaaggacttagggttttaattacactgggctcaatataaatagagtgtaatataactgccaggaaagcctatgcgatattagactgcatcagtagaacaacagtgtctagaacaaatggaggaattatccttttccattctgtagtggtcatactacctaagaagtactgtggccaattctggacattacctctgagaagcatgtttataggacagtgatcaaatatgctaaaggaacttcagactatgctgtaaagaggagcatgtgaaagaatcaagaaactataatcttgaaaaagaaagcctggggtaagggggatgttagatgtctttggacattagaagaaggcttacttagacttgttctggatagccacagaatccagaactagtatcaaaaggtggaagtttttttgttttttgttttttaaaaaggaagcacatttctagttaaaacaaggggaaactcttaataattagggtggtagagatactggagggatcagggagtgagtacttccaccaaacaggaacattagtatatggatatttcactaataacaatagcggggtcagtaggggttgaattaattgagattctctaaacttaggggaaagttcttaactttgattttattcatagcttactttcataattagaatttttggcaccatgcttgaaagaaaaagtaaacactttttttttaaagttagtttcctaaagaagaaataaaatttcttagttgtcatcacactcttcatttgacttccctcccaaattgctattgttttctgcttctctcatgttttcttaaatactcatcagggtgacttttcttaagtttagacagacattccactaggtctcttacctcatttgtggcaaggtttatattgatgtgtgactgctcaggtaaacctttagtctgaatgatacagctatgacaaaatatagcctcagttgtagcaaaattaaatgttacacaatggctttaattggtggtacacctttgaagagtttgcagtatgcccaagtgctaaagcataccatgtgagaatcactgggtagcaatgatttctgggggtgaagaattgaggagaatggaaaatatattaagggatcagaaaaatattctagagaggtgtgtctgctccccgttttcccccaacactgatttccccaaatttggagacaaactactattatctcaaagaaccgcttttcctttagaaccacaggctccttaactaccctttttcattagccttactttcctcttgcattttatccctccaaatagaatcttttgtgcttctctagggagattccctttgtgttgaattttatgagtagtgtaaattgtgtgggttgcatcataaaacaaagtgcgaacacacacacaaagtcttattgatgagccaagttcctaagcactattaatgagttaaaagtgttaattaaggctgggcgcagtggcttacatctgtaatcccagcactttgggaggccaaggtgggaggatagctttagctcaggagtttgagactagtctgggcaacatagtgagacctcatttctactaaaattaaaaaaaataaaaattagccagatgtggtggcacatgcctatagtctcagctactcagaggggctgaggtgggaggattgcttgagtccaggaggtcaaggcttcagtgagctgtgattgtgccactgcactccagcctgggtgacagagtgagaccctgtctcaaaaaaaaaaaaaaaaaaaagttaagtaggcagtatttgcttatatgtatatattttgttgttttctccaaatgcttatgcctctgaagaggatatacattgatgagtgaagatattagggagggtagggagaaagaatagaagtttttacatataaatacaaatagaagtatttaaaaaatttttttttcttagctttatctgatagcctgccttctggaattgtgaaaggctaacaatgaatttgacttttattcctacttcatttgaagtattctctcattgaaaacaccagtttgcaccatccaggaggccttcttatttcagttattattggagtttaaaatttgtttttaggtgtgtcgtatttatttctacttcatatatacatgtaattatcaagtttttaaaacatatagaacactactattgtttaaacagtttataaataaggtacttttatacttagaaaaattgtttttgatatgtgcaggttaccatgctaaggatttgaacaccttcagtaccctatttgtacttgcgtctatgcctagcatttttgttacgtgcatggatctgcaaaggaattgtggtttgtttcacagctgcatgtagcaggcatatgtgtgacatatttttatttcagctattatttcctgttttttattttcagcatgttggaacaggattccaggagaatgaaccctagtgtgagccctgcaaatcaaaggaggcaccttctaggattttctgctaaagaggcacaggacacatcagatggtattatccagaaaaacagctacaggtaagatggcatgcatctatcttttggcctaagtgatttaatgaagctgaaacaagagaattatctgtagtataacattgcatctaaattgttcgtgtatattttgagtagtagaacacataaattactgaaaccattaatacattttacttttaatattgtaaaattaaatttactttgaaaccttttgtagttttaaaattcctatagagatgtaatcttaaaatctcagtttgtgtgcattaatatacatattgaaatatatacatattatatataatgtctttaataattattttatctatcatgtgtttatacatataatacatctaatatttgttactgtctcacctgtggatggatatgatatggtggaataacatgattgaacctatttgcagtcattaggtaaaatcatttatactcatttattgtgatctttgttgaatccctcccttgttgcaatttaataatgacttgataaatttccatattgcttgtcaatagcaaaaggctttaattgtataaaaatgcaatttctatattatgttaactagaagaaggtatagtggacatttttatagttgtatactttttgataaacatttccctgtgttatttagaatttgtattagagccaaatggagccaggtccttgactaacaaggcaaagggaggtcacagtatggtaactattgcacagtataatgcttgaaaattattacagatttgtttacttttatctctttaaggatttgtaggttgagggcaatctttcttcctgatttttactgtgttacatccatactgttgaaagatgatcaccacaatcctgcaggcttgtctccacttagccttcctgaaaaaactgttatttttgtggagtacagtatgccaagtcagtggaggacccaaaggattttatggcagtagctgcaacgcaacatagcaatgatagatgtcataatgttggaaaacatagcatttcctgcttttttacatgccaaaattcatcatacttcttaaaatattcaccttgatgatctcttaacggtgcccctgaatattggtagagtttaatagtatatttaattttcataagtaatttgtgcaggtttgccctacgtgttctataattttgaattctgttagtgtccacataagatccatcaaaaattaaatttaaatctaatagcctttggatttacgagagttgagatagcgtcttgctaaagaatagaacaagttatggattgaatgcttgaaattacagttcaggtaagctttacaagaatattatttattctgcactaactgcagcaagtagaagccttccacattagcataagataacatggtggctcccagaaagcatagtagtctgatcatactagttcaaactaaaagtctgaatgactttctggctgaaatttatcagctttcagagtagtacatgggatgcaagctattttttccctcccttctccaaagtcaccattgagtgaataatctgggttactggtcttggggaaaaaaaaaaaccaaaaaacaacccaggaaagattatggattcttgattccatgcaagtcctttgaaatatttttcagcaacttgagagatttaaataaatgtcagtccattaatttgatgttcttgattttatcagtataaatactgaataaaagataccaaaaaatgtttgtgaaacatttgaaagcacctaatattactttgttctgtgttctgaactgaattttagatgttttatctattttcagccgtgatacctatacattttttttaatgcagcttactttatgtttctttttctaaggagagctatgagacatggttcaaataaaaaatgagtagattctaatcccatagtttataatattgtattagcctatcatttagtaattaactgcttatattttttcagtcatagaaatgtgtggcatataaatagtatgaccatataatgttctatcaaactgggacactcttaagaaggaaaggtagtgctagtaataattacatcagaataccagtactgctgtcttggataaatgagaaaggatggtcaccctatataagatgtcacccagaactgatctttactccaagaattctcattaactctagctccctagcactgtcctttactttatttactttaatgatttatttgttgaatttttttctcttggcataaaatgtttgcaagcagactcgaactctgactgttcctgggctaatgttggtctaattgtctccagattgtatgttggctgattttctctctcctttaactccacccaatccttgtcctggtatttctcctatcagactttttttttttttttccaaagaatatttttggctgatagaacaaagccagttagcacagatgtgcagaaatcattactagagttcagatcacaaatatattttcaaaagcagttttggacttttctcatggactacagtgtttgtatttttctaagtatgcaggcatgatttttaaaataatgcgtatgtcatagatttataagaagaggtgttaagcagcctcctcttagaggcattcagatttatcaaacacaagacagatactttttttccttctcactcaatgcttcattttaggctgatccttttgtgtttgcattcattacctgtgcaccaacatgtctgttttattccaaacaacttaaacctacttaacccttacagccacaagagaggacattgagaatattcctggtgcaagttgcagggaagaatgttctatatatcctctgctattgtttcttttctctcgtgtgtggcataaatagctatctctaacttttaacttgaagttagccttccactctgccagagttatttctgttaaggggccagtgctttctgccatcttacttgccctttcctcagcatttggctgtgtgggtcatttgctccttgaaagactttccttttgtgttactatggttttttagtttcctttttttattggctgctgcttcacagtaatctttgtgggctctttttttacccaactctcaaggtttggaactgtaaactttttttattttctttctgcctaggtgactcatctataatttcatgcacagttcatatctatatgtcctgatgactctcaaatttatgttttcagtccagacttctcttctgagtctccagagtcacatatccaatagtctctttgacatctctgttttaacatttcaaacttaacatgtgcactgtggaactcagttcctctccctgttttacttccaaccaattttctacaactgtgttttttcctttccattgcttaagccagaaatcctgattcctgtctttcaacaagtgttgttgatactcttccccaaaattgtcttgaattggtccactcctctccgtctctgctgccacaaacctagtccatgccatcatcagttcttgccaggattgccatagctctttcctaatcagtgtctcagcttccccttttgcctccattgagtccatttttggtaccatggcaaggtatgaatgtaaattgaaatatatcacttctttatttgaaacacttttatgacttcttattacatttagtaattccttattatgacctggtcttttattatgaccttattatgattcctttccagcctcatcctgttccctctctacctccccacttgcttgcaactcttcagccagtggtctttttaaagttctttgagcccacctttcccccacctgcctcttttatgcctagaatgctcttaccccagtttctatagaggcggcgtcttctcatcatttaggccttgatgtaactaccatctccttctcggaccattttatctaaagtatatactaccattgcttttccatttcaaccatttgtttgtttctttcatagcacttactagagttcggattattttatgcatttattttcttctatttggtccatcttccccattaaggtctttggggacagaaactttgattctctcattccctactggattctcagcacctagcacaatacctggtgcacagttggtatgcagcaagtatttgttgaatgaataaatgaaaagtgtgagtctcactatgttcagttttatatgtttacatgttttcttttgagatattagcatatctagttttctaaatccagatcatcctatataaagaaattcaagagagatgcaagctttgttagtgagagagattaagattgcagactgaagagcataaataacagtaatatccccatctcaaattctaactttcaactccagttttgctccctacgtcacaccttggatatgaattcacatgatctacatcagtgcgatggctaggaaagtatatatttttgaagcaaatggagtaactagttaatgtcagtcactctgttgttttattagtgattcacattcttccatgatcccatagtttatattcggcttttcaactctttcacttttctcctgccaagcattttatgtctcaccctatccttaacatacacacacacacacacacacacacacacacccctacctgttttacagatactatccagttttatcatagaattgtgtctcaccctatccttaacacacacacacacacacacacacacacacacacacacacacccctacctgttttacagatactatccaattttattatcatagaattgtgaatgacccctaaactttagtctggtcacataataccacttgattttcgcctcaattaccccgttactgtgttactacctctgtaccagcagcattgtgcatgtcttaagctcattgaagatatgatgaaccatgtgttattgtatcgcttattccaaattaattgctcaataaatggtgattagacaaatgtgaattaccatcctgtctctgtagaaaatcagaaaatgacatttcatgtaaaataaggttttgtattttatactttatcttgcagtatattctgtttactatatttttgtttccatgaaaagttaacactaatgatgattttcttatagcaaacttcttaggaatttaagatacaaggaaacaaattttgtgcatccatgtttcagatatgatcattctgtttcaaatgacaaagccctgatggtgctaactgaagaaccattgctttacattcctccacctccttgtcagcccctaattaacacaacagagtctctcaggtgagtgttgtagattattgcagaaacatctgagttggttcccatgtttagttttggaacctagacaagtaattggtcaagttcactaagtgactgagagaatctctgaattatttgtggataactgtaggcatattagttgtccagtttctccaccaacctcatggagatggtgatgggtctattttatgtgatagttgcttacttaaatatgtcttctttaaaaactacagaatgaaattaatattaaaatttcatggtgttaggcttacagttggtaacattcatagcagaaagtacctttttcttccaattaggaagataataatttgtgggtatgtgattctggagatactttaccgttagtacacacttctttatcaatttttcccttgaatttttttttcctgtgattttggaccttacccttaaaacctcaaaaactacctcagattttttgtgatatgtagtaatcaactacagttaaacatagtttaacatcttcacagctgctgtaaaaagtaagcaaaataagggaagttatatatgagctatgcttttatttcgtgtgttgaaaaatttgaatttttttttaccccaggcaattgagttcattctttttcttctcccaaaagagcatgattttcaagaggttttaatgcatctatttgttgttaggggtcctatgacttgttaagttctctacaatgtgtctcaaatgtttgtgtttatatagcccaagaacagaaataggaaatactttttattttgttttgttttattttattttatttttagacagggtcttgctctgttgctcaggctggtgtgcagtggctggatcatagctcaccgcttccccaaactcccaggctcaagtgatcctcttgccttcgcctcctgagtagctgggactacaggcacatgccaccatgcccagttaattttttaaaaaaattttctgtagagacagggtctcactgtgttgcgcaggctgatctcaaactcctgggctcaagcagtcttcccaccccagcctcccaaagtgctaggattacaggtgtaagccactgtgcctggcaaggaaatactttttttggtggaaaaaccttagcatccagtgtttatatttgggaggtatttagctgtagttttctttgaagtttgaatgcatggttgacaggtttaccatgtaaaaatgcatgtcttattaaaaacaacgttaagtgtcaactttttcaaatcaaaaagcaatattgagtcatcaggcacttggaatgctctttggaacctacaaatgattagattcatttccacccacagggtgaaacatccatttctatgtttaattaatttctatgtttaattaattaaactatattttataggttaaatcatgaacttcgaggatgggttcatagacatgaagtagaaaggaccaagtcaagaagaatgacaaataatcaacagaaaacccgtattcttcaggtatgtttctgtttgtctttgaacaatagttggcgtatttgttggaaggcttctcccagctgggttactctcttccctagaaggttggtaaacttgagctttagcctcttcccactgtctcctgctgcttccgatgcagctatcattgccactgaagtcctcctcccaggttttatagcactagtttaggttttatagtattagtagttccctgatcaggcatcgtgctatttcttgctctcaccttcaaatttgctttcaagccaggagttcctatgcatggatatctatatcaaatgtctttgtcacaatggtataataaataatactgcttatctcctcttttcttagagcttttcaaaaagagaatgttaagacctggggcagtttggaaatgaagacatccatttctgaacttagacatttactactatggtttaatgacaggtcttacttagaatctgttaagtgggggttccatctcaatgttgtttgccacaaaacaccattaagtcattccgtcattcatcaaatatttgttgttagaatttagactagcaactggcatctgcaagttcccaataatgagccaaggactgttcttgatcctgaaataaagtaatgggtatgataaagtccctaccttaatggagcttacactctagtgcagagctaaacaataagcaaataaataaatacacaaatacactgaaaattagagctaagttctctaaagaaacacaaagcagcataggaggttagaatttgaattgagaaatgagtgactagactgagtggtcagggaaggcttctctgaagaagttccactttaagacaacattgttaaggtaattaatgctagctgttataacagccccaaaatctcagtagcttaatggaataaaattttttcacttgcacaaaatttgacttcactttctaggattgcttttctccaagcagggagtaagggatccaggttccttctattgtgtagccccaacaacttgaaattctttgcttcttgcttgagatgttagggaagaaagagtttggtggattgtgcaaaatgttttaagaatcaggcctggcttttagccaatgtttagttggctaaaactctgtcactttgcccaaactactgttagaaagactgggatcatgtatctttctgtgtgctcgagaagaagacaagggtttggtgagaacattgcttttgccataggcagaaaagtcactgaaataacaatgtaaagatttaggggaggctgggcgtggtggctcacgcctgtaatcccagcactttgggaagctgaggctggtggatcacgaggtcaggagatcaagaccatcctggctaacacagtgaaaccccatctctactaaaaaatacaaaaagttagccaggcgtggtggcgggtgcctgtagtcccagctacttgggaggctgaggcaggagaatggcatgaacttgggagacggagcttggagtgagccgagatcacgcagtccagcctgggtgacaaagcgagactccgtctaaaaaagaaaaaaaaaaagatttaggggaaaatctggagaaagagcttccagacagagggaacagcaaatgtaaagaccctcaggaaggaacatgaagaagctgagtacgactggaatgcaggggctgaggggagagtggtagatgagattggagaggcagcagatgtaggctcatagcaaacttcataggctttgatgagaactttgggtttcatcatgggtttgaggggatgccattgaaaggtttgagtaggggagtgacttgatatgatttatattttaaaaaattagtagttgctacataaagtggaccatggtggggagtatgactggaagtagggagacaagaagccattttagtgggctaggtgagagaaattgttgtggtccatactggtgtggtagtcgtgaaggtggcagaaagtacctggatgccaaatatattttgaaagtaaagctgatggaaattgttgatataatgataaatcctatgcttaggtactggatgattggtgataccatttactgagaccagtactggggaaggagcagttagaggtggaagtcaagaattttaagtatgttaagtttgttatggctattaggcattcaagtggagaagtcaagtggacaatcaaatatctgggtctggagtttaggagagaggttgaaactggaagtttaatttgtggtgctactagctagagagaaataaagaggaaagaaaacagagtgaggtaccaagttctgggccatctccaacattacaggttgaaagagaaagaggaaccagtacttgaaaaggaagaagagtagctggccagtaaaataggagaaattgtagggatagtggtgtcccaaaattcaagcaaagaaagtttttaaagaaggggatgtaacagttaattacaggggctaagagagctaagagatgctgattcagataaagagtgagaaattacttttggaattgaccatcagaacttgttagtgaccttcgtgaaagttctttcattggagtggtgatggcaaaagccaactgaagtggattcagggaagtaataatagagggggaagtgaagaaaattatttcagggtgatccctatacatgggaatagagaaatggagtagctacaggagtcaagaaagagttttatttttggatgggaaatatttcaccaggtttacatgtttacatgctaatggaaacatcttaaactatttaattatttcctgactaattggaagcagtatgtgttatgttctaaagtacattaaaaggataacaagaaacatgggtttttaaccattatggaactgttttcatacataaaatgagggctagtctaggtgagctcaaactctgacattctgaaattctgtaattatctactgtgtgcttctcttggcctctccaacttttttcacctactatagtaggcaactttattggttgttaatactaatagaggctgcagacagtcattaacaatgtcacatgtaccccaaagtcccaaagctgcttattggcattggtatgtggagcctagtacttcaaaaattcatgtctgccaaagcctacacgtcagctgctaccatggtcagaggaaaaatggaccctctctcccttctgctttccacatctgaagcaagtgcatcttattggcagaatctaaattatatccagagctctggtggcaaaatagtttgagcgatataggtttcaggcttccatcctttgctacacagaggaagagcacaggagtcaggaatagatcattgccagtaggtaatcccacacagctagtataattaacttaatgaaaaattagattaaaattcttgccctaaatgctttttttttggccttatcattagatggaacttgtcatgtttttctttcctagtcattaaatgaatagagcatttactgtggaaggggtgcttggtattctttattcttaaaggaattccaatgcaagaaaaagaattttgttttaattttactgtctttgttcatttggagatgtgtagtttaaagtcttatttcattctgtgctattttgggtacacttctttctgtagggagcttagatatgctcagaaatgtgagaatcttagctactatagaagggaatgatggggaagaatctgtatttgtcagtagtatttgtcagtagtaaagaagttcctggttagaggaaggagaagaattattctgcttttatgctgttgtcaatgccaaagcatatcaagattttaaaaaaattctgtttcttggtgtaaagagcctgtaactgctctcctttttcttttctcatttcaacctttttttcttccggttacctctttcagttgctaagagtatcccaaactcttataaaatattctgtaattttagtgaactgacatttctttgaaatatctgttgtatttaagcattatgtcttataaaatattctgtaattttagtgaactgatttctttgaaatatctgttgtatctaagcattatgtctttgatttgacttgtcctgtttcatagttctaccctcttcctagactttgagtttttagagaaggtaaaggggaaaattaatgaaatatctttcaaaatgaaggcaaaataaggacattttcacatagagaaaaccaagggaatttgtctccagaagacctgtgctataagaaatgctaaagatattttttaaaagacttgggtaaatgataccagatagaaccccagattagcaggaaggaagagcatcagaatgggcaaatatttgggtaaaaagaacaggactttttaaaaagaaactatatttatcttatgtgtgtgtatttaaatgtctttaaaagactattgtctttttaaagcaataataatggcaatttattatggggtttacagcttatatagaagtaaaatataagacaataagaacacaagggggggagggataaatggaataatactcttaataaaatttttatgttgttcgaataatatttcaagattgactgcagtaactgatatcaaagtataatctctagagcaactactaaaagctaacataaagaagtacagctagagccaggcacggtggcttgtgcctataatctcagctactagggaggctgtggcaggaagattgcttgagtccaggagtttgagaagctgcggtgagctgtgatcacatcattgctctcctgcctgggcaacaaagcaagaccctgtgtcttaaaaagaaaagaaaaaatatagctaaaaagacaatgtaagaaataaaaatggaatactaaaaaatatgcagttcagtgaaaagaagacaggaaaagagaaacacataaagaacaaatagaataaattaaaaatgcataccaagatggtagacttaaatccaaccatattagtagttaaattcagtgggctaaacacatcaattaaaaggaagaaattttcaaactagatttttttaaaaaggaaagatccaactatatattgtttataagaaataacactttaaatatgaagacactgacagatggaaaataaaggtgaaaaaggatgtatgccatgcaaacatgaagcattaaaaagctgacatggctatattaatcagaaaaagtagacttccaaacaaagattattctaagagacaacaaaagaaattttttattgataaaaggagcatacaaggaagataaaacaattctaaatgtctaggcccctaataacaaagcttcaacgtacacaaagcaaaaagtgacagaacttgagaaaaagatctacagcataactggagattttaacatcctctcatttctgtgtaaatgcctctcacatttttgtcaattatgatcttttgctaaacccatacagctgaaaatgcaaaagctcatgactagtttttcagaggttccttagttaattggtataaatcttggataggtaaacggaatatctgttttctgtttgcctgatatctctgtaacttggcttttcctaaggcctacccattgctttctgagactagggaaataagtctggcttctttcaaacttctttgctcatttcatatgggccaaagtagcactaatcatttaaaattcaccagttaatctgttcattttcaaccttatatttatcaactagctataatttagttttggttttatttactacttactggataactatgccagtaagtatagtattttattatttaactgtgttcttcttttcattttattggtgatttttttcatttgttgttaaacagagcatttattgaacacctacaatatacaagacccacattagatttttataaaatgagatccttgacttgttacagagccagaagtgggaacccctatattcatctctgcatattggttccatccaccaaacaaaattgtttccttttcttttctcccttaaacttctgtacatgcttctgttttagcgcttatcgcattgtattgttttcctatatctgtcttcccagttaaactgcgagcttcttaaaggcagaagtcaaatatttaattttgtagcttgggcacatgtaggtgctttgattactgaaagatggatatatggacacagtaatgaacaaatgattaaaaaattatttaaaccattgtttgacagggtaagattactttctaatgaaatagaacttggtaatatgcccttgaagtctgataccctgacaaaccgcttctgaaaatcagcttacataactaccagggagaataaaaaggcatagtgcaaagcaaatgctgtgtgaaagacaggtttccagtgtagcatatgtgggccactaatgggtgtagattgaactgttctcttgccaagagtcatcaataagaactctttaatgatggcttagttcatagatgtattttggcatgaagatctctgtgtttaactcagtaaacaataggatctagtttcattatggacttttcatacttcttaggaacttgtcattgggaagataattattttagacaagcagacattgttatatgttcagtaacacttatatagcttggtcataaaatttgtggtgcttggactagcttttgggctctttctttaaacttaatggaaagtgccttaaatgccttaatctccataagacacttctcccagactagaatggacctaaagagttctaatatctgtcagtgtttaattatttgaactgaatatgtcagaaatcttagcaatggaagtttaacaaatttaagtatagaatgaaccagtataggaagatttcatataattttgtgatacagtattaaactttttttttttttaatattccagggtgctctggaacagggctcaaattctcagctgatggctgttcaatacacagaaaccactagtagtatcaggtaagacagtgcagaagctcttggccaaggaatttaaaatagctggtattttaagaaagttgaaattcacacttccctttcaccttaaatttgttctcatctatgagttttatattagtcatatactctaagatatatatatatatgtatatatatatataacatactactgagcagttggaataaagccagataatttcaaaagttcaactctcccaaatcccttaaatacaaatttagtcagaatgctgttccatcataattttgatgaaaatcttgaatacccatagctttcttgcccttgatttgcatctgtttcatgaacctagggaagggaatgttattttttgagtgctctgtaccaggtgtcctgctgagtgttttacatgtattttatctttaaatccatgtaataactaaaagtttattttatatatagaaaaactggtcaaatcatttattttttttgtaattttcagagtcataagacctagtggtagactcagaattcagatcatagctgttttacttacaatgcatttttcactacacaataatacttaagattttgaaagatttcaaagagaatgctgtatctacaggtttaaatgtcttcaaagggaaatataatatgggaagcaatatggtgtcatggttaagatgctagctttatttgccctgttgggcagagttcaaattataactctacctcttactttgtgggctcaagcagattacatgcaattgaagttttctcatctacaaaatgctggctgcacagagttgatataatggttaaattagataatatatttagagcacttagcatggtacataagtgccccccaaaatggtaaatgataatgatgtgatgtcattgacaacagtatcactgaagtgaaatttgaggatctcagcttctatctgtagctctaccacacatttgcagttcacttatatgaatttaacatttacttagaatatactgtgtgccagtgttctaggcactgagaaaaaaatatagatagatagatagatagtaaaaatgaagtcaaaagctattttattcattatactaataactgagaattcctattaaatgacaatgagcagcatatcagcaatcatgaatgtttaaaatcctgagattgtattatcctgttgaaattgataattcaaatatgtttaaataataactaatcattctctgctaaccagaatatatcattcaattacatttattttaaaaatatatcaatttttggatgcatggttataatggcatggtatttcttcattagttaaaatgttttagtgaattacagccaattttcattatttgtggattccatatttgctaattcacctactaaaatctgctaaaatgtatttgtaacccctaatattagcagtgcttttgtcatcatttgcaaacatgcgtagatgctccctggtgaggttgaacaaggcagtgttctgccttttagtctcagctatataaacaaggtccttttcacagtccacatttttcatatttttgtgctttttgttggtaattttgctgtttgaaatggccccgaggcatattgctgaattgctgtctagtgttgctaagccgaagcgggctgtgatgtgctgtgtggagaaactacgtatgttagataagtttcattcaggcatgatttatagtgcagttggctgtgagttcaagttagtgaatgaataatatatgttaaagaaggtatctctaaacagaaacacataaataaggttatatatttatcacttaacagaaatattgtaaccagaggcttgcaggaacctaaccctgtatttcccccaggaggatggtttaggattcactaattcattgctggcagtgactttttagaacataactatcacaaaatagcaagaagcgactatatattcaaaatattgtaatcagaaatggcctagtgaacaaatggagttatttcaaaggaaattcttatgactcatttattacttccatttaggtcagtctttttctcctcttaataatatttgattgatacatacaagttttctctttgaggaaaaatgaagcatttttacaggatccctttaactcttccagatattggtcctaaaccctagaaaatcctgaacacattaagaactctattagaatcatttgactgtattttttggggcatgatgtggtttgaggtattatcattttagtttttaattttagtaaggcacatacatggtacttttaatatcaatgactagcagttgttgagtgactcctatgggacaggatccatgcttggcacttgacatataacatctccagtaacagtcctacaagggttgtgtggttatactctttttattgaggaggaaacagtttgttcatggagggcaatttccccaggagtgcccacttgagaagtgaagcaggaattctaaaccaagtctgcttgttttcaagtcctaagctttttccacctttttgcacagcctcgtaggcaagcataccttcatatattcgacagggtggtgaaaaatgacttttcctcagatttaatttgtattactaaaaaaattaaaaatcgttcaaacctatgcagaaatctctctattttctgatactttcattatttttacatgctttgcaatgtacttgaccatctagtacattttagagccttgattcagaaatcagaattttagcataagtgaatgggttcttataaaatatcctgatccttgggctttgcaaaatattgttataaaaattactgccaaagtgcaactaatattttggttgagagagattcttagaattcagacatagccttagaatgggaagtattttgggaaaacaggaaactttttattttagtaataccttatatttttcttactttagcaggaactcagggagtgagctacaagtgtattatgcttcacccagaagttatcaagacttttttgaagccatccgcagaaggggagacacattttatgttgtgtcatttcgaagggtaagttcatcttgaaagaatagagcaaatatttttgagtgcttgccgtacacaagacattgggctgaatattgtggaaaatacaaagatgtgagaaataggaagcaatataaaataaattatgtgagtggaacagtctaagtactgtaatatatgctttactttgagctgttgagtattataaagatgaacatggaattggtgtcagactatgagtttgtatttaggaaatataaactacttgttgatttttattgtttgtaatcctgatagccatgctgtttataaaaaaaggaaaagtaaaaacataaaaatattctatttaggcttttcctatttaggcttttaaaccaattcccatttggttattgagaaacagacttctgaaatgtaggtttgagatggatcatgggctgattattaattgtggaatgtttggatctatgttcctaagaatctctattcctcttttatctcttcttaattaaacatttggttggtgaagaatgtgttagataatcagttagcttatgtaaaagtaaatgtttatactagcacttttgaatgttatgaatgttaggctaaatggaaaaaatgcatagctgtttatatttcatctactttttctataaaatgaaaatattttcttcatagaattgccatgtgaatatctctgttagagtgctgtaggttaacccaggagcacatgaatgaattagaattcctcagtggtggtttctatcccaagctgttttttctttctttctctctgtttttaaacaagagaagggacctcactgtgttgcccaggctggactcaaacccctgggctcaagtgatactgagtagctggctttcttttttttttttaagaatacactgggtatggttagaagtaagtacagttgacccttgaacaacacaagtttgaatgaagcaggtccatttatatgtggatttttctcaaccttagcaggatgccaaacccacttatatgcagggccaacttttcacacatgtagattccacagagctaactgtgggacttgagtatgtacagatttggagttatacaggcggctctgtaaccagtcctccacatatacagagggatgagtgtctatactaacaatagaatgagcaaattcattctctgattattaccactcactgtcactgaaattctcagttaactagttaattcttttcctaaggtataaatatctagcagctcaggtttttaggaccagagaactttgatacttgaaaactagggagatcaaacatcttatatattttcagttattaatcaaacatgctaagagatttggaacactttagccatagcgtctcatgatcactgccttttcacaaaattccctgtgttcaccttactctatcagacataactggtatgtttctgtacaggaccagcctcaaagtttcttttcagcagcaagggggcagctgagaacaatgtttcctgcaaggctccaactgtactggtctatgaaaacaaagtatttcccttactattgacacaattatgttcaaagtaggagaaaaaaagtaaacttttaagaagattcagtactatgaagaagaaacctgctgggtgttaaaatgattgtgttgaagtatattttatggaagttactgtaggagaatgtttttaacactcaaatagacagtttttctgaggttcaggataattactgtattatttgatcaaaacagtataacagatattagaagtaacacttgtcaagccatggattgaagtcatggttagtaatgtttttctaagggaagagaacaagtattttttatagagaagacaatcctagcttttttttttttcttttgagatggattctctctctgttgcccaggctggagtgcagtggtgccatcttggcttactacaacctccacctcccaggttcaagtgattctcttgcctcagcctcctgaatagctgggactatagccgcatgccaccatgcctggctaatttttgtgtttttagtagagacggggtttcaccatgttggccaggatggtctccatctcctgaccttgtgatccacccgcctcggcctcccagagtgctggaattacaggcatgagccaccgcgcccaaccaatcctagctttaaacagactgtatttttataaaagacagtgaatggcggtttaaaaaatatatatgcattgcatttttttgcatttgtaaaaagtgatttctcattagtttgctataaaagtgctgttagaaaattattgatttccactcctccctagtcccttgatgttcattcaggaagactgttaggactggctctcacacaattactattaggagtatgtctaacattctgtttcgatttttcattttcaaattactgatttatcacattttggtgttttatatcaaggaagagtaaagacaaatgaactgaattagataatagtaattaagataacatcctttttattttttttgttttgtttcaatagtagggaaaaggaagttaattttatcttgatgactgtaaactatgttatgggacaggaattttgttctttaatacctggattgttctttttgctcttgctgaaatgaaaatgaaataataaattacctcatgcttggtcttctttcatctttcaatataaaatattctaacagtttcattaaaaaggtgagtggcatcatttcttgtgcagaaggatgtagactttttctcccacttaggttcttaattttattggcagaaattattataattgatactacattggaaattcagaagaagattccagagccccaggtttcggcttagcatgaaccagacatttataacaaagccaataagcaagctatgttattttattttatgaatggacatgtatttaacaaaatattttaatatctaaagatgtagaagtagccattgactgtttcgtactgttatttaagccactctctcccaaacttacactccctcacaccctgcattcctgtaccttttaatctctttacagttgagcggttgaaattattttctctaaagcagacacactcttggataactactgagttcctgttatagctcagcaagaaaaaatgcttatgatcccagtactccagacaaaggtccaaagtgcttctgttcttttgactctccttaaagagtttttaccaccaacatagtaatctattcggctttctttgcttagttccagttatttgtagcttattttcctgtaaatactttgcctttttctcctctctttgatttgtttgttttagtatgatttggagagggaggttggagaataactttttctcaaacttccaagtcactttgagtgtagaataactgatacattaataagaaaaaaatccaattaagtttaatgccttttttgtttgtttgtttgtttgttttaagagacaaggtctctgttgcccaggatggagtgcagtggtacaattatagttcacttcagcctccaactcctgagctcaaacagttctcctgtgtcagtctccagagtatctgggactacaggagagtgccaccacatccagctaatttttatttattttttgtagagatggggtctcactttgttgcccaggcttgtcttgaactcctggactcaataatgcttattttaaaaatacttttgtggccaggcgcggtgactcacgcctgtaatcccagcacgttgggaggccgaggcgggtggatcacgaggtcaggagattgagaccatcctggctaacacggtgaaaccccgtctctactaaaaatacaaaaaaattagccgggcgtggtggtgggcacctgtagtcccagctactcaggaggctgaggcgggagaatggcgtgaacctgggagacggagcttgcagtgagccgagatcgcgccactgcactccagcctgggtgacagagtgagactccatctcaaaaaaaaaatgcttttgtatgatagtctatttagggagggagggaggaggttgattaaataatataacaaaattaattcaagagctaagacagaaacaaatactcaggaaagctcaaataaagttaagaagaagatgattttaaaagggcagaaaagaaacattgagaagaaagattgggaaatgatattaatttattatttcaatacacatttaaataccatccttacatgtagctgtctcatccactaatatataaggaaagaatttcttcctggggcagtttttcattaaaaacaggttctctttgaatcagatggctgtgaatgtcagtttgccatattatctctacttgtttaatatttttcttttgcaaatgagatggatgcctactttgggaacattttttatttctattacattttctgttttcagtacctgtctcaaattgtaagtaaacacgtaaagtgtcttttcatcagtttcaaatacatacataatattacagaagaatctgagctatagccatatgactgcctgagagatgtctctttctcctctctttccaagtattttatatattctagcaatagtaccatatttgggtatgcaccccttactggtcccttataaaaattattaacactgtcatatatacggcatggattataagggtagccttaagtaatagggacttattgtaagttatgtgagattaaagaagcacaggaaactggctcagaatccaaataatccctctgtgcttgtgcttcattgggtggaatgtatactagtcttcatggagaattggaatagtggtttattgtcatttctgatttgacagcagctccagtgattccactttagtcttttttttacactttactgattcatactcctcaaacacaaagatctgattgggtagttctggtcaccatctcttacgcagagaattactatggcagctttggcttatgatccacagttattcatttgtgacaagagaaaaacctggggccactcttctgagaaaatgactttggcaggcactgggagcttcataaactactataccacacagcctgttttttttaattattattcttttttccccgttcttagtaagtgtgcattaaattctttcttgtattggttcctaattgtttgatctaaaaggcccatcttctcatctatatgataagccttttgaaggcaggaaatatcgtatgcttttgtgactacccctgacactcagcaatgcctaccactgagtgcttactgaacagaatggttttagacatgagccattgagagaagtcacagtgatggaagtttgttgtttttcataatcatttaaaaggtttttttttttacattgttttgcttaaagaaattggaatctattttactgatctaagaagtaatataagctgtgctgaatgccagtagaaagtttagttaaagatgatctctgttttgtccatttatgatttgcactagccagatatcatcagcttattcttgtctctgaatctaagctgtagagctaaataattcacctgagtgtagtgtttaacagctttctatgtcagtaagtagaactttgagatacttgcatcttcatttaaaattatttgttggcagcattttggagtagattgttgttagacctcactgatttcttttttggagaagggatgggttctactatttgtacagattcaagcagtaggagccagaaacttgaaactttggaaacactgtaggaaatactgtgattattgcaaaaaaaaaggttgactagtggtgttatttgttcaaaatgtttgccagaggtttagtcccacggatgggcataaaaacgaatttcaaaaatagcaatgatattttctaacttaatacctagattaatacctaacacatgaagaatggcatattttcttaatgcctgttatttatttcttagaaatttatgtttagtttatatgcatatataaaaattcaacatatgtatatatataaaaattcaattgtatgtatatatataaaatcttcagaggcaggaggaatttctttagtatcaaaggaaattcatttataaagtctacttcaaaagggtacagctccttcttttgtttctgagacctcaaaacttgagtgtacacatagatgttggagtttggccattttcttatctccactttcatggcctttgagccaaattctagctggaaaaaaaagtgaatagatgagtttggaaagatacttgcattttagaaaagggtcttatctcagaagagagatgttttaaaaaaccttcttttagaaggctttttaaaattaatttttagctttaaaatatattctcattcaggtctaaagcacattataaaaaaatagagcagagttgactgagtaccctaggttaataaacttaacctagatttatttaatcattatgccaataatgttctttttatatgtccattttctatttcactttattatatacaaatattaacacttcaatgtatactacctttgtagtttacaaacctctttcacatacataatcttagcaattccttacatataatcacaagtattcttagtcctattttatggctgaaaaagctgaagcaaagagagattaagtagcttatctaaggacacaaaaatggtaagcattagaactagggcaataattgatagattctaatttaatacagtgatttttttttctttacattgttgtgcttttttctttatatctggcacttttagatgtattacagcatatgtaaataaattaatctaaccctccaaaatcaagatatttcattgaaaaatctgctggacagttttggcagattcattacacaacttcaaaaattgtttgtttgttaattacctgattatgtttgtttgttaattacctgttaattataattatagattaagtactttaatagattatgctttcataatgctggagaataacttaatggtttgaaatattatagtatagcttcagatttcaagtcagggaatagaataaataggccttgaaagtttctggtttctttttaaaacagtgtctgaaatttccaacatggtggaaaagaaatgtctttgctttgtcttaaaaaggaagtagtttagcaaaaacagaagctgttttaattattggtattctagagcttctcatagaaaagagtggggtttttgtgtgtgtaaatacattttattatggattctgtatatggcgtgctagatctttgagatcagaagcatttgatctcaaactccttgttaaatgtgagttactgttgtgtggttttagaggattcaactatttgttctttgtctctataacattgctagctaacataaaaacatgttttttacttacacttttcaatcacaaagtctaaaataacttgctttatgtttgagaaaagattgttcagtagtctgtaagtagacttgtatatagccacaaacagagaacttataactcaagaataatacgaagtcttcaaaattctcagaatggtgggcagatccatctgagtcatgataatttttcaatggttcttatttgtttgctctatttggtagtcttattattatgaaatgtgtttttcatatgcatttgtttaatctccccttttcaggttgtatgctttctctgtgcagggataaagtctattcattctgttttgtcttttacaagatctattgcaatgcattgcaggctcggcagagtaagtcctaaataaatgttgactactcagaccactaactgtttatttgtgttgtttacccttattttttatgtcctactcttcaaaagattactagaggtggggtttgcagaaacaaaggaggacatttttctcaatgaatgtttaaaattacttcggtgacttggatagcaatgaaatttttaagaatatatagtcagctttggtgtgggtggactttttgctgtggaatagaataattcctgaaagacttctaaagttactttgaaaaaaggcaggaattagggtgggaggtgggagaggagcagaaaaaataactattgagtaaccaggcttactatctgggtgaccaaataatccatacaacaaacccccgtgacatgagtttacctataaaacaaacatgcacatgtacccctgaacttaaaataaaagttaaaaaagaagaaaggtaggatttaatgattgatagcttaaagttctcatcaaattttttgtaatgagggaagaaaatatttccccaaagcagaactgcattcccagaaagaacatttcttcacatcatgaatatgtgaggaaaaaatgtattttaaacaactgataggtacagaccctaggaacctgcattctagccccaatgttgccactcagtgacatctgctatgtgactttagacaaatcacttagtccctctcatcttcagtttccttatatgttaagtgataaagttaatgtagatttgcttttttccttctggctccagaaatctatagtttttatctgtgtgtttgtgtgtgtgtgtgctttcctcttagaaagctgtagtattgctttaaactctttgaagttactaagtgattcaatctagtggagtcagtgtattttaagagttttgaaaaacagccataacaaaaacaacaaaatgtgaagttacaaggtggggctataaattaatgagtttgttttttgaatagctggcagttttgtaatttatttaataacacttatacagaacacaatacgataatctttaatctttataattgagataggtgcagttatcatcattttacagatgaagaacctgaggcagtcgtgtccattgtgaactccaataagaaagattaaaaagaaggaagaaaaagtccgctgtagaaatgaaaaaacaaatttatccattgtgacatcgtttagaaatagcagtcagaatttaaccaagaaagtctggctctatgttcttgatcatttccctctattgcctgtttaagatatccaaatatcatatctttgaaggtagtcaacttggagtttaattccgttgatctctcttttcaaaacatattttgagttgtttcgggatcattttccagagactaagacaaagccctgtggaaaaccaagccacatgttactcaaagtaatagtgtaggaggaacaagagccagcagggaaacacagaggaaattattagaaatataggagaattggaagagtacagatgaaggaaaataaatcaacttgtttatgttattttaaaacctagaggtcaaggaagagttcagaaaacgaggctgtcagtggtatcagatgttatagcgctccctaagaatgagaaatgaaagaaactcatttgtcttgtgtaaacattaaaatcattggtaacttgagattacatttattgtagagtaatcagaacagaatccagaaaagagatagaagagaatgggaaagaaaaacaatggtttggtaaatctgacactggaaggaaatggagatagcctagatatagataaggagaagagaactaagagtgtgtatgtatgtgtttgtgttaaggacaggagagatatagggatagggtataaggtaaataaggactattgtagttagtttatatacatataagaatagagtttatgttttatgcttgacagatgttctaaaggaaaataaacaagtcattgttcctcctctgtattgttttctgtttaaagtaaaagcatggagaaagttgaacagtttttgtttatttgcagtaggactacagaaaagaaaaataaaagagcgtatggaattaaaaccagatttttgaaaaatcaaatcatatttaaagtactgcttgagatatcaaaagtcttttaaatcttaaatacagagctggtttttaataatggtaaagagttttcaaaatgttaaagtttatagaactatttctcatttaattatatgtaaatggttttataattttttctcacattaagttagaaaactagcaaagtaacctacataaaatttggtataacctttcttatgatgtcacaaaacttaattatggaggaagcaattattataattaggaaaaattgatgacttatgatctgactcaggatcaaggtctgaaacactcatgtcatttcctcccctctcctatatagtatacagtgatttgttcattttggactcttaatattttaacttttgacaccatcagcaaatctaaacactgacagttggtgttttcctgaaaaatgttaaggctaataattgtgtgatatttatttcaacacattgctgctagtcttctataaagatctcattatgggtaggctttgaagagatatccagttcataatatgggcatcacactggaagcctgcaagatggatgattggctgagagtaggagtgtagtttctaaataataataagtctgtttcccctgctaggaagtaccctgagggcaggaaccctctatcttagtcatgactttgttcccaatacatggtatatcaggcatgtagcaggtattcaataaacattgaatgaataaatgaacaaattaattagataccaaatccatcagtttgacactatattctaaattagtttatatagtcaccgtaatgtgataaagaaattgtgatagtctagtttactgagcattgttatcaggaccatctgtgtctcatgtttaagtctagaaatcagtctttgaaaatgagtgaattcaaatgcatttttaaaagtctaagtgccattttgcatgagggaaattatatacctagtaagaatttctctgggtttcaaagtcagaacactgatcttggtaatacatggacagaaaggattatttttcagttagggtgttaaacagattgtgctatcattttaacctctggaatgaataagccccagatttaataagctccttatgtataagatgcctgttataatgtgtctgtaatgtcctagaaagatgagactacccctgcatagtgcttatttcttgcatggaatgaatttaagataagcttgtcaaattttaaatctgacatagactatcttttgaataatttatttggagtcatctctgtctgattataatatgccctaaaataaatcttgaaaaattaaaatatatcatacagaataaacagtctacatgtaacagttaacagttacatgtaaagtgttattcagattacattttacaactatttcttttctgattccattttttattgaatagaagttcaataaattttattctgttaagaatgagtctgtcttggagagggtcagtgtcacatatttactttgaagttccttaaagaggttagttgaattctccccccaaaatgtgctttgaattagcagcttttgaatatctattctagtagaggtaggagcaatatgaactagagagaatgatatgcaataaaaataataatttttctttgactttggaatgaggataatctaaaccacagccatgtaggcagacattttctgatgtatgtaggtatgtttgcatgtctgtctatctatccatctccttgttttctatatatttgaccctaacctttcaggctcctattttgccatcaggtccaaaaccaaactgagcgataagagagtggagatccttaaatcagtggttctcaaactttttggtttccacattcctttatgttttcaaagaaacattaatgagaagagtagcattttgttaacattaagaaaaacctctttaataactggcttaatagaaaccagctggattcttatatctgttctttttggtcaaaatatatgaagaaaatccagcctcacacagagatgtaattggaaaggaaggactattttaaaagcctttcagataattgtgggtattctttgatgctacaccaaaatgcaacaagaggtagtttcttaaaggttagttgcaacacggaagccaaatctgtgaacttttagtactctgaaattaaaatccattggttgatcttgcactttgaatggatcttttacctgtgcaaggttttgttacatcatacattggtcatttgaaaatactggttcactgagttatgcagatcttccaaatgttgacacattttattatgtattaaaatgtcacattctttaatactatcacaaatcttatcagaaaagtctttaaatattgtgagcagttcatggtagcagatagaagttttccaaaattctagttttcacttgagggttcaaattttatcattgtcaaaaatatgtcagttttccttgaagtggtagattcactaatttattttcaagaacatatctgtcagatacccaaggctaaacaactataatttatcagtctttcaagtaaaagtggtgttccatgaagaaagtagctagtgcagctcacaactcagttacacaagtggttttcctctagacaacaattgtactttgatatgcagcagaaatgctttatgtgtatttcccattttgtcgtacagaatattaaaaagacttctactcaagggtcaagatttcataaaattaataacttttattgcttcatcaaagacttccttcaattacattgactgtgtgtggtatgtgcatgtatatgaacatagggcagtaatatgatgaactatataatacagtttgatgttgctgtcttaattcatgctagggcaccatcattgcttttgcatcatcagtgtaaatatcaacacagttgtttcaagataaatgatgagatttaagaaagttattcaacactgaatatttcagtactgttagtgtttgttgccaagcattcctataaaaggtctttgttgttgattacttggggctcatactgaataaatctaagcaaaacataaagtttatagattcttccatttgtaaaacaaaagcacaattctgtagttgagatattaactcagccttcgtatttgcaactaagtgtaatttgatgaattaacatatggttggaaagtgtcatgatttcttatactgacttttcagcaggcattgagcaaggtcgattatccacaattttattagtctctcagctattatatgcactttttcagtcattgcattatattaataacttacaatgtaggatacttccgtggtcttttcatttccagtatgataagctgtaatagaatttttttttagaggattcttcacacctgtgtttaaaatatccagttccattttctttgaactctacatgattggtttcagaatgacatcacaacttaattggcaccattatagtatttgaaagattttgttgcataagcgacaagaagatagattattcatatgtctgaaacaagagaaagatggctttcaatgtatggtcattttttattaacaattttgaccagtttctttgctagattccacctttccgtgagtcataaaattctcaaatatatcagttttatcttttctgtatcttatatgtagacagtatagttgtgggttaaggaggcaagttttctaatctcctgtcttttaagccagcaattcattcttaaatataagaaaagtatgtaatagatttttatatgaaatattaaaatttaagaagctgtagatagatttagaaaacttttccaaaaagatttaaaaataatattataaaacaaaacaaagtatacattcttctttgttgtatttagatagaagtttcagtagtggagtccatataactaagctccataataatgtgtttcataactttctccattattctactactagatcatagaaggcttgtttctcttaaggtttagttttttcatgcactcagaaaatagtttttcaggaagtatgtactgagtattctgaggatatgcaaggagcatgggttccagtgataaataatacatagtctctgtgctcagggaacttatagtttagttggtgctaaccagataaattagcaaaataattgacagatatagtaagcatgatgaaaacacacaatggactcagagaataacaaggatgctctcctgagacagcgacatttagctgatatctcaaacatggggggaattcaaggattccaggcagaggaaagagcatatgaaggcagttaagtaaggcaggaaagagctttatttgaggcactgaaagaaaaccaatgtgacaggagactagtgaatgggaagggggatgagtaatgaaaatgaggtttgggagattggaaggggctagttctacaaagccttatgagctatagtaagtagtttgggttttattctgagggccagcaaagggatttaagcagcagaataacacgaatgatttagttcgtagaagatgttcactgctacatggacaatgcattagagagagacctattaacagtaggagcagagagagcagagataccaattagaaggctttttcagtagctccggcaaaatgatgatggcagcaaagtgatgaatggattctaaatacattttgtggatagatttagtgagaattggagagatattagatgtgttcagatttctgtcttgaattactaggtagaaaggactatcattttttactaagatgaaaatatttggggggcacggtaatatgtttggtataaatgtggagagttatttttggatacatttaaatttgaaatgtctgtgagacattcaagggaatgtgtgcaattggctctgtgaatctgggactcaagagaggatagatctgagctaagaagagtaattaagaattgtcagctcatacacatttatttatttatttggagacgagtcttattccatctcccaggctggagtgcaatggtgtgatctcagccccctgcaacctctgcctcctgggttcagatgatcctcctgcctcagcctcctgagaagctgggattacaagtgtttgccaccacacctgactaatttttgtatgttttagtagagatagggtttcaccatgttggccaagctggtcttgaactcccaacctcaagtgatccacccacctcagcctcccaaagtgttgtgattataggcatgagccatcacacccggtcagcttacacacattatctcatggatttacatgggaataatggagtcatcaagaagagagtatatagagagaggagggttcaggaccaaattagattttgaattggagaaggatgagagcagcaaaggacggttcaggaccaaattagattttgaattggagaaggatgagagcagcaaaggaggagggttcaggaccaaattagattttgaattggagaaggatgagagcagcaaaggagactaaataggagcggtcagcaaatagggagaaaaccaagagaagagacttttgaatggggaaggagtggtttattcttgaatactgttgagacgttagataagatgaaggattggttttcactggatatgtcaacatgaaagtcactgatacacttgacaagagccttttagtgatgacatgaaacataaaagttaaagatggattaagtagtaaggaagtgagaacagcataactatttaaaaatgtttgcctataaaagaaaatagagaaaaggtagggttttgtcttattttcaaactctagatatcaattatatattttaaaggaatgaacccatagataggaagaaagcaatgttaaaagagaagtcgagtccttgagaaggggcaaaagggtggaattcagataacaggtggaaggatggccctttgctagtaaggcaggacattatggtagaggcaagatgagttcatagataggaccttaggttccaggaagataaagagaagacacttctaacagtttctgttttcccagtgaaggacatctcaactgatgtcatcagctgaaagtaaggatattagaggaggtgtagaagatttaagcagagaggcacaagtatgaagtagttgtcttggccagtgggatagtgagcctactagagacatttggattgtgaggccttggtggggtgtcagtatgccgtatgctttaaagtcaaatctctgcaacagaatgccaggtgtagagttacagttgattaataagacacagcccctgtactcaaggagtttgtaatctagagaatgaaagacatataattacaatatggtgtgatggttgtgatgaacaaggtaaatatagggtgtcataagagcacacattaaccaatcttggaggggctgtcctatgcaaggaggtcttcatggagacctaacagctaagctaagacctgcctgttctgcaagtaccttacttaaagctattacataatagctgctggggatgaaaatattctagaaggtatgatagtcacactgtattattatatctttatgcagtagcttttatttctgctgacatcatcaggcatctttgaaatttcttttttttttaacacttcgaaatgctgtgaagcaaagtatcatccctctctttcctcaccctcttctcttccttaacacctttcttcagttctagctgttggcagctagatgcaacttaataatgccattttgttttcatttggcatgtcattcatcattttcaaaataaataaactttaattttgtgctgccacaatcaggaatatttgaacatttagtgcttatcttgggtatctgcccttattactttctgaggagctgccctttatagcaatcagggaactataccacttggaagactaattgtctttatacaaaaataaaatccttgtgttcagatttctgtcttgagtggctggtttgaatctaattttctgttatatgaagcaaagatttattatttaacatagtttcaaaattaaaattgatagtgaaattttatgtgccatgcaatgtcatgtgtgttcttttaaggtgaagattcattttttaatagctttattgaggtataattgacatataataaactgcacatatttaacaccacattttatgtgtgatatgtatgtgtgtgtgtgtgtgtgtgtgtatatatgtatatacttatataggtgaaatcatcaccatagtcaaaataatcagcatccccatcagtcccaaaagttttgtttctcatgcccctttgtaatttttccctgccctctcaccagtcaactgatctttctgttactacaaattagtttatagttttaaaaattgtatataaagggatcttaattatatatattttccttccagcagaattattttgagattaatccatggtgttgcttgtatcagtagttcgtctttactgctaatattctggtgtagggatatagcacaatttactaatatattcaccttctactgttagctactacaaacaaagcaactgtgactatttgtgtacaagtctttgtagggacaaatgcactcacttcccttgtgtaaatacctaggagtgggatggctgggttatatagtaggcatatgtttagctttttaagaaactaccaaactactttggtacaagtggttgtaccattttacattcccaccagtgggaataagagttgcagtgcctccatatccttggcaacacttgatacagcctatctttttatttttagccattctaatagaggtatgtagtggtatctcattgtggttttaatttgcatttccctaataactatattaattttgaccaactttttatgtgcttatttgccatccataaatcttctttggtgaagggtctgttcaaatctttcccgattttttattgagttattttctaatgattgagatttcattttgaggattttgtgtgtgtgttgttttgtttagcagcttagaacacacacatttattatctcacagttactatgggtcaggagtccaggcatagatttgctgggtcttctactccagggtttcatctgaaagtaacaatcacagtcttggccagggctgcagttgcatctcaaggttttactggggaaggttccactcataagttcacatgattgttggtagaattcagctcctcgtgggatgccgaactaagggtctcagttatttgctcagttggagattcccctcagttcctgccacatgggcctcttgatatggcagctcacaacatgacaacttgcttcatgaaagccagcatggaagtgtttatgtttactggtttattatgattaacaaaggatacagatgaatagcccgatggaagagatgcatagggcaagctatgtggaaggggtatggagcttccataccctctccaagtaggctaccttccaggcacctcctcatgttcagcaatctggaagctttgcgagttctttatgtattctatatacaagtcctttatcaaatacatgacttgtaaatattttctcccagttttttgcttgtatttaaatttcctttttagtgtttttcaaagggcagaaattcttaattttgatgaagtccaatatgtcagctttttattttatggactgtgtttttatggttttaagaaatatttgcctaactaaaggtcacaaatattttctcatattttttttcttaaagtcttacaattttaggttttacatttaggtgtatgatccattttgaattaatttctgtatatgtgcaaggtgtatatcaaagttcattttgtgtgtgtggatatccagtattgtatgatattcaatgctgtgttttcacctaatagcttttaaaggaagaattaaagcaaagccaagttaaataggttataccagactgttagttttctttgtgttatccttgactttgttaggttgcacattttgctggaacttcttaaaacagtatcctatgattgaacttcttcaacctcaaatttccagtctttatacttaaccaatgaaatgttatttatatactctttggaaacataacatatactgtagataattataacaaaagtgtaatgggtagcagaagatattgccaaaccaaaattctggagaccagatgagacaaacacataatatgtgcctgtatgggtcacagtgctaggaaatacactgaaaagtgaacaaagaactaaaaataagcctcttataagaaaagctgctacttctgggctaatctattagtagtttgttttccttaatttgaaaaagagcttcagaatcagactctagagtgaatcttttaaaactatatatattatgcatgtatacacatatacatactctatgcattggcttagataatataaaaacagcacaggaatagtttatgctgtagtattgtgcagtcttattcagaaataagaaaaatagtttttccatttagctgtgagtcattactttttagtttcgtggagaaattaagttttagtgggggtcgatacagcttttttttttttgtagaaaatcaggtagcatgggctttggagtcagacaaatctcggttttaattttcagtgtccttatctctaatatagtaatattaatagttacctcttcctgggttgttgagaggtttaaatgaaataataagttaagtactggcacagtgcttaacacataataggtattcaagatatgtatacttctttatcatcaggggattgaccttggaagcatatgggtacatagaaagaacccataaaaggatatgacaaggggagaggagtttgttttcattagatttagcaaattcattctttcccccaactccccagaaaaattcattttaatgctattattttccttatcacccataaacagacagaaaattggcatgtttcgaaagagtgttaaaactgcaagagtattacatggtatcattacactaccatccattatctaactgggtttatttatgaaggttagatttagataatttagacttaccctttttccattttgtggggaaagagaatcagaaacttgaaaggaagagctcttccaaacagaaagatagctagaatctctctcaatagtctatataatctcttctaataatctttagcaaaagtgacttttgagttcttttaaatatttcctgtattgattctaattcagtgctcatttcatgtgatgtctatagaactacagacttagattacagtcagaaaactgagtaacagcagacaccaggttttcagctgtttttagggtttattcagattgactacatcacattcatttggatggatttagtgacatcaattgataattgtaaagaaactagcctttaatctgacattttcatattgatattagataggagccacatgactatgtcatgggttcattcacaagatataataaacattattttcacttgtagcataaaagcagtctttagtgttatcttagaagcattaaaacacacacatatataaaatcatatagattaaaaaattctatcagcataggttctgtaattgttaatagatgtaattgcataaggtcgctatgcattatttctcattttcagatgaagcctgtcaccttgacatttttatatataataggaatccacaggttgttaaaaacataaggaaattaagataatttgaattcagattataaaatagttcaggtctattctgatgaagcaatgtcacttaggtctgaggcttttgggtcagcttttaaaagtttatcttatttttcattaaaatatgtatgtataatactctatcatgcaaagagaaatggtcaacagaatttctgtgcatatatggttgctggttatttgaaagccattctcctcctaggattatttgaccaattttgtattcagcttagattagggagaatatagtgtctccttaggtaaaatacttactagaaccaaaaagtccagattaaattgtttttatttttattttactgcagttttgtgcagttgacctgattttaaaatataaaactaggaaggcatatttttcatctaccaaaatgtgaatcttactttcattttgaaacaaacacctctgctttaagaagatgaacggtagtgataaatacaaaaacgttaaaattttttaaatgaatagcgtttgttgatctttaaagaaaacataaatgtgaaataactttagagcttaaaagttttcttcctcaaaccttttaggaattgattttattatccaaaacaactttattcatactaagtgtgactatctgaataattaccttacttttatagttttttttttaaaaaagctcttctaactgtaattatcctcaaagaattggattaagaaattcaataattttctgtcattagtccagcgagatatttactgaatagccattacgttcctggctgttaacactacaaggactccagcaatgagcaaagcaaacaagcccttgcttttccagagcccacattctagagtcagatgctaaacaaatacacagatacatatataataaaatattggtttaagtgttgaaaagcaaaatcagagtaagaaggcaggtagtcattttaaattaacattgagaaatgtttccattttaagcatataaattctttggcttctctttttaaatttgcttttgactgtttgttgctggcgaaaattatttaaagtaattaggaactcatcgtaaatattttgtacactactctaaaaatctaattccaactagtgaatttagcatttataaatggaggtgtctatagaggaataaaatctttggttaaccactactttacttttagcagtaaagtctgcagctcatgaaatttgtaattctggagtggtttcagtttgcaccatcccctggggagcctgttgatacagcactgagctacagattattattcagctgtagaagttttatgcttaggcattttcttacatcttcttctctcagtcagttgaaatcttgtatttttgccaaataaaacaaatcctatattaataagaagctataaataaacagtaggagcatgagtcagagccagcatcaccccattccttgtgtgtacctctctagtactccccagtatgttccttttgcacaaacatgtagtactgcgtaactactgttctacagatgaactccagttatttaagtgaggcctgttttttagaactaagtaatactgtaactagtagaattctggcatgttaccacagtcaaaagcagaatgtgaagctgtatgctattgatgggaggaaaaaagaaatatatttcctacctttcctgtataaagcccagaagattcctgttagatttccaaaatgggtttttatataatataatataattcaacatttttttcagaggaaaaaagaaaaagataagttgcttgaaagtcccatctcttttgctagtcggcttctgtctgataaaattttattctgttttgcttcattgtttattcattcagtagatgttcattgaacacttactgttaccaggcactgtgctaccatagacggtataaagacaaataagctaaaatccttgttctcaaggaatttattattgtagagaaaagtgacttgtaaatccaaaatttcatactgggataggaactataaaagagacatcctgcagaatactgagattataaataaaactagtatgtttgaagcatttagtgtcctagctgttttatagaagtcatttcatttaatcctttcaacagctttatgaggtagatatcattacactattttacttgtgccaagagcactacattcatcaaggaaggaggaggtagtatcaaatttttcagaaaacaagagagttggttatagaaggatgagtagggtagagagtaggaggaagatgaggcagtgtggcatttcagacagagaggtgaatatgtaagcacacaggatgagtgagagaattgttggaatgtagtcagttctaggaaataaaagatggcagggtccagatcatgaagtttggttcttaacctgtagaagacagaaatatgatcagacttgcatttcaggaagataactctgtaattgtttgcaattcctgttaaacgaagaaattttctccagcattgacttatgtttattaaatacatataaaaactaaattctagaaacatcttatacagttatacatcacttagcaatgggatacattctaggaaatgcattgtcaggcaatttcttcattgtacaaacgtcatagagtatacttacacaaacctagatgtatatctttgtttatatttattttttcatatggaaaaccaaatttcttagccatgttactgaatgtcagtcatttcccttacttgatctgcatcaccaacattaagtgccatgtatcagatttctgtatatgttccattataatctcatgggaccaccatagtacatgcggtccattgttgacagacacatcattatgtggtgcgtaagtgtacttatagttttacaactacaaagtgaagcacagagaggttacataacttagccagtgtcacacagctaataagtagcaaagtcaggattcgacatgttaagccaacttcatggacttaaccacagtcctgtattgccactcctcttcatttaaaggcatgcatgcacatattagatttggagacagttctagagacactgaattggcaactacagtcgacaaagagacattgcagcaagtacctctacgttgtttgtttctgtacccttaacttgcagtggtctacaagaaagaatgaaggaagggaagtgatatatttgtcaaccctaactacattgtaaaatgaagctttttttttttctttttttgagagggagtctcgctttgtcacccatactggagtgcagtggtgcgatctcagctcactgcaacctccacctcccgggttcaatctgttctcctgcctaagcctcccgagtggctggaattacaggcatatgccaccacacctggctaatttttgtgcttttttttttttagtagagacggggtttcaccatgttggccagtctggtctcgagctcctgacctcaactgatccgcctgccttggcctcctaaagtgctgggattacaggcttgagccactgcactcggcctgaagcattttatgatgctcactaccaagtgttcataagcggtaaataaagcccttgggctaggtaatgtaagatccattgcaacctggagatgaagaactttgtaaaggggataattgttatcacccatcagagcatcagagttttaagatgatctagatttagtcccactaattatatttctcctaacttttatagacagagaaatcagtgaaaaatatgtatttctaaggattaaatcccaatccatagctcaaggctacctttatgtctaatagttgtgatataatatgttgcttagaataggttctataaatggaattcacacataggaccccagaatcgcttcttcacagggtttcagagttggaggacatataaaaggataaatcaatccataaatctctaagtattcctaaaagaagagtggtgtgtcagttattggcaccagtacatcatgaatcctgctgggctgtggagaaaggagaaactaacctgaacaagactatactctacacagctgtccctgacattctaccacctgttagcattcagtattaatttcatggatcaaatcaaggcatgcaagtgcattaaataactttttaaaaaacaactgctgattgctgacgtctatgagggaagaaaaattaggggctgttattttcctatcaaccatcactctcattaacaagaacaggaaacattacgaataaataaaactcttacatcataccagaaaaaagaacagctgaatcccctaaaggatttcatattctatcatcagacaacgaaagaaaataattccatataaatggctgcatgaatcattgaaagaaacttccctgcttttttaaaagagcaactagaagtatttactttttgaaaatagagtaaccatttgttaaaccgtatataccattgaagatgttttgggtataaaagggaatttccataataattacatagtaatcttttatagccaaagttatgaagaagatcaggatttgggaaaattgtggtcaatatttgattttccttttctgtttgatagccttatctaaattcccctagcttgaatgtagtaaatatgagtgtgtaaaaatgtgtatctaattcacctcttgggggaggtttaatgtaactataaataaaaattctttccccaggttaaaaaaaaagttacatagtgtttaattctaccttttctcatttctctatatccaaaactatcaccaagtactgttaattttactttataaagctctcttgatatgtctcttcaacctcatcaccactgctttaaatgaggcatacttcctcatttggattatggcagcagtctctcttcctttagtctctccttcaaatccacctccatccttcatatcatccatcatgtatttttccctgcctaaattccttggttggcttctattaaatccaagttccttaagcatggcaaacaggggccagcttccacgagctggtccatacctctcctgccttatttcctgacactttcccttataccttgagatccagcttgccagtatttccccaatacctccaccgcatatacaaccacatacatatacacccttatcccctccctcatgtaccacccatatataattctctttaccgcatcctttatcacactcctacaagccttgaagcaatctgaacatagaaaccatctttgattttcaactcctaattgggactgaacatacttgtcttgaacacagattgctgccttgttagtataggtatcctaatatggcacatgtgtatagttgaagctataatgcattccccaagttccctttcaggactaaagggttatttcccaacagctggaagtcctgctgccagacagccttcttcaggaattgccttgtccccaactcaagacaaccctgaaggacctttcccagttttccatggggtccactgaggccttgagattgtactgaagtcaacttctccctctgctgtcgcttcccttccacaggtgtttatcacaagaacaatccttaataaacttcctgtaagcacactctcagagtcagcttgctggggaacccaagctataacaacatgtttatcttgttcacactttcttctgagttctaaatcatgggaagttacagttatccaaaatcttactaattggaagatcatttcatcagacgtgtattgagcacctgcttcatgtcaggcattgtgccagatacaatggaaacaaatcaagacttggcctctgtccttgagtttacagtctgaggtgacagttacatatgaacctaactgtattaaagcatcttgagaatctttttgattcaaatgtcaataattttagtataaaattcaaaagcatggattttgtggtgttacaaagaacaaaaggaaaatatttcaggggaaggaaaatgaatataaataagtagaatgaaattttagaagagcacagaatttgtctttataattctgaaagcctttagggaaaaggtaattttttcactttttattttgacataatttcaaacttacagaaaagtcacatgaatactgaactcccatacaccctttatgcagatatatcagtttttaacattttccctcattctgtttctttacacacatacaaattatttttgtgaactctctgagaacaggttaaatactacattatatcacttcataccttaaaaatgtagtatttcctagaaacaagggtattcacctccataaccacaatgcagttgtcaaattcaggtaatttgaccttgatctttaatctacagtccagattcagattttgttaattgtccccaaaaagatgagtttaggaagagtcatataacttaacatttgtaatgtaaattaaagatctcggaagtttgctaacctgatttaaataccacagtgaaatgaaccacttctgattttctacggagaaagcaagggttaggtccaggttacctgtaaaggtgtgacttagggctccccagaagtgaaccttgctctggagaccccatttggtgaggttcttttcaaaagagattgtatatttttgacccagggattgtcgatttgttgagctcccatgtaagtatgccgccttgccattgacaggtcttcacaatgctttcttaaacgacattctttggaactgtctttcatagtcaggcgacccgccagccaggccgccaggtaggtggaagggcggcttcgggaactagatccggctggttctctgctaacatgtggtcctcgatgctctagcggattggccccaaacctcagcacacagagctttggtagggctggggatgcaggtcagcctgctgaaggcgtctagaggacttgggcgggggcgtgacttcctgctgcaccacttcctttccagccacgtgggcttctgggaccctatgacataatttctggagtggtctgttgggagttgtggcggcggcgaggcccaagcacagctggccaaggcgggtgtaaaacgcgggtcgtgtccaccccaaagctcgacgcctctagaagccatggcttttctgctgaagctagagccggacatgcaggggaaagtagatttgtttcgagcccgtatcgcccaggaggccgaggatctcgtgtccaccttctttcctcagaaggtcttggagctgaatagccgagttcaggagctccggctgcaagacctgtccagaatccattcggtgccaacctcggagcccctggccaccccaggcaacaagggagatgggcccaaccaaaatctgccagttctgctgactcagttctccatcaaggtcccagcactgcttggcagcgagggacagcttctgcggagcaaccagcatctggtggagttgactgagtgggtgaaacctgagatcaagctgctgagagagaaatgcaacacagtgcacatgtaggtgcacccgcttatcctgaaggtgcaggacggcaacaacttcagggtgtctatccaggaagacactgtggaccagctgtggaccgtggatagcacagcggcctcctctctatgcggcttctccacctactacaacacccaggccaagttggtatccaagatagtgaagtacccccaagtggaagattatcgctgcactgtagcagaggtcgacgaaaacgagtacctgagtgtgcgccagatcctgctgcacctacggaacgagtatgccaccttgcgtgatgtaatccttaaaaacattgagaagatcaagatccctcggagcaccaaccgtgataacctatactgatagcctttctccaccccatttgccttcaggagttggcggagctgtttaggcacctagaaggctggttattaatgactctacaggtcatgaaattactggaaatgtgtgttaccatttagaatttcatacagcttatcctcatactgaatcatcttttggtgtaatttttatttgattttccttttgtgaggagaatggggacaaaccatcaaaaagaaaagactgccatttttaaaagcagctttatagataaatgttggcccaaggtttctttattatggccttagcgacattgaatggttttaggggctacttaaaaactaaatcttaaagttaaatgaagtttttcctaaagttctgctatccgttgaactttgttcaaacttacagaaatgctccttttacagcatcatttttctttttttgcgaggaacggagtttaaagggatatgtttaggtcattgtatgcctccagtttaacagattgaaataaaacttggttataaaattttgtgatggcctgagtgtgcttatctgagctttaattttcggatgtggacaattcagatgataatttcctacttcaggtggactcatacacttgatatttttcaactctgatgggtaagaaaagtaagcaaagagtaatgtattttaattattctaaacaaatggacatctacttcccttagaatgaaaagaggaatctgtggaaaatgacttccttccataatcttctatcatctcaggatcttcatttctttttacacaatttagaattccttctgtatatccgtttgtctctttaagtctctgctaaatccatcaagctgtgtatcctgtaatactttttcccccagttgattttcattgccctttctttttgtctcttagatatttcttaaagtccctcattagcatttccctctcaggttatacaggtcattctttttttttttttttttttgagatggagtcgcgctctgtcatccaggctggagtgtggagtgcagtggcgtgatctcagctcactgcagcctctgcctcccaggttcaagagattctcctgcctcagccttccttagtacctgggactacaggcgcatgccaccacacccagctaatttttgtatttttagtagagacggggtttcgccatgttggccaggctggtctcgaactcctgacctcaggtgatccacccgccttggcctcccaaagtgctgggattacaggcgtgagccaccgcgcctggcgggtcattctttaaagaccctaaaatgtggctttgtgttcttttgctacgtcgttgaggggaagccattgtcttctcaacagtaagctatatggttggtatttttaaagttcagcatttccagatttcatttgcaggtaagataaattactgcactgtgagtctattctaacctatgtagattagaaaaatcatacactggtttagcggaaactttattttctttctttctttctttctttttttttgagatggagtttcgctcttgttgaccaggctggagtgcagtggtgcgatctcgactcactgcagcctccacctcccaggttcaagggattctcctgcctcagcctcccaagtagctgggattacaggcatgtgacaccatgcccagctaattttgtatttttagtagagacggggtttctccatgttggtcaggctggtctcaaactcctgacctcaggtgatccgccagcctcagcctcctaaagtgctgggattacaggcgtgagccactgcgccccgccacggaaactttattttcaaagtaaactcctgaaaaatgataacaagtgaaactattcttttgtcgaccttctgaaaagcctgagtctttcaaatctgtgcttaaaaagcaacaacagcaaaaggtattgcctaatagaaagacgtcttacttccttccccttcaagtaaaaagagttctttttattttccctgtaaggtgttctatctgattcagaaaagtgctgggaaccctaaatcagttcataccatttgacaggctttaattgcacacaagtgtataatggacaatgtaagggaagaacaaatgttgcttaatttttcaactaatgttaatcatctaagacttaacatatctgttcctcacataatataatcatcttttgcttgtttcttttactcaaactgtcaagctttatgacagattgaaataaattttctccaatccctggcatgccttttactgagaaaatatgtcctttgtagttaaagatttctggtatatgcatttttcacctttttccaactctgtatcaaattaagttggctctggaatactttataaagtccctacttctgcaaaaattaatctctttgtgattttcccctttcttgcaaatggttggaaaaacttttataataataaacttaggaactggtgttacaatatggtatccaatgtgaatcatttgcctgttattagtacttgttacttgaagccacgtttttgttccttttaagatggcagctgaattgagcaggtgtttttttttttttttttaagaaatggttttaaaaacttattttggaattaagtaattttagttttaaattctaaaactaaaacatgaagaccactaaaatttgattggaagttgaaattagtagatctaatttttatgattgagtgaaatgtcttaaaccacataaatgatggagaagagtcttaaagttcttaaacttcaaacttcttaaacgtttgggcttagttttaaaaaattactgaatcgtttataaatttttctttggttattagaggcaacatttgttttgtagtctttttttttttttttttttttttttttttttttgagacagagtttcactctgtcacccaggctggagtgtagtggcgtgatcttggctcactgcatcctccacctaccaggtttaagcaattctctgcctcagcctcccgagtagctgggattacaggcgcccaccactaagccgggctaatttttttttttttttttttttgtatttttagcagagacggggtttcaccatctcagccaggctgaccgggaactcttgacctcgtgagccacccgccttggcctcccaaagtgctgggattacaggcgtgagctgctgtgcctgtcctattttgtagtctttatgaggtttacatatttatatagaattcttaccaagtagtctcaaccattaatagataactgtgtgatcaatttaagtgatttttaatttcaggccagatgcagtggctcatgcctgtaatcccagcactttggggggccaaggtgggcagaacacttgaagtcagttcaagaacagcctggccaacatagtgaaaccctgtctcaagcaaaaattaccaaagttagctgggcatggtggtgtgtacctgtagtcccagctactctggaggctgaggtgggagaattgcttgaacccaggaggcagaagttgtagtaagctgagatcatgccactgcactccagcttggctgacagagtgagaacctgtgtcaaaaaaataaataaataaaaagctttttaatttcaaaagtaccatctcaatggtcagaaatttgaaaagtataaaaggagaaatcacctatggtttactagcctaacaaaatcattactatttgtgtgtgttttacttattttaaaggatgcatatatgtttttacatcattgcaatatagtatatgcctacttttatagaggataaacatctgcatttaaatccaatctaatattataacttcgtttgatagatatcccctgattcagataacagatacatccattcccccaaatatttttaaggctctgtttcctaattgtgaaaatgatacttgtctgaggcaggaattgtgattagagtatggaacatagagatcaagtagctgggaggaaatgtgcctatatgactgtgagaatgtctagatatttagaatagggttttactctgcttttaggttggggcttcataatagctttagcaacatatctgatcattttattactcagtgctttttccctccccctagagcatttaattacctctaaaaatatgtacaagaaagcattcatgccttatactgattagatgaactgtttcagctttcatgatttggtatgagtaggagggaattctacttcctctgtcagcacttaaacatttctggaaaatgctgtagtgcattgacatcaggcatttttaaaaaattactgatctttgagaaaaaataaaggacccagtgagttacagaaatagatgctggaccatccctgttctctgcattagaaaactatactgctaacacatagaaataactgctcaccttgaactgaaattatccatgggaagccaaatacatccgtctatctatccatcaatcgatagatagatgtatttgtctcattctgtcgcccaggctggagtgcagtggcacaatctcggctcactgcaacctctacctcccggtttcaagtgattctcccacctcagcctgccaagtagctgggactacaggtgtgtgccacaacttttgtaattttgatagaaacagggtttcttcacattggccaggctggtcttgaactcctgacctcaagtgatctgcctgcctcggcctcccaaagtgctgaaattacaggcgtgagccaccatgcccagcctccatattggatgattatacatttgtatatatttttctttgcttgctttattttgatgagtcttcaagtcagtagcagaattttattagtgaagtgtagtaatcccagttactcaaatttaaaatgtttcactagtaaactgaatttaacgaattctctttcatagagaatgttgtgttatttttccttattggtgaaaacctagctggtgcagatgaacaggaatcgaacctattatcagtaaaattagattccttttacaatttggccatttattttagctttattatttaatctcatttttacaaagttatgcaatagtatattggaaaaataatattgctttgaaagtgtgaagtatttagaatttcttaaataaatatatagtttccagtttagatgtttgagatttagaggtgtacttttagccccttgttttatagatgaagaaatttagaatcagagatatatatggcagcacacaactcatctgtgacaaaacaaggtctagaagtcaaatcatcttccatttcaggctagtgcacttttcactgcactttactatgttctaatcagtaaataaaattacattagaagagagttctttcagaaatacgcaaaccagtaaaatttcaacaaattaacatccctttcaagttgtgtgttatttttttctgcaaaatgtaagagaagttgaaatgtttccaactcagaatggactataatatttttactgaattaaatattatgtaaagagctgggctcggtggcacacacctgtaatcctagcactttgggaggctgaagcgggcggcttgcctgagctcaggagtttgagaccagcctgggcaacacgatgaaactccatctctactaaaatacaaaaagttagccgggcatggtggcatgcacctgtagtcccagctactcacaggctgaggcgggggtgggtggatcacttgagcctggggaaacagcgatttcagtgagtcaaggtgccattgcactccagcctgggaaacagagcgagaccctgtctcaaaaaataaaataaataaaaatattctactggccaactcctcccccaccttctaaccttcagcaccaaagaactgctacatagatttgtcatggctgctgctcctaaaaaacctacagaataaaaggggaaagaagagctgtagttttctgttcgggaggaagcctgaaagggtcatttcccaaaagaagtttatcttttagagctggactggtcagtacagtagtcactagtcttgaaatgtagctagtcctaactgagatgtgctgtaagtgtaaaatacacactagattttgaagacttagggtgaagaaaaagtaaaatattttaataacgcttatgttgcttacgtgttgagtgataatattttggatacattaaataaagtagattattaaaattaaatttatatgtttccttttacttttttattttgtgtgcccgaaattttaaggttatatatgtggcttgcttatatgcctcacagtatatttctattaaacaacactgctctggaactaagatttctaaggtaactgagatgatccttggagttgagcctaaacctgctcttgtggtatattttggagatgtgggtttccattaagtatagatttttttgactcctagtaaatttttattgattcgtcatctggttcataatgtacaattcagtaaaagccattcagagagaggctaaacattgtaagccaaaccttcttacagtgcaacttggtcttggaacttagaatgcttacaggaatggatggctagcatgtgctttatgcaagccttttaaatatcatatccaggcttttggtgagagactagagtactaatattctgtattgctaattcagggctgctccatatgctttataaaccaaatagagggtagatttagcatgaatattgagacatttacccagtgtttttatctggatgaaagaataacgtacctctggtgcctcgagagtacctataggcagttaggctttttctcaaggagcaatatttgaacactcaattaaatccccatgatttcattgaattcccataatatagttatatagtactcattgtattctgtgtgtgtgtgttttttttgtttttgtttttgttttttttttgagacagagtctcactctgtcacccaggctggagtgcagtggtgtgatctcagctcactgcaacctccacctcctgggttcaagcaattctcctgccttagcctcccaagtagctgggactataggcgcacgccaccacgcccagctaatttttgtatttttagtagagacagggttttaccacgttggccagaccggtcttgaactcctgacctcaggtgatcctcccacctcggcctcccaaggtgctgggattacaggtgtgagccaccgtgccaggcctgtattctgtatttttatgtatatcctcactaaataagtttcttgagaatagtgtagggttttttattcaccctttttccattatggtgttttgcatatggtaaaattctaaagtattctgaattaaattgagctaaaccaaacctggatgaaactaaagaaaatcgtttctcccctttcttattagaggaggcactttgttacaacagaggatatatgtggataagtgtacccaggaatatgtaacaatgttgagacatctacaaatctgattcagaattaaacaaaggccaatgaagtttctacactgttttctggcttctaattaaacatttttttcatatcacaataatataaatattttaaagtactccaggcagttctccttcagtattcccaggatgtcattaagcctattcaccctgcaacagctgcaagttattccaaacatttgtactgaatctttacactctacaagcccatttgaaatcaactgtgtcaccctattaacagcttcagtaattctctattacttttctaaccaagagttagggagaaataagtctagtatatcagaatgaagaatcctgaaaattgcttttcaaaaccgattctctgtggtcacgaacataatgtttttatttacccttccagattttggtacttaaaaagttagtttcttaaatgtgtaaaatttagatcatttgataaatgattaaaaagaatttcccttaagtttattaagtcttatttggtagtaaatataaaagacaaaacattccatgtaaaaattatttcatacattttaaacagtttaaataaagtaagtgtagtcaactcaaaactccactgccttattcctctgggtcttgcatatttattggtggaaatttttctctgctatttttttacattttacattgtgggataggcacagagttattgaacctatgacctatatattccacagcttacttcaatgcttctattaggcacccgtccagagttgaagaaacgtctcagatcacagcaggttctcaaaaaatgtcattttgtttagcttcatttcaatataacattgatgagaaaaaaaatcagttcccagctgggaccactgtctgtgtggaattttcacgttttctccatgtgtctgcacaggttttctccagtttcctcccacatccttataacttttgcttcacaaacatttattgacttaacttacatcactacgaccaccatcacttactgattcaccaaaaattgcataaattatcttacttgtttttattagtttttattaaatgtatagctcacatttatttcaatatttaatattagaagtgcttggggtctttatttagaagtttggtgatgtttttatagccagaaatatgctgtaggaacgtaactctcatttatatcaattaggctatcataaaactggtttcctttatgtcatttcgcttaaagaatttatggacgacgtgaggaatagtactcaacttttgcttataaataattaacagatggcatgaaaaataattaacagatgacatgaaaagagacctcttaggaagcaatttttacgagcctgctgaactgggagttaacattttcaataagaagccattaagtcaaatataatcttttgcatttaaactctacatcattatattactagaagtctaaaaaccaaacagtatggtaggaagaataaaatgttacttatgaatataatttctgattatacttttagaaagaggattaaaagtattgacaacaaatgaagtcagaatagcttgattaaagtagtttatttaaagtatctccttaatgttatagtgtatgctaattatttgctttgcatatgtacacatcatgacatacatttatgcattagctgagacatgttcattctgtaagttttgtacaaaactaatgatcttcagttacacaagaacatttaaaagttttacatttgaaatagataattaagcaatgctgtgtgaaactgaaaaatgaaaactttgattaaaaaaagtattttcaaatataggatagtacatgtatatgagaatacttttttgggtataatcttagtaacatcattatggtgttatgtaaacatatgacatatgacatataaaattatagtagatagatcactgtgttacccacttacacattcttctgtcgtattaagcaacaaacattattcttatctataataaagcagatatttctgtctgtcatacatatgaaatatttgtatgtatttattggaagtaatttttaaggctagtctttttttataatttcaacttttattttagatttggggtagatgtgcagatttgttacattggcatattgggtgatgctgaggtttagggtatgaatgatcccatcacccaataatgagtatagtacccaaccagttagtttttcaacccttgagtagacattgctccaaaggaagatatacaaatggccaatagcacataaaaatgtgctcaatatcattagccattagtagaaataaaaattaagaaatgtttaaaatatttaatgttttatttgaaaaaaaaaacaattaaaattttaaataacatttttaatggaaaataattatatctcccaaagcaaaaaaaaaaaaaattagtgagaagagtagcactgttttacagttttgcagatttttaatatgtgatttaatggaagataacaagattcttatatatttctgtattcagtctgttgcaatatattgttttagttgaaatatatgaagaaaatctaccctcatgcaggtaagtagttgcaaagggaaggagtactttaatagccttttcaaataattgtgaattattgttttgatactacataaaaactcagcaagtggtaatttctttaaagattagttgcactatagaatctaaagccatatcagtgatacttttaccctctgtaacattaaaaatccattgatctatcttgcagtttgaatggaacttgtacccatgcatgattttgtaacatcattcactgctcatttggaagatactggttcactaagagttaggcagatcttctaaatatgaacatatttcattatacaatgtcaaaaaatcacattcattaatatcaccacgaatcacatcaagaaggtcatactcatggtggtagatacatggtttccgaaattcggattttcactcaaaatcccaaattttataatttgcaaatactgtcaagtattttctttgaaatatcaggcttactgcatttttaaaaagtgcttaatgggttacccttgcctgaataacaataattcgccattatttcaagtaaaagtggtattgaaaaaagtgggttgttcagcttgtaaatcattcacccaagtgctttttcttgagatagccattatgcttcagtaggcagcaaaacagttttttatgttcttgccctttcatcacagagaatgttaataatttttactgcttcaacaaggatattctaaactgaaattggctttaaaatattttattcatttattcatttgttggctgattcattgttactgtatgtggcggtgaagaatacagtgactgctagactagcttggtgccactacatagatttatactaaggcctagcagtttggctttgctttttcaccaacagagtaaatttcaacaaagtgcaaaaaggcttgaaaatagtttgacctgaaagggtcttagagattcttgcctccttagggaaaaaactagttaaaaatctattataatagctctcctttagctagtttacattataaatcgtttgtggttacctactatatgaaaggttgtagtagatcctggggattcaccaatgaacaaaacagatgaaaatgtctgctgttatggagctcatggagctcatttataaagggtaacgatatataataggtgttagagagaaaagtaaagcagagaaaggaaaggaggtgtgtttggtgggaatgtgtgtgtacaatttaactaaggtggctaggaaagacctcactgagaaattgacatttgaatgaagatctgaagtgggagcaggtaaaggtgtgtgcctctacaaaggccacagctgaggccgcccttctttatctacctcttttcatctttccaacttccagaccttttttttctgctgataactcataccttttaattaaactttaatttaatttaatttaatttagtttcttccaactctgctctccaccacttccttgcccctagcacacacacaattaatcagcacttacaaaaacaaaaatttacctctttacaaaaggtacagggatagagtagaggctttgaatacttgtgcttcaattatttttctcctgtcatcttttatattaaaggaaataaaatataggggtgtctccttttcctggttgaattggtagagaatatctatggcagttagtgctaatgtttataaaaaggaataaacacaagtgagatcatgatggagagagaccaaatcagtagggaccaaattataaagagatttcatttctaggctaaagagtttggattggtcatgtgtgcctgtcatcctttatttcattcagtagtggaacaatggctctcaactatgtggttgagggaataaacttaaacaacaaatctaaatttcctatatcagttgcatttaactgttgcgtttcctcagggacttcactctcctcaaactttttggtccctttttttaaaaaaaaaattattgaacacttataagtgttgaaatactaacttgtctaatctttataaacaatcggtgcaataggtgttgttactgtccctattttactaaagagaaaatgaggacacagattaaggaacttgctctatatcctacagctagaaattaagtgatggaagcagaattcaaacccaggcagtctagctccagagtccatccttttaatctctgtctgtgccactctggccagtgtttgtgaatgcagagtcctggaactatctgcatcagaatcaccagggatacttgttaatagtgaaaaattctggcccacctcagacttaccatgtaagaaattgtttttcaagagttgaggaatgtgggtatttatattataaaatcctgcaggtgattctgatatgtatcttttgttaagaacttctgttttagaaggacctaccattggcactgtttttgcttctgatcccagcttcctatgattaaatgctttctgaaagatacatagttagtacagaacttaatactattatactattctatactattttaccccagtttgacttttaagctgttaccacctgaaatttaaatgaaatcctttttagaacaatacttgaccaaacaatttaaaaattgtatttcctacaaatgcatcataccttaaaaatgcactttaaaactgaatggaagccaggtatggtgactcacgcctgtaatcccagcactttgggaggctgaagtgggtggatcacctgaggtcaggagttcgagaccagcctggccaacatagcgaagcactgtctctactaaaaatacaaaaattagctgggcatggtggcgggtgcatgtaatcctagctactcaggaggctgaggcagaagaatcacttgaacccaggaggcagagtttgcagtgagctgagattgcgctactgtactccagcctgggtgacagaatgagactgtataaaacaaaacaaaacaaaaaaacaaaaaacaaaaaaaacaaaacacacacacacacacacacacaaaactgaatggaaactgagaacttactgttctatttatgatgaaagaaaactggtaggctttagaaagtacaccctatgtgatatgaaaagtgaactcttctagattgtggaacagctttatatagtatcatacctccatctttaactaggattgcagctggcaataaagctcagcttctaatgcgagcaagtgttgagtttggctattttgttaacccaagatcctgagagaaaatttgttcactgatgtacataaagcatattatggttaaaatttcttattccactttgtagtttgccttgttaagactagtctttcctaaaatgtgctttaggggcattttatagtcctccatatttctttatgtgacgccaacatcaaaattgctttgaaaaggatcaagatctggagtgaaggctggaggaatagctagacactgaggctcatgcaaggagagttaactttagaaatatatattacatgaaacccctttttttctccccttccagaaatttgtagaatcattgatatgaaagagttggctagtatatctccctgtgttcccttcccaccctgctgtgctatccacacaaacacaagtggcatttgaggtaacttttgagattctgctgggttaaaaaaatatatattttttgtctcaacccaatatgttcctttttttcaacaaaaagtataatgattctcctatatatctatgtttagctttttgctagaagtgtttcctaataacttttctcaggaaacttgttgactcaatttactgtagtcatagagcctcctacctgaccccctgtggtctgctttggtaacacacctgtaggaggcaatgtaatcttcaggaaattcacttcctaccagtagtcctgagtaaagtgaattttctaaaatgaaacatcttgtaaacattatatatgacaaactcccaaatggttaaactctttatgcatttagtgtttgatctttttccttaagaagacttttttttggattgctgtcctgttggcactcaacaaattacaattgctaataagtttcagaggccctaacttattttcctaaatcatatacttcccagtttttgaaaaggctctctattatagctaacaaagttttgaactttgattaactcaagtgtttttgttgttgttgttttgttttttgttttttgtttttttttgagacggagtttcgccctgtcgcccaggctggagtgcagtggcagcgatctcggctcactgcaagctcagcctcccaggttcacgccattctcctgcctcagcctcctgagtagctgggaccacaggcgcctgccaccacgcctggctaatttttttgtatttttattagagacggggtttcaccatgttagccatgatggtcttgatctcctgacctcatgatccatctgcctcggcctccgaaagtgctgggattataggcgtgagccactgcgcctggccaactcaagttattgaatgaagtaatatgaagcacatgggcagagacttcctggtcctatacctgtccaaggcatgtaaccaacattttgtttaagagctttccctagggagatcaatcctgacctggtttagaaacattttttcctgaaactctcatgaaaagagaagaatgattttggatgctactgtcttatcggaaagtatttacaagaaaccattttgaccaagaaactcaaaattaattctggtttttaaaaagagaggcatatattactcttagattgaaccttatgaaattactgatatttgactcaccaaaatgacagttttttatggtccaacctaatactttttggtgttaataaaaggggaggcagggttagttgggcagtttgtgggggacatcctacagagtttgacatgaaaagtatatcttaaatcaaaacttgaatttgtacttattaggatttcaagctcatttttcctctggtgaccttgccagcattatcagatttgtattaagtgtcaaaagtttcctcttgtcaaagtgtaaaccttggctcattcttgggccatctgttgtacactaatagttttgatttattcttctggctgacatgcgtattaatggtacagatgcaagctttatatttccttttatgggtctgtagttttattgcatacattagtggcacaaatacagcattcatattagctatttatatgaactatttctagttttggggtgactaatatactttgcttatgtttttactatgctgagaagccctgtatcgtagacattttaatagactttaaatgattacattctacttaattttaccacccctaattttgttttttgtaatttttattttcaggatatgtcatgatgtatgtctgtatatttttatgatttcaaattcccaaattgccattgctttaatgaatgagcacatttggtttttgatcaggaattactataactactagaaaacaacactagtgcaaaatgtgaatttagataaataactctgaaaggcctacttctagttgatgctttggctctgatttttgagggttaatatgttcttcaacttctttgacagcttgaaagttatgaaatagagtgatagaaaacaaaagctctctaggacagggacataggttagagaaaatttaatacaaagctgtttttgaaataaggctaggtgctatttttatttttgatctgcttttaacagtttcctatattggaaaaccaaacccatctctggaatccagtggatatgggccaaatataaaatgttaagaggctggtgttactattggtctgctatgcaaaactttttccctaatagaggtctgtgttgatctgtgtgaaagctgctcagtgtcacaagtgcagcctgagtttcattcatttctaggggaaattatgatagaaataacattcctttctattaaagataaagggctccaaccttgagccagagttttctaatacagtagaagccatcttatctatatagtgggtactagtagatagtctgttaataaacaatactggctaaaataattttttaaaaagatatgtatctttatttcatttgattatattaatgtgcactcattggctagttttgtatgcagggccaatttcttttctttgagtccaaatccactcttcagagttccatgttgccattcttgcataaactatactcacaaatcagcaaccataatttccagtcttggttacagttactgtatattggaataagaacttaaaggtacttgttaagcaatctgagggcagactattatgatttttatggttgctttgcaaggagagaacattttaaaacttacctttatctttttgctctcttttcacactattagtttatgtaatattttattacacaattatactaatacaattaatgaaagtagtcttgaaaaaagacacaactcaactagtcgtgaatgttccctgtgctatgggcaccagtcagtgagttttatagggggaatgggaagggtcatttaatcagtctgtactctacatagatacgtagaatcaacatttgataactctcagtagggcctgaattttattgtgagttaccataattaatttcagtggagcaaaatgtggtccttttcttttgataagccagtctccaatgcttttgttttcttaaaaagacaagaaacgtaactttgaaggctgtgttatacactaatattctgttggtttctaacaaattgcttggaagagggaattgggagaactatatgaaagtagcatattttctcatgcacaatattgcacaacattagaaaactgatgctttattttcatggtgaaatgttttgatgtttctccccgccccctcccctccatgtttctctaactttttctgggaataagagtaacaatacattgattataatatttgtccacatgatttcattccagaggaaatcctatagtatctaagccctacggaaagcctcataaagacatttcaggagtccattcgaagatgtcttaaaattaatgacattgttttgagtgacagtgccgaaatatatttctttctatggcaacattcttattctactatcctttttatttttaagtagtttcatttttgtcactgttgggttattttaaacaatttaattggagggaaagaaatacaaattcatcaaattttacctccagaattgaatttccttcactagttccttaataagtatttaagtaaaagggggtgcaatatcaagaagactaaattataaatatggtttctatgctgttaaaaaataacagtcctgtccttaattaaccattatggagattcctcttgaccaaatacctttagaactgtttcacagatttataatttaactagtaatttggtttaggtttaggtttaagtgacagaaaatccaaaataatagtggcttagataaattataagtttatttctgtctcatgtataagtttcagagatctaatgatagctacttaatcatcgggatccctgtctccttctgtcttcttgctccataatcctcaacttgcagcttctgtctcatggaacaaagacggctactccagctctggcagtcatatctgccttctagctagcaagaaggagaaagggaaggaggagggaagccttccaccattaccaccttgaagaagttgccatttcttcttacagtccgttgaccagaccgtgtagccttatttggttgcaaaggaggctaggaaatatagtctttattctgggtggccttgtgcccaactaaatatcacaagtcctgttgctattttaatgttacagaggaaggagagcatatattgggtaagaaaaaaaaaaaggctgtttctgccacaattcagtttccccaacaaaataaaaacttggatttatattctttaaaagaaaatatcctctgtagcacagtgctgaatacatgacaggacactgtgctcagtaaattttttttaagtgaacagtaagggccggtcacagaggctcacacctgtaatcccagcactttgggaggccgaggcgggcagatcacgaggtcaggagatcaagaccatcctggctaacatggtgaaaccccgtctctactaaaaatacaaaaaattagccgggcatggtggcgggcgcctgtagtcccagctactctgcaggctgaggcaggagaatggcatgaacccgggaggcggagcttgcagtgaatggagatcgtgccactgcactccagcttgggtgacagagcaagactccatctcaaaaaaaagaaaagacagtaagaggccagtaaatatttattgagtgattacagctcctttgtttctgaaaatgtgactcacagtactaatgatctgaaaaagagtaagatgaacacagagagaaagtaatgattcaggattcattgttgtgaggttcaagaaacatttattttgaggaagtggaggtaaatattcaatgaagttaactacattgtcccagatatatagataagatagataaaatgtatatattatatagacacttatttttattataagatatgtactgttagagttggtagtataccagctttggttccctgcagtctgatttttgggcctcttggtaaacaagtacttaaaaactgttaccccagtttgcaaacctttaataattagagacaaggcaggttaactgtaataattcgtatgcatgcaagatatgattcttctttttcataaatcatacctagtttttagctttctgctgcaaaagtaactagtttgttagaaatttagtgaaaagaaaaagtaggagacattgtgttcagaagatcatgtttaaaaacaacaattagtatggcatctgtatcttagcaggaaactcagaattaagtctgagcctgaccttaacccatgaccagtggaatctaagtttgtttatttttacaatagccttaatttggggcttgcaagttttttggtttgttttcacattcaatttagagaccctgaagcagtattttaatgataggaattaagctatgtataactttcatggcttgaagatcagcaaattctgttttttcttggttataatgttatcttaatcagaaatgtgtgatctttgtgtctaacaatgcacttaaaaaaacaaaacaaaaaattcccttgctgcaatgctggaattctaacagaatttactcatcttctctctcctccccaatttttaaaaacatgttctcatggaaatgttgccttgaattacacaaaatacaagcagttactggaaatgttttctacacagttctgttcatgtatatcaatttcaatttgtttttcactttttagatttttttcttagttttgctgataatcacacttcataatcatatcaactttgaactttgaagttgtgttgaatttttattgctctcagctgtatcagatcctactttttgatgagttatttcatatagtaagtttgttgaatgaatggtgaaacaatgaacacaggaacaagaaaagaaagcaaaatgcatcaaacttaggtttagttttatctccagtttaaccatgctcccttaaatggaaatgctaatatacttctttttttcttttttctgtaacagttcatatgtttttgctaggaagaagaggagttactgaaaacagtagttaatatcaaagtcataagtcatttataatcagccttagaatgcctacagatgtatatacatttttcaaaacacttatactctgccttttctgaagccaagcttctcttggcttattcttacttttagtacttgtgtgctggaaattagaaacctcagatgccctgcacagtgtaggactatacaattgtgctaggcatgtatttataattctttaactcttctaccaaactgtgtgctttttaagggcaaaaactgtacaacttctttagcatgcacctgtcacttgcaaataaatgtctaattctgtggtcccttcaaagggagaagaggaggctaagcaggcaaggctctaggccttggccctgcttcagtcagaatctttcttgtacatgttgataatttctttcttctacagatagaaaattcctgggataagaattttgatgggaaaaagagtttattgcctttaaaaaaaaagtttgagaatgactgtttaggggagatactctcagtatcttgtgacattatctagtctagcccccatcattttacaggactggaaactgaaacacagaaaggatacgtagtcttgtccagattatacagctatttagtggcagaattagaattaaaatcccttgtcttgactgcttgaccagtattctttatagtggtgctacagcatatgtgttgtaaaaacctaggagttttccaagatcactgcatagtgcctgacaacggtagacactctgtaaatgtgtattacattaatgaatgaatgattctaagctggtttgtagttaattaagccaacttcaaataaaaactataatttttcatcatcccaacgaaatattgacctcttagaagccctgaatttggcctgttctaggactaagccaattgttatatataacagattgttctttgttaattttaggatcacctgctgttaccagctaccacccataacaagaccacaagaccaaaaatgtcaattgtgttaccagcaataaacataaatggtaagttgaaattctgatgtatgaacaatatgagatttctttgtttaaccaggattctcttcattagttcaaagacatttaaaatgttcagttaaatgagtatatatccgtacattatttctgaaacatttttccactgttttattatttttaagatccattattcttttaaaaaaaattactacatccctaaaagaaaaagtagctttcttttacttacaaaattggaaaagctagcatcttgactgctctacagacttgcatctgcgacccttctagtcataaatgtagtgtaagaagcccctgctgtgttctgacagtgaatttgtaaattagatttttggaactcaaagcagtttcctgtgttacctaaatgttgatatcatcctagaccatgccacagaagcctgtttatgtttaattgataatactgatgagtttgacactgatagtattactattgcattttgttatattactagccctggacattaaacaaaatacaaataataatataatgcacagatgttaaggcataatatacctgcttatagtttagaagaaaaaaaaagacaagcacaaaaatcactgtactccaaagagaaagtcacgtaagtaatatgtgaggtactaagaaatctagtgaaaagagattactttcagcttgattcttcatggagaagtgaaataactcactcccattaccagttgtggattataaatgagcacagtgtatgttattgactaattgctttctctgacacattatattgaaaatcggagagttggccatctttttcaagtttgtgtatctcacataatgtaggtactagtaaattttctgtctggtagcaaaaacctcagtatatgaagaagatggaaacgaaaagccctttgaactaacctgcagtcgaaccagttcacattttgattgataaatataattaaaccttcaaatacaattataaaacaaaacactagaattttggggggattccagataagtttcaataaaatttagtctttaggggaaaagtggtattcatcatacattttaagaccatagaggaccttagaatttcatgatctgtatatagacagcttattagaaatgcttaggaagtaacttcatagacataaacataaatgggctttttgttaaagcataaaaattacaatatttacttagccttacaaagacattcagaataagtttaagaaaaacagtaacattgagaagaacatctctttcttcagtaaagacatacctttgaagttactcatggaataatcatttactacctgaagaagaatatattccaaagtgcattttattacattccaaagaatgtatttaggaagtctcacttatactcaatctataggtacctaagtttctctgcctaaactagaatagaccaaagggtcagcttatgctcagaaaggctattttctaagctttatcaaggcagaattcacttaattttgttcttctgatattgggttcttatgcaagagaatgcctggtcttattttgtaacagtgagctatctttatattaagccaaaaccaacaagatgctgtttgactatgtttatcttggccaggtgactgatttttgaagaggagcctttcatggatttggaaaaatccagtcattagaggatcattgtctttttaatctgtttcagactctttgtaaatagtctttttaaaaacttccctttttaggataagtcctattaaaaaatcaaaattcaaattcaagaaatattgattgaatatataccgtgtttcaagtaccatgctacatcctcagccttttctcttaacagtcttgctctgaggatacttcttaaattagagcctgattttttccccttcctcatgtacctcaaagtctgcagcagggcaggtggtatccttgcttcccactacaactttcaaattatttctccttcagtccccttaacatcttgcaaatctgtcacatcacactttactcctctaacccttatttgttgctgccgtctactccaccttcactgacgactcctccactgcctctgtcatcctgctgtctaacttcagcatccgcatagaggagtcattagtactctagccttttttgatccagtcatcttttattccgcgccacctcagcctcccatccatatggtcataatctagaccttatcatcatcaacagcagcactctctttgaaatctccttttcaggcatcccactctctgactgttacttactctcttactttaaaactcacactccaactactctcttaacttacaagtctacagtcctttgaccctgccacttcttttctgtgtccatcacatccttaatggccatacattcctccttacccagcttaaattccatggtcctgtcaccactctcttgtgaacaccccttacttcctggctcctttcttaggtcccactttcttggaaaaactgctttctaggtaaacccagctcttctctctatgcctgctctcaagcagctgaaaattgctagaaagtaccgttcagtgagaacaagtagattcacttcaaatttgtgaccattaatttcaaagggatatttaatatgccagtcattactagtaaattcactttccctctctctgaaaaaaagaatttctcaccttctcttgtcaaaactccaacatcctctctccccaccccctcagctgatgaactcaccaaatactacactgagaaaatagatgtcatcatgcaagagctacatcatgtttccactaccaccggcccagctgcatctacacccacaaactctgccttccctcttgttgcactgaaagaaaagtctcttccattgggttctaaatcccagctttgctacttgctggatatgtatcattgggcaagttaattaacttttctgtacctcagcttcctcatctgtaaaagaagatattagtaataccttcctctaagagttgatgtgagaatgaaatgagtaaaaaagctttaaatagtacctgactattttggggttagctgctgttttactgcaataatcatcattgccattgtccttaagacatcattgccaacttctaaggtaatttcttccttttggaccctgactcctagcacttctcacagtgctcaaagactttactctgcatttataccattcgtcttttatacagtttcttcttctctactgggtcattcccatcagcatacaaatgtctttttttttttttcctcgagggagggactcattctgttgcccaggctggggtacaatggcgtgacccatggctcactccagcctccacctcctgggctcaagcagttctcccacttcagcctcccgagcagctcctgaacacaggcacattccactcccagctaatttttaaattgtttgtagagacagagtctccctatgttgcccaggctggtcttgaactcctaggctcaagtgatcctcctgcctcagcctcccaaagtgctaggattacagacatgagccactgcacccagcccaaaatgtcttaatattactgttacctctggtgtagggagacttctttgacttcacatcctatttctctgttaccctttagagcagaactctcaaaagacttacactcactgcttctacttccttacctctgattctgtcttcttttcacccttaccaagcttttgccatttcacttcatgaaatgctcttgcccttccactccactgaaatgctcttgcaaaacggaagtcaatgacaaatatctcgccaagtcaaaggtcatgtctccatggtcatcttacttgacctctcaacagtatttgacacagctaactattccctcttttttttagtccacccaattcttatttttaaaaatttcaaatctatagaaaagttgacagatgagtgcagtaaatatctagagacccttaaatagataccaccaattgttaacatttttctatatttgttttatatctatctatgtacactcaccagattttaaaacctatttgagagtgaattgcagataacatggtgctttacccctaaatatttgaaaatacatctgctatagaaaggactttctcttgcataaccacaataaaatgatgatactaaaaaaaatttaacattgatacagtagagttcaatgtatagcatatattcaaatctctccattttcccccaaaatattctttataactttttgaatatatgttccaaagattatacattacacccactcatcatacctctttggtttcctttaatctagaaaagctcctatcctttttactgtctttgatgacatttacgtttttaaaaattagacttatttaggtataatgtacatacaataaaattcaccaattttttgtatacaatgtaatgaattttgacaaaagtaaaccattgtgaagccaccatttcaatcaagatataaatgttgtcactacttcaaaaaattccctcatgctcctttccagtcgttcccctcctgtacatttttgacatcccttctttcttgaaatatgttattttctaggctttcatgataccatgacttgtctaggtttcctcctgtatctcctcagtcagcttatccagcttctcctcttctgtcaggatggaatcttgtttgttatgttcgccacttaccaccatatccccagcccctggaacagtacctggtgtaggaaaccttgaaagatgaggcactttcatttacattaactcatgtcatgctgagctgccagttaagtgcaggctaactgttctttattcaaatgctgggatcatgtggtgtgaatccattggtcaaaaaggaaagataagaaggacaaaatgcatgggaccagaattatttcagattttggattgtttcagattgtggaatatttgcatatacataaggagatatcctggggatgggacccaagtctagacatgaaatttatcatttatgtttcagatacaccttatatacacagtctgaagataattttatacacaatttttttttttttttgaaggcagagtctcgctctgtcgcctgggttggaatgcagtggtgcgatctcagctcactgcaagctccacctcccgggttcacaccattctcctgcctcagcctcccgagtagctgggactacaggcgcctgccaccacgcccggctaattttttgtattttcagtagagttagggtttcaccgtgttagccaggatggtttcgatgtcctgacctcgtgatccgcccacctcggcctcccaaagtgctgggattacaggcgtgagccaccgcgcccggcctttatacacaatttttcacaattttgctcatgaaacaaagttaatatacattgaaccatcagaaagggtcaggtgtggattttctgcttgcggcattatgtcaacactcaaaaggttttagattttggagcaatttggatttcagatttttggattagggatactcaacttttattctctttattttttatagataatgcctcaagaaagtaattcataccatttgcacaaccactatatagcagagccaagatttacatacattgtataaaatatcttctaattaattatattgttaattcaatattaaagacagatgtgcaaggattgaaaatatttgggactccaaaatttaagatagattttataccattttattcctacactataaggtgggaaagattcattgggagcagtataacataatacagtcatttgaatttgataggtatatgtttgttgaataaaagaataagtaaggtaaatgttatttggtgataactttgtgaccacttgaaaatattttactagtttaataatattttatataattaataatagttagcaagcacagattagtctaatcttttcaagtgtaaagtaattaaaacatatactaggctacctttctaccacattgagatttggacttcagagtgaattgaaattattagcctccttttcagcaattgttctataaataaaaccatgcaaaaagttgtcctataggaaactataattctataggattcttcaagacccagagataaatttctttggcttattagacttatggatttgacaaattatattataattacataatgtataatctgaagagtttaagttatgtaggcacaaaaagtttgagtacctatttattgaaagagcagagacattgtgaggctatccctaatatcagagttgttcattctgagcatataagggtttgagaaagttgaataaaatacattttctgtcatttctgagtttaaaagttacatacaacttggaaacaaaaatgagttgtggaggtgatccctctctctgactcaagtggagcttgtaaaattttggagagggtggcaaaggatagaaagtgaagacagaaattcagattttattgagcaactggtttatgtaatatgctggatggggatatttgtaagatgaatttgattttccaatttaagcacagtaaattacatttccaggtcaatgtctggtcttaaactgtaacgtattatgattatactttgtggttttaagccatggaagaaagtttcagaaatcgctaaagagagtaggatatgggtgtgaaattaatgccatttagaaatcacgtcatatcatctgtgttctccatgccagttttatttttgtaatttattgttttttactttgcattctgtttattatttaaattcctttgtttcataagagagttgaaaacaggttagtgaagctgcaagaaagtaagtctttctttgtctgaggaagttgtcacacaagattattgaaataaaaatagaatgctaggtatgctttgaaaaggcttttttaaaaaaggattgcatggttggtggaacagtggatgatggactaaaagctactgatttcttttttttaaaggattttggaagttctactagtagttactgtaagctaacatttcctgctttcaaattatttctacttatgttgtggtaaaactgttcatttcctttctttcactcttggtaaataattgaacaagatagagcatagaaaagggggtttttaatttgattttttagtgatatgtttgttttttaatggtagatagctaaactttgtagatatctttcataggggaatgaattctatgaacaagccatcagcagatatgtttcataatttggccaacatgttcattgatttgtttttactgtttcccttcccttctgtgtgccaggtacctgtttgtgtggtacatgtgtaataaaaataaacaactgtttataactgttacttgaattaagggcccacgtagatgaacaaatgactaccaggctaaactgtaattatatttaatctcaaggtaatttccatccatataaagaaaatctagaagagcttaatagcaatggttgcaaatactagtgccagcacatgcaacacatttttagttggagaggtcgtaacagaagggtaggaagcaaaccaaccaaataaatgtgttggttttaaaaataaaagaatattcatataactgcttttgatgatcacagttttttggactatcccaaggcaaatatatttggaaaccgtcctattcattctgctcaagcagcctggtttcctaagcaggtcgagagtttttccttttattcttctcaatatatttctccttaaaggtctgcaggttgtctattttttttaaaaaagtattatctaccttgcattttcattgtaattcatttcatttcagtttcatataattgcatccagacagttgaatggagtcttcacttaaaactatgttttaatttttaaaaaatacataatcatagttctctttctctctctctctctcttttttttttttttttttgagacagagtctcgctctgtcgcccaggctggagtgcagtggcgcgatcttggctcgctgcaacctccacctcctgggttcacgccattctcctgcctcagcctcccaagtagctgggactacaggtgcccgccaccatgcccggctaattttttatatttttagtagagacggggtttcatgatgttagccagggtggtctcgatctcctgacctcatgatctgcccgcctcggcctcccaaagtgctgggattacaggtgtgagccactgtgcctggccatcagttgttttttgtttgttttattatattgagaagtccacagcaaagaatcacagtgaatgagccagttgctgtgttgagtcaacggcttaagagtggctaaggccgagattgcagaaattcttttggcctttcccagatgatcacaaagtgactgttgcagttcaagccatcatatttgtattacaggcagaaaaaaggaggtgtctatcaagaaagcagacattttccagaaatttctagaaagctctgcttatgtcttattgaacataaactgtgtcaactatttaggcctggcttcaaaggaggctcagaaagataatattttaactaggcacattatgatttgaaaaaaaatttggagtctttttagtaaggatccaccctcggcctcccaaggtgctgggattacaggtatgagccaccgtgcctggccatccgttgttttttgtttgtttgttttattatattgagaagtccacagcaaagaatcacagtgatgaaccagttgctgtgttgagtcaacaacttaagagcagctaaggccaagcagcagctgcttgctgcagcactccatcatatgctaaattggaattgagcaaagtgtctgggaagagacagtaaagagaggattcatgttgaaaagagaaataaatatttatttattgcatgggatgcagccagatgatttaggtcattaatgagttgaggaagtaactttaaactatcaaacataagaataatacaatgaagactctattaagagattattaatctggctaagaattgtatatagaaaaaaatgaagagcgaagatgagctaggatagatactaggatagatactttggaacaatctcaagatgaggtgattcaaagcttggaatgggaagaaaggaaaaatttccaaagaaattccaaaggaaaaatctatagcatttggcagctgatgatttataaaggagagagaaggaaaagctgattccatgattttgagaccagaccactgagagactagtactgccattcaaagaaatggataaaatgggagggacagtgtgagatttatgcatcttgaattagagatgtcattggtgggtatttttgtgtatctcttgtaacagattggtgtgtatttctgtgtgtctcttgtaacggaataccaagtaattattgactgatgaatttcattttctttcctttttgttagatactaccagccccctcacaagttagtgtccctttccatctgttgtattgtcttagacttctcctcattcaccaccttgatgcttttacaagataacaaagcttatggagataggcatggggcagcaagaaatatagagtgggaatctgcagagaaaagaaagatgagccctctttctttgcttgttttccctgtttgtttgtttgtttgttttttctctgctttgccttgggcatgattgggattactgagattattcctcttgtctatattgttgcattagtattttaactggtgtccctaatttattatttttccatcttaattcctacaattcaccctgcatactgctgccaagatgagtcatccttacatactgcttttgttatatcattatccttcttgagaaccagcggtggattttcagtgtctatcagatgaaatccaaatgctttagcctggcatctaaggcccaggacagtctgtccccacattaccttttcaactcagttctaaccaaactgttctactaacagttccttgaatctgtattcattagttcatttaaaaatactcattcactgattctcctttatgcctaatgctggagataccaacatagaataaggtacccatgatttgtactttactgtagcctctaagtgcaagagacagaagaaaacaaaaaaaaattaacaacccaaacaaaacaattgcagcttatgacagtttgggagaaagaaagaaatatggtcccttcatgaaatatggtgggagtcaggggtagagaagacctttttgattgggtaatgaggggataacagttaaaccaagatctgaaggatgagaagaatcaactgtgaagagtcaaggggcagaagattccaagaagagggagcaacaagagagcagaggccctgaggctggaaagaatgtgttcgttttaggatttgtcagaagaccagtaaggctagagtaggacccagtagggagaggaaggaatgatacgagatcagatcgggaaggtaaacaggggccacatcagacagggaattgtaggccacggtgaagagttgtgatttatcaatatagtgggaaggtgctgaggagtttgaggtgggaagtgacttgatctgatgtacatgtaaagagatcactctatttttgcacatgtggtgtccatgtcttggattacctgtcctcttccctccaggctatctcctacccatccttcaaaatccagctgaaatcctaccacctctgcaaaacttttgctttacttctgtggaccactagaatacttctgtaggtcctagaataaatagtctttcctccactgaacctccttaatgtaaccacctctcatttatggctttatctaacactactcaaagataattaccttgaaggtggtggtgttttttttttatttaactgtgtctcttcctcctcttcatcccatgcctaaagaaatgctctgatacttaatttttaatatatacttagagttgggaaatttttgcctttttatgattcacaaaaaatagctgttctatagctgtatcttacctccctcatttcctctggttggccttacttccctcttatttcttgaagtcattagtgtatccatttttaactcttcccaaaccattagattttctcccacttagcagagcctcttctgaactctctactataaggtaaacctggaaataaatagatttcttaagtggaaaaaatagggttaatggtagagctgcctttatatacttggaatgttattactttgctaagaatgattattgtgttgatgatttattggcagttgcatgggtaatttttccatgaatagtttatattcattgtatttgatttactaattaattatttagtttattagaaccttcacaagaccccagaggtttagattcaatcagcttgcattgatccttctaggatattagttacttctttgacccaaaggagccagttgctgagccccctgtacctaagtgaccttcagagtcctgttagctttcagtgagatcacattcactctttctgccttatggcaaaaatctgtttctactcaaacagatggtttagctttcaacaaataaaaactagagatcagcatctacttaagccaacagagttggtttgagcctcccactaactctccaaagtctgttattttttattttttaatgttaagctcctcctaatggatttatctttgtacggggaaatcaagaaccttgcactttgtcagaagatgagccacttcatataatctcaagtttctatgttttagaagaattgcttagtaagcacaggttcgactgctctgcgttctctcttttgcagttacaccaactggaaacattggggatcataactttctgtggagtgttacataggtgtgtcagcagttacatgatactttctttgttatttaagacatctgcaagctgaggatggccagtgtcatttcagagatgtacatgccaaagacatggtagttttcattgacattgggaaatactccttctcttgagcttttacaaataaaagttagagagtgctaagaaatccacatatttaaaaaaatctagaatcttgacattgaaaatataaatgcagattgttaattatatgttcctgtgttaagaaagcattcttgctttggggatcttgagtacatcagacaaaagttgcctttgaactcaaccaagtatccatagagatatttgcctctatatgtattattaattttacagaaacaaatgcctagcttaaatataatatttagattaaatagtgagacaaatgtaacctgcacaatagtttgctgctaggaaaggaattgttaggaaggccatataagcagtttctttgaagatacctaggacctatctctttcttttcactctattatgtaggacagaaccttgtgggaaatgtgatctacttggcatcattatggtatggattaggacaaagaaagatgcattaatattcctgtactcatgccataaaatatcatggttaaaaaggctttagtacaaagttatccatggtaactcccttcgagggattggattcctttctgcaacatgttgctctgtggccaaccagtttagatataatcaccgccatgtatagagactgcctgctttaaatagctctggcaatttgtaaattgttccttttctgtctcttaaatccacaggattatatataaatataatatttcttccacatgacaaaccttcagctgtgtgtatactatataccctctgagtcttcacatcccaagaccttccggtttttggaagctattcttgtgacctgggttcatggtgcctcgattctggtcattctcttctgaatgggctctggtttttccacatctgttaaagagggctgatgaatgctgagcatagtggaggatctcctaattctatatagtgtatttctattggtgaaaccaaggtgtttttttctagttacatcatacattgtaccttctgtcaaatatagtctttagctttttcatatatgttactaccaagctttttaattttatttgctgatttggatttttggcctgaatttagaactgtgtttttatcctgattagatacagtttaagttccttactcaataaacattcagagaaggcttccctaagtccatggaataggttaggatcccttcccaactttatgtacccagaatactccaaactttcttatttttgtaacattcatcttacttgtaatcagtagttatcatcaacttccctgctaaattggaggcttcttaaggttaggaccttatttattcaatattctttgttattcctactgcctgacaagagtaagtgcttaatacatagtagctgctcaaaaatgtttgttgaattgaattaaatatatgaagtatctatataagccaggcactgtccattgtatctaagaaaaaaatgtaattaattaaatgaacacacagtgaaatttgaactgaatcttcaatactggccaagtgaatgaggcattctgagcatagggaacagtataagtagggatatcagagaaagaaaagtacttagtccatttggggaattaaagttggactaaagtgcacatggatcaaggtacagatgaagctgcagaggcaagcagaagccagttcatcatggccttgtgtaggacatgatacagagtttgacttaagcctctgagtaatggggaactattaaaatattttgagcagggaagaggcacaaacagagttacatttcaaaagatttccccagcagcaacataaaagatagatgagaggggattatgcttttatagggacaacagttagaaagttatcatctaggcaatagatgatgggtagttcatatttaaaaaaggattctttctgtatactatctattgtgtgtaacaaattactccaaaacctagcagctgaaagaaaacaaacattatctcagacagtttctgagggtcaggaatctagggccagcttagcagggtgattctgcttccggatctctcttgagattgaagtcaagctgttgactggggctgaagacttgattgggtctcagggatgtgcctccacattcactcacgcagcaggtggcctctttctggggctgctcacaacatggcttccccaaagcaactgttccgtaagagtgagaaagcaagtgagtaagagcactcccaagatggaagccactgtcttttaaacttaatcttggaagtctcataccatcacttctgctgcgtgctgttggttacttagaccaaccctcgtacattgtgggaggggactgtacaagggtatgaataccagaaagtggggatcatttgggggcatcctagaggctgccttccatgctgcttgtcaaagaatgtaaagagtaagtctacaagtccataatattttgatggcttatggagataagagggcagaacactccacctagaaactatcctattacctagagcaggtaaataaagtcatttgcttgactgaaaggtaagagggttaaaacccaccattctaaatgtcaagtaatagttacgttgcagtcattgcttagttttatactataaattatgatgatttggttccatgtttttttttagtataatgtgattgctgttcagctttatattcagcgcatagcactatgccaagtaatgtacaggtttcaaaagaagactaaaatgtgattcatgccttcagagagttaatttactggaaaacaaggcatacatagatcatagaaaatcttagaccccagagaaaacttaggggagtttaacacaacagcctcatgaaacagctaagaaaacgggttgagggaggtgaatggctgatccagcccagctactgacagagctgagaccagatctcagacctttaggtctgtaggcaagcattttatttaaatataaaatgtaatttgtttacgataccaagaacattcttttttaaatataatgtaaaaaacatttatagagacagggtctcacggtgttgcccaggctggtctcaaactcctgggctcaagcaatcctcctgcctcagcctcttaaagtgctgggattacaagcgtgagccaccacaccaggccaagaacattgtctgaggacttaaatcatttttctatttgaaatcagaatgacttagtatttgatgtggggaaaggcaagacataaatgtgttagaagacatttctgtcttctcttgaaagaccaactcatcctgtcactgattactgtgtgactttgagctaaattacaacacattagtaaatacagaagaaaataatgagcaatgccacatcccttgcattttttaaagcaaggaccaccctaattgacagtgagatctttatattaattttcccatttaaaatagataatattcagtgttcgatgaagaaagaattatggggtagattatgaaataataattggaatactattactgttaatagtaaaaaatgtctgaactatactgttggaataataagagtagaaatgagtaaaattaagtatttacaaggtttaaagtattttggagttttgtttccttttttaaaaacaaaatgctttttaactgttcattgcctatattaccaaatagttttaagttgtacattcaggttcagctccccttttttgagtacccaccatttatgttaagtatattactgggttctttaacagatataattgcatttggtcctcataaagcctatgtgagataaacattttccccattttacagctgagataactgagaaattaagagaaccacaactgaactttctgcatggtcctttgaggtcatttttctgaaaagcaagtgctaacttttaatagtgtctttagcctttccctcaggcaacagcgtatgactaagtcaagacagcagaactaaatacgagtttatgttaccataatttcagagtaacagctactgttttatgttctggtcatctattacataaatatttaatactgagcacataatttggcatgatggcagcaaaaagatgtctatcctggagtttccatgataaaccagaaaggctttttttccccaccagtatgttaaaatatggagaaataaattaggagatggtaagctatagctttcttatcatcttaagtttacctaattaaagcactttaaaataaattcattccatccaaatttagcagccatctattgcaaagtttgcttcctttttccatgacatttaaatatacaaaagccttttttttaaaaaaaaaagcattttttagtaggtaaatgtcagtcactttcttaaactagcctgtcctagaccaacagaccagttctactttcaaaacaaaacatagcatttaatagtaaaaataaactgtcttctcactaatgaatttactgtctgcatttccatagatgtggccatgtgttttcccaggaaaactggcttgaactcaaactaagatagctactaagatccatttagacaaagtgggctataaacatgagaaatcttccgccccctattctgtgtttggttaattttgctgctctcatacattctagcaatgtaccattctgttctcccttttactccagggagcctcatttggcatatagttagtcatacgcatacacctttgaaaacagtcaatgtaactcccagttattaagaacctgatgggtgctaggcattgccttatgaactgagaggtacaaatatgaaaactatataaaagctcctgccccagataaactatgatacagaagaacatttgttagctactttttaggtgctgtgtatcaatcagttttcttagtttcaggtgacagaaactaactctgggtaacttaagtagaatttctaggagggccaaagaatctgacttggaggtacggtaaacaaaaacaaagtcctaaattacaccacagagctggacatagaccatagcttacatcagtgatagtgctgatcctgaactgtacttccagaaccaaagccatggctggcccttgcaactagataccactccttctaggccttctagggccacccttctttccagaagagtctcctttgcagtctggagctggtgcatctgtgtggcagagcctaggccatatgcctgtaccctagttacaaggaagtctgggaaataaattatctggtactttatacacttaactagtaggaggtcagctctatctcacaagataggaggttctgtaaacctaggtatgcagtcaggcactaagtggccaaaaacttctatcagcagcattttgaataatcagagaagattcaacacaggagatgagaaccaggaaacaacaaccaaaaaagaaatatggtgagtttggccttaatatcacaaaaagatgaaaaaacaatgtgttcctaaaccagtttacaaacccacagttagtgaaaggctaggtgatagcttatattctccaaagttataaagtcctaaagaatgtagcctctacttgagacccatttggtctgtgcaggtacaggcactatcatctctctctgtaaagggtcagtatgatgtttaggaaagcagcccacatttggagtcaaagccttttgttcttaccctgcgcagcccttaaccagatgtgtgacctgtaagcaaggagttcagttagtatcctcatctataaaatgagaaggttgaggtaggtgatctttaaagttcccccttggctctaaagttctatactttgtacatgataggccagtgacaactaatgtttttactcaagccgattgtatgttttagaaggcaaataaattatgagcttattttttgatgacagtacattttcataaacccaaaataattaaatctccacctcccacttagtttagttgttttgggttttttaaaacaattttattttcccacacagtacagtttaagcattcaagttgcagcaggggaaatactcattgaatttgtcatcattatttttggcttctatctttatgagagccattttagttttctagtttcagtgatctattttttagattttaagctacaatatattttaacatttgagtattaaattgcatttgtcataatgaattagaaccttacgtttctttcaaaaatagctttatctcaatatgaaatgcaagattattcacatttattataaagaggagaatttttgagacattctatatccactggtcagttactgttttgatttggtgatggaaaatcatagcaaattgtacatttaaagtaaaccaaataaataactttatgcagagatagagattgaagtagccatttggagatgagaattttatctccatgccttcaagaaagaccatatgtaaaccaggtcagaaaaataaaaattacaccatatttattttaataggaccatcttagaatacaagacataacacaagagaatttatttctggaatgacgtgaaggaatttattatacaaactgctccatctaaaacatgttcctaaaatgtaggttcgtagaattttttttttttttcccctggggacatagtttcactctgtcacccaggctggagtgcagtggtgtggtcttggctcactgcaaccttcgcctcccaggttcagtctctcctgagtagctgggattacaggtgcacaccaccatgcctggctaatttttgtattagtagagacgggagtttcaccgtgttggccaggctggtctcaaactcctgacctcaagtgatccactcgcctcagcctcccaaagtgttgggattacaggcgtgagccaccgcacctggctggttccaagaaattctaatatttgttctgtttttaaggagaaaaattattgaacaacttacctctaaactatagtcctttaatgataaacactactgttaaaaaattcttataattaacataatctgatattgttacttaagtctttgaagaaatagagaaaaactggctaacatcccttatgactgcatgtttttatatattaaatagcagtatcgaattgccttccactatctttttcagacgaaataatatatatttaaaccttgcaagccttatccttttttatacttcttttttctagaacagctttattgagttataattcacataccatacatttcacccatttaaaatctataactcagtggtttttagtacaattttagaacatatcaccccaaaagaacccatccccattagcagtgactcctcattcacccctttccccactccagtaatgctgagcatctttttatgtgttactggccatttgtatatcttctttggagaactgtctattcaaaacatttgcccattttttattggataatttatctttttattgaattataaaaattatatcttctaggtacaagtcacttatgagatatatgacttgcaaatatttttactcattctgtgagtttgtcttttcactttcttgagcaagccttatcttgagcaagccttattcttaactctggttaaattttggttttctgaacattttgctaaattttctaaaggtctccagttgtggagtagcctgaaatgaatactttattttttgaaagtggaactaaactctaatttaagtctataatagaaaagagtaattgctataggaaccaacattttttttggttgtttaccctgtgccaagcattgtgctgagtgctttgcaaccctaaaatatagggttgttattcctgttacatagatgaagaaacaaaggcttgaagaagttaagtaagttgcacaaaatcaaaaagtgctaataaatggtcaattggaatgacaatgcaagttattttttttgaccaactttcacattttatgtggggtgtttgtattccactattgtactttttaagacaatattattttacagcctcattttccatccactacaatccctagattttttcaggcatattggaaccgaatcattcacttctgtctctttaaaactggaatttcttggtttctgaaccaagaaatttgatttgatttctatagccttttgattttttgactgtcccttccaaattggccctttttaaacaaattataacaattttcaaagctaaaaaaattctaaaggtaaacttgccattaaaatgattaaatgtaaattgcagaccattttaaatgtctttttgattagctactattaagaatttagctgatctacttcattaaaatgttatattagctcaatgaataattatatatttctgtgtaacaaattacccccaaaactttaatggcttaaagcagcatttgttatttcacagtttctttggtttaggaatccaagtagagtttagcaatgtggttctgctctaggtctctcatgaggtttaagtcaggctgctggctggtgctgcagtctcatttttggggaggatctatgtgcaagctcactcgtatggttgttgggaggattcagttccttttgagcttttggactgagacctgcaattcctcactggctgttggccagagttctccctcagttccttgccatatgcgcctctctatgagacagcacatgacatggcctctggctctgtcacaatagcaacacaagagagtgtccaagatggaagccatagtatctttgtaacctaatctcagagttgatatatcatcacttttcccatattctactcattagaagcaaactattatgttcagcccactctctatagaagggaaataccaagggtatgaacaccaaaatatggagcttactgagggccatcttagaggctgcctgtcacactcagtgaatctattgtttaatcatggagaatccaaaagtcatggtgtttttatatagaacattgatatgtacagttccatcctgcaaacaagtgataattttatctgaaaatatataaggaagtctctccatcctaaaatatgcatatgtgtatatgtattatttttaaagcatctttagtctgcatatacatttgctacttattaatctgttttatcaagagacaacattaaagttgtaagacacaattagaatagaaaattttatgtgtaactttatgttctccccttgacttataaagattgctattgaattttagtattggaaaactttggccaatgtaaagatgattttaatttgaacatgtacaacatgcaaaagaatattttttctccttaaatcatactttagaagtcaaccctaatttaacaaaataggtgatcctgaatggactttaattcatttattcagcaaggcttattgaattactcttctaactcatcatgagttacactcataataaaagtctgcactcctaattttggcctcccatagctcagtcaatctctgtctatgtttccagtttcatttcctattgccatctcccttaaccttccactccagcacagtttttcttgctcctccccatgttgatgctcatgcatgcctcagggcttttccatcttcctgaaaacctcttacccagatcgttacatggctcgcttcacttcatttacttctctgctccagcatcactaccataaagaagcatcccaccagcactcttcacaatacagcagggaccatcaaaaagcaagagacacaataaaaatgatagttgaaaagattaatctcatgacagtgtacaagataacttgtacgtaaacaggctggattagacatggatgagtgggggccacaattaggaactttcacattcattcaggtgtgaattgataatgatccagttatgaccaccttgggcatgagtaaagctacacaaacattctcccaaaaccaggtcttccctcggatttgtgatgccggtaaattgttgccaccttcctccatcctcctctaacagagccatttcagaaccaaaactttttaaagaaaagtttgaaaaaaataagaagcaccaaagaattagcaggaaatggttaggttttaggactagaaaccacaatgcagtaggggctctgcaagaggaaggagtgagtgcttcaaagtgacatagcagctgtgtgctgttgtgcctgagactccttccaatcctagatgtttcctagtggtgctggcaaagcttctgttggctgtaccacattctttcccaatccaactccctctatgtaaagtctcataattctaaggatcctgggttcaaatgtaagtttcttccgtagtagttaccatttgggtgtttctgcttcttctaaactcccttctaattgtttttcctcttgtttttaagctagtgattttttcccctgtattttacatatgcttatggaaagaacagatatgttttcatggcacttagcatgttataaatgcattgttttccatggagtaagatcattctaccactgagagcattaaatccatgttcctaaggtaacccatgttttcctagaaacaggggaagagtcatgaccaactttcacattgtctgctttgttcttggggtatcatccattgtgataaccattcccaagaagtttcctccccaaaacagaattacttctctgcctacccttgattcaagtgacctttcattacagataatctggttttatagggaaatctagtaggttctgcactcagttgtaaagaaagacagatgcaaatgggtttcagtaattggtacaacattgtcacaaagctctttagattagcaagtacttataaactaggtggaatattttttattccatgttgttaataagaatgccctaatcctctttacacacttgaaaatatccagggaatgcagagagagacagacagagagatagactcgtatgtaatcatggacttttgagataggtaggtatagatgttcctgtaaactaagcgtttgtagcctcccaaaatttatatgttgaaatccctaccatactgtgatatggagcctttggtatgaggtcagaggcttcatgcatgggattagtgctctcataaaataggccctggagagcttcctcaccccttctgccatttgaagacacagtgagaagatgaatatctgtgaaccaggaagcaaaccctcaccagacattaaatctgccagtgctttgatctagttcttctcagcctccagactgtgaggaataaatttctggtttttataagccatcctgtctatacagtttgtcacagcagcctgaacagacagagacaagtgtaatcccatcttttccttagctgtattattaggttagtgcaaatgtaattgctgttttcgccattttaatggcaaaaatcacagctacttttgcaccaacataatatttgctcacttttctctgttgtaattttctcatatgagactgtaggaaagaatgatttaatatattctataaagtgcctagtaatataataggtccagcatatgaaagcattcataataggttctcagtaaagagtggcaatgctcgagcatttctaaagaaacggaattgattatattccattcctttttcagacagttataaatgttagaaatttctttctgttactgctccagaatctgtgcttttcaattattggttctaattcagtatttttaggcctcagagaaaaagccttaatgccgtcttcacgtggtaggctaccaggtctttgaagatggccattttgtatcccacatcttctccacatctgctcatagaaatacagtttcttcatttgctcccttatggtttaggttcgaagcaactcagaatggaacacaacgctactggtgtgttaattagcaggtgagaatggaactatcaccttttttgttgtgttcttaacacaaccttagttggcatgaatttgaggagcagttatatttcacctttgacttgtcaaacttacacttgactaaaacctacagatgtttttctttttaattttttttaatttttaatttttgtgggtacatagtaggtgtatatatttatggggtatgtgacatgttttgatacaggtgtgcaacatgaaataattacatcatgaagaatgcagtatccatcccttcaaggatttatccattgagttgcaaacaatccaattattacactctttaagttattttaaaatgttacagatgtttttcaaacatgtctctgttctaccctatctctctcatcatatatttgtatgggattttacattttgacatattaaatttcatcttgttggagtttgctcgttttcttcttacctatgaagctgttttgggaccctaactatgacagtaagtcacttggctatgcacttaatcagcatgtgtttaatatccacactcacatttttataaatatttaacaggaagggaaatttatacctccaaacccactctaatccctgaactccaaatgcatgtaaccaactgcctgttaaatatcttcacttagatgattcctgtcagttcacacttaaccaaactgatttccaccctcaaccttctcctgtagtcttctcatcctagtcacagtgaagcatatccgtccttcacattgcacagccaaaaaccttccttgcagtcatccttgacccattttgtttcctcccacatcccatatctaatccctcagcaaactctacttcacaatgcatcctgagtcatacctttcttacttcttaccttcttgcactaccactttggaccaaatcatcagaaatagattcctaacattttctgtatttacccttacattctttagtctttttaaaatattgacgctagaatgaacctgttaagacttaaattatgtcactcctactaaaaatacaaaaattggccaggtgtggtgaggcatgcctgtagtcagtccctgctactcgggaggctgagttgggagaatcacgtgaacccaggcagcggaggttgcagtaagcagagattgtgccactgcactccagcctgggcgacagagtgagactccctctcagttaaaaaaaaaaaaaaaaaaaaaaatcaccttaatgccttttatctctggttacttcaacaccataattaccataaataattcatctctgttggaatatttgtgtcccattaaaattcgtatgttgaaatctcttcactaatgtaatgatatgaaaatcagcctttatgggggtgattaggtcatgaaggcagagccctcatgaatggaattactgctcttataaaaagacaaaggactttgcagggacgtggatgaagctggaaaccatcattctcagcaaactaacccaggaacagaaaaccgaacactgcatgttctcactcataagtgggagttgaacaatgagaacacacggacacagggaggggaacatcacacatcggggcctttcggggggtgggggacaaggtgagggatagcattaggagaaatacctaatgtagatgacaggttgatgggtgcagcaaaccaccatggcacatgtatacctatgtaacaaacctgcacgttctgcacatgtatcccagaactgaaaagataataaaaaaaaaaatcacgccactcctctgttcagaacttaccagtagctttccatctcactcagagtcaaagctaaagccctgacaattgcctgcacaactctacatggttctgcctccccttcccacacatgtacacaaacacatttgcttttctgacctcattttctagccttctacccttgcttcctcctctgcatgcacagagtcctctttgctgtcccctgaacatgccaggcatactcccaccttagggcctttgcatctactgttcgcctgtctggagtgcactttcttcatcccatgcactatgaatcttccttctgctctcatttttgtttaaggtattatatgagactgtgctactaatagaaattatagggctcttttggctagtgtcaagtatagatttgcgttttggactcacataactgaatatgttagaattacatctaaagaaataattgcctataaatggagtattgtgtgtgaagagttagagtcctgccccatctcctttcctattaaatgatagtgattttcacagtatctgagatagccctttgaatatcagagaaacataagagtgtaaagatttcaaggaaatggtcatatttttcagatgagaaaagttcaccaaagattttacccattggtgccagaaatgtaaggcaggcaagaagttagtagaagaaagtcatcacactgtaacaattattttttttaagttgtaggcactgatttccaaatgagttccataaaccactgctatttccatttgtagtatagcaataggttgtgatactaaccttaaaggtctcaagttcaacagcttattatgaggaaagctgccattcctttaagaaggtgagtttctattatctttttaaagagagaattactcctttataaaaatgtaacttcttcatactgtatttcagatctcttgctttttagtaaaacttttcattgcagtgggtttgataataatagtgctcacttttaaaaaattccctaaattttagtttcccctccagtcaccagctcacttttctgtgatcctctttagcagaactccttaaaagactcatctatacttgctgtttcctccttctctcctgctgttctctctataacccactccaaataggctttcatctcgtcgctccactgaaactacttatcaaagtttccatcaccgtcatgctaccatattatcttctccatcctcatcttattcccagcaacatttgacatcaccttggaacactttatttacgtgatttcactgagacctcctgtctggttttgtttttcatcttatttcattagatgctagttctcagtctcatttgactctttctcttctcccaaaccctatacattgaaatatcccaaggcctagaccctctagtctttggcctaggtgatctttttttatatatgtattttaagttctagggtacatgtgcacaacgtgcaggtttgttacatatgtatacatgtgccatgttggtttgctgcacccattaactcgtcatttatattaggtgatcttattcaatcacatggtatataaattacaatataggctactatgacagaggccccagaatgaaggtgcctaaacaagatgaaagttgatttctttttcctataaaagtgtgggagcttgtccaagactgataggatagcttgttagtactggagacccacgctctttctttcctgcactctgctgttctcaacatgctgtctccatcttctggtcccagatggctgcttcagcccctgcatcctgtcagtattctaaccagcaggaagaagaagataggaagtgagaacgtatcccttccctttaggactcagaagttaaacatgtttcatctgctctcatttcattggccagaactgagtcacatgatgataacttgctgaagagaatttaggaaatatagtctttaggtaggtagctatggcttccagctaaaatggagcagttcttttactagaggaaaaagagcgtgatggattttggaggacagggagcagtttctgctgcacatggctttaaatactatctatgagctaatgtctcccagatttgtagctatttcctgagttcaggactctttcctcagctgcctccctaacattctcgaacacctgcctgttcaaaattgaactcttcacttttctccccaaactcctacccatcttaggtctcccaggtgctcatgccagaaacttagaacagtcttgattccttgccttctctttcatccacttttgatccatctgccaatcctattaactttaccttcaaaatggactccaaatccaaccacttctcatcagatctatcttccacattaccaccaatgacttattttaataaaatacatatccccatcctgtttcttacttccttaaaaccttcctctgtctccttattgcctttgggataaattctaaaccctgtgtgaaccaactctttctatctctctggcctcattttcccattttccacttatattttgtatttcagtactacctagcacaacacacctcatgacttgatgtatttactaatgcttatccctctgtagaatttcccccacctcagacctggctgaagaatcccttagtctcaagtgtcacctccttcagatctttttttttttttttttgagacagagtcttgctctgttgcccaggctgaagtgcagtggcacaatcttggctcactgcaacctccgcctcccgggttcaagcgattcttctgcctcagcctcctgagtagctgggactacaggcatgtgccaccacacccagctaattttttttgtttttttttagtagagacagggtttcaccatgttggccaggatggcctcgatctcttgaccttgtgatccgcccacctcggcctcccaaagtgctgggattacaggcgtgagccaccgtgcctggccagaaaatgttctttgtcatctctccacctccccaggctaggtaggcaccttcctctttattcttgttgtaccatatgcatacccgtatcacacctatcctggatgataccagtttacatagctgcctcttttcctagatgcaagtgccttggtcaggggcaagggcttactcatctctcagtgcccaacacataatagctgctaagtaaatatttatgtaattgaatcatattgatcatgggaacaaactcccattgggagagcatcacctctgccttacatatctgagaaaagcccttgtttattgtaccctatcaactgaatctgctgggctatatattaaagtgggtattttaggccctgcttaaaaaataaaggttaaattgagcatattcattgctctgttaggattacataatgcctgatagtgcaaaaacatggttgttgactgaactttacagttgtctggggtttgtgaggcccagctatagtctaggtagctttgtgtgtttgaaggtattctgactagatgagtcagtagtttaaaagtaacaagtcactgttggtctgtgggagaagttgtgtggacttagacttgccttcactgctttaaaatcttgctttttaaaaaatcccaagaaaggtaggttctctttaaaaagtttatggcctgtatttgctgtcataaaccaacccagttttcagcctttagccgggctccgctcccttagagatgaatggtaacccatataaactacatggcgattctagttgtttttagtcaggaaaagccccaaggtttttattaagaagcccagaaagaagagatgtcaaggattccggtgagaagtactatgttataagaagcagattaggataacttgtcttaaaaatgaaaaagggatgagaaacttgacaagtttttagtgctttcttagcactaaatgatgacttaaagaaagtttagtccttgccaaattttcccctttggaactgtttccactgtgtgatagagatctgccgctacgagcttgtcatcattctcatccactgtcttctttgtcttcttcgaagtcacgtcctactcctcttcctcttatcttctttttttcggcggggtgggggggttttgtttgtttgttttttgcactaagtcatagaactgaaaagactctgggtaatgttttcaaaataaagccacattgtttccaatacaacagctttctctgggttctttcactgcctccttaatgtaagtcttaatcacacttgtattaacagtagaaacactctgcagtatctcgtttcatacagtggtgttagaagcattaactcctcagccctcataccatcacaggaaaacagcaatcattgttaacccccatccattggggagatgaagaaaatgagcaaactatgaagaatgcagtttatttcgtctccataagactgtgaggcagtggaaggtaagggctagaccccaggatggctgattcctagggctcttttcctgtgctccagaatgcagtgacacctttcagttgttgctgtattcagaggtgtgtgttgcatgtgataggtacagtacttgacattattaactcttgcaaccaccctatgggttaggtattaatatccccatgttatagatgaagtctgtgattccaaagcctgatgtctctccactgtgccacacacactgactccacacaataacaattactcccatttcatatcacttgacatcctgaaagtcctccacaaacatcatcatatttaatccttaagaactttggaaatatcagtgattatcacacactttgaaataagcaagtcactaatcaatgtgatcttattaaaatttaagtcagttcatgatgctactactccgaccttccaatcatgtcacatctgtctagaatcaaggcccaaatctgtgtgacctgtgatatggtttggctatgtcctcacccacagcctcatctttttttgtttgtttgtttgtttgttttgagacagagcctcactctgtcacccaggctggagtgcagtggcgcaatcttggttcactgcaacctccgcctccagggttcaagtgattatcctgcctcagcctcccaagtagctgggattacaggcatgcgccgtgacacccggctaatttttgtatttttagtagagacgtggtttcaccatgttggccatgctggtcatgatttcctgacctcgtgatccgcccacctcggcctcccaaaatgtgggaattacaggcatgagctaccacacccagccccaaaacctcatcttgaattataattcccacatgtcaagattgagaccaggtggaggtaattcgatcatgggggctgtttcccccatgcggttctcatgatagtgagtctcacgagatctgatggttttataagcatctggcatttcccctgcttgtactaactcagtcctgcccccttgtgaaaagggtgcctgcttccactttgccttctgccatgattgtaagtttcctgaggcctccccagcaatgtggaactgtgagtcaattaaacctctttcctttataaattacccagtctcaggtatttcttcatagcagtgtgagaacggactaatacaacctgtaaggagagtggtccgctggtttcctctccagcctcatcgcctcctactcttcccttgattctctctgcttcagtcacactggtcaccttactattcctcagatactcagggcacgctcctgcctcagggcctctatacctgctcttccctctatatgtaatgccctctccccagacacctgcttgactagctcccccagttctgccaggtctcgaacaaaaaatcaccttttcacacgcacacaaaaagccatcttgctggtcaggacttgccagaccactctttgcaaaattccagtctagcccctaacatgtcatatccaccttccatgctttagttttatccttagtctttatcattttcaaacatactgtgtatttacttacttctctcgcttaccatctgctcactagaatgtgaatgctgtgagggtagggctttcatctgttttgttgttcacttctccactccagcacctgtaacatactgggcacatagcaggcactcaataaatatttgatgaatgaaaacagattagaaaatagaaagtcaaagaagctaagtgagtttccccaaaatgatatggtatagcagcatcaaagctaaaaccaagactggtcttctgatccacatgcagtttggtgctcagttaggccagaatccgaaaaagttgtaagttaagttctgaaataaaactcagccaaataaagtagtttggtgtaatttgcacttttaaaataatttttcatcagttactatatcatagaggatgaagagcagtccttcccttggactgtctccaagcagcaggaataatgagaataagttacagaacttaaaataaacccaggtgtttctgggcctgagattcttaatgtccacaatgaagggaccatgtcagttcagagctcttcacagctctaatcttgaatccatctcatggatgaatgaaatgcctggttttctttgtaatttgttcagttctatgcatacaaggtatgcagtttgttctgtagataaactacacatgggtatttctgtaactctccttttatcatcattaccgtctgtttgattctttcccctacatttgtgcaaaatgtaggcttgtcatctcactgtgttgtattgcaggatcagcaagcatgtcaaggatctcatgtgtcttctaatctcatgcagcctctgctgcaaggaagctctcaccactgcctcctcagagttatccaatgggcaaagaaaccagaaggcaggacgacttaaggccagggaactaaatatgcaataatggtgtctgggggtcaggaaagcaagtgtttgtacaacatggcctggcattctttgtcactctgaattaaatctgcacatggtaatcagacctaaaagaagtgcaccaataagtcaggccattggttatccagctctatacaagttttggcaaagaaggttaaatgcagtgtttggcattgtatctcatcctggttcatttcttcattaaaaattccctctgtagagagtaaaatacagttattttgaggtggtgtccatatccttaggaacaggaggcaccgtcctaagctcctttacacataccagctcttaaatacacaacttgagtaaggtttataattctcatttctattatatgctgcacatggcttatgataaagtgaacctgcaaatgatagcaagatagaacaagtctgcaaaagtaagaatggcacgttaattacagaagttggatcctatcagtaatttaaaccaaagcatttatttgaaaacaaaatgaaacaaaacaccaatgccctcagtcaccttcttattccattcccatttgctccagtaggaattaatctctttatttctccttacccttgagcacttttatatatctgcacttgggttaaaggcagttctattaatttctttgtttggacagaagtttccttaatttaccataatcatcactgttgtcactatgccagtccagtatgtttggacttcacagataagtcttgcagtttccaaaacaccatcccatccttactgcgtttattcttgaatgacttttcactgggagatagtatacttatctttttcaacaaaactacaaatgggatcctaataacaagtttactgtttgttaatttgtgttagatataggcatactgtcatattttcctgtaatttttcatatctggtcttgtgaactgttactagtatttttcttccatatgtattttacctaccaacttgattgtaaactgcttaaagatagaagctatgttatataagcatttcacgcatgctggctcaatgaatcacaaataattgggaatttggttagacatctcatctgaacagtccctgccctgataccaccctgggacattcagcccttggccacctgctttgatgagcacatttctatgtctcctgcttaagtacttacgtaagatgctactgagtacctgacttcagacctacagagtctgtttttgttttgttttgttttcttttgttttgagacagggtgtcagtctgtcacccaggctgtagtgcggtggctagatctcagctttctgcagcctcaacctcccaagctcaggtgttagcctcctgagtagctgggactacagacacaaaccatcatgcccagctaatttttgtatttttcatagagacaggagtactccatgttgccccagctgctctcgaactcctgggctcaagcagtctgcctgctttggcctcccgaagtgctgggattgcaggcgtcagccactacacctggcccctgcagagtctttatcaaacagaagtgaatattaggaggagcctggggaagaattctctttgatttaccttggtgttaacactccagcgatacaactatggatcctccagaaagactatgtttttgctgtatcagtgccacctattaggaattgttccataaaagagcatgagaaactctctggagttcaaaaagtcaaaatgacatccttgctaaaaaatctctttatggtttgagttccatagttacaaccaggaatctctgggaatttggtctccaagctcttctcagagcatgtgttgcatacattctgcaaagcccttgggggatggagcaggcctagtttttggttttcagcagtgtttgttatcttcacagttaaatggaacactggaatgtgatatttactcaattttgcccatttttcattcagtatttataatttttaatgtggcaggtcttctaaaaaaccaacaaaaaattgctgattttgtgattttagtttctaaaacaaatgaaagcaaaaaacttctcgcccctgaactccatccctggctgttacccttcattctctgttcttactctttcctaagcaagtaagatatgacatttattcatcagagcattttatggttaattcactgttcaattttctaaaataccatttggcttcttacctacagagctatagcaccagaattcactcggtatatgtgtaagaatgactgcttccattttccgagagaaatagaaatagaactaagagcagtgatttccttgtgttaaagaaaaattattcatgacccttgttgaaaacaatagagaagactttattcaagggaggctatgggaacgatacaaggattacggcagtggagtcttgcagtgtgggagagagattgggctggagtctgactctgacaaggacaagtagggatttgtagccaaggagcaaggtgtgggggtcagtagatggaaaattactaagtggaaacaccaatgtaagggagattcttgctagatggactcaacagaattcttgctgaaggcaggccagggtgattagatgtcgagggtaatcagataacaagggtggaggatttttgttaaactttagccggattcttgctcaaactggattctgtaaggacagagagggaagcccagggtcaggcccatttgagcagggggcttatggagatctgattagagttagtttaatgagagtctttgtcacctgctgaaaagaattcgtttttatggctcagaataatagtgtaatcatagcaagagatgacttgtctatgtccattttataataattcaaaaatctcaataatttctgaaaaaaagaagcatttgttatcagagtcataaatgttgctatttatatgcttaagtagtagtatatcagaattcacagaaaggaacaattatttagtgtgcaagatagtatattccaaattatttcatattatagaaataaaaaatattccatagtccttaagccacgcctttttttttttttttttttttttttttttttgagatggagtgttgctcttcttgccgaggctggagtgcaatggcatgatctcagctcactacaacctctgcctcccaagttcaagtgattctcctgtctcagcctcccgagtagctgggattataggtgtgcgccaccacatctggctaattttgtatttttagtagagacagggcttcgccacattggtcaggctggtctcgaactcctgacctcaagtgatccacccccccgtcagcctcccaaagtaccttaagccattccttttgagactctgaagaaagggtacgttcctaatgtttttggtttggattatcagttcatggcagagcagtgccttaattgtacttggtagtgaccactactagttgttcaatcatgaatcctccagtactttttatctgaataatatggagatcctttcttagtactttgttagacagcttttctagatcggtttccaatagtagcgaaagagaaaatcctttatcccatcttttccagaattaatattttctgatcacttcatttgcaagagtaaagtaaatattgaaaataccaaagtgagcttcagtcatttataagaattgtttaaagaaggcagtcatcagttacttttttcacatgattgtattgctgagagtagtatctgcattagtctcttaagcaagactttaaaaaaatcctactgttgtccccacctttatttttgaaagataaacttaaaatttacatttttaaaaatttttaaaaagtaaaattttaaatgactcaacaggtgattagattccatctaaggatgagattgaattcacgatctcagattctcaacatatatttggccttacctattgttaatgaaacttgcctgcaaggagggctgcatgttgcagaacttaaacggagcaataaaactatttataaatccagacacctttatgaggatgtttccttggtttcacttatgtaagccgacaaaacgatcagttgtaaggaactgaaggaagtaaacacttgaatgtactcaaatgtctaggctttgctgaacattatatgattaaaaagcagccaagttcagcgtggactgagaactgctgacaatggagaacatgagacccagaatggcaaataatgtttcagacattgacttctcagactggtctccaccctgtacttaaccccattctcacccttttttggaggggaaaggaattatctagttaaaaactgaatctataggacaacctgtctctcctgaggcagctgacttatgctaattcttgcttagctcagtttcttgagtttagcagaggagatcactgtcacccacaccctctttaaatcagcctcctgtggggccatgtctacacaaccaaggcctcattcattcgtttattccaaaatatatttattgagtgccttctgtgtgccaaggactggggattcagtggtgaataaacagataaaaacacctgtccatagggaactgatattctagtgtgattactgctaggagtgtgtctgagttgaattgaggctcagaagtagatgtgtctgagaggcctcaggagtttggaaatgggggtgtccaacctgtttctttgtcctccaacaggctttattacctgtgcaggtatggtagtaagtctgttttgcatttctttaaggaatacctgaggctgggtaatatataaagaaaagaggtttatttagctcacggttctgcaggctgtacaagaagcatagtgccagcatctgcttctggtgagggcctcaggctgcctctactcacagcagaaggtgaaggggagcctgtgtgtgcagaaatcacatgatgagagaagcagcaagagaaagagggaagatgccagactctttttaacaaccagctcccatgggaactaataaatcaagaactcgctcacccctgagggagaacattaatctcttcatgagagatctgccccatgacccaaatacctcccattaagccccacctccaacattagagatcagattccaacatgagatttggaggggacaaatatccaaatcatagcaggaagagacactccctcctatgaaaacacaaatttgaagaacagttgtcttcagtgttatacaaactgctttctgactgcatataagagaattccgtttatggggttttggtctaaaattatagtgtcatgtcagatctcaatcattttaacttaaggcagttattctagcctttgaatacatttttcccctgaatattcgtggtgttgtgtgacaactatccaaaatattttaagattccattttatcagtaaaacatatgccaggctttttaataggcagagagtaatttggtagtatcattcctcttatcctttaaagttccttcatgctctagaatttaattcagtgattccttgtagaagctagcctgcccaacaccatgggcagagatattgcagagaatgccattttgatactctgagaagaacatgtaattcccatgccttgattttaaatgcaattaaagagccatagtttttcagaagaaagagtactctttggcaaacagtagtcattgcagaggtttggtccttaatctgttttcagggtagttatttcatggttactggatgttatagggacgtgcttctgaacattggtttagtttttatgggtcttgaatttcagattgtgacataaaacagttttctagtacatggtgccagtgttttaatcattagaagccagaaagtaataggccattcctcatgttggctgatgaccccaggctaaacctccaagctgtgtttaggacagtgaatcaggttccagggctagttcactcagccttcaaaatgattttttaccccaacccagtcttctcatgggcccctttgtacacacacctgaagttcacttgttttctgtttttgaggcactaattgtaactacataatcagatgtcagtttggtagtctagaaactctatttgaagaaaatacgtaataattttgttagtcattttctttttaatggtgtttcaagaagtgtttgagatcgatgaaatgatattcttttctatgatctaatgaagaaacctcccacagttgtgggcagcatttttggaaaagagtagccaggtccagtgaaaagcaaatctaataccattagtctttgaactttaatggaattagccagatttcctgaaatagtcctagaagactatcaaaagccctaggggagctaaacttgattgaaaatattataggaacttgaccatatatagcttagacctctgtggcataggctgctaaatttcccaagggagaaatgtcattgggtcacctttcaaagagtcattgttgatggttatgaattcaacagataagcttgaggttgaagagaagtgactttgattgtgttttagggacaaggtcttaacaaagtattgtctaaatttgtatttgaggatattagaaatccagaaaccaccatttctggaactattctgcgatggcactttctcaagttggagccaagaatggttgaattttcagaaagcaaaggatttcttgatgacttgaccagcaagtattagaggacagccttctcattgctgaaggttgtgttctatattttcatcatctgctgggtgccaggcactgtgctagctttgggcatgtagtggtgaacaaaacagatgttctctctgaatttatggagtggatagtctagtaggggtgacacacattattaaataagcaaataagccaaagtttaattacactttgtaacagatactatgaaggaaaagaacagatatgatttgggagtgctattagagttttggtcataggagaagacctgaggaaatgcatttgtttgatgatttaccagtattttaaatgtaatttctggtttcacagaacttgagtaagctgcacaagggaaaaaaactcatcttctgtaattcctcccagtttcttaagccactcagtaaatgctgactacggttttgtggatccattttgtggtgtctgttttcctttaggcaatcctccctctgtctaatttggatacagaatctaaatctttatgagtctgtaatagtacctggccattactggtctataatcagtgctcatataattgttgaatgaattagtgaaggttacaaattgagtgtggtttatcagttaaaagtgctctcccaattatctgatggaaccacaaaccttctcttttcccattatgcccctccttcttaacacaggtgttcccagcattctctccccaagagtaataccctatggccccagggctccatctatctcttttctacatataagtcccaagcctacaggttctagccctgttttctcctgcagagtatcagtccccaccccagtttcttactgcttgccagtcctctccactaaaatgtcctcctggaaactcagacgtgtgtgcaactcttccccctttgcctccttaagtctttagaggtcaccttctcagagagtcctcctctgggccctgcacttaaaactgcaagctactctcccatcccacctcaccccacactcaatccctaatcaacttccatgctttttccccccatagcacttattcatcattctctataacttattttctttattttctgtatccaccctctcactctctttttttataagaattaagctccatgaggacaggatttttttttccgttttgtttactactgtgtccccctgtgcctgtcatgtggtaggaattcactaaatgtttgttgaataaatgaatatttaatgttcaggcattatatatatataatatatcataatgcttctattgcattaggagacagtgaacaagtcagacgcttgcactgatctgtactgtcactgtgaatgtaacaaatacagactgatccaagtgttcctggtggtgactcagatatcaggagtgtctttgaccatagatgatgtgattttctgaaatgatagacaattcttgattgaattcagacaaaaacaatgctcccagcaaagtggaatggtggtgagaaaggattctgaagccatactgcttaggtttgaatctctcctgccatttgccagctgagtggctagtcacgtgatgtctccatgtttcatttcctcatctacaacataggaataataataattcttcctcatttaggagcttgttacaagaattagatgagcagtgtttagcacacagaaacactaagtgtttcttaagtaaattattattcagtagcttcgttcctggaaatttagggtatattaaactcatgtaaaagtactttatatttaaatttaaaacagtgagcttctagactaatttagtaataatcaagtttctttttaacctacgtgaattatatgagatataagacagttgtcatatgggactgtcctgtgtgtcacagaacggccagcatccctgacccctgctcactaaattttagtaatacccttcaatcatcatgaccacttagagtgcctggaaggttggtggtttttacatacactgttctagcgaggcctatacatttgttttgtgacatcattatagatcatctaactagacaagctctccctatctgaatcctcattgcccagtgtccacaatacccttatcacagtgaacaaattctgctatgtcacagctgaatgtgtgctgtctctttttttccctccctgcctttggacacttcccatcctgaatctctcctgtcagaggaactgtttttaatttatttcagcaaaaggaatacgtggtggtggccagaagctctttgccccatgcatgtgttctcccttaagcctccagaaagattcttgagtttggaagcacttaccccatctgcagttttactgttactcactcagcgttcttcccacttataactgaggggctctagttttaccacgctccctgaccagcttcaatttcaccccacctcaatttttgccaggcacttcttaagggagccaaacttcatttctaaaagtattttaacattattcaattaaatggaacatttataaattggttataagggaaaagatcaatattggagttcccatggaaggtttataagaagaagtgggcctcaaagaattaatagaattggactaagtagaaaattagactgggcagaaaagagcaggaaaggagggggtttgtttgtttgccaagcagagggaaaaaatactaacagaaatgcagtgcatggtgtgtagggatggtcaaaaccaggactcagattgaaaattataagtaagaatggcacagtagagttaacttagggaagttcttggaaaccacagtaaaaacatgacattctaccacttccttgttcattgtgttcccgcctcccttgtttttctgtttgtttttgttgaagaggtctctcgtggtccatgagtgagtggatatttatttaccttccatgcctccacacttgtgtaccccacaccccaggggattcaggcacatatacagcagcactacctgtcaccagcctagtttacacagagaaagctacctctttttagggttagtgtttgattctgaatagaaatctcattatttatgcttctttgcaaagtactggtgaagtcttatcactttttaatattaaacttcatgtaaatgttttggatatttaattgtttatgatcaaggtgtctggctagtgtgttagtcatctcccagctaacagtctcttggcaggccatgcttaattcagttattgcatgttaacaggctgttcaaaattccacattgcctagagtttttccacctccaatgtccagacactttttctggcttctccaaccctctgggcattcagaatcatagtttagtgctcatatttgaagccatttagctctttcctttttatttgcctgattaattttgaatttgaattaatcatactttatacccttttcctgactcagttcagtgttcatctcattctgtttactcagaaagcccagaacataagatttgaaccatttgtgcagtgcccaaatgtgtgctgatggaagagtgaacctttaatgttttgactcccgtactatttggttctatttttcctaaataagtcatggtcttttttcattaagtatacatttacaaaaatggttcagtctttgcacataactcagctctcacaattccctaatctaatgttgaccatgttctattttgtcataaaacccatgattttactgctttctctttactagagccctgcatattagcagtgaagacctggtccttaatgaaagtgtggggtccatcctcagtgtctcatatccctgcctgtgttttccttcaggagaccttcctttccttcctatctaagccagagtcttctctgtttccccagttaaaactcgatctgatagtttttattcagactgacaggcaagttgtaggcaacgattgaaggtggctttcttcccaggggtggccagaactcaaagtcttaaagtaaagggtagcaggagcttcatctgccatgattaagaggagttctgggggctctctgctgctcctgggtgcatactatataaacagatgcccagccacccaggggagggacctacaaagatcatgagttaccacgagctgtttccagtttgtcctcctttaattaaaataattagagcctcgtcagtaatgacgagattgcctcactaactgtccaagggtgttagtactaagccacccaaagaacctttttataatgtctcatacagtagaccagagaatgttgctgtgactcctttatcatttatagagatgtggctatgttgggactcctaatggcatgttaccccaaatgctgaactatccagcttgtcactcagaaggagcttcctgacttcagcttcaggcattcacatgctatctggtagagtcgtcttctagcaatgctgatagtttccttggtccagaatttgttaccttcagaagaagagtgtgaggaagagatcccgttctaaagccacctagaccaaacctagcctgagtctccttctggttgggcttaagatgacaatgccattccaaccatggctaggaactcctgagtcttggaatcagatcatagctttacatttccctcaaagcatctgagcttacattcccaggttttccatctcttcttgatatttaaagctttaaaaaaccgcagttatcagtttaaaccataacaggcacgtgggctctaatgacttctgcaggtggtttgggctgtattagagaacctagtcttgatcttaaactgtcatctggattctgagttaatccaggaaaccagtaagaattagtaatgtgtattgcatgtctctgatacatgtgttttccattatttggtcttccacagtgcatgcgcatacacacacacacacgcacacacagcccttcagtttttctaaaatggggagagagggactatggttccaaaaggaaatgactggtgtggtgccttgaaatctgaacttagtcacgtgttgtaaatgaaatgactccaggcacattaacaagatttctttctttcatctcctactttttggaaaaccctttgatgagaaacattggctaacttatagactttcagatttatttctgtaaagataagtaatagccattgcaaagcagccgtacttgtgaaattggagttaagcttccataacagcggtcttaaagaataggtagggttagttaatacacagcagcaaccagctgttcttcctccctgctgagactgggaaagaaggaaattaacttcaactataatggaagagattttcaaaactggtaatgggaaatttatcatcaatgaagactattttaaacattggaacaaatgagtgaccaacagaagtggaggaattatgtattctattggatttaaaatagaatatatcatctgctcaagacacttagaattgatagattagatctgtctaataatttttaactcttgggggtcacagaccccattcagaatctgatggcccctctctccaaaaacatgcacacacaaaactttgcgtatgatttcagggaacttacagactccctgaagtctataaattagacctgaatttaggacaccctggactagatgatctccaaaagtctgttttagctctctaagtgacaagctccacagcatagttgtcccatacataacaatggaatctgaagaccaaatgtcagactttgcattttcttcctccagatttgtaatgcttggcatgctcagtgtcaaagttaaaaaaaaaaaaagtagaatagaaagaattctacgtttaaattcaattctttgtcttggaaaagccaaacatttaattttaaaaatcactggttggctctgtgtcatctttgtagaaaggcagtacagaactaggttgttgccggcagttcttccccagccccacaccccgctctggattcatggatgaaaatgcaaactcagatgccatattaagtactcagaattctcccatgttcacacatctttttactgtattgctgtgattgttcagttgggcttgaaaaatattatttattttctcatcagttttatgtctaagtttcattgactacaagttggaagatgaccacccagaattacaaatcagggagtaatttggtcctctccctaaaataaagagcttttatcctcttaagaagtaggaatggagtatagtctgtgtctgtgtattttaaactcatgataatgagttgccccatatgtagaaagcatgactctatatggttttcccattcccttctgtaaatattctctagcttacctgcaagttctgtagactccctttaattccatgttggaattgtacttgacactttgtgcctggaatcaggaactctggaaataaagatcgcctcaatatggaagggaagtgatctctggaaaagagcataattgtcagatgtctataacttgtcagttttcactgtacctcacactcctaatggcaaacctttaaattcatagttggaagtgtcttaatgaagtcagaaatattactgatgaataggagctaagcgtacttggccagggtctccttaccattcacatggaatgctggtccttttgacagttgtttcttcccattgttgaaggcagggaggaggacttagggattcttctctgtattccccactaaaaagcccttctgttccagttgctccaatcagagtaatacactgcacagaaagcatacaagatatacgatgtctgtggacagatgctctgtggcattattaaccctggcagttgctttagccgttgtttagtcaatggaggttgtttgggagctagaattgggagagaacaggtgatcctggcacccagcccacttgtagctctgcttactgactgagagtccctctgcaccccttgaaagtttactgacagttcacacccttaaagcacatttctgtatttctggggctgaagcttatggcagagatgcacattctgttgaatatttattctttgtgtatattcctgtctgcagagaatgtgatcaatgggcaggactacgaagtgatgatgcagattgactgtcaggtgatggacaccaggatcctccatatcaaaagttcgtcagttcctccttacctccgagatcagcagaggaatcaaaccaacaccttctttggctcccctcccgcagccacagaggcaacccacgttgtcagcaccatccctgagtcattacaatagcaccctgcagctatgctggaaaactgagcgtgggaccctgccagactgaagagcaggtgagcaaaatgctgctttctgccttggtggcaggcagagaactgtctcgtactagaattcaaggaggaaagaagaagaaataaaagaagctgctccatttttcatcatctacccatctatttggaaagcactggaattcagatgcaagagaacaatgtttcttcagtggcaaatgtagccctgcatcctccagtgttacctggtgtagatttttttttctgtacctttctaaacctctcttccctctgtgatggttttgtgtttaaacagtcatcttcttttaaataatatccacctctcctttttgccatttcacttattgattcataaagtgaattttatttaaagctatgccacacatgcatgttcaaatggtttccactgattcgatttttcattcatttaatgcaaacccattctggatattgtgcttatttgagaaaacacatttcaaaaccagaaaagccaaaaacactccaaaaacaagcaaaacaatttggagctttagataaaaggaaaaactcccagttggtaaagtttatctttacttaggatttgtggctcacacctaaacaaagggggtcagggagtgggtacaaatttgagaaaatagaagggtaagggaagggccagtggtggggtttggagagaggagatagctccattaatacacatgtttaaaagatggaaagttcacgcctgtaatcccagcactttgggaggccgaggcgggtggatcacgaggtcaggagatcaagaccatcccggctaaaacggtgaaaccccgtctctactaaaaatacaaaaaattagccgggcgtagtgacgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagatggaaagttcgatgtgactgcagtatgagattaaagccacaactattgtttattttggggactctaggccaccaagtattagcacacatacttatgttttctctactaatctggtccaggtcctcatggaccacaggacaaagctttcattttcattcattcttctattgaaattataccaaattcagctgaggaatatggaagtaactttagacttaaacaagacaaaagttttttcactgaagaattgacaagtatttgctccttaaaacaacgcagattagtgaacgtggattcctgctgagggagtgcatcccataatatggcaataattttcagtttctccaacgaaaagatagtgaaggaattaaatcttttgtcctcccatggttaaaaaaaaaaaaaaagctgtgttcatttttactgtactatgcctcttttttcaccatagtagacaattatgtttcatttgatgaattcatagaactggatctcatacagcgatgtcctctctaatgttctacctttcagtttctaaagtgagtcttcctccctctcctacaaaacttttcaattttttgatgtaactcatctacaaatactgtttcttaccccagttgacttgcctttgtcagatttcttcttgttccacactatagcaatcaatttctcttcttccttacaagaaagggaacgagaaattgtagcaacctctcaaggattatatgcagctagttagttttctgcctgtgaaattaggtctggctcctaaataattttaaagaaccatcagcacttctaactctctggacaggtgcctctttgtccaagctagttaaatgctttccaaggaaatcagttcaacttttgtgagcggggaaaagcagggctttattgttgtgttacctgggagtctggagtttgaaaagtgctaattaaccttcctctttttccacattacaaacctttttaagcagcgcagcactccccttagatttggctatcctgggtgattttcagacaagaaccattttctctggggaccattcttctgctgggtgccaaggaatataaggcaaatgcccagaagaccttcaggtgactgggcagtcttatcatgggatatttcttctggccctgccccttcccattctgtaatgtgaattagccacaccagaggctgtgaccatggctagtagacagtggcaacatagtcatccccaagatgctaatcttctgctggaactgtcatacgttatcatggtcaatgtaaacctggtttgtgtggggtgattataaatagagtttccctcctctctgtgacagaatcacaggagaaggacccatctcgtggccttcttgttcttagcgcttcacttttacttcatccctcgattcccagctttttctatcatcattttgccaactcctcagatgcaagactttggttatgtcatactcaccaacgttagtccctctcttccaggtgaaaaggtgggtagcggttgggagggagtctccactgaagagcaggaaggtggtagcagggccggcagctctgccacagagctaggggtgcctgtaaggtgccgcctagagcagcctgggagctttgccttcttttgtctctcactagcccttctactctttgtcattgcctgttcttgagtggatctttgaaatgaggggacaggattctcctaagggtagagtttcaggaaatgagtgaaaggcaattgacaaatgcaaagaagtagtcactttttaaattgctggcaaagctataattaatccctaggcacaattgtagtttttattttaatgtttgtatgcacaaggccctttaggaaatgagaagttgccatgccagattaatttttttttttttttttggtgggattgccttttgggggttgcagccagaaattgtgggtaatgtgtgtatttttttatttattaaattttaaacaggattgtgcaagcttatgagacaattagataaactcatggaggaggcaggtcctcctgttattagatgattttgtgctcttggggctgacaataatacactcttgggaagtgatggtagagactgatgggaatagtctttctgcctggttgcaagtcccaaatttttaagggttaatggaagtaagtggatgtttcctcatgttaactactgaatcagatgttaggagcttgtccctttggggttgacttatgcccagcagtacagggacacagcttcattagagtgttagtgtaaactaactccaaagttaggagttaatgtgaaaggatcatccttgaaacaaatctgctgtttgccatgcttgtagtacagaaacttcacatggagttttgggtgggatttgtgttttcacaagtaaaaaatccctcacgattataaaactcagagcatcatctaatttttttttttaatgactacaagttccagcacaaaactggcatttctttgccatttcttgccagtaagaagttgacacggaggtatttgaaagcaatgttatgtgagtcattcttaagtgttccaagtaagtttagaaacagaaaaggaacttgggattcaaattgatttttcaaatcatttttaaagagacatcatcctgactaaatcttagcctgaaccttcctcccctgtgtgtattccccggtagtcaccgcagcgagatgctggtgagactgccgtggtggcatttagcatcgttaaaactggaaaactctcaagctctttgccactttcctactattttttgattcttgccattttaccaagcttaggttgtgaaacttgacagaaatgtattacaggaaaaacttataattgtatttgactttctaacacattgcaaagtttcaaagtgactttcactttcaacaacatattagaagtaaccacttttgctttcacagcctgaagagttagagcctgatctgatgccccctttcactctgaagtcatgggaaattttccagccatgaaagccctctttccactgcatactgatgggctgactcagcttccttcagccgactgagatcttttcatactattggctatttcataccaattaacctcttaaataagattgtgaattgccaaaattgatagacacttattaccacctgtggactccatattccttaccacaaatgttattttcatcagtcctgagtcattttaacttacagaaattaggattgttgctgctaatatgaataccaattataacttttagaaacaagaataaagcctaaaagagaatgaaatataagaaatgttcgttcccacccctaataacatttggaagtgaatattcccattttcttccacccacagggattgggattgatttttaatttcctaggaaacaatactagactacccaaaaagatgttgccagaatccaaaaggaactatgctcgtaaaagaaatgcagttttctcctacctaaaaaaaagaaagtaaagtgtgttctgttcttatctttttaatgactaagctttaaacagtttattttgggtaagactagaactttcggccatttgttctaatatgtgtgttattagatgcaatagaatttatgaaaagaagaatgacaaaggtatctgattagaaaatttgatcttacgcatgaatccatgtcatggccagccactgtcacatagtgggtgccattctcaacatattggtttgctaactttaagcattagggatttagcacactaaaatacttttaattatattaggtttggtaactaaggagtaaataaatcataatttatcatttgccaaggccaacaaacaacactattgtgctgtttgctctcaatgaagttgaataaaccaggaggcttggcatatcccctttatgttaatcccagctagagattagtaggttgactttcacagcaattgtatattgatccattttaactcatccttgccataatttccaggccagtcaccaggacagaggagatgatggggaaacagagctttagatgaaaactactatgcactactagccttagaggcactggtttcctgttaccactttggcaagtatggatggtctaagtccagtagggcttcatccatggagccattagaactgaggggggagtgttagagatgccatttcaccaggatctttttgctcaggttgtacccatgccaattgaagaacgtgttaaagatgaggaggagagatgtaccattctctcccttaataatgatgttggtttgcaaaacctaaagaaataataacaacagactatttcatactttcaagcaagtctttatactacctgttatttctctaaaattcaaataaagaatttttaaacttaccttgtttattctgtatgtagaaagagagaaaaaagcccccaaatgaatcttcagtgttggggggttagtaatgggaaaggaagcctgaaaaggctttgtggcttgtgttactgttcagatgaaactgttgaactattttccactcttctcccaagcctaattaagtaaaaatttcctttatttaagtgtccagatatttaaactacaatcttatcaaggaaaaaaaaatctaaaaacccatattttatctatgtcttcaggaaagtgggttactcggtcacgcatcttgtcctcaccaaaggcctcttcccagcttgcaatggcaaatgccaccacacctgaagctagtcactgcagactgacagcaagggatccatccaggagtaattaatgcaggcatttactgagcacccaatgattacctctgacactggtttattaactatattatcttatttcaatcgtctctacatcctattttgtaagatggttattaataagtagtggagctggctgggtgcagtggctcacgcctgtaatcctagcactctgggaggccaaggcaggtggatcacctgagctcaggagtttgagaccagcctaagcaaaatggtgaaaccctgtctctacaaaaaatacaaaaattagccaggcatggtggcaggtgcctgtaatcccagctacaagctacatggggagctgaagtgggaggatcacttgaacccaggaggcggaggttgcaatgagccaagatcacatcactgcactcctgcctgggtgacagagtgagaccctgtctcaaaaataaaaattaaaaaatagtggcccaatatttgggcccaggcaattatgtgaattattcaccattatattattccacctgctgatacatagatctggcataagttcatgccctaaaagagctcacagtcagcccatggagccatatacataaattacaaaactacaataacatcagggttctctgagaggcaaaactacatttgtttcagaagatactttaatggacttatttagaaaatgagaccccccccccgccccctcatctaggagaccaacctcaaatcacctctactgcagacaaagttagcagagattggagggtagagggttgaacagcagaaaagagaaatgggaccaaggaatagggctggagactaaagcccccaaggggagtgtcatgaaaagaccccctggtggcaggagggcaaaggacttttacaaactgtgatgctgaaatgcaaatcctcttcattgccccaactcttcagtaaaagcagatacacagttttgtatcaatgttgccttgggagtgagagactgaaggtaggactcaacatgatattactagtgaagaagaagacagcacagcaagataattcatacactgaagtgtcagtggacgtcaggtgaaacagggaaataaaaacttccaaccccccaccccgcccccacaatctttatggcattgtcccctgggacttctcactctatgtgggatatggttcaagccaatttttgaatctcaaagggtaaccacaaatgacatttgggttatataatacatggtatcatagatagagggcctctttagcatttaccctgtaatttacctaactggtccaattttggtagagatttaaatcacttccaatgttttgctcaccataggaaacctatcgcatatttcactccgtcgtattcattcggcatgatctgtgcaaatgcctgaagagaatcgttctcttagttcagttcagagtaggagctgatgcttattgaggacttaaccttccagacatcatgctaagcctttacaagcattagctcatttgaactttgcagcaagccttcatcatcgacataataatacctatgtctgtgaattacagatgaagaaatagtcacaagagattaagtaacttgcccaggatctcacaactagtacatagcagagttgagatttgaaatgaagtctgtcatgattttaaagccacattccttctactatgctacattgtcattcatcctttgaagtcataaagagacaaatgagtgaggaagaaaccaagccacacaacacaggcaaccagggtattgaggcatgttcaggaaagagggagagtcgctaagaggcaaggtccagcagtactcgagggttttctatgagtgactcagaaggcatacactcgatgctggctgcatgcagagcccatgctgggctgctgcaccaattcttctagacctcagtccttgtagtccccatcttggacgagttacccagtggggtggatacaagctggctcctccataattgaagatcctaggctctcctaactctcctactctactcatatccaaaagcccacccaagtgtggcatccagctccatcccaggatgtatccactgttttccctgtgatcacaagttctatagaaagttttcactgcagaattaactgctgatgtggatgctggactatgaaatagagatgcttgtgtaagagatcactaatctgcagacccaaaattgaaatggtttgtttcagaagtgaaggatatatctttaaaataaatacaacacaccatattaataaatggatcatcttgtaagattgagtgcagcagtgtcagtcctaaaagctgtatccatttggaaggcggaccttgcaaggctaacagaaaatactgttgccaattgtttacagtacagcccatatttctgcaaacatcaactgggtacaaaggaagaactgagaacctcaaaagccatctcagatgctccttccctaggtgtcctgcttgacttctgaagcctccgagttatctccatttcctgagcacccaatggagcttcgattcttgggctgcatttcttcatagtgggctagaggcaatggccctggaatttaaacatttgccactagttctaagtgttgtgcgaagctccaacatctaccatggagctgtaggaaaccatacagatgaactagacaacatccttgacatgtcctttacatgtctagacacatgagttatgtctcttccatgggactatgtggtcacccttctgtccccacagaagagtaaagatcatttccaggtgagggtaagatttctggtcagcctgaaaaagaaagttcagttggacacaagctactctcaggagagtttgggggtgggaggttcatggccagcatctttgccatgggcacagatctcacccactcacttggctgctggccccaggacatcaaatgatccatttcgccatattgtctctggtttcctggagttgctggaattcttctctgctaagccattcgttcacatgagatcgacatgttgtccccttccgcctggcaacctttaggaagacggaattacagcaacccccacacatccaactaggctgtctccatcaaatcaccagctagggggaacaggaaattcgtcttaatttagacaatatgagcaggaaagatgctgaaacacttaatctcttgttttaaatgactctacaggtcaccacccaggggagcacaactagaagcacattgcaagtagcagcacggttggggccgattccatcttcccaggatttatcatctggtacaaggcagcagggctcaaatagtccaaggaaggaaaaggccactcatagaaagattgtttttgttgccatagcagcatcttgtacttatcccttcctaactcccatcgcctttgcaattaccaggtaaacatttatcatccctgtgggacagtgagctccagaagagcaggaaccctactaatgtcttgaattcgatttttttcctccaaaagtgctgtggatatagtgtgcttgggacatggtggtttgggcattttaggctaaatcaggatttcgttgaattattgagcatttagaaagccacaaatatacactgtccttccaggagtctgcatgatagactggcatttgtcacactgcactagctaccgcaccctattcagatattcacagggcacagaagttgcagtatgtgcgatgcccagtgctgaggcaggactgcaagggaaaacagcagagatccctgccttcccttaaaagatgaggcatcatttgttttcctcttccccttttcttttcttttttttttttttttgagatgaggtctcgctctgttgcccaggctggagtgcagtggcgcgatctcggctcactgcaagctctgcgtctggggttcacaccattctcctgcctcagcctcccaagcagctgggactacaggcgcccgccaccacgccctgctaattttttgtatttttagtagcaacggggtttcaccatgttagccaagatggtctcgatctcctgacctcatgatccatccgccttggcctcccaaagtgctgggattacaggtgtgagccaccgggcccagccttccccttttcttttcatcctattgctttttcctctggcttcagtctgtggcatattagaaatgggcctggaaagaggatgtaaaccagcgagtctgcaagcggggccctgagactgcagcagcacctcaaaacttgttagaaatgcaacttttctggtcccaacccagacccattgagtcagactccaaggccgggcctagcaccctgtgtttcaacaagttccccagatgactctgagaggggactgagaaacacccgtgtagttccctgtcagcaagactggagaatgggaagatgcagactcctgccagagatgaaccttcccctggctgctgatgttggggtgggtggtaatatcaggatcacctgatgtcaggagttcaagaccagcctggccaacatggtggaaccccgtctctactaaaatactaaaattagccaggcttggtggtgcgcgcctgtaatcccagccacttggtaggctgaggcaagagaattgcttgagcctgggaggcggaggttgcagtgagtggaga

SEQ ID NO: 1035 - DNA, 22389 bp, Homo sapiens
accacccgattacatccactttacctttcctatgtccctctcctctgagtattaaaaaaaacaaaaaaatttttttaagaaaaaaaatctaccaccccattcaggacacccctccccaacacatattgggggaaacggggcacggcacgcgttgggttcaggaaaaaaaccgggaacggaaaaagaggctggtttggtcctcagcttcctggtcaggtttccccgcggcctccgctgccgccatccaccgctgggtgccgtctgcattccctcgccgcgccacggtgcttctctgttgccggctcacatcaaccgaggttccagatgggtgcaaggagatgtgggtgggaaggagtagggtatcggggattgaggtgccaaaggcccccacccctggaggtggggaaggggaggattcatttgtgctgatgctcttcttttggacatgccctgccatctgtctgtccctctcttgctctcctgccaccgggaagtaggagttttggtgagcagaaggctccagctgtacgctcgatgccaccttgagggtgcgtggctgtagggtgcatgtaagagacgatggatgggtgggtggtagggcagaaaaatcctgccctcccccaaagggagaagaggttcaaaaatgttgtgatttatgaaaaagtcgaacactacccgctctcacattaacccgaccaagtcttccggagtttccctggcacccgcgcaggccctaacactagctgtctctgcttctgtatgtctcttcaaggagtcattactcccagttgggcacaagccgccttcttggcacttgaatgacaagggagtctgaggaagagggcgaggaaggggaggaggcagcgggcggggagtggagggagagaaggtagaagggtatttacatcttgcatgaacttgcggcagactggacggatctctttgctcaaggtagcactgaacatcatgacctgcttctcgtggggggtcatgcgaaaaatttcctggacatcccgacgcatgtctacaagaacaaggaaaaaaattgtaggagaaaataagcaggtatgataaacaaagattagaggtagacttcccagtgaggtgaagattgctggaaatagtaacaacacaatggaaagagcaatggacttggaatcaagaagtgggatcagattccagctgtttgttttaaccaagcaagaaataaggtaaaaccccaaagttcccaactatgaaatggggataaagcccagtgcagaggctctcaaggccttcaaaacatgctttatgggaccttctcccaaccctttcctgcccaagccccagccagccttcagcagactacaaatatcaagcacatattatattccagatatcagagtccatctatgactctctggattacttttctatcaagtcaggcaaatatgacatccctacctggagcccacctttatagctcaccatatagaattgccaaagatcatttgtaatgacttatggggcctatgtccaaccccactctcattcaccaagattcaattcttacagaaaaatcttccattaaccccacctggcacactagaataccacatcacacaaactgctacaaacactctctacattaatcccagacctgagtctagacacttattcagctataaattctgactgtaaatgctgtgctggagatgccagaagggtactgtcttctctttcagtttagaatctccgctatgactcccagtatatgaatctataatgaaaacggtggtggtggtgatgacttatgcctaaaattatcaaagtcccctattctcaaaggttaaaaacaaaaatcatagaaagatgatagatgacaccctttactgtgcttaaaagcataataaagaccaaccagggaacccagagccatcagtcatgggtgatagataagagtcgtccttgcactgaggtgctcctgtttcaaataaacatcatttggctccaaagaacaactccccagcattagccaagccccagcactgccactcaccgagctgttcaagcatcttatcacattcatccaaaataaagtgtttaatgtgtttgaggttgaggctcttatttcgagccagggctaggatacggcctggagtccccacgacgatatgcgggcagttcttcttcagcacctcttcatccttcttgatagacagaccaccaaaaaaaacagcaacctgccgagccagaagcaaagagtctcaaaacagaggaaggaaagagtccaatccccccagggttcccactctgtttgagctaaaccaatttttagcatgtttccaaactaaaactaactttagagggcacctaatttaaaaattttatgtcccccccaccaaacactgagggtgattgcctaaagttacatggctagtcggagcagtcaggacaataattcagttctactgacttaatctaaccaacttccttcatttatgaggccaggcttcatttaaaaaataaaggagccaggtgtggtggcacacgcctataattccagctactcaggaggctgaggcacgagaacctgggaggcagaggttgtggtgagccaagatcccaccgttgtactccagcctgggcaacaagagtgatactccatctcaaaaagaaataaaataaataaaaataaaataaagccaggcccagtggctcacgcctgtaatcccagcagtttgggaggtcaaggaaagtggatcacttgaagccaggagttcaagaccagcctggccaacacggtgaaaccccatctctactaaaatacaaaatttacaaatttactactaaaaaacaaaaaatacaaaatttagccgggaggctgaggcaggagaatcgcttgaacccgggaggtggagattgcagtgaggcgagattgagccactgtactccagcctggatgacagagcgagactccatctcaaaaaataaaaaataaataaataaaggacagcaagaaatcaccagattagtgtaaagtaccacaaaaaacacatggaacattaaggtttcctaaataaacccagaatctcaaactcttttcacacaaaccccatgaaattactgcttcgggctaaatattatcatttcatgttaaaaccattaggtgaatagttgtttggggatctgggccttggtacagtatcaaataacaccagaaactactttctggtttcaagggggaaaagaacaactgtggaatcagactgtcacgacgctaatcctatggtaaatctaaaatcattaatgaggccaggtgcagtggctcactcctgtaatcccagcactttgggaggccgaggtgggtggatcacttgaggtcaggagttcgagaccagcctggccaacatggcgaaaccctgtcactactaaaaaaaaacaaaaattagccaggcatgatggcacactgtagtcccagctactcggggggttgaggcgggagaatcgcttgaacgtgggaggcgcaggttgcagtgagctgagatcgcgccactacactcacagcctgagggacacagcgagactccatctcaaaacaaataaataaaaataaaataaaataactaacataagtcgaccagatttgtggcataacaggagatacagtatcacctatgaaggattcttgccaaaaatgcttaacttcaatcagattttttctttttttttgagatgggagtctcactctgccacccaggctggagtgtaatggcacaatcccagctcactacaacctctgcttcctgggttcaagcgattcccctgcctcagcctcccaagcaggtgggactataggtgtgtgccaccatgcacggctaatttttgcatttttagtagagagagggtttcatcctgttggccacattggtcttaaactcctgacctcaaataatccacacgccttggcctcccaaactgctgagattacaggtgtaagccattgtgcacttggccagaatcctcaatattcacacaccactggagctgttttaaagtttccggctttctctgccacataccccaaaattattaaactgatatgattcaaagtcagtataaagtagtaagaaaagggtggtcttgtgttaagcatcatccatagcccaattacgaatcctcctgttacataggaactcaacactctgttacaccacagcaaactaaagcttctccaaaattaaagagactattggcctacaagtttcttatccctccaacttgccacaccctcactctcaggtctctttaccttggcttaccttgacattgggcatgtatttagagaagcgctcatattccttgctgatctgaaaagccaactcccgagtgtgacacatcaccagtacagacaccttaggcaggaagtagacggagacatatggtaaatgtagctcttcattatcccctctagggaagtgactgtcacaaaaacacacctgggccgataataaatgacttcaattatgtgatctaaatcatgaaccccacgcttgcgacagaacatcccccacagctgtcaggttgtcaagggtaacagaggtcatgtgctcatggctctgcaagcatcatgtagctaggacaaaaacacccttcccttatagtcctaaccaaaatcccctccccagcactctccccaaatatacctgcccagtaactggctccagctgttgcagtgtggccaagacaaacactgctgtctttcccatgcccgacttggcctggcacaggacatccattcccagaatggcctgagggatgcactcatgctggactaaaagttggggggggaggaagataaattagacttcagtctccagataactctacctttttcaccatgccaagcccatttcttaccactcaattctcaaagtctagtatttacctggttcttgccaacttccagacccattttacctctctctgctcaattacattcacctcaaaatcagactctcctaattcctcctagctttagcctcctccagatctaggccttcccagtcctagtaacaaaccccttgcatctaccaaccgctcaccttcaatgatcctagctctgtccttatttttcttaatctgtaacaattcatgacatttgaatacctgccacagaccacttctcctgcttaggttgctatacttcgggtcacgtaactactacaaccctggacaaaatgaaggacttggtacctgacccagaagccagtcatctctaaaccagtcatagaggtttccagagaccacagttggcctggcccaacagagggagactacaggtccaagcaggacctttctggaaatttaaaattagaagtcaagtgacaaaattaaaaataagcagacaagaaaagccagtcacaagaatgaatggcagacctggaagtcacttttggatcattagcactttggtgctatcacgaaagaaagaataagcctgtataagcctcctctatccaaaattgtttttgatacttatcccctgattttttcttcctcactgtcgccccggctggtgcacagtggtgcaatcacggctcactgaagcctcaaccttcacctgcttaatttctgaacgttttgtagagacaggagtctcgctgtgttgcccaggcttctcttgcacttttgagctcaagtggccaccctcctgcctcggcctcccaaagtgctgggattacaggcgtgagccactgcacctggccctgatctagccttaagtataaacccttaccaccacctgagcaacgacaaacacatctttgtattgtacccttaaagagcccaatgagcactacatgcccaagagaaaatttaccttctgacggatgctcaaagccacagtcgacaatggcccggagcaactctggcttgagcaggaagtcacgaaagccagagctgtggatggagacataggagcccttgacatccttcttggcaggggcctcagccccatctcccccagctgctgtctccacctcatcatcttcatagtccaagagctcattgtccacatcgttctctgccataactgggccggcaggggaagaagggaagggggatctggatgggttctcgcaaaataggtgaaaacaaggggtgaagagtaggggattgaggaacagcaaaggaaaacaaagatactatttctaacagaagagctggaggggggaaaaaaaaaagcaagacttaatcacgagcacagccttcaccacctcttttccatccccagttcccactttccctaaaccaggaaacttttacctggaaagaaaaacagatacaaaacataaaaacgaaaagcaaatataacagaacagaaaaagcagtaccagggaaagtggttaggacagaggttcccaacaagattagcaatcacagtagcggaaaccagaaaagttggaaggggaagaccaacttataaattcttgatctgaaagtaacagtgaggaaatagaatagataataaaaggtaaaatacgactaataacttagtaaagtggaaaatggagatgacaagtagagtcctgaaaagtcctcaaaggaagactccgctttccctattataatcccaccgttatggatgcctaactcagcagccatcagtcaagggtgatagatgagggtcatcactgcgcaaagcgctcacctttcgaaaagaaaacatcatatggccgccgtccacctcccatagctctcagcctcccacttctcagtatcctcccttccgctgtttaagcaagccttgtgtaattagcatgggggggaggggcggtgcaagacaaatggctcggccacaaaaaaacaaaattcatgtctccaccctacaataagaaagctaataggtgacagagaaaggcaatccccgcccaggctttaacaggatctttaccaagtggtctcacatcactgttacgctacgaaggtgagactccttttggagaaacatacaatgacaccaatcgtatcgtaaacacttggaaggcactccaaattaagttgggcaagtcaaggtgagaaaaatccaactgggcccagaaaccagctcctcctcccagtcccaccgagggccgagaaagagctcaagaaaggacaaggaaggtgagaagagccccgccctccgcaaataccaagaccaagggacgccgagcgccgcctctcattgatgctgaggcctccaatatgagaagaacccattggaagaagggagcaaaacgaacacaatggcgccgaggacaccatcttggattgggtccccccttagcttcccttccttcccccaggagctctttgctctcgaaagggatgcaagctaaggaaatagcgaaccaactaggccccagcgaccagaccatcgcctgtgaaaagggtatcaggaacccatgtgacgggatgggtgcggagaagcgcagatggaaacggattgtagcgaaggccaaagcttacctaaacagggagagcgcgtatggcggcagcaacagcgacgaaggagggaaatctgccttcacttccggttgcaggcttccctctactccagcctcccgccttcttggctgcaagagcgcaggcgcaagggaccggaaacagggccttccgcggttatacagatccgtgcgctccaggcttgcctttggaaaatgcctgtctgaaatttgttttaaaaccgtttctaacttcactgctaccgccagtaacaaaagatataaaggaaactaacgtctcccccccactgttatctttattctcttatcctactcctctccatgcccctcatctcttcgtttaggtttttgccacgcaggtcttctctgtaggcacccctccatggatgcgcgaggaacgagtgtggcgaaggctgcgagttcccacggggtccttggcccggtagtgaaggtgacctgaggactgctgggcacgcactaggaaccggcaggccctagctgaggggagggaggagggaagtctcagggaactggattgctcgggggtgtttcccgactctttcccagtcgtggggctggtgggcggtattttcccaaaaggatgctgtccgaggtagctgatgccctagggccagtgagtcaggaaggtgttctgaatccgagcgggaagacggggtctggattcggccccaagtgttaatagtagggcttgagggttatactacattccattaatactgtttttgtttttgttttgagacagagtctcgccctgtcgcccaggcgggagtgcaatgtcctgatctcggctcactgcaaccgctgcttcccgggttcaagcgattctcctgcctcagcctcccgagtagctaggattacaggcgcccgccaccacgcccagcaaatttttgtttttttagtagagacggggcttcacccatgtatgacctcaggtgatccacccacttcggcctcccagagtgctgggattacaggcgtgagccaccgcgcccggcccattaatactgttaattcgagcagaatgttcttggccccgccccaacagccccattgttcaacctggatttttttcctgaatgaaacatttgctatccccgtctttgagatggggagctacaaaagtaagacctgatgtcctgctgtgtaataaaacaacaaacgtttggccctctccctgttaacatacttaatcatttaatactaaggagtaggtaccgttattctcatcttattgacagaagcgaagcaaagcaacatatctcaagcagtacggctggtgaggttacagccaggatgcaaacatctctcattctctattgtattctgcctccctgctcaaagaatctggttagtaaatacactgcaggttaccttattggttcaaattcttggtgaagtaagcttgtcttcagtgacaaatgaagtaactaattcaagaatggtgtcatagaaggtattttcccaagtatcatttaatttattcaaaagtatttatcaactgcctcccttgtgccacatgttgtcctaggatctggggacacaacggtgaacagccctgttctcacagtgtttacattacaggaaagaaaacacataaacacaaatataatgtcaagtatcgataagtggtcagggtgcagtggctcaggcctgtaacccaacccttgaggaagccgagcccgaaggattgcttgagcccaggagtttcagaccagcctgggcaagtgagaccccatctctacaaaaaattttaaaattagcaaggcatagtggcactcgcccgtaatcccagctactcaggaggctgaagtgggaggatcatttgagtccagggggtcaaggctgccgtgagctggaactccagcctgggcaacacagcaggaccttgtctcaaaaaaccagtagcagtaagtgctatgaagaaaatgcaaggtaaaggggcaaagagcacttgctcctacactccagcttttctctacagttgcgatctatagtcctcagattcccaaatgaggaaccatgtttctcactttagagaaataataaagtactacttgttcttgtttctccaagaagtttcaaaggatagccatttgggctgtttagggaatatgtaaacaaaaaacaagaaagtgactgaaggccaggcacagtggctcacacctctaatctcagcactttgggaggccaaggcaggtggatcacttgaggtcaggagtttgagaccagcctgaccaacatggcgaaaccccatctctactaaaaatacaaaaaatagccaggcgtggtggcacacacccataattccagcaacttgggaggctgaggcaggagaatcgcttgaacctgggaggcagaggttgcaatgagctgagatcacgccattgtattccagcctgggcaacaagagcaaaactccatctcaaaaaaaaaaaaaacaaagtgactgaaaatgagaaatgatgaggcaaaaggaggctgcttcaactcaccaatttatttgccaataattattttattgatactttttttattgttacaatgggaaagtaaggtgtcaaggatatagaaaggaagggcatgcatatgagggaacacagtatcattttagatcttagaaagcaatgagcatctgataagtctttggggaaataggaaaggaggaaaatctaataaagacaaagatcagcaaaagaaaaacaaagagaggctacaaaatgcagttatctacctggaattataagagaggggctaaatgtagtcatctcctctttttggagatcagaaggtctctgggaaaagagaagaaccaatttttcagaaaataactagggtcacagaatgaacaagtggaattagagagccagtgatggacgtgaggaaacagctgtgtaggttttgaccagtgagcaggtggtggtaatagtatcacagggttgctacttactgaatcactgctacaacatgcaaggaactgtgctagactttacagaatgattcctaatcattgaagcaaccctcacaaggtaggcattattatcatcccagtttcacagaggaggacatcgaggctaccaagttaagtagcttgtcctggtttcacagccagcaagtgacagggtcaagagagggacccacatcggccagacactgaagtcaggatgttttccacattcctacttccccatattacaaatttcacagagggtttaggtgagaatgacttggaagtttacaaagtcccagtgagggttaaagaacaacaaggagattcagatgtgagcaggatatttataagtgtcacaggaaaattattggatcctgcctcccaggatttctaggggatggaaagaagacagggattatggtgggaggtgattttgattggaggatttctttgagggagggaactggcagaaggagtcaggccctacggtggccctaggcagaaatccggtagttggggtggacctggggcctgacgtcgcagaccatgccaagaagctgggccaggacacgctctcggtttctctgctgggagctctgcatgccctgcacctggcgccttgtagcctgctccacctcagcagacaggttcccctgggagcccatggcctggggggtagggagaggggtggaagagagaaagggaaaagcagaaacagacaagggtccaggcatatgaggggaaagatcctgaaacaaagcctagaagaaaggccctctcagaaaccacccccatcccacagaaatatcccaacaccaaagagatcaacacagtcccctttccccttagacctaacatgcaacttcatcctaaaacagaccgtaatatccccaccacctcaccatccatgaccataaaactctaccctccaccacaaatgttaatcatactccacatagatgttatactttacacagactgtggcattccgcccacaagctctatgtggccttcaaaactcccagactctcctacatatcatcacaaagtttcaccaatgttgtggtccctgccagggtcccctcagcctcagccctctgccaccatattttcttgttgagtcacccttacacacctcactagatgcacccaccaacttgcagtggggtctcaacccgactctgcctcaactcaccgcctgctgcttgctctggaattcgtgctctcgctctctgcggtattgctccacctccatctgtgcctcctcctttgcctgcttcagtcgccgggccttccctggaggcagaagaaaggacagtgagtggggatggacccacacacacacaatgtaatagcaggagtcagtcccttccagaaagttatacagccttctctcagccaaccaggtgccagattctaatatccatccatttcttccctcctaaccagcctccagaccctagctgtctgtcttcccgccagccttgggttttcccaaaatgtttgctgtcccccacccccaattttctttccaaactcctaagggaggaaagaggagactcactctttctggcatctgccaccttctcagctgcccgcttctcagcttgcagaagctgctggataccttgggactgactggccatttctgttgttatggccgatgctgttttgaatgctgtcaaagtaccagatggctcccaccccccaccgcttacttctcctcctccagctcgttgctgcagtcctccactacccctgggtcttagtgctcccctgctcactcagcctcctgcaccgagtgtctctcccaatctcatcctcctattgatgactggtcctcctctccagcacttcttgctcaggcagtacccaaaggggccgcctgggagcagcagagaccaggcccaaagctgcgggcttacaacaggttagccatcccagtcggaaaggtctagggatgaggcaggggcggagacgggggagtactgaggtgagagaaggagaacttgattggtggtaacagaggaagcataaagggttgtgaatgcggtgaaaaggtaaggatgtcatcatgcaacctgtgttgggaaaagagcattctgggcttaattctaaactaactctctacctttctctctctctccaccatcccgccccctcccctgcctcccgttgttaacatctccatctttttctacatatttctcaagtccaaatttttgcatctcacttgccccatcctacgatagtcttcttccgtcttttgtctgtattttttctttttttttgatctgtccctgttgttgtcccactgtggtttttgtttttgttttccatgtttaatgtgatttttatcctgtctttatctcctctattttctctgtcttctcatcttttcgtccatcactgaaccatctcctctctctgccaagttagaggaggcgggaaaaaacctccaaataactctcttttctccctcccctcccctcgcctccttttcctcgcctccagtccagtcttctggtttcagacggcccctttaatttaagttccctagtttcccctgggagatctggccaagaactacccggtcggggcggaacgacatccggtaacgcccctcacagttcacttccgtcctccacctgcgtctctgcttgcgccatttcctccagcctggagtgtctccgcccttcccgcctcccgtctccgagcttcttaaacacaggccttgggcctacggctctgggggtacttgggggggcgggggcaggtctgatgagtaacccctccccccaggttccagaggaagaagcctccacatctgtctgccgggtacatgatattcaatttctagatcattattggagattatctgtgactttttaaaactcagatttctgctgataaaaattttccccatccggccctgttgggtttttttaaagttctttgttaaaaattaaaaatttacctgggctcctgagccttaaaccaattatttacccttttctcgaattttacattaaaaaaattaaacctctgatcctatcacccccctcaaaaaaaattttttttcaaatctatcatctgataaaggatcagggttaggttaggcctcatctcttgctgaagatattaaaaaaagacggaaccaaagggagaaacaacaggggatgtcagagatggagggagaaggaccagccaaggctgaagtcctgactgctgccttttttccttccccagcccaagagttccatggcctccacttcccgccgccaacgccgagaacgtcgctttcgtcgttacttgtctgcaggacggctggtccgggcccaggccctcctccagcgacacccaggcctcgatgtagatgctgggcagcccccaccactgcaccgggcctgtgcccgccacgatgcccctgccctgtgcctgctgcttcggctcggggctgaccctgcccaccaggaccgccatggggacacggcactgcatgctgctgcccgccagggcccagatggtgagtctgctcagtggggaacaaggtcataagcagctgaccagacctgaaatgaaagccaaccaatagttgagaaataagctggttatttggtcatcaggacctagggaaggagttaaccaagttggcatgtggctgtcatttgtccctttacattactgagctaccattgtctgaagaacccaacattccccaaagatcaactggtcttcaaatttcacatctgtttagattagtagctactttgtttcttgacagattgtttgctcgtagccaaaaagtagcatagaaggtaggctctggagttagattgcctggattcaaaccccagctccaaatcccagctccacacttcatagctacgtattcttggacaggttacttgaggcttagtttgcccatgtgtaaaaattaaaataataacaacctttgctatgtgccagacatttcttataaagtaacacatttaatcctcacaacaatcttaggaggtgagtactgatattatcccccatttcccagctgaggaaacagggcatagagaagtcatttgccagagttacagttattcactggtagagcagagattataacccagatggactagatagagtgtccatgcttttaacagctacattgtcctgtgttatacattatagcattgtacattgattgtgcccatgttcagagtacccatgttgtgccatatatgttttgagaatcaactgacatagtacataattagagtacctggcacacacgataagcacttggtatatgctggcgattgttgttcctgtttctctgttttttgtttttgtttttgttttttatgaagtttcactcttcttgcccaggctggaatgcaatggtgcgatcctggctcactgcaacctctacctcccaggttcaagtgattctcatgcgtcagcctcccaagtagctaggattacaggcgcatgccaccacgcccagctaatttttatatttttagaagagatgggttttcgccatgttggacaagctgatctcgaatgcctgacctcaggtgatccaccaacctcagcctctcaaagtgctgggattacaggtgtgagccaccacacctggccttgttcctgtttttgttatcaacaggtccatactcccttaaccacaattctaaactcaaaaacactctgagaaccaacatttttcatcaggctgccaccaaaattcatttggtgacagaaacctaatctgaactaaagtaagactattatttattttcatcctactgatgtcaatattcatacatttccctgcagaaacactcatgtgtttggttcttgggctgcctaggccctcctgggctacctaatatagagtgagtgtacttttaggtcagccctatcaagtcccaaaaacatttgaattctgcaaaacctttggcactgaaggattcaaatggggaacctggtgatattataatagtggtggaggccaggtgcggtgggtcatgcctgtaatcccagcactttgggaggccaaggcagtcagatcacgaggtcaggagttcgagaccagcctgaccaacatagtgaaacccccatctgtactaaaaatacaaaaattagccaggcatggtggcacacacctgtagtctcagctacttgggaggctgaggcaggagaatcacttgaacccggaagacagaggttgtggtgagccgagattgcactactgcattccaacctgggcaacacagcaagactccgtctcaaaaaaaaaaaaaagagtggtggaagcagctctttataggtagagccctgcttactagaataaaagctgaaaccttctttccccatctagagatttccttctggagtaagaacattacaggaaaacctctagatccagatgaacaaccctaacatcccccagctcaagtatagacagaaggcccctcccccaaaactcccccaaatggtcaaaaaaccccctatttaaaaatttcctttaacgtacctgagataggctagcatattcagatttgtttcttgttgtttttacttaaaacagagtaggtttactgagtgcaggcatctaacttgacagctcatattgtaagaggcaggaccctggaaggcaaaagagcggattaccccgaagcagacctgcatccagaccccagctctgccatcaacagggacatgcagcttacctctgtgagcccaatttgcctcgcaaaaatgggagttttgttttttgttttgttttgtttttttgagatggagtttccctgttgttgcccaggctagagtgcaatggcgcgatttcagcccacctcaacctctgcctcctgggttcaagagattctcctgcctcagcctcccaagtagctgggattacaggcatgcaccatcacgcccggctaattttgtatttttggtagagacggtttctccgtgttggtcaggctggtctcaaactcccgacctcaggtgacctgccagcctagcctcccaaagtgctgggattacaggcgtgagccaccgcgctcagccaaaatgcccctgatagtgtggtagggatttcctttattgtttgtttgcttgtttgttttgagacagggtctcattctgtctcccagcctggagtgcagtggtgcaatcatggctcactgcagcctctacctcgtgggctcaagcagtcctcccacctcagcctccctagtagctgggactacaagcacacaccaccatgcccagctaattgtttgtatttttggtagagactgttttgctatgttatccaggctgttctgcatctcctgagttcaaacagtctgcccacctcggcttcccaaagtgccgggactagaggcgtgagccaccacacccaactccattgtattgaattttaagaagctggtgagactgatattatcccatttacagatgaggaaagcagggcccaaaaggttcgggaacttgtctgaaatctcacagctctcaggtcattgtcttccaaagggggacccaagctcagtgccttcactcccagaccctggtgtcctctctggccttatttactcctggtcctctgccagccctgccaccagatggccttctaactccttggttgaaaggcccatctcattcagcttccagcttcctttttcttttccttttgagacggagtcttgctttgtcgcccaggctggagtgcagtggcatgatctcggctcactataacttctgcttcctgggttcaagcgattctcctgcttcagcctcccaagtagctgagattacaggcacacaccaccatgcccagctaatttttttatttttatttattaatttttaaatttttatttgtttatttatttttgagacggagtctccctctgttccccaggctggagtgcagtggcagtatcttgactcactgccacctccgcctcctgggttcaagtgattctccttcctcagcctcctgagtagccgggactacaggagcctgccaccatgcccgactaacttttgtatttttaatagagatggggtttcaccatgttggccagactgctctcgaactcctgaccttagatgatccacctgcctcggcctcccaaagtgctgggattacaggcatgagccaccatgcccgacctaatttttgtgtttttagtagagatggggtttcaacatgttggccaggctggtctcaaactcctgacctcaagtgatccacccacctcagcctcccaaaatgttgggattataggcatgagccaccgtgcccatcccacagaatgtcttttggttttgtttttgttttctgttttgttttgttttgttttgtttgaaaaggagtctcattctgtcgcccaggctggagtgcagtggcacaatctcggctcactgcaacctccacctcccaggttcaagagattctcctgcctcagcctcccaagtagctgggactataggcgtagggactgtaggcgtatgccaccacgcctggctaattttttgtatttttagtagacacggggtttcaccatgttagccaggatggtctcgatctcttgaccttgtgatctgctcacctcagcctcccaaagtgttgggattacaggcgtgagccacagcgcctggccaaaatgtttttatgtttatttttcttagtatgaaactccagcgtattaaagagcattgagaacggttgatctggtaaatcgctataaaggcggcatttctttttttttttttttttttttttttttggcgaagtgggggatggagtctcattctgtcgcccaagctggagtgcagtagtgtgatctcggctcactgcaagctccgcttcccaggttcaagccattctcctgcctcagcctcccaagtagctgggattacaggcgcccgccaccacgcccagctaattttttgtatttttagtagagacagggtttcactgtgttggccaggctggtctcgaactcctgacctcatgatccgcccgcctcggcctcccaaaatgctgggattagaggcgtgagccaccgcgccaggcctaaagggggcatttctaatactggagaaaggtgaacttttttttttttttttttccgagacagagtctcgctgtgtcacccaggctggagtgcaatggcgcaatctcagcttgctacaacctccgcctcccgggttcaagcaattctcctgcctcagcctcctgagtagctgggcacctgccatcatgcccagctaatttttgtatttttgtagagatgggggtttcaccgtgttggccaggctggtcttaaactcctgtcctgacctgaggtgatccacccacctcagcttcccaaagtgctgggattacaggcatgagccactgtgcctgaccaggtgaactattttataaataatattggaacatttggctcatctagggaaaaacaagagtcccacctcacacctaatcaaaaagtaaattccagcagattaaatacctgaatatgacaggaaggtacacaccaaattcatgggacagatggcctggggaggaatgaaacttggaaggcggtatcacggtaaactacctttatctgtgatgattttatttccttaaaataaattatactacaaacatgacagtacattaacaaaccctgtggtaggaatggggttgtgtattgtattatactttgtatttttgagagttttttaatttcttttttgttgttgttgagacagagtctcactctgtcacccaggctggagtccagtcgcgcaatcttggctcactgcaacctctgcctcccgggttcaagcagttctctgcctcagcctcccaagtagctgggattacaggcatccgccaccacgtcaggctaatttttgtatttttagtggagacggggtttcaccatcttggccagactggtcttgaactcctgacctcatgatccacccaccttgggctcccagagtgctgggattacaggcatgagccaccgcgcctggccgagttttttaatttctaaaaataaaaatgagtatacatctaaagtagtagaagaaaatgcagagaatgttttataatcttaaaatagagccttcctaagagtgaagtgaaataaaaagtcagaaaataatatattgatatagatttaactacatgaaaattttaggccgggtgcgatagctcacacctgtaatcccacactttgggatgccaaggtaggcagatcacttgagccaggagttcaagaccagcctgaacaacacagtgagacctggtctgtacaaaaaatacaaaattagccaggcgtggtggtacgtggctgtcgtcctgtagtcccagttactcaggaggctgaggtgggaggatcgcttgagcccaggtggggcagagtttgcagtgagcaagatcatgccaccgcactgcagcctgggcaacagggtgagaccttgtctcaaaaagaaaaaaaaagcttttttaaagatagatagaagaaaatgtttgcaatatgtataacacatacagtatatagaaccctcatatcaatatatataatttccaaagaaaaagtggataaagaatatgagcaattcattcacaaaaaatacaaatagccaaaagacatgaaaaagaaaaaaacattgttaataaaataattttttaatctatccaactggcaaaattaaaagggttgatgatattcaattttggtaaaggaagacataggcacacttgtatattggcacaaacttattgagagcagtttgaccaaattgcgcatgtcctttgactcagaaattccacttatgaaaatctacccccacagaaagactgtaagatactcatgaggctgaacattttttgaaacaaagtctatcgatattggggtaaggagatttgttttgtacacacagtggaacactaattataaagtcgtcaaaaagtatgaggtagactgtatatattcctgtggaaaaatataaatgagatgttaaatgaaagaagcaagttgccaagcaatatttgtagtatggttacatatctccaaataaatgtgtcatatgtatgcttttaggtacaccaaggtgggactggaagggatcacagtacactgttaatagttatcaaatttgttcgtccttctttaaaaagaaaatttcaacttaattatatccctttcacattaaaatgtcaaataaaattgggggaaaagccacctacagccccaccacccataggctagaatttttacatattttttgccagtctattttttttctttttttttttttttttttgagatgggagtctccctctgttgcccaggctggagtgcactggcatgatctcagctcactgcaacctctgccttccaggttcaagtgattctcctgactcagcctcccaagtagctgggattacaggcacatgctaccacgcctggctaatttttgtatttttagtagagacaggatttcaccatgttggccaggctggtctcgaactcctgacctcaggtgatccacccgcctcagcctcccaaagtgctgggattacaggccatgagccaccacgcccggcctctttttttccaaccataggatttggtctcttgttttagacagttattatctgatcctctctctctctctcttttttttttttttttttttttttgagatagagtctcaccctgtcacccaggctggaatgcagaggcgcgatctcggctcactgcaacctccgcctcccaggttcaagcagttctctgcctcaacctcccaagtagctgggattacaggcgtcagccaccacgcctggctaattttatatataatataaaatataattatatatatattttgtttgtttgttttagtaaagacgggttttcaccatcttggccaggctggtattgaactcctgaccttgtgatccattgtcccccccccccagcctcccaaagtgctgggattacaggcgtgagccaccgtgcctggccacatctgatcctctctacagttttgtagccagcttttttcaaacacatgcctcagttgtagtggctgtttaatattatgtttttatagttggaggccctactccttaaaacctatgaatgtaaacctcccatgcaagcctgagcactcaccatgctcaccacctgagctcaggtggggaacaagcgaatgagagacaggaccaggtactttctgggtgggacaagttgagagggtctgtgacaggtcacagcagcactagggagaagtgcccccccccaccaaccctgatgtgatttgggtagggatggtgggccttcgccagccacacctgggccattctgtcttcttgccttcctggccttgccttcccctattccagctttctgccaggtaaacagtactttccagcactaccaaataaagatttaaggactgctagcccatttcctcttaccccggggaaagaaagtaggtccacaggaaggaaggctgcctccctccccttcttctatcccccaagtgaaagaggtggttggtggccacagcaggtgggcctggccaggatgcctgggttggcagtgaaggaagtagcatggcactcagctaaccttgggccagatgcagcaaggttgggactgaagaaaaggggagttcaggaacgtcggttcctctcctgttttctctcagcccatgggtgagaccctctgtcacactccactccctttcccctgccctaggtcagcagtcatttggaaagagcttgctctgccgccggccatagttgttgccggttcacctccccacccctctcccatcatcccctggtaaggctggctgagagaaattcccctgaaaacatttattttactcagtttattgataagtgataat

SEQ ID NO: 1036 - DNA, 95600 bp, Homo sapiens
agtgagccaatactgtgccactgcattccagcctcggtgacagagtaagactctgtctcaaaaaaaaaaaaaaaaagaaagaaagaaagtcactggcagaggccaggcgcagtggctcacacttgttatcccaacactttgggaggccgaggtgggcagatcacctaaggtcaggagttcgagactagcctggccaaaatggtgaaaccccatctctactaaagatacaaaaactaggcatagtggcgtgtgcctataatcccagctactcaggaggctgaggcaggagaatcactggaacccaggaggccgaggctgcagtgagccaagatcacgctactacactctagcatgggagacagagcaagattctgtctcaaaaaaaaaaaaaaaaagaaagaaagtcactgacggaattagaatacaccttttctatttcctagtccagggttctttctgatatcaaaagctctacatacagttttttatattacaccagtaattttactcaaagttttcaaaaactctaaaaaatttttatctacctgagcaatatgcctccaatggccaacttcagactcaagtcttgaaacttcatttgagagtcggtttatttcttgttgggatgaaattatatcaccaaagtccatgtcatcgtcatggaaagctgaaggatgatgactaatcccataagcgaatgaagatgatgcagtggttgctggtacaccagctcctgaaggtactgactgagcagctgactgcagtttcagcaactgatcctggagtgcaatctgtctggctttaagatggctgatttctacctatatatttataatccaagttttagagaaggtactttaaaacaatcatattgactttttatagatttgtattaaaagacacaatacaataatttgtctaagattatccaatgatggtcctctatcaactgaatctaagtcttatataacattctaaccataacatttttatttaaaacacactcacaattaaagcataaataatgttacaaatagtagaaatatcagaattttgtatgttaactaaagcaatgaatttctcagttaaacatgggtttgctatcttctctgcatggagtagtataggcaatttcttagggttctgtttgtgattaccaaatcttaaatgatgagaaaatgaaagctgtgtccgtctatgcactggaaattttcttagaatatctcctgttacaagggtgttgtgtaactgattatggctggatgtaggcttaaaatgcaccatgaatctgaggtaactttgtattgacctgcacaacacagctggaagaatgctttgatttataaatccaatctttttagataagataacagtgaaacagtgagcccatggttattagcccatgaatcttaaaaagaaataatatactgaaagtggtcttagctttagatttggcaaagaggagccagcgaaaatctgacctatttaggaagagaacagttctgaagttctgaaattaccagcagttttgactaaaggcgggtaagtcatagcgcaaaagaaattataaacacaggacctaccaaaatgccacatccattcttgtaaaagattattcaaaacacaaaatcaaacaatatagacagaactgaaaaaagttttctataaagtagagtagtccagaagacactgccacaactgaggaaaatttgatattaggaagacagccaacaagtaacagtatttctatatgcataaagttaagcaagtagacaaaaaccaaacacatttatgttgtatgtcataacaaacaagtttttcatattggagccccttctcaaatggaaatttatagtactgtacaaatttcattcattttcccacaaatgacatgagataaattccatcttggagaatatgaacatcacaatgagggccgcacatagattcaggaaataacagatctatataatcatatatttcatcctcgtaaaaagtactaaaatccacatctttttcaaatgtagctatatttaaaaagctatcattatatgatatttatatcaacttgtagttatacaagtgcaagctgtaataacagatatttccaaacctgaatgcttaatgtgccctctaatatcgatagttaagtagaacataaaataccaaaattttccccaccagtgttttcaactgtgaggtaggcatcagaataacctgtggagcttttgaaaatgaccaatacaggttgagtatccttatccgaatgcttgggactagaagggtttcacatttcaggtattttccaatttgagaacattctcataaatgtaatgagatatcttggggatgggacccatgtctaaacacaaaattcatttatgtttcatatacaccttatacccacaggtacgtgtgaaagtaattttataaaatgcttttaacaattttgtgcataaaacaaagcttgtgttcagtacttatttgtggaattttctacttgtggcatcaaactggcactcaaagttttggattttggagcatttcgaattttggtaggaatgctcaacctgcaccagggcctctttccagtacactaagttagaatctcctaggtggtgtaaacatgtatatgcttttaaagtgtcataatgacacagctgtaaacccctgggtaggaggaactactgttctatcataatgtttataactcaatgctactcaaaatgtggtccacagacgaatgcagttgaatgctcactaccagtccagagcaagtatagcaatgtgaaaagtaaggtttaagacttttaaagcaatttagtagtaattttatatctgctgaacttttttttttttttttgagacggagtctcgttctgtgacccaggctagaatgcagtggcgtgatctcagctcactacaaccaccgcctcccaggttcaagcaattctcctgtctcagcctcccaagtagctgagactataggcatacgccaccacgtccggctaatttttgtattattagtagagatggggaatcaagaaaaaaaaaaagtagccttgtaactttaagttgaacttgaggacaggcacggtggctcacgcctgtaatcccaacactttgggaggccaaggcgggcagatcacctgaggtcaggagttcaagaccagcctggccaacgtggtgaaaccccatctctaataaaaattcaaaaattagccaggcgtggtagtgcatgcctgtaatcccagctactcaggcggcacgagaattgcttgaaccgggatgcagaggttgcagtgagccgagattgcaccactgcacttcagcctgggcgacagagcaagactctgtctcaaaaaaaaaaaaaaaaattatttgaacttgcaactttgccttttttagtattcattttatttttatagtaattcattttgtattgtattttatgaaattatcacttcccaacaaattggaaatttaagcactactttcaaaacctatgtatatctttaacgtgctatacttttatctttcaccttagcatgtcactaaaggaactagaaagcataggaattagaaagcatgacacctaaattttaaaaacccaaatataaagttatggtagaaatgaacacttagtcaacaaactgaaaaacatccaaatgatctggacaatataacaggaaatggttccattcaatgtaagtatttattgggggccacttaggtactaaacactaaagagaattcagtaacagcatgacacatgaggacacagactgtattttaaggattcagagtaacattaaattatataatatctactaccagcactgtaaagcaaagataaatcaattccaaagcagccatttcaaactaaaaaacccaaaaacatttataaagcaattatatgtaaattatcatatatttaatagtttttccatggaaaatcaagcacatgccaatacaacaaatattaggcttcataaaatcagaaattataagcaacagatccctaaagatattttatacaaaaactttttcttcttctttggaaagaaaaaaattatacttcacacaggttggtttatatatgtaaacttaataaagtttacattaccttacaaagttcttattaaataagggatatcaaactgagtcgaaaatcattaaattcatcaccttttcatatttttacagatctgaatatacctcgatttatattctaactctaaaaacatacctaaatacattacagtgaagtacatatgaagtaactgtgataacatttacctctttttgttgaagttgatttcggtaacttgtagattgctgctttatttgaatctctgatgcttcatgtttctcttctagatcagtacaaagtttcttaagcctttcattctagaaaaaaaaagtattttcaacaaaaagactgcaagtaaaacatgtaattagttatgtgcacagcattatgaaaaacgtactgctttccccccccaaaaatgtcaaatataaaaggtctcggacagaattctggactttaaaatatgcttttaaattaaagttaaaaatgcactgaccagccgggcactgtggctcacgcctgtaatcccagcactttgggaggccaaggcagatcatgaggtcaggagatcgagaccatcctggccaacatagggaaaccccatctctactaaaatacaaaaaaaaattagacgggcgtggtggcgtgtgcccgtaatcccagctactcgcgaggctgaggcaggggaattgcttgaacccgggaggcggaggttgcagtgagccgagatcatgccattgcattccagcctggtgacagagcgagactccgtctcaaaaaaaaaaaaaaaaagcactgaccatgtttatacagacagaatatgcataattctaaaccaaacagtgaaatattaacattttgctcagattgattttctgctaagaaaaggccacgaatcaatgtttccccatctttgtatacccagttctagcacacagcagtcaatacatgtctagtaaataaatggattacatgtttgaacttttgttttcttccccaaacagaactttttttaaaaagaaatctttctggttgaagtacagggaggaggctaaaatctcacataatttgcttgtctttcagggtccctgaaggacctcggaaaaaatccaatttgaaaaccactactagaactgtttgaaaaaagttaaaagtacacaaaatagcctaattcaatgaacctagacattacacactgtcttttaagatgttgaaaaacatgaaaaaaattactcaaattgtatgtacctaaatattaaattatcttaacctattatcattccttatttgaatgaaataataagaacataatggggcgccccactggctgctctgaaaagccatctttgcattgttcctcgtccgcctccttgctcgccgcagccggcagctttatcgccagagtccctgaactctcgctttctttttaatcccctgcatcggatcactggcgtgccctaccatgtcagacgcagccgtggacaccagctccgaaatcaccaccaaggacttaaaggagaagaaggaagttgtggaagaggcggaaaatggaagagacgcccctgctgacgaggaaaatggggagcaagaggctgacaatgaagtagatgaagaacaggaagaaggtggggaggaagaggaggaggaagaagaaggtgagggtgaggaagaaggatggagatgaagatgaggaagctgagtcagctaccggcaagtgggcagctgaagatgatgaggatgacgatgttgataccaagaagcagaagaccgacgaggatgactagacagcaaaaaaggaaaagttaaactaaaaaaaaggccgccgcgacctattcaccctccacttcccctctcagaatctaaacgtggtcaccttcaagtagagaggcccgcccgcccaccgtgggcagtgccaccagcagatgacacgcgctctccaccacgcaacccaaaccatgagaatttgcaacaggggaggaaaaagaaccaaaacttccaaggccctgctttttttcttaaaagtattttaaaaaggaaatttgtattttttattttcattttatatttttgtacatattgttagggtcagccatttttaatgatctcggatgaccaaaccagccttcggagtgttctttgtcctacttctgactttacttgtggtgtgaccatattcattataatctcaaagcagaaaaaaaaccttgtaaaaaaagcaaaaacgacaacagaaaaacaatcttattccgagcattccaataacttttttgtgtatgtacttagctgtactataagtagttggtttgtatgagatggttaaaaaggccaaaaataaaaggtttcttttttttccttttttgtctatgaagttgctgtttattttttttggcctgtctgatgtatgtgtgagacaatgttgtccaacaataaacaggaattttgttttgctgagttgttctaacaacaacaacaaaaagaacataatggggcaaaagaaatggacactaaaactctctacaaaaaagaatttacaaataattgcagataacaatttactaagcattctactaatatacccacaaacacggtttaacaacaatgaatgagaaaaagaagactgatagtgagaaagaaagctcttgctaaaaggtgaagactttttcactttggggatgtcatttgttttcttcttagattctaggaacttctgatgtcaacagatgtgaaaataatgatccaggaagattacataaattcccagagaaaaccaatggaataatcaaaggaataattacagcatccacaaatcctagtttgggactctatccccagaaatctaacacagaccttaattatcctgaagaactagtagtaagaaacaggaccaatggtcccaacagctgattaccttctattctactggctgcttttgcatgactttctgtaagctgtttatatgaaaaacaccatacataactcagcgatataatatactgaagtcaaaccctggttataaaagttcacttcaggttttttttcacacaaaaatacctaaggttatttatttaactctgattaataaatagaactgtgaaactttgaatatggtcaatatctacttggttgtctgccctcatctccatagccatatgagagtcagaaagattgagaaagggctaggcgtggtggctcatgcctgtaatctcagcactttgggaggctgaggcaggaggatcacttgagcccaggagttcaagaccagcctgggcaacataaggaacaaaaaatacaaatacaaaattagctgggcatgttggcttgcacccatagtcccagctactcaggaggctgaggagggaagactgcttgaacctgagaggtcaaggctgcaggggagccatgatcacaccactgcactccaacttgggtgacagagcaagaccctgtctcaaaacaaaaagaaaggctgagagagcaaatgaaggacagtttctcttcatgtggccgaacccataaaatatgaaaagagttgccagagataatattttctattatatggaatattgaacagagggggctggtctgaaaggagaaaagaataaatgcatagaaagaagaaaagagagtacaaatgaaaagagagacagactcctgatggcctccagttctagctgcagtccttctaaagtcagactacatttctgctattgaaatccataggacactcacatcttaaaatattccgtcctgcttaatctttggttataccattagggtccactgaaatcaacttaatttcttttttaggcagtcctaactattcgtaaaacttgatatttatgatttttattctttctgaggggtctaccaacaaagagaaaatttacctattttcaaaaatagaataaaacattctatcttacaattaccatagggtaccgtggatctttttataaatctaagaaaaatcatgggagcaaaatcaacttgtattttctgtatcttaaaacatttggctcttttactatcatgggaattttaaaaaatcatttaaaaaattattcccaactattttaaaaatgacaataacaagaaaacggaaaacttatgaaatcacctaggagaatgatgcaatggtaaaataaccagttttctgactgcattgcccaaagtattatttttttttttttttttttttttttttttttttgagatggagtctcactctgtcacccaggctggagtttactggcacaatctcggctcactgcaacctctgcctcccaggttcaagcaattctcctgcctcagcctcctgaatagctgggattacaggcacgtgctaccacacccggctaatttttgtattttttgtagagatggggtttcaccatgtcggtcaggctggtctcgaactcctgacctcatgatccgcccacttcagcctcccaaagtttacaggcatgagcctgtaatcatggattacaggcgtgagccaccatgcctggcctatatcatctttttaaaagaaaacagctgtctacagacaccactttttgtagttttgttttttctctttcatcgaacacagttaaaaactcagaatttttaattatttgatgaagagaagaaaactgacaaaggaaaacattcacaattattagacaacttagaagattaatgcagagacagaaagcagcatcctagagtctaatggttatggtgaaactgactgtagaagtgaaatcttacacaaatcttcagatggcaatatcctggaagaattttctaaaagtcaagaattgatgagtgggccgggcgcggtggctcacgcctgtaatcccagcactttgggaggccgaggcgggcggatcacgaggtcaggagatcgagaccatcccggctaaaacggtgaaaccccgtctctactaaaaatacaaaatattagccgggcgtagtggcgggcgcctgtagtcccagctacttgggaggctgaggcaggagaatggcgtgaacccgggaggcggagcttgcagtgagcctagatcccgccactgcactctgcactccagcctgggcgacagagcgagactccgtctcaaaaaaaaaaaaaaaaaaaaaagaattgatgagtgaataatatatttttaagaacaaaaaagaaatatggctttcagatcaattagtcattcaacaggaaaatacttcactctgcattattttgtgacaaggacttaaaccatttcattttgctaagcagatacatgacagtattctttttttatttttattttttattttttttgagagtctcgctcttgttgcccaggctggagtgcaatggtgggatcttggctcaccgcaacctctacctcccaggttcaagtgattctcctgcctcagcctcccaagtagctgggattacaggcatgtgccaccacgcccagcgaattttgtatttttagtagagacagggtttctccatgttggtcaggctggtctcgaactcaggtgatccacccacctcggcctcccaaagtgctgggattacaggcgtgagccaccatgcctggccatgtgacagtattctttcatcatgtatatttgtacaccaacatttacttgatatgttcatatgtagaaggctgaaagcaggtgtgtacacaaaggcaactgggaggaaacagatgacacagaaatgaaaaaaactcagtggactgatcattctaattggcatttataaatctaagaataaacatgcttttgaaattatagagcaaagatgacagccatcatctcttcaataaaatcatgagccattaaaattttcaaaagtattgcttttaatgacacaatcaagaaccaggctgggcatgtggctcatgcctgtaatcccagcactttcagaggccaaggtggaaagactgcttgaagccaggagtttgagaccagcctgggcaacagagcaagacatcgtctctacaaaaaattttatttatttatttatttttttatttacttacttacttacttatttattggagatggagtcttgcttaggctggagtgcaatggtacgatcttggctcactgcaacctccacatcccgggttcaagtgattctcctgcctcagcctcccaagtagctgggattacaggcgcccaccaccatatccagctaatttttgtatttttagtagagacagggtttcaccatgttgaccaagctgacctcaagtgatctgcccacctcagcctcccaaagtgctgggattacaggcatgagccaccgtgcctggcctattacaaaaaaatctttaaaaattagctgggtgcggtgttgcatgcctgtggtaccagctactcaagaggctgaagcagaaggatcacttgagcccagaagttcaaggttgcagtgagctatgactgtgccactgtattccagcctgggcaaaaaagcaagaccatgtctcaaagcaacaaccacaacgaaaagaactagaagtaataataacctgaaatctattagagaggtaactgaactttggaatcaatattttacaagataaagatattccaggttatacaattaagggttaaaaagcagttcactgaattcaaagaacattgcttattttgagtctttatgctttcaaaaccagaaaaaaattaaataaaaatttggatttgctgtatttaaattattaaaatgtctttttctttttttgatacaaggtctcactctgttgcccgggctggaatacagtggcaggatcacagctcaccgcagccttgacttcctgggccctaagatcaggtgatcctcccacctcagcctcacaagtagctgggactacagacacccaccaccacaccttgactaatttttttatctttattttttgtaaccggtctcaaactcctggcctcaagccatcctcccacctccacctcccaaagcgctgagattacaggcatgagccactgcgcccaatctagaccctaataatgaataaaacattaaaattaatttgctattcctgtatcctttttttctttttttggatggagtttttctctgtcactcaggctggaatgcaatggcgtgatctcggctcagtgcaacctccgcctcccagtttccagcaagtctcctgcctcagcctcctgagtagctgggattacaggtgtgcaccaccacatccagctaatttttttgtatttttagttagagatggggtttcaccatgttgtccaggcttgtctcaaactcctgatctcaagtgatccacccacctcggcttcccaaagtgctcagattacagacatgagccactgtgcctggctgctattcctatattcttaacttttttgtatccaaatattattatcattttagtgtttaaaaagctccaggttaaacagaattgcattcttaatattatacttagctgggcgtggtggctcacgcctgtaatcccagcactttgggaggctaaggcgggtgaatcacgaggtcaggagtttgagaccagcctggccaatgtggtgaaaccctgtctctactaaaaatacaaaaattagctgggtgtggtagcgtgcacctgtagtcccagctactcggggggctgaggcagaagaattgcttgaacccaggaggtggaggttgtagtgagccaagatagtgccactgcactccagcctgggtgacagagtgagaccccgtttcaaaaaaaaaaaaaaaaaattattcttaaataaatgtgccactgcaatttagtatgctgttagaacacagtaaactctggattatgataaattattgatactattatttctacatttggcagttttcctacttatacagaaatagagatgggaatattaaagaatagcaaactgcagtaacaggtaaatatatttttcatctacagaaggttgataaaagctcaaaaaacaatcaaaattaaacaagaagagaaaaaaagtgctaagcagtacatttaaaaagaaaggatcaaagtaatgtttgagtaaccttcatgacttcaaaaaagaaaaatctaagtagtctttgatttttcttacctctgatctcaagattgcatgaatggcttcaatttcctttgtcctagaatcaggtaattctgctacaagagaaataacaaatattgaatatttaatcaataccatatgaagtaataaataggtattttcaagaaaatatatttcactgagtttacacagaatagtaggctgatatgaaagcattcagaagaaacaaatcgctttatttccataacaacttttcactgacactaatgttcttcattgtcataaaagtcattctttttgcctatgccctgtatcttaggatgtctacctttaccccttagaaatgttcattagaattttgttgtgggaaattaagctttagaaattaaaactatttctctgtgggctaatgctgctataattttagatgaagcttactcaactggggctttaggccttatttctaactgtaagaattaaagaaagaggagagaaacacaaagggtggcttgccagttaagacaggtttattttagagaaaacaaacctgagaggggtgttcggctgagttaggttagaggcacactcttttccagactaagagtttttaaggatttagggtgggagaatttattagaggcttagactgcttctgtgtttttttgtagtgcttatctgggagggagagttgtgtatttgttccatttattctagagctgcaggcataccccccgagtctgctttagcttccctattttagtgcacctgaagggaaaggaatgtgctttctaaggcccactgctttactggggcccactgtatgagagtgaagtttggcagttacccaagagactttacccccacctccctttgtgcccgagcactccctctgtatgtgttttactgtctgctttttctggctgcttgtagttagaagagaagtgacttccttgaaatgcatgaggctagaaagggagctggaggtcaggtacggtggctcaccgcctgtaatcccagcactttgggaggccaaggtgggcggatcacgtgagatcgggagtttgagaccagcctggccaacaggtaaaacctcgtctctactaaaaatacaaaaattagccgggtgtggtggcacacgcctgtaatcccagctactcaggaggctgaggcaggagaattgcttgaacctgggaggtggaggttgcagtgagccgacactgtgctactgcactccagcctgggttacagagtgagactcttgtctccaaaaaaaaaaaaggaaagggagctggaacttaaagtggcactgtttgtctgagataacaacagtgctcctgctctgtcactaacttctgctctcaatactatcaaataataagtgacctataaacgaagaaaaatacactgagaacacttatttaaagtaacatagacacaatttattaaaaatgggaatgagctcagtctggttttctacattttcatctttattttttaattttcttggaaagggtctcacttcactctgccacctaggctggagtatagtggtgtgatcatggctcactgtagcctcaaactctctcgcttcagccttccaagtagttggaactacaggcacatgcgaccacacctacctaatttttttacttttttggagagatgaggtttcactgtgttgcccaggcaggtctcgaactcctagccttagggaatcctccacactcagcctcccaaagtgctgggattacaagtgtaagtcaccatgcatggcccttggttttgtacattttcatttaaaagtagagtgagagcccagcagtgtcaacatggcaccactaatgctgttagaaaatcatcatctggctggtctcggtggctcatgcctgtaatcccagcactttgggaggccaaggcaggtggatcacttgaggtcaggagttcaagacaaccctggccaatatggcaaaactccatctctactaaaaatacaaaaaaaaaaaaactggccagtcatggtggtaggtgcctataatctgtaatcccacctacttaggaggctgaggcaggagaaattgcttgaactggggaggcagaagctgcagtgagccaagatcgtgccactgcactccagcctgggcgacagagcaagactcggtctcaaaaaaaagaaaagaaaagaaaatcatcatccagagttagattttttttctaagtactagtatttttttcattactcacagctctttaatataaaaataacttatctggactacagtttattaggagtgtccaatcttttggcttccctgggccatactggaagaactgtcttgggccatacataaaatacactaacaatcgctaatgagctttaaaaaaaaaaaaatcgcaaaaaacctcattttttatttatttatttatttattttttttttgagacagagtctcgctctgtcgcccaggctggagtgtagtggcacaatctcagctcgctgcaacctctgcctcctgggttcaagtgattctcccacctcagcctccccagtagctgggactataggcctgcgccaccatgcccggctaatttttgtattttttagtaaagagacgaggtttcaccatgttggccaggctggccttaaactcttgacctcaggtgatcctgaggccctcctcaaagtgctcccaaagggctgggattacaggtgtgagccaccgcgcccagccagaaaaactcataacattttaagcacgtttatgaatttgtgttgggtctcattcaaaacccatcctgggccacatgtggcctgcagaccacaggttggacaagcttggtttaaatcaaaagaagcatgcagtaattacagtgacaaacactcttgtttagaaaatcaccaggtagggttacatctgtggttggttgtacatcttgcttgaaactatgaaaggactgtttaattgctactctgaagaggacaagttataatctaatttgtttaggaaggtaattgttaaaagcagcaactattttaaagagggattttacaagtccatgcaaactccacacctcccccaacaagaaaaacttggcctttttaagtacaaaggggagatattatgcagacaaaaatattctgactttgtcaataagggcaaatatgacatttaccattcattaatgtttacgattcggtagacacaattccaggcattttacactcatgatttcatttaatcctctcaacctcacaataggtatgattatccctattcaacatataaggaaactgtgcttttggaggttaatttctaataatttgccaaaaatcccacaacttgtaatgcacaaaagcagaatttcaacccatgtctctctgatttaaaagcccaagctcctaaccttgaataaatcagtagtgttaggtaaaactgcaaccttctgatattgtaaatatggatggctttcaagttgtccacatagtgctattttggaactgttttatttttcattactgacacagggtaaacactaataaatacttgttcaatgaataaaagaactgtactctgaccctccattccctttatttttttagacagggtcgtctctgtcacccaggctggagttcagtggtgcaatcgcagctcactggagcctttaactactgggctcaagcaaacctcccatttcagcctcccaagtaggtgagactacaggcacatgcagccatgcccagctaaaaactttttgtagagatgagatctccctatgttgcccaggctagtcctcaactcctggctttaagctatcctcccactttagcctcccaaaatgctgagattacaggtatgaaccacacctggccagacccctatttttaaaaatttacaaaatcaataaattaggtgttaagcaagtccgattgaaatacaaaggggaaagaataaaggcattaagcaactttgcagatttctaatcacgcacttgtgccatttttattgagcatctactatgtgccaaaaggaaggtgtcacatatttggtaatataaggagcaaaaaaattcagtcctcacgctgggcatcaggaaaacagataaattataactcaacatgttaaatgctgtcagggagagatccacaaagttctgttagaacacagatcaccaacattcaactcaacaactcaacctgtgtgggagtcagaatggttcaccaagtacttaagtacctgacatatgagcagggttgtacaggagaattgttttctgggtgaaggaggaaatagagaagaaagggctttccatgtagaggcttgaagttgtgtaagtgcctgacaaaatcccacacgacagaagctgtgcgtacaagcaagcatatatatgtgcacatgtacagcaactggtatggcaactagaaaaggtacattgaaggtcgggtgcggtggctcacgcctgtaatcccagcactctgggaggccaaggcaggaggatcacctgcggtctcaggagttcgagatcagcctggccaacatggcgaaaccccatctctactaaaaatacaaaaattagccaggtgtggtggcacacgcctgtaatcccagctacttgggaggctgaggcaggagaattgcttgaacccgggaggcgaaggttgcagcgagccgagatcgcgccactgcatccagcctacgcaacagagtgagactcagtccaaaactaagaggtttggattttattctgtaacagggtcaagaaatttttacgcaggtttgtttttagaaagtaactgacaatacaatagaaaatggactggggtagggagaaatgggtgacaggacatgaaagaggaatagtccctgggaaagattatagggatctaaagaataaggagtaataaagcaaaggacaattctggcataggataaacaagatatcatgaccaactggaagtaggagatgaaaaaagacataaaacaaggacacgaagatttacagtttaggaaactgagagtgaagctattaagaatgagaaaacagcacatttggcaggagaacaaaatgaacaccaccttaaacctggaagacatccaggttgagggatgcatattctctggcttagggtctaaggaacagccaaccgttttcccctatctaggatacaaggagcgaccagtcatttcccatagttatccagcccttctgtgcttctgactgccctcaaggtcccatgctttcccccacacataaagaagccctttcatttctatccccaaagctgtctcactgatgcacctttatggcatggggaacgtaaagcggtaaaatggatttcggtagctccccagtctattcttccttccatctaaatagaccccacagaaattcaaaacataagcattatctttctatcaaacaatctttcccgatttctaccaaataaatatgaaggatctgttaaattagcaattaaaaaaaaaaactaagccagaatactaatttattaaatttatttataagaaatacaattgtcaaagcagcagctctcacccaaaagaacagcccattatctccctggagcagacttagattgaaacttaaaaactgttttgatccaaacattgcttactaaaatgccaagaaatcaaaatagtaattaatggatagtaactaatgtagccattgattaccatgtaactctgggtcactattcattagtaaaacgagattgaggacttcaaaaatgagtgaagattgctaagggtaccttaagaatagggttgtcttccctattctactgtcgaaatatgggcgaaatgggcgattatacacaaaaatacattctcagctggaacgctataatgtatcatcacaataaggaaaagtaaaaaataattaaatagaaaaacatggccgtgtttcataacatactcaagacagaaaagagcaaaactcaccaagtgtttaaattatgagttatttcaactgttacaaaaatagaaaacagatatacaattctttaaactgggtcagaatacaggaagatgttaagaatgagatcagcccccaaactgagggcaaagtggtgggcgtggatcaaccaaacgaaaataaactcgacttaacgtaggagcagtttcactctactgtactttgagatatccagaatatttaaagagaggagaaccaggactcttcccctggcccccagtggtctttcatcatagaaaatctgttgagaagaggcaagaggaggtgtgtgaagaaaaaagggaggagcagcattcctttgcgacctgtccgcgtctcctgactgatggaagtagggaccaaacggacgttcccagggtcttagaaaagccctcccttccctcgctccagctgttaccttccacttcctccgtgccctccatcagcatatcctttgtaaagtttgatatctggccagtgagggaagccaggctgcccccgacttgacccagagactggcccaatccggagccgaggcccccaagccaggacgacatcgcggcgagtttagagaacgacccggtccgctcggaaaaaagaaaacgtttagcgccgccgggcgatccgaccaaatatccttgaacgcctgccttcgcgagacaggatacgataacacaaagctgggttctcaggcaaggccgactccaggttctgcctagaaacgcagaggcctggcctggaattttaccaggggcccgcctctagtgacacagtcacctacggagggccttctgctcattcccacgaattcccaccgtccagattgggccacttctttctcagctctaatgactttcctcagttccgtgggttactcctgccaactcgacgccggccgccatgacactcgctcggaaagcggcagcggatcatagaaaagcgccgcggtggcgtagacaggccccgcgaagccgccggacgtgtccttggcgcaagggaggctgggatcgcggaggaccgagcgcgggctggattaaccgcagccagtgcctagcgcaaggttaggtgcatgcaggcggccagcttcggccggggaaggaatggcctggataactggggcatcgcggcgctcctcggcctcctgcagctgcgtttcaaagcagagccgacccttggtgggtagtccggggaccctgcggaccctccttgtgttgttgaaacctagtgttttaattgggactacacccagcagtgccgggagacttggcggggacgttccactgcgcaggaagtggcttcaaataacttacacgcgtcactgtgtcgattagctgctccgtgacaggcactatggtaggagctgaggctacaaagatagaacggatgggttgcaaaaaaaaaaaaggaaaaaggaaaaaagaaaggatgggttgcaaattcaggtgtccaagcaggaaacacaccttccttctataggagaaatctcctctggtggctttatagctcacaattgaaaccctaccttctttaacatacgatgagcttttttcatgaagctgccctcacccaagtagttgaaaaacggacaaccgtttttcaaaatgactcgttagaagacagcagggcaacttaatagagaagtgccgtttagtgtcaacgctcctatggtattggcggcactagctatgcaagtgcccacacctccctcagtccttagttacccacactggctgtaacacacagagtcctaccttgcttgcttccttccctaaaggaagaaaggttgtcatgtgactttcaagcaattggtgcaggatacgtggacacacagcatctagccagggagacttccacattttttggtttcaaaaggatatgatagatctgcagttcttttaagcatagcaataagtatactggcatctttcactttgattatattcacaagaggggctatcacagattgcacagtttgtgaacagaacattgggaatgcctccagtatttgggatctgatggcaccaggcagtagtaattctccgtgaaagctgaattttttttttttaaattttattttttgagatggagcctcgctctgtggcccaggctggagtgcaatggcgggacctaggctcactgcaacctcgtctcccgggttaaagcgattctcctgcctcaggctcccaagtagctgggactacaggcgcccattcttcattttactaatgagaaaccagtgcccagaaatgttaagtaacccatccaaggtcatacagctagtaagtgacagacccaggcagtcaggcgttggagtctgcacatctaaccgctgggctgtgatgttcacatgaatgcagggacagcatttaataaacacttccagaatgagatgtgaattttattttaagcacattcagatatccagtgtgactccgggatgtaaaaaaaaaaaaaaaaaaaaaaaacagggccgggtgcaggggcttacgcctgtaatctcagcactttggaaggccgaggcaggtggatcacctgaggtcaggcgttcaagaccagcctggccaacatggtgaaaccccatctctactaaaaatacaaaaattagtgggatgtggtggcaggcacttgtcacgggcatccgtgtgaagagacctccaaacaggctttgtgtgagcaataaagctgtttatttcacctgggtgcaggtgggctgagtcccaaaagagagtcagcaaagggtgttaggggtggggcagttttataggatttgggtgggtagtggaaaactacagtcaaagggggttgttctctggcaggcaggggcgggggggtcacaaggtgcttggtgggggagcttctgagccaggagaaggaatttcacagggtaatgtcatcagttaaggcaggaatcagccattttcacttcttttgtgattcttcagttccttcaggccatctggatgtatacatgcaggccttggctcagaggccagacattcctgtcttcttatattaataagaaaaataaaacaaaatagtgttgaagtgttggagtggtgaaaattttggggggtagtatggagagataatgggcgatgttcctcagggctgcttcgagcggtattaggggtggtgtgggaacctagagtgggagagattaagctgaaggaagattttgtggtaaggagtgatactgtggggttgttagaaggagcatttgtcatatagaatgattggtgatggcctggatatggttttggatgaactgagaaaccaaacggaagacacaaggtccaaataagagaaggagaaaaacaggtattaaaggactaagaattgggaggacccaggacatccgattagagagtgcccaagggggttcagcataattacttgcttggttggcaagtttttggactctgtccttgagtttttttatattgtcatacaccaggccagattgatttaggtaaaaagaacactcttcatttaaaaatatacagagcccggccgggcgcagtggcccacgcctataaccccagcactttgggaggccgaggcaggcggatcatgaggtcaggagatcgagaccatcctggctaacatggtgaaaccctgtctgtactaaaaaaatacaaaaaattagccgggcgtggtggcaggcgcctatagtcccagctacttgggaggctgaggcaggagaatggcatgaacccaggaggtggagcttgcagtgagcagtgagccgagatgcgccactgcctgggtgacagagcaagactccgtctcaaaaaaaaaaaaaaaaaaaaaaaaaaaaaatatatatatatatatatatatatatatatacacacacacatacacacagcgccttcctttttcagcagtgagtaagtcaaggccttggcagttttggaggacaactgcagccagagagtcaacttgggcctgaagtactgataaagtttaagatatgtctgtgatgctagtggagaagtcattagagaggctatggaaggttgtgacagaggttgaaatgccttctattccagtaccgagagcaatagaggaggcagaaagtcctaaaccgacaagcaagggaattagtggaataacccttttttgtcatgtcggtgtcatgagaggaacaggaagctctttggtcccatttgcaaattgaattttgggattaaggaaaatgagtgtgcatgtgcctgtccagttagcaggtagacacatgtaggtagaggatccacagaggaagaagagagcttgtgccaggcaaaactggaaatgcaaagtaaaaagatgagaaggagtgctgaaaggggtgtcttgtacccagactcctagggatccagctagggcggcagccgtcagaggttgtaatggggactgatggggtaactgtgtagagggagaggttcaattttcatggtgtatgagaaaacgtcgagtgtctatgagcaacctttcactgttatttacggggctgggtataacaagaaggcctgggaggagggtctgacgagcaaggggaaggtagccaaggatggagtgaaatacagggtgtcttcctaagcaataattacttctaatgtttttaagtttgcctgtattgataaaaggcttatctgtaatacggagctggaaggctccagttgtttcagtgatgtgtgtagttgggctttggagatgaagagtgaatgaacatcaagaaggtgaaaggttacccaggggaattccagtgggtctttgctgagagatacataaaggagcagccacaggaaaagtagtttgtgttgtgagggatccaaatgtggggggagtagagttgatataaggagaaaggttttttaagtaagtgtggaggagggcggcagcttgctgatgtgaaatgtctggggaggccttgctggacctgtctagaaagtgaagaagttcttcaggagggtaaagatgagggctgttaaaggaaatttggaggtgtagggagacaggagatgttgcccagtctgtatataaggcgggggcagctgtgtaggtgcaggaagaaagggaaatgcaaagccagcaattattcgctaaggagggattagaaacggctaggagagagtaagattgatagtgtggtggagatagctggggagaggtagagggtggcataagaatgggaatgagaataagagtgagtataaaagtaaagaatagaacttcatcagagtgaaaatattggaggttgccctgccagcaaatatcatctatccactctaagagggagttaagagtggcggtttggggatagcaccaggagataccagctgtgatggcttagagaaacagtgtaaacaggcaatgtaaacaagattagggcatttatgagtagttgagaatagtgaatgggagtatgagtaaacagaagatagtagggatgacaagtttttggggttcagtccaagtagggggggtgactgtgtaaagccctgttgcaaaaagtagggtaaggatgaatagagctaatagaatgaagggatgtattaggctcataagggttattactgttcttcagaaatgagagtgactttaagggaagtagtggggagtacttgtgacttccaggaggaagaagagagattaggctggttgtccgatgggcacagctttattctggaacggtgaacccagtggggaggatcctgcaggcggacggcagttggggtactatagatgactaagtagggtccagtccatcgaggttgtagagtttgaggggtcaggttcttaataagaactgatcgtccagctagggtgtcttcatatagttgggaatctggagtagacaagagaagattagcagcctggtggatttcctgtctagcctgccagaggactggaagatagtcgcctagagggctggtgtctggaacgaggttggggctgagcaagaaagtgcgtccatataaaagttcaaatggactgtaccctgtagcttctcgaggacgggctctaattctgtgaagggcaagaggtaaaaatactgtccagtcctttttaagttggaggctgagcttggtgagatgtctttaaaagaccattagtccgttctacctttcctgaagattgaggacggtaaggggtatgaaggttccactgaataccaagagcctgagaaactgcttgggtgatttgactagtaaaggccagtccgttatcggactgtataaaggtgggaaggccaaaccgagaaattatttctgacagaagggaagaaatgactgtggtggccttctcagaccctgtgggaaaggcctctacccatccagtgaaagtgtcttcccagaccaagaggtattttagtttcctaactcagggcatgtgaatagagtcaatttgctagtcctgggtgggggcaaatccctgaacttgatgtatagggtagggagggggcctgaataatccctgaggggtagtagaatagcagatggaacactgagaagtgatttccttgaggatagatttccatgatggaaaggaaatgagaggttctaagaggtgggctagtggcttgtaacctacatggaagaggttatgaaatgacaacagaatagaatgggcctgtgaggctggaaggagatattttccttggtctaagaaccatttgccttgtgtgagaagagattgataggtggaagtttcagtcggtgaataggtgggagtgactgatgagaagaagaaaaactggccgtgagggacagaagttagaaagctagcagcttctttagctaccttatcagcataagcattgccctgagcgatgggatctgatgccttttgatggcccttgcagtgaatgactccagcttcctttggaagtaaagcggccttgagaagagtttttattaaggaggcaataatgatggaggacctttgcgtactgaggaaacctctttctgcccatataacagcattgtggtgcaggatatggaaggcatatttagagtcagtataaatattgacatgtagtccttttgcaagagcgagggctcgagttaaggcaatgagttcagcttgctgagaggtagtggaggggggcagagcggtagcttcaaggatagatgtggaagatactactatagcatagcccacctttgctggtgaatggcgattaggccaggtggaactgccatcaataaaccaagtgtgatcagggtgaggaataggaaagaaggaagtatggggaaatggagtgaatgccaggtggattagagagatacagtcatgggggtcaggtgtggtatcaggaataatgtgggggctagcctaaaacagtaaggtcaagttgtttggacagaaaggctacagggcatggtcctggctcttgtgtaagaattccaactgcacagccctgcatttcagctgtgtgtaatgaaaaaagggttgggatgagttagggagagctagtgtgggagcagcttttagggctgttttttaaggaatggaaaggggagtggggaaaggatttaggatttatgaggtcagctaggtttgcttttgtgagtttatataatggttttgttaggatggcaaaaccaggtatccaaaggcaaaggtatccaaccatgcccaggaaggaaaggagttgttgttttgtagaaggtgttggggtttgagagatcagtcagacatgatcagcagggagagcacatgtgtttttatgaagaattatactgaggtaggtaacggatggagaagaaatttgagctttggagggggacatccgatatcccttggagaataaatgttgaaaagtatcttgttgagaagattcaaaggaggggctacaaagtagaaggtcatcaatatattgaataaggtgagaagcgaagggatggaaagaaagtatatcatgagaaagagcttggctgaagtaatgagggctgtccctgaagccttgcggcagtacagcccaggtaagctgctgggactgatgggtgtcagggtcagtccaggtaaaagcaaaagaggctgggatgagtggtgtagggaatagtgaaaaaagcatctgtgagatcaagaacggaatagtgagttgtggaggaaggtattgaggacaaacaagtgtatgggttgggcaccacagggtggataggcaaaacaatttggttgataagatccagatcctgaggtaacctgtaagacttgtccggtttttgaacaggtaaaatgggagaattgtaagaagagtttataggttttagaagcccatgctgtagcaggcgagtgataacaggcttcagtcctcttaaagccagttgtgggatggaatagtggcattgagccaggtaagggtgattaggttttaatgggatagtaatgggtgtttgatcggttgccagggagggagtggaggtgtcccatacttgtgggttaaggttgggggatacgagaggaagaggcgaaggaggctttgggttgggaagaagggtggcaatgagatgtggctgtagtccaggaataatcagggaagcagataatttggttaaaatgtcttggcctaataagggaactgggcaggtggggataactaaaaaagagtacataaaagaatgttgtccaagttggtgccagagtgggggagttttaaggggtttagaatcctggccatcaatacccacaacagttataggggcaaaggaaacaggcccttgaaaagaaggtaatgtggagtgggtagctcccatatcgattaaacaggggatggacctaccctctactgtaagagttatccaaagctcagcatccgtaatggtccagggggcttccaaggcgatcaggcagcatcagtcttcagctgctaagctgagaagatctgggaaggagtcagtcagagagcctttggccagagttctaggggccctgggagtggctgccgggttggacagtccgatttccagtggggtcctgcacagatgggacatggcttaggaggaatcctgggctgggggcattccttggcccagtggccagatttccggcacttgaagcaagatcctggggtaggcagtcctggaggaatgcctggccgctgcagttcaggcatttggaaggtcttgtgtgctggagatgtggctggggtttgtctcacagtggaggcaaggaattgcaactcagaaatacgttactacttggctgcctctactctattattgtacaccttgaaggtgatgttaattaagtcctgttgtggggtttgagggccggaatctaatttttggagctttttctaatgtcgggagtgggttgggtaataaaatgcatgttgagaataagacggccttctggccattctgggtctagggcggtaaagtgtccaagggttgttgccaaacaggccatgaactgggttgagtttttatatttgatgaaaaagagcctaaacgctaactgatttgggagaggtcagataaagaaaaaggagcattacccttggctatgccttcagctccagccacctctttaagaagaaattgttgggcaggtaggggagggctagtcacagaaagaaactgtaagccagacacggtgtgaggagggggtgataaaaggattatagggtgggggaccggaggctgaggaagaattgggacctggctcagcctggtgaggagcagcctggggaagaggggagaggtcagatgagtccatagaaaaggaggattcaaaggactcggagcttggggtggagactgaaggaacagacaggagagaaagaagaaagatttgggatgagtcgcactgggagcagagactagggagggaccagtgtgtaaaagaatgcctggatctgaggcacctcagaccatttgcccatttttcaacaaaaattatctagatcctgtaggacagacaaatccaaagtgctattctctggccacttggaactactgttgagtttgtattggggccaagcggtattgcagaagaaaataaggcttttaggttttaggtcaggtgtgagttgaagaggttttaagttcttgagaacacaggctaagggagtagaagggggaatggaggacggaatgttgcccatagtgaaggaagtaagtttaaagagaaaggtagagacacggagaagggggtgggtgagcagccaaagcaggcgtccccgcaattgacttgccaccaagggaatgtgggtgaatgaccaagacaggcacccccacggtgatcagacaccaatggagtgtgggtgaataatcaggcagtcgtccctgcagtgattaaacaccaagagaagactgtcttcttgagtccgtgaccagcgccggaattttgggtccacggataaaatgtgtctcctttgtctctactagagaggaaaaagaactggaattggaaggacagggagattgaagggtagcgagagagggagattgaagggtagcaagagaggatggaaaagaccgcttacccgatttgaaattcatgagatgttccttgggctggttggtctgaggacccgaggtcgtaggtggatctcctcacggagtgagggcaaggacaggggacccgtctcctgaaggagtcctcctgtcccgggtcttcagcaccaaatgtcacacgcgtccatgtgaagagactaccaaacaggctttgtgtgagcaacaacgctgtttatttcacctgggtgaaaaagaatgagacatgtaagtatctgcgaaagagcaatccaggcagaaagaaacaaataccttgaggcagcagaatccttggcaggttagaaaattagaaggaaggtaaggatagctagtgcagaaaattagaaggcaggcaaggatggctagtgcagaaattaagtaattaacataaaagctatgtcctaaaagtttctcatgggggatttctttctgtgagatggactgtgactgaagaaacttaataaataatgtgataaataatgtgatgtgatgtcttggatgtgcttcaaaataatggaagttgactttgctctcgtgtgtgtgtgtgtgtgtgtgtgtgtggtgtctgtgtgtttgtatgtgtgtataatagaggtgggataggtgaaacaagaattgtcaggaactgataattgttgaaactgggtggtgggtacataaggttcattaaactagtcttttgcttttgcatatgtttgaaattttttataataaaaagttaaaagacatacaagtttgatagcatttgagctgaagacatctcttcctttttctgcaaaatatctcagtagctaatatgttgctcttcatcactcaataagcagcaaaaccaacccagcacaatctaacacaacacctcaaacagagcctgtgaacctcagtggctacaggtggtgggatcgaagctgcccagctgaaattccaaacctaggacagtggatagaacaggaaaaaagacaaaaaataactatcagctgcaagctggtttccattactcaagcagtgggatcatcaatattcctcaaaggaaaacagttcatctgttctttgtgtttttttgagacggagtctcactgtgtcacccaggctggagtgcagtcgttccatcttggctcactgcaacctccgcctcccaggttcaagcgattctcctgcctcagcctcctgagtagctggtattacaaacgtgcaccaccacacccggctaattttttggctggtctcaaactcctgacttgaagtgagccatcggccttggcctcccaaagtgctaagattacaggcatgaaccaccgcacccagccagttcatctgttctgagaaaaccatcaaaatgaatttatttatgcaactataaagcaaagactcagtttaaagtagactttaaaatttagtctgatacttttctgaatttctaagcattaggcttatggttgccattttcttattaattttagacattaccaacttattgaaaaataaaagatttagcactcttgtatttccctttatttcccttccttctgggctttcaatatgatgatatcataatttttggtaaagtaagtaatcagtgtttaccttctatgactatgtaagtcttattcattgcagctaagtcaaatgttgtaccaagattatattgccttgatttttctaccttttgttcttcctgaagttaacagattccattttttaaatttgtacaattttccattactacagaatctttctaaaacttaccaagagaattgtaaagtgcttctgttttcaacaaaacatcaagaattctatcgattggctaggctcagttcgctctacccaggactctgttttcctgctctactctactctgattattctctatgccttgttttcttccaagaagcttgtcagatcttctctttatttctgatgctctgaaattaataatggtgtgctttgatgtgggtttgcttttgtttcatacattaagctgggtaccctgagccctttcaaaaagggcttttacttctgcgatttattttaatttttttttttttttttagtgatgaatgtctcctctctagggaatctgctgtttcttttttcttttcttcttttcctttctttttttttttttttttttttttttttgagatgggatctctctctgtcgcctgggctggagtccaatggcatgatctcggctcactgcaaccttcgcctcccaggttcaagcggttctcctgccttagcctccttagtagctgggattacaggcatgcgccaccatgcccggctaatttttgtatttttagtagagacggggtttcacatgttggtcaggctggtctcgaactcctgacctcatgatgcacccgccttggcctcccaaagtgctgggattatgtgagccaccgcacccagcctctttcaaagagttttaaccacacctcctgatttcagtctacatctaacccccacctctcaggatacttgttgctttcctttcctgcatattgctaggaactctttaacactcagtattcagcctcctggttctgctcattcctgcatcaacttgtcatcctccaaaaaacaaaaaaaatgttcgcatctctcgccgggtgcggtggttcacgcctgtaatcccagcactttgggaggctgaggcgggcggatcacctgaggttgggagtttgagaccaccctgaccaacatggagaaaccccgtctctactaaaaatacaaaattagctgggtgtggtggcctgtaatctcagctgctcgggaggctgaggcaggagaatcacttgaacccaggaggcggaggttgcggtgagctggatatagcgccattgcactccagcctgggcaacaagagcgaaactccatctcaaagaaaaaaaaaaaaattagcatttctcttctgttgttgtctcacctggaaatgactgctaattgttccccaaagtctgttctccccttcatatatagtaattgagcctccactttttacctggatgcatgacagccaagatgccagtgcccatattgcactccctcatccctttaccacttttgtgcacaccagccagcagtcagcagactgcctccaggttactggagcccatactttccaggtgcccagagagctgaaatgcaaccttattcagccagagttgaaaattatgcagcttgcctgttctgttttggacaactctaagatgtgaatatcctgcctccagactgtctgcaggactgaggctttgcttgataggctcctcttgcttggcttccttcttttcctatttccactttcttactcccctatgccctttccatttcctcctggaacacttttaaaaaatcattttcagccaggcacagtggctcacgcctgtaatcccagcactttgggaggccgaggcaggcagatcacctgaggtcaggagttcgagatcagcctggccaacatagtgaaaccccgtctctactaaaaatacaaaaaagctgggcatggtggcgcatgcctgtagtcccagctactcgggagactgaagcaggagaattgcttgaacctgggaggcagaggttgcagtgagccgagatcacgccactgatctccagcctgggtgacagagtgagactccatctcaaaataaattaattaaataagtaaataatcattttcataggaatcattatctcaggacctgtagggtacttaagctaagatgcatggcaacccagaataaaaaccaccttgtagctagtagttgtcatgttaagttctggccaatgtaatgtaaacggaagtagtatgcacaactttgagaaggtaacccgaaagaaaaggtacatagcctttttctgctctccttttttttttctttctttcttttttttttttttaattatttgagatggggtctcactctgttgcccaggctggagtgcagtggtgcgatcatagctcactgcagcctcaaacctccaggctcaaggtatcctctcacctcagcctcccgaatagctgggaccacaggtgcatgccaccatacccaactaatttatttttatttcttgtagagatgaggtctccctgtgttgctcaagctggtctcaaactcatgggctcatgtgatcctcccgccttggcctcccgaaatgctgggatgacaggtgtaagccaccaaacccagcctcctttctctttctgattgctgggctgcaacatgagcaccaacacagccatattagatctatgagctgaccctagccatggaagccatgtacataaagccattatgtcagaggcctgtaaaccagagcaactccattttggtttttttttcccccgagacggagtcttgctctgtcatccaggctggagtgcatggcgcgatatctgcttactgcaacctccgcctcccagatccaagtgattctcctgcatcagcctcccaagtagctggcataataggcgcacaccaaccacgcctggctaatttttgtatttttagtagagatggggttttgccatgttggccaggctggtcttgaactcttgaccttgtgatccacccgcctcaacctcccaaagtgctgggattacaggcatgaaccaccgtgcccggctgcaactccatcttgaataggagctgggtaaaatgaggctgaaacctactgggctgcattcccagatggttaaggcattctaagtcacaggatgagatacaaggtcaacacaaaatacaggtcataaagtccttgccgataaaacaggttgcagtaaaggagctggccaaaacccaccaaaaccacaaaggccacaagagtgacctctggtcctccttggtgctacgcccccaccagcaccatgacagtttgcaaatgccatggcaacatcaggaagttaccctatatggtctaaaaaggggaggcatgaataatccaccccttgtttagcatatcatcaagaaataaccataaaaatgggcaaccagcagccctcagggctgctctgtctatggagtagcgatttttttattcctttactttcttagtaaacttgctttcactttgcactgtggacttgccctgaattcaagaaccctctcttggggtctggatccggacccctttcctgtaacaattatacagaaagagcagattcctgacactgtgatgctgtatcatccccggactggcagtctccacatttcttgaagatgagaggagaaaaaaaacccatagcatgtaaagtcactgttatattagtttgtttttgtttttgtttttgtttgagatggagtcttgttctgtcacctaatctggagtgcagtggcgtgatctcggctcactgcaacctccgcctcccgggttcaagcaattctcctgtctcagccacttcagtagctgggattacaggcgtacgccaccacacccggctaatttttgtatttttagtagagatgaggtttcaccatgttggtcaggctggtctcaaactcgtgacctcgtgatccgcctgcctcagcctcccaaagtgctgggattacaaggtgtgagccaccgtgccggggaggattttttgttttttttacaaccaaacgtaatccaatgaatgcatctcctctcctggtccctgtgttcttgtgggtttatatatttttctttactttaacctaggtgagattttggaagggagcaaatatagtgatcaatcctctatattttttattgtgataagatatatataacacaaaattttgtaaccattttcagttgttaaatggttatacggttcaccggcattaagtacattcacgttgttgtgcagccattacaactgtccatctccagaacttttttcatcttcccaaactgaaactccatactcgttaaacaactcctaattttcccctcaaccatcccccggcaaccaccattctactttctgtctctatgagtttgactattccaaagatcttatgtaaatggaattatacactattaatcctctgcatttgactagaagctcctggaagatgtgtgagacggtggctcaaagcagttaaatctggccaggttaggtggctcatgcctgtcatcccagaactttgggaggccgaggcgggtggatcacctgagctcagaagttctagaccagcctgggcaacatggcaaaactgcgtctctactaaaaatacaaaacttagctggatgtggtggcctgcgcctataatcccagctattcgggtggctgaggcaggagaattgcttgagcccaggaggcagaggttgccgtgagccaagatcgtgccactgcactccagcttaggtgacagaacgaggccctgtctcaaaaaaaaaggcagttaaatcttctctgggtctggcaaaaggggtttcagtgttggagacagagatgcccctgtgcagaattcaaacacagcttttggaaaaaatggatctggagaaggcacggaagcaatggaggtggcatagaatctgctccctcctggcctcctacgctagtttgagccactttagaggggtgaagaacgagccttagcaggactctgggcacaagagctccttggggcccatgtagtgacatgtggctcagggctgagacaagggccattcctctctgctcagcttggattatagtacctgtctggtattcaagaatttgacattttcgggcttggtattttccatcttatttttttaaccaggttactgccggtatgtaaaaaagctactggttttctttgatggataaatgaataagcaaaatgtgcatatatcatacaatggaatattattcagtttttaaaaagaagaaaatttggacgtatgctacaacatggatgaaccttgacatgctaagtgaaatacactagtcacaaaaaaaccctacaaatactgaatgattccacttataggagatacttagaatcatagagacaaagtagaatggtagttgtcaggggctggggaagggaggaaggatagggagccatactgactgactgagctcctctctaccctaatacaagagactctcataggcaggaatatcatcacccctattcagcctgaagaatacagaagatggatcttcatccctctgcaacccttaggattaagggttttcttataaaagggagtagggaaatatcagaggcatttgaaccagagcaactccatcttgaatagggggttggtaaaatgaggccaagacctactaggctgcattcccagatggttaaggcattctaagtcacaggatgagatagaaggtctgcacaagatacagatcataaaaaccttgctgataaaacaggttgcagtaaagaagccggctgaaaaagccaaaatggtgatgaaagtgacctctggtcctcctcactgctacactcccattggcaccatgacagttgacaaatgccatggcaatgccgggaagttaccctaaatggtctaaaaagggcaggcatgaataatccaccccttgtttagcatatcatcaagaaataaccagccaggcgaggtggctcatcccagcactttgggaggccaaggcgggtggatcacgaagtcaagagattgagaccttcctggccaacatggtgaaaccgcatctctactaaaaatacaaaaattagctgggcgtggtggtgcacgcctgtagtcccagctactcaggaggctgaggcaggagaattgcttgaacgcgggaggcagaggttgcagtgagctatcatgccactgcactccagcctgatgacacagcgaagctctgtcttaaacaacaacaacaaagcggggggagggggcgcgggggtggacatggcaaccagcagccctcagggctgctctacctatggggtagccattcttttattcctctactttcttaatgaactagctttcaatttatggacttgccctgaattcattcttgcacaagatccaagaaccctctcttggggtctggatcgggccccggtcctgtaatgttattatgtttcaaaatttgtgcccaatcctaattaaagttaaaatgaatagtcaaccctcataaaatttgaggacaatatattcctcaatcagtctaggtggattccaatcactacatttggattctggtgtccagagttggataaaatgaggaaaagcagcacttaaaaatttgatgtgctttgtttggccctcagtattaaaaatcagttgagcaaacatttatttgacttttttaaggcagcattgtctctatttttttttaatagagatggggtctctttatgttgcccaggctggtctcaaactcctggggtcaagtgatccttccacctcggcctctcaaagtgctaggattaaaggcatgagccactggcactgggccagttgaacaaacatttaaaaaatatatttcaaataaaaatttggaattcttagcttctcttggaaaagactgaggatccagtaataatggaccttttggcaggcagtaagctggaatagaatatcaatggactgtgctggcctgcgttattcatattcatcactgcagctggttaagaacaatccacacaacagcgcttctcaagcttcactctatactttagtgtcctggggatcttgtaaaaagtgcaagttctgattcagtaggtccgagtgtagcctgaaactctgcatttctgaaagactcacaggtgatacagatgctgctggtcctccatccatacttttttcctgttttgtcgcccaggctagaattcagtggcaggatcatagctcactgcagcctcgaactcctaggctcaagcaatcctcctgcttctgcctcctgggtagctggaactgtagatgcaagccaccaagcccagctctaatcacactttgaatagctatgaattaacaataaacacaaattcaaaaggaaatagaaaagcaaacattatctttatttaataatctttgatatttaaaatacaactcattgaacatccacactaacaacagaatcctgtgttcaacagtgctttggaagcccggcttttctaacgaccagacaggaaggcctgtgtgtgtaataacagcaaatgaacttaacgagggagcacacacagaagggctgcagggctgggtcctgagcaagcggcactgccacagtgcacttgtatcatggccaaacaacaatgctttttgtttcagatattttctgtacttgaatttcaaatatttatacagaacagtaatttttaaaaagttattcctaatagcccagtgttgtaaaaattagataatcacatttaaaaatgtatgttttcctctttcaaaaaaaaaaaaagcattaaaaaaattcagaaaacattccttgaactatgcaagagacaattgagagcttcctaaatgcatcaggaatatccatttatattttactaatgtttctcattgctttgtctatgaatccacaggcttaaaatgttttttgatatgctattaaacatgccaattacgacaaatttagaagttacgttattagcactaattcttaaaatgccagaccacttggaaaaaataataatagcaaagattttcttcaaattaaaaaacaaaatcaaaattctagaatttaccaacgatgtcaataatcttcactcatgaaagcaaattagaacaaaaatatttttattatgtttaagactaaaaaaatacaaagccaggtcattttttaaagcaaaaagatgctggttataaaggggccagaaataaaagaaagtttttattttgaatatgaaaaataaagttatttacattgctgacatgattagttgatccaatctggtagttcttaattagggtcacatatatatccatacttaaggactcgatacaacaaacaattcactttgaaaacagtggcccaaggccgggtgtggtggcctgcacctgtaatcccagcactttgggaggccaaggcaggcagatcacctgaggtcaggagtttgagaccagcctaacatggtaaaagcccgtctctactaaaaaaaacaaatattcgccaggtgtagtggcaggtgcctgtaatcccaggtacttgggaggctgaggcaggagaatcgcttgaacccaggaggtggaggttgcagtgagccaacatcgtgtcattgtactccagcctgggcagcagagctagactccgtctcagaaaaaaaaaaaaagaaagaaagaaagaaagaaaaagaaaatagcggcccaacgcctcttcgtttccggattaaaaaaaaacaaacaaacctttaagatggagttttactcttgttgcccaggctagagtgcaatggcacgatctcagctcactgcaacctccacctcctgggtttaaacgattctcctgcctcagcctcccaagtaactgggattacaggtgcccgccaccatacctggcttaagttttgtatttttagtagagatggggtttcaccatgttggccaggctggtctcaaactccggacttcaggtgatccacctgcctcagcctcccaaagtgttgggattacaggcgtgagccactgcccccgactgggataaagtttttaataggaagtcatatatatatacatatatatatacacacatatatatatatatatatatatttttttttttcagaaacagtgtctcactctgttgggcaggctggaatgcagtggtgagcccttggcactctgcaacctctgcctcctaggctcatgcgattcttagcctcctgagtagctgggattacaagtgtgtgcaaccacgcccggctaatttttgtatttttagtagaaacgaggtttcaccatgttgcccagactggtcttgaactcctggcctgaagtgattcgcccacctcagcctccagaactgctgggattacaggcgtgagccactgcacccagccgggagatcatcaatattaactattgaatcctcgtaagaatttaaaacatcaagatttatttttctacttaagattttaaaattatcatattttgattatgcactgaatctattttttatctgtacaggtccaatgggccggttttaagaatttagtagctcttggcactagcatgattttttttttttttttgagacagagtctcactctgtcgcccagtctggagtacagtggcaccatcttggctcactgcatcctctgtcgccagggttcaagcaattctcctgcctcagactcccaggtagctgggattacaggcacctgccaccgcgcccagctaatttttgtagtttttagtacagatggggtttcaccattttggccaagctggtctcgaactcccgacctcgtgatccacccacttcggcctcccaaaatgctgggattacaggcgtgagctaccacgcccagccgccactagcatgattttaaaaatagtatcaaaaattcagacaatcaaaatgtgatttaggctctgactgaaataaaatttattttattcaacttaatattaaacaatatggactactggtagttttgtctgcaatgatactcaactggttttgagtttttttcctcatttactttggcatcatgaataaagttaagaaaaatcaagttttaaggacaaaaaaaaaaagcaccaccttaaataaaatattctgtgaattgtaaattatttggccaagatcctagtatagagtttacctgcagcagccttttcaaacagtttatattactgaaatatttacatgattaccgtaaaaaacatagattgatggttttagatcagagattaactattctgaattttaaaaacataaattactcattaaatccatgacatctgaaaatatgaaagtggtatttccaaggcttaaacttctactagcatcaccactgtacatacttgatcccagtaatacaaattatacattagaaaaatgataccaatagtttaaatattaaacattaagatgttcccaattagtaaaacaaaatggaaatctttaatacacttcttagcaggacagttcttgtgaatttagttgttcctgactttcttgcaggtggtttacagtaaatggcagtacctgatgtataaactatagctttgaataatttttaacttttttgatactatggttacttgcactggcatcttttcatactggccaatcaattaagaaatggaatctaaacagtcaattaaatttaagccaaccccaccaagatgacagttcactagtgcttctggatctgcctgctaaatgtaacaatttcacaacaaactacacaaacacattcaaacgcatccagtgtgtgctcagctctgctttaaaaactctctagctggccaggcgcagtggctcatgcctgtaatcccaacactttgggaggccaaggcaggcggatcacctgaggtcaggagttcgagaccagcctggccaaacatgatgaaaccgcgtctctaccaaaaatacaaaaatctgccgggtgtggtggtgggcgcctgtaatcccagctactctggaggctgaggcaggagaattgcttgaacccgggaggtggaagttgtagtgagccgagatcatgccactgccctccagcctgggagacatagcaagactccgtctcaaaaaaaaacaaaaacaaaaacaaaaactctctaggaactaaaagtcaaacatgccatattttcttaagtgctttaactagggtatatatgaactttataaactctaaagttaaaactttaaaatgcatattggttttctcatttttatattaggtagctcatcaattcaagtgtatgaaaagtttaatgtaacttttcaatggaaaaaggtaatgaacaaatatccatggaaaatatgacaaacacactggtaataattaacataaatgttcagtcttaaaatatttagctttttaaatcttgagggagtagtactaaactccaacatcccttgcagttttaaagttttataattcttctgaaacatttttaactattaaaagaaactttagattttaaaataaagctatccttttgtgtaagggaaacttcagaaaactgattggcacaaaataatgacttaaaaaatctgttatatcgaagaaaaagctattttataatcataaataaaagatattttttcttctcttttcagttagttagcaataaatcctagatcaaaaaactttccctgataaaatgtgtgcagccacacaccaggagggcaatataccatattataattttcgaagttgtcagctgaaatttcttggattttagcttatgaacaattcaacattcaaaagagcttcaaaaggagatggagaatgagggatagggaacactgaaactaaaacatcaatttcagagacatggttttcaccaaaatgatactatcctattgacccagcaagaaactctctgtacatctcaattaaagagaatatttatcaaaactatggactttcttatttatagatccactaagtactgtgacttccattgttcttaagctatctaaacatgatgcaagtgtcaaatcacagtataaatttaaacatattttcattagtaaattattttcatgttccagatcaccatctttgacaagctatacctactaaaagatgtgaagcagacacctacattccatgactcaactgtaaagagaacacaaagctccagtcataggagaaaaaataaaataaaactgctattaaaattgaaggccaaatttcatgtatcatacattcatggtgggtacgtatgtttagtcttctaacagaaggagacttgcctgcatactatgcttctcctagttttctcaattggagaagaaaggaaaaaataaggcgcaggaagaaggggttgcaacaaagctgtaaggttttgatataagtgaaaagacattcataaagcatctgggaaagcacatgctcacacattttaaaaaatgctcatttattctcaagtacttgtgcaaggctgatttcagagtttaggaacgcaccagtcatgaaataatgatcccatcgtagggcttaaaacgctaaacctcagaaaagattaccatctttcaaaagaattgtgggaaaataatgaaaaccaggtagcagaaaagttgtgatcagagaaaacaacacaagaaaacactggagcacacggtatacagttgaagggagaactgttcatccttctagaaccattactattatcaacatcaggaaagtagagatactttcctgaaaggttaatttggttaataagaaatgaaagccactattacatgatgtgagccaacttacctacaagacagaaaaagaaaacaaactatatggaaaaagcctgaggcgagagctaattagctagtctgcaaaaagatccaagaaaaatgccctaactttagacatgttacatattgcacactcaaaaaagaaaaagaaacatttagaaaactattttaaatgtctttaattgctgaatgcctctttggctaatatttggaagatcattatttagtcctacaaccgacgcattgttccactttcccatcattttgtttgcaaaccgctaaaagtcttatttcctcatctctttgacacattaccaaagtggaccctatgctgtaatcacacaggataatgttggaaagtatgaatatctaaattattttttaaaggtattatttttttccttctgttttcaaatcatttctgacagtttctaaagacatggtcacagctgcctgaagcatgtcttcttcactcatagcatcacctgttgggaaacaaaaccacatttctttaaaatttccagaaaattctcaaagtcatcaaaaggcaagttctcagaaaatgtatttctatttgagcacgagtttctttttttgatttaatacatataaagcaaaatttacttttatagttctatatattttgacaaatacaccatcaagatacacaaccattccattgccccagaaaattcccccatgctgcccctttgtggtcgatccccatttcctaatcccagatagccaccagtatattctctgtcctacagttttatcttttcctgcacgtcatataaaaggcatcagtaggtatgtagccttttgaatatggcttctttcacgtagcataatgcatttgagatttgttgtgtatatcaacaattcatgtatttacaaaaacccaactttctattttgaaaaactgtcaattcaaaggaagttgtaaagatatttaagagaggtttcgtgtactcttttgcccaatttcacccaatagttacatcttatgtaactaaagatcaaactaaaacctagatattgacattggcacaacgttatatgtagttctacatggcattttatcacacgtgtattcatgtaaccaccaccactacaatcaagacatagaagtgttataataccacaaagatctccctgctatcgatttatattcccacccacctatcttttacccactttctctaactagtggaaaccactaatatgttctctatctctatacagctgtcatttttagttgaacaagtggaatcatacagtgtaagaccctttgaggcttttttgcactcagcataatgcccctgagatccagccacggtgctgcctgtgccaacagtgggtttctttttaatcctgacagtagagtattacatgctatggatgtactacagtttgtttcactgtaggacattttggttgtttccagtttttgattatgacaagtaaagctgctataaacattcatgtacatgtttttgtgagaatataaatttctatttttggctgggcacagtggctcaagcctgtaatactagcacttagggaggccgaggcaggcagattgcttgagcccaggagttcaagaccagcctgggcaattgcgtcagtggaacaatgtgtcagttgtaggactaaataatgatcttccaggctgggcacagtggctcacgcctgtaatcccagcattttgggaagccgaggtgggcggatcacgaggttaggagatggagaccatcctgactaacatagtgaaaccccatctctactaaaaacacaaaaaattagccgggcatggtggcacacgcctgtagtcccagctactcgggaggctgaggcaggagaatggcgtgaacccgggaggcagaggttgcagtaagccgagatggcgccactgcactccagcctcagtgacagagcaagactctgcctaaaaaagaaaaataataataatgatcttccaaatattagccaaagaggcattcagcaattaaagacttttaaaatagttttctaaatgtttgtttttcttttttgactgtgcagcattgcccaggctggtcttgaactcctgggctcaagcaatctgcttgcctcagcctccctaagtgctagtattacagcacttacggagtgtaatactaaaaaaaaaataaataaatttctgtttctctgggataaatgcccaggagtatagatgctatgtcatatggtcagggtatgttcagtttttaaacaaatagtgaaattattttccaaagtgcctgcatcagtacaaaagaaatatagaaaggttacctccctttatatcctttgaccctccttcatctgtaacataatgccttaaatatttccaatatatatactgaaaaccaaatcagtgctataattcttgcttcaaccatcatacaatttagaaaattcaaaaggaggggaaagtctattgtgtttacccatattttactctttttattgttctttcttccttcctgatgttccaaaattacttcttttatcatttcttttctgtttagagaaattcctttagccattcttttagggtaggtctcctgaagacaaatcgttaattttcccttcactcctgaaggatatttcactggatatgtaactctgggtttagagtttttttcttgttttttttttttttttttttttttgagacaaggtctcgctctgtcacccaggctggagtacagtggcatgagcttggctcactgcaacctccacctcctgggttcaaccaattctcttgcctcagcctcccaagtagctgggactataggcgcccaccaccaagcctggataatttttttttttttgagatggagtctcgctcaactgcccaggctggagtgcagtggcgcgaccttggctcactgcaaccgtcgcctcccaggttcaagcgattcccctgcctcagcctcccaagtagctaggattataggtgcgtgccaccacacctggctaatttttgtatttttagtagagacagggtttccccatgttggccaggctggtctcgaactcctgacttcaggtgatctgcctgcctcagcctccaaaagtgctgggattacaggtgtgtgccaccgtgcccagcctagagtttttgtctttcagcactagaaaaaatgttgtatgtaccccttccttctggcctttatgatctctgatgggaaatctgctgtcattcaaattgcttaggtaaggtcatttcttgctaatttcgagatcttcattttttgtctgcagtgttcagaaatctgactgtgatgtgtctctgtgtgaacttctttgagtttatcatatttgagcttcattcagctttttcaatctgtaggtttctgacttttgccaaatttgggaaattttcagccatgacttcttcctcaatttttttcagccccaccctttctcatctccttctgggaatcctgacacaaatttagatggagtcttgctctgttgcccaggctgcagtacactagtgcgatcttggatcactgcaacctccgtctcccaggttccagtgattttcctgccttagccttcccagtagctgggattacaggcatgtgccaccacgcccagctaatttttgtatttttagtagagacagggtttcaccatgctggccaggctggtcttgaattcctgaccttaagtgtttggcccaccttggcctcccaaagtgctgggattacaggtgtgagccaccatgcccagcttagtgattttcaattaaatcctgaaaatttggggtattatgttatgagaatgtgaatcttatttacatcttccaatttagcaagcctccactgacacagcactggcaacagggaaaagggagtgccacctcgctacaaccagaggggagtgaaagtccaggtttcttcaaggcctgtgatgtcaaggagtggcggtcatggggattactgctgaacgcacatgggagttctagccccctagtcctccactgacatctctctgactgggagggagagcagtgccttgttactgatctccacatggcctccacggacattgtggaggtgtccttgttactgctgggtgtcagcaacagtctggattctctactcggcctcttctccaacatcacccatataggagccagagagatgcctatgtattactgggtggaagttcagcctccctgtgaccactgacaccatgtgaaaggagtgttatcacctcctggagggaatgagaatcccagctccccagtcagccttctctaacaccaccttggctgggaaaggggagaagtgtaccttatgacttccaggttggggtacatatcttggctcccacttggcctttgctgacaggggtgaatggggccagtttattctgttttgtttgactggagtcaagtgcttattatctaaaggtttttatcttgctaggttgcctcttttggctagagagagcaggcttttcatggggttttctcttggtctgaacccatagcttctccagcaccaagtccaggataaatgaggcaaaaagaaaatccagtccactccccaccacactgctcctctggttccaaggtccctagccagtctgtcttctctctgcctttgagattcagctgaatggttttttttttctttttgagacagagttttgctcttgttgcccaggctggagtgcaatggtgcaatctcagcttactgcaaccttcgcttcccgggatcaagcaattctcctgcctcagcctcccaagaagctgggattacaggcatgcgccaccatgcccgactaatcttgtatttttagttgagacagggtttctccatgttggtcagaccggtcttgaactcccaaccttaggtgatccacccgcctcagcctcccaaagtgctgggattacacgtgtgagccaccgcacccagcccagctcatgttttatacaaatgttgaggtgttttggctgtacttaaacaggaggaatagaaaaaagtaccagttcattcctttttttattcaattgtttggatataccacagtttgtgcattcattaactaaatgaaggtctacatttaggcagtttgtaattttgggcaatgatgaataaagatgctataatcttttttttttttgagaaggagttttggtcttgtcacccaggctggagttcaatggcacaatcttggctcactgcaatctccgcctcccgggttcaagtgattctcctgcctcagcctcctgggattacaggtgcccaccaccatgcccagcaaatttttgtatttttagtagagatggggtttcaccatgttggccaggctggtcttgaactcctgacctcaggtgatccatcagccttggcctcccaaagtgccgggataacaggcgtaagccaccgtgtccagcccttttttttttttttttttttgagacagagttttgctctgtcacccaggctggagtatagtggcacgatctcggctcactgcaacctctgcctcccgggttcacgtgattctcctgcctcagcctcctgaatagctggactacaggtgcctgccatcacgcctggctaatttttgtattttaagtagagacagggttttgccatgttggccaggctggtctcgaacacttgacttcaggtatctgccaacctcggcctcccaaagtgctgggattataggcatgggccaccatgcctggtcagctataagcatttgatataagtttttatgtgaacctaagttttcttttcttttggttatatatacatgattgggactgctggatcacatggctaagtatacatttatcaaaaaaatgccaaactgttttccaaagctgtacacttttacattcccattaacagtatatgagtctcagctgcttggatccttgccaacacttggtattgtcagttttatttcttcattaaagccatacctacaggggtgccatggtgtctcactgtggttttatcgtgcatttccctgtgactagtgatgctgagagtcttttcatgtgcttatttgtcatccctatgtcttatttggtgaaatatcttttcaaatccttcacctttttattgagttgttttctgattattcagttttaagagttctttatatattctgcttataatttctttgtcagatagttactttttctctcaacttctactactaattggccaaagtttaagacatatttaaaccgagacctggaaagtaactctgcacttcccattgttatttagattatactcaagtatttttcattttccaggtggtaaaatgtgtttatttttcacctactaatattcatgatttctggccggacgtgatggctcacgcctgtaatcccagcactttgggaggccgaggcgggcggatcatgaggtcaggagattgagaccatcctggctaacatggtgaaaccctgtctctactaaaaatacaaaaaattagccaggcgatgtggcgggcgcctgtagtcccagctactcaggaggctgaggcaggagaatgccatgaacccaggaagcagagcttgcagtgagccgagatcgcgacactgcactccagcctgggtgacagagcaagactccatctcaaaaaaagaaaaatatccatgatgtctaaggaatttttggagactgtacaaattactgtgaagtttaaattattatgttaaagtattcattaaatgttctagcaatcctctcctgccttggtttcccaaagtgctgggattacagatgtgagccaccacatctagcttttttttttttttttcttttggtaactgctccttaatccagggaaatttagtagattacaaatttacttaagattcttaatatgattaaagagggaatgaagaataatgtaaagcaaaaatcacatggagctcgtatgtcagataaagtgtgaaggtagcgaacatgatgaatggtgagcaggccttacctagatcactcccaagtgctcctgaactggtggctggcctttcacatggatgtgaactctgtcctgataggtccccctgctgctgctgctgctgctgctgttgctgcttttgctgctgtctgaaacattcaaaagtgaagtatatttaaaaaacaaaacttaaaagaataaatacaccatgagaaaaactattcataaggaaaatacattgtttcacgaatcaaagtagtcactggtattaaaagaatgcaagagcagttagtctgatacagattactttaaaatatggaagtgctgatcttaggaaatctagacataaaatttaaatttatcagacaaattaagaggtaggtattttcatcacaaaataacctatcatggccaggagtggtggctcacacctgtaatcccagcactttgggaggccgaggcgggtggatggcttgaggtcagaagtttgacacgagcctggacaacacggtgaaaccccatctctactaaaaatacaaaaattagccaggcgtggtggcaggcacctgtaatcccagctactttgggaggctgaggcaggagaatcacttgaaccggggaggtagaggttgcagtgagccaagatcgcgccactgcactccagcctgggcgacagagcgagactctgtctcaaaaaaacaacaaacaaaaaacctatcatacaaaaagattcactggtagttattcttatgcaaatgagtgttggtttatagacccttaatattgttgaaagtcaccaaaaataagtacctttgatcagataaagcatttcaaactaccatgtgagttaacataatgtttccatggctggctcattcttttcactcaggtctgagcttaaaatttatctccccagagatgcctttcctgaccatcccaccaaaagtagccacctgacattcccattatttcatcacttcattttaattctcagcataaacttatcatcatctggtgttctctttatttccctctttatggcatgtaagctaatgaaagtgcaaatcttatcttactcatctatttccccagtgctgataactgtgctgttacatagtaagcattcactgaacacctgataaatgaaataaatgaaaactactatttaacacacattatcagattttaagtaatactgattgcattaagctcctctgtaattttttcaaaaagagaaacaatgtaatacaaatccccattttaaaatgtttaaacatgacggttatcatgtaaatatgtaggaatatattcttgtacttagaaaatatacactgaacaactgagacataatggaaaatcatatctgcatattattcccaaatggttcagaaaggccaataattggggaatctgggtgaaggatataaggagctctgtgtactatttctgcttttatgtaaatctgaaattacaggtcaagcatcctaaatccgagaatcagaaatccaaatgctccaaaatcagaaactttttgagcaccaacatgatactcaaaagaggtgctcagtggaacacttcagatttgaaattttggatttggaatgcttaactggtaagtatagtgcaaatattcacaaatcctaaaaaaccccaaatctaaaacacttccagtcttaagcattttggataagggatactcaatctgtatttcatatatgtaaatacaaacacagaaaaccaaaaaccaaaacttacaaacagctgacaatctcagtgagaagctataggttaaaaaaaaaaaaaaaaaaaaaaaagattgcttctcggtcttttggctaagatcaagtgtttaaaaaaaaaaggtatataagaatttgaaaaggaacaaggatttttaaattaccagcaacaattattaatagaatggcacattttttatagagttcctctcaattttgtgttttaaaactgtgaacaataaagaaagttcaactaatgagaactgcaatttctccctgttggtctctgagccagaatactgacctgtgtgtaggtgtaagaccttagtgtgcatggctaatgatgcacgtaagggcagtatcctcccattagcaaatcctgatgctgcaacatagcacaagagggacggactgagttatggagaattcctggcacatctgctatcactccatgccctctgcccctccactcaagaaggtatgtgagaatgcaagggagtgacaggtgagatagcaattttagaggaatagcctttattctacttttagtttatgaaaaatgagaagtaaatcaattgtccaccttgaaacaatgtagacaccttccagctgtgaagacactgaggtggaacatgttcaagtggtactcagcatccactcccactgtgccatcaatattatagaggttacaaagctaaaagctacatgtcttagattattttacaagtaggattctggttacaaattaagtgctcacatgagctttaaaaagcagaaacgggtcaggcacagtggcttgcgcctgtaatcccagcactttgggaggccaaggcaggcggatcacctgaggtgaggagttcaagaccagcctggccaacatggcaaaactgtctctactaaaaatacaaaccttgtctgggcacggtggctcatgcctgtaatcccagcactttgggaggccgaggcgggcggatcacgaggtcaggagttcgagaccagcctggccaacatggtgaaaccccatctctattaaaaatacaaaaaaattagccaggtgtgttggcgcacacctgtaatcccagctactctggaggctgaggcaggagaattgcttgaacccgggaggcggaggttgtagtgagcccagatcatgccactacactccagcctgggtgacagagtgagactctgtctcaaaaaaaacaaaacaaaaacaaaaattagccaggtgtggtgctacacacctgtagtcccagctactcaggaggctgaagcagaagaattgcttgaaactgggaggcagaggttgcaatgcgccaagattgcaccactgcactccagtctgggcaacagagtgagactccacctcaaaaaaaaaaaaaaaaaaaaaagggagaaatgggccaggcatggtggctcatacctgtaatcacaacactttgggaggctgaggcgggcagatcacctgaggtcaggagttcaagaccagcctggccaacgtggcaaaaccccacctctactaaaaataagaaaattggctgggcacagtggcgggtgcctgtaatcccagctactcaggaggctgaggcaggagaattgtttgaagctgggaggcggaggctgcagtgagccgagatcacactactgcactccagcctgggcgacagacaagactccgtctcaaaaaataaaataaaataggcagaaatgaggcctagccatctccctccactttggttgttctctggtggcaagcaaagccatttgggagatgccagtcccaaaattctgcttcactgctgttgcaatgggggccagacttcatgttcccatctctaggcaattgtggtggcagctttctatgccaaggatcattgctatagcagtatgttcttaaatttaatatcctcattacccattgtcccaactggggcagtggttacagctcttcctgcaagttggtttgtggtactgtggaggcctggctaagagctgcaccttcatcctttcttaagattatgtaaacccctaatttctatattaagtattttcctctttaaaacatccccagtagtttctgtttctcaacactgtttgataaattataccatatcactgaagtggtggctcaagtattaggcaatcaaacactcatagcaatccatgtccatgaagatatttgtgtctctccttgttatagaacatttgcaacttatgttttttgtaacagaaagcatctgcatccatttcaaagccacacctagagaagacattaataactgccaacatgtatgtatggaatactttacagtttataaaatagtttcacacacattgcttaatttcatgcttctgtgagttaaggcaggttttacagtgacacagctgatgtagtagagttttgcttggggttttatgatggtaaaacagatttagagactactgctggaaaaaatgtcatggcttgaaaatattatttaatgactcataaattatgaatctgtaatagggagtttttttttttttttttttttttttgagatggagtcttgctcttgtcgcctaggctgtagtgcaatggcacaacctcggctcactgcaacctctgcctcccaggttcaagtgattctcctgcctcagcctgccaaatagctaggattacaggcgcccgccaccatactcggctaatttttttgtatttttagtagagaagaggtttcgccatgttggccaggctagtctcgaactcctgacctcagatgattcgcctgccttggcctccgaaagtgctgggattacaagcgtgagccatagcgcccagccaaaactagtttttttaatgcatgaaaactatgattactttatgcatttatgcaattactttatgattttctttatgcatgaatactatgattactatattcagtatgaagcttcaaatactcaaaaagggaaaagaaaaactagaaaatcgtatgaataacaaatcagcaccagggtcaatttgggaagggtgagagggaagaaagagttagcttgataaccttagacccaagctcccaaagacagaacctagagagacaacgaactacctaggctaagtaatcaggaattttagtgaaaggcaaatattagcttcttagctcctactaatgagctctacaaggttttgaatgcaagccattgttaaaaatgaacatcaagaagttagttcttaactcttctcagcaacatgtgactatgtaagatattctcaagctctttccaaattctcaccagtatttgcaaagtcaagccaagaggctgaagctggtaaccatcactgcacactttcctcctcaatcaatcctccaccaagtaggaaggaggtatatcgatattcgaacatttttaaaagggtacaaggttgcctgaccctgtttactaaaaagcactagttattgctgacattgtacttgttataacttacttagtcattattggacattactgaattatcgttactactataaaaagttcaggccgagtgcagtggctcatgcctgtaatcccagcatgttgggagacccaggctggcagattgcctgagatcaggagttcgagaccagtctggccaacatggtgaaaccccctctctactaaaaatacaaaaaaattagcccgacgtggtggcatgcgcctgtaatcccagctacttgggaggctgaggcaggggaattgcttgaaccagggaggtggaggttgcagtgagccgagatcgcgccactgcactccagactgggtgacaaaagcgagacctcgtctcaaaaaagaaaaaaaaaaaaaaaaaagctcaatttgttggaagtttcatatttttaatccagtttttaaaaaattttaagtaaaagagcagtttatttttatgctttaaatatacttttcttttcttagatatacctgtaaattttgtattatagtttctctatgatgtatgtctttagaccattttattttgacaaaaaagactctgatggctgggcgcggtggtgcacgcctgtaatcccagaactttgggaggccgaggtaggcagattgcctgagctcaggagttcgaaaccagcctgggcaacatggtgaaaccccatgtctacaaaagacacaaaaattagccaggcatggaggcacttgcctgtaaccgcagctacttgggaggctgaggcagaataatcgcttaaactcaggaggcggaggttgcagtgagccgagatcatgccactacactccagcctgggtgacagagtgagatttcgtctcaaaaaaaaaaaaaaaaaaaagtctgaaataaacatggtgaaagtatcacatgggaattattctggaaagcaatttagaaatctgttccaaggccttaaaaatgttcatatcctttaacccaataatctgacatcctcagaaaaactagaagaaatgataagacatttgaggtgtagaggcaatataagaattgttcattgcaatattaattataatagcagaattcaaaaggctcacatataaattatgccacatccattcattttatgaaatatcatgcagcctgttacaaagactatttactgtcataggaaatgagtacaacacttacaaggtaagtgtgtatatgtcacagaaaaagaatgtgccaaaatactaacatcagtcactgaaggaggtgagagtatgctttcttttttttttttgagacagagcctcgctctgtcgcccagactggagtgcagtggtgtgatctctgctcactgcaagctccacctcccgggttcatgccattctcctgcctcagcctccagagtagctgggactacaggtgcctgccaccacacccagctaatttttgtgtattttttagtagagacggggtttcactgtattagccaggatggtctccatctcctgacttcgtaatctgcctgcctcggcctcccaaagtgctgggattgcaggcatgaactaccgcgcccagccttttttttttctttttgagacagtatctcgctctgtcacccaggatagagtgcagtggcacaatctcggctcactgcaacctccacctctgggttcaaacgattctcctgcctcagcctccaaagtagctgtgattacaggtgtgcaccaccatgcccaactaatttttttgtatttttagtagagacaggctttcgccatgttggccaggttggtcttgaactcatggcctcaagtgatctgcctgcctcagcctcccaaagtgctgggattacagacatgagccactacgcctggccatgtatgctttaatttctatatttcttttctcttttttttttttttgaggcggagtttcactctgtcacccaggctggagtgcagtggggtgatctcagctcactgcaacctctacctcctgggttcaagcgattcttctgtctcagcctcctgagtagctgggattacaggtgcccatcatcatgcctggctaatttttgtatttttagtggagacagggtttcgccatgttggccaggctggtcttgtactcctgaccctcctgacctcaggtgatccgcccacctcagccttccaaagtgcagggattagaggcgtgagccaccgtgcccagccaattttgatatttcttaaaataaaatttttagaatgttagtttttctaattaagtagatttaagttattttttattatttatttatttatttatttgagatggagtttcactctttttgcccaggctagagtgcaatggcacgatctcggctcaccgcaacctcgcctcccgggttcaagtgattctcctgcctcagcctctcaagtagctgggattacaagcatgcgccaccacgcctggctaattttttgtatttttagtagagatggggtttctccatgttggtcaggctggtcttgaactcctgatctcaggtgatctgcccacctcagcctcccaaagtgctgggattacaggtgtgagccaccgcgcctggccttagatttattttttacattaactagataattgatgatatagaattacaattaattattatgattattattttatgacaatagcatttaactatgttaaaaataaagctaatatattttagagacacatattaaaatggttatagaataatatgatgattgagatttgttacaaaataatccaaacttgcaggtgggacagtggaaagaatgggagatgggagtattataaaacgagattgggccgggctcagtggctcatgcctgtaatcccagcactctgggaggccgaggcaggtggatcacttgaggtcaggagtttaaggccagcctggacgacatggtgaaatcccgtgtctactaaaaatacaagaattagccaggcatggtggtgtgtacctgtaatcccagctacttgggaggctgaagtgggagaatcgcttgaactcaggaggcagaggttgcagtgagcagaaattgtgccattgcactccagcctgggcaacagagcaagactccatctcaaaaaaaaaaaaaaaaaaaagcaagattggccgtgtgctagtatttgttgaatctgggtcataaacaggagtatgctagtttttctacttttgtataaatttggagtttattataataaaaaagttaattttgaaacttaaaagtaaaaagcactaataagcactactttgaaatttaacatataattagccattaatctatactgaataaagactagaaatatctcacattaagaggatgtcagctgatcagaattttccttcatctacttctgagttgtgacttaaaaacaaaacagaaaaaaaggtaaatattttcttcattataccatcaaatgtaaaatgagccaatatttataggtgctgctaatatactgtcaattatgactgtaagatgcttctcaatttcagagacattgaaatgtgaaactatgtgcatctcagaatggatgaaatacagcaaatagtaagtcagattgagctatgactctgttttctgacctaggatcagtgggtctgattatttatcttgtaatctttaacatgaagttttctttctctttttttttgagacgaagtctcgctcttgtcccccaggctggagtgcaatggcgttatctcagctcactgcaacttctgcctcccagattcaagcgattctcctgtctgagcctcccaagtagctgggattacaggcacccaccaccatgcccggctaatttttgtatttttagtagagatgaggtttcaccatgttggtcaggctggtcttgaattcctgacctcaggtgatccacctgccttggcctcctaaaatggtgggattacagacgtaagccaccgtgcccagccttttatttttctttaaaaaaaaaaagtgggggacaaaagtctgaatgatagttacttgaaaagaatgtattttcatatggtggaattcctatttagcaagcacttacaaggctgggcacaaggtaaggttttaggagttgatccagatttatggtttgcatccattcccctgatgctaacaggcttacaggactgcctgaagcggccatgagcagctaaatgaactaccacgtctatttgggaatgcgctcccatacctccaaagctgtttttcgtactgattggtagaggaattttgcagggttaatcaggtaagcaagaagtacatccaaaggatcaattggcattcttcttgtcttgtcctaatttcatttttcttttaataaatgaaattttataaggtttccttcactcagtttaaaaaatttatccagtattggggcaaggtttttttgtttcatgttatttgccgtaaatttttatttttatttatatatatatacatatatttttggagacggagtctcactctgtcacccagtctggagggcagtggtgcgatctcggctcactgcaacctccacgtcccgggttcaagcaattctcctggctcagcctcccaagcagctgggactacaggcgcacgcttccatgcccagctgattcttttgtatttttagtagagatggggtttcactgtgttgcccaggctggtctcgaactcctgacctcaggcaatctgcccgccttggcctcccaaactgctagcatcacaggcgtaagccaccgtgcccgtcctatttgctgtaaatttttaaaaaatacattcaaatattcacaggattcaggcagtaaccatttacaaatagacaaaatagccaaagcaaatattaaacatgctactttaacttgtaccaactactttacttttcaaagtaggcttctcgtctcttccgaagctcttctgaagtaagatttgtacctgatgtctgtgtcatatcttgagatatgtttctggaactacctgaaaacaaaacacaacacaacaaaaaccaatcactgtatttaccaattcaagcaacaatatgtttgtttatactcatttgagtaagcctttaaaacgttttctctttaagaatattctactcttctggctgggcgtggtggctcacacatgtaatcccagcactttgggaggccaaggcaggtggatcacctgaggtcaggagttcaagaccagcctggccaaaagggcaaaaccctatctctactaaaagtacaaaaaattagctgggcgtggtggtaggcgcctgtagtcccagctactcaggaggctgaggcaggagaatcgcttgaacctcggaggcaggggttgcagtgagccaagatcactgcactccaggctgggcgacagtgagactctgactcaaaaaaaaaaaaaaaaaaaaagaaagaaaaaaaaaaaagaaagaaatctaaagctgatttctgtccctgctaatccagcaggactctattaatcaaaaatgggattgcacaccatatggagtactcagaggcatgcatagaggcaagaaaagttcaggataaaaataatcttcccattaatgaaatttcaattttatttagatatctaaggaaatcaactgataaataatttcattagaaagtagaagcaaatacatatgagttagaaaaaaataaaacaaaaaacccacttcaaacttttaattaagctactttgagctatgtcttaacatttttctttgcctagattgtctaggggatatgttttcgcttttctctattgatagtttatatcactaaaaaactgggcccaccaaagtgggcttacggtttaagttgcatagccaataaatgttgggtttttgtaaaatcagtttatattccctgtccaggcccttccatagtgtctaatggcacatatttatgtaacagctgatttggataagggtcaactgatacccacaaagattaaaaccacaatttactattgtgttagtacagtgttgaaaccaaataaaataaccaggagtaaaaatataactactcctaataaaatataggttgtaaaaagtgatttccattataagaaatctaaagggaaagcccactatatagctattgcttctgcagtaattgtcaaaacacctctaagagtacattaacttccatgaaatctaagaataattggaatcaattcttcagcaatgaatacaacacacatcagaatgtctttaccttgcatacttagctgaatagccctgcggagatctgcttcctcatcttccatgtcaatttcttggcgacttagtgccagagccctctgcaaatcctcctcatcttcgtctaacattcctgagccatcatttgcttctaacactcgttccaggtctgttttatggactctaaagaacaaaagcactggtaataactgcaaccaatcttctattttagacataacataaaggcatttgtaatgtaaaggctttaagtaagtcaaaacttaaaatgttttctggcaaataagctctagtaatataatgattgtgttgcaatttgaatccaactaagttttttttttccgtttctttttttttttttttttgagacagggtctgactctctcgaccaggctggagtgcggtagtgtgattatggctcactgtagtctctacctccccagtttcaggtgatccttcttcctctgcctcccaagtagctgggactataggcatacaccaccacatctggctaatttttgtactatttgtagagatgaggttttgccatgttgcccaggctggtctcgaactcctgggttgaagcaatcagcctgcctcagcctcccgaagtgctaggaatataccataccagctaactaagttaatatatttaagtatttcaaagagttgattcaagtttaaactaataaacttcactaaaatataaggtccaaaatagagtcgccaacaacacaaggaccacatattcaatctaagcatgaaaatttaattctcataatgaaatactaccatatattccatactgcaggcctcatttttacctttgctcttttagttgtgctaattcttctccaataagttttggtcgatgcatctgttggaccctaatcatctgcaggagttggtcagcttcgcaatctggcagatcacccttaacgacaaatatagaataacctaaaaaaaaaaggcaaaaatcaacctaaccagttagtaaagagattcaaaattgatgtaaaacactagtagataaaaaggcagcacagaacactggaaaaaaatacaagctgaggattcagaaagactttagtccaaataatgattcttatacttactagtaaagtcgtctaaggtaagttacttaaagtctctgagcctcactttctccattgtaagactggaagagccgtctcattgagtgactgtgagaaataaatatgtctgtaaagggccctactaatatagtacttgactgagcaggctactcacttactgttgtcagagtgggtaacagcaactgatttagaatcagactgcctgcatctgatcccagttctcccacttcctagctgcatttgtcttggtttctactgttaaacatatgatactagtaccttcctgtgatggttaatattatcaacttgattggattgaaggctacaaattattgtttctgggtgtgtctgcgagggtgttgccaaaggagattaacatttaagccagtgaactgggagaggtagacccaccctcaaactgggtggtcaccatctaatcagctgccagctcagctagaataaagcaggcagaaataagagtgtggaagtactagacttgctgagccttcatctttctcccatgctggatgcttcctgccctcaaacatcagactccaagttcttcatcttttggactcttgaacttacaccagtggtttgccaggggctctcaggccttttgccacagactgaaggctgcactgtcagcttccctacttttgaggttttgggacttggactggcttcctggttcctcagcctgcagagagcctattgtgggacttcaccttgtgatcatacgagtcgatactccttaatacattacccttcatatatacatctaccttattagttctgtccctctagagaaccctaatacacttactcacagggctgctgtgaggacacagataatgtgtgcaataactagtaacatggctaaaactaatcatctgcggaaagagctacccccaccctgacccacacatgtacaccccttgtaactaaaaataggggctgggaagccaaatacctaaaagctatttaaggtgtcaaacgtgtggtttgcatcccaaaagaattacattagtctagtgtgactgtgtctaaatatgattccagaaatccagggtttccccaagctagatgctacacacaaaaaccaaggatgggctatacctaaaacaatctaactgatttaagtttctctatcattaatttttttttttttttaatttgagatggagtctcactctgtcacccaggctggagtgcagtggtgcaatattagctcactgcaacctctgcctcccaggaggttcaagcgattctcctgcctcagcctcctgagtagctgggattacaggcacccaccaccacacccagttaatgtttgtatttttaggagaggcagggtttcaccatgttggctgggctggtctcgaactcctgacctcaggtgatctgcccacctcggcctcccaaagtgctgggattacaggtgtgagccaccgcgcctagcacatttttcttaaactttggtgtttgttattggatatcctttgttggattaacacataatgggacaaagattataagaactattaatggaaaacctcaaaatagtatgttgaacattttttatgaggacaactgtattcagagtttagacggtttaatgtgttttctgccagtaaaattgtttctgtattgtataataaatatgccagctcaccatggtattctatgaagagtgtctgaagaatggatactctgccctgttcaggggccatggtaaagatcttgggttttattcaagacttcacatattttttttttttaatttttttttgagagtctcgttctgtcacccaggctggagtgcagtggtatgatcttggctcgctgtaacctctgcctcccgggttcaagtgattctcctatctcagcctcccgagtagctgggactacaggtgcacaacaccacacccagttaatttttgtattttttggtagagacagggtttcaccatgttggccaggctggtctcatcaactcctgacctcaagtgatctgccccctcatcctcccaaagtgctgggattgcaggcatgagccaccaagcccggcctaagacttcagattttattctaagtgtgctgggaagccactgaaggacaaagagtgagggtgggacataacaggccttacactggttaagaagcactctgggctgctctgtcggtataatatataggaaccagagtacaagagtcacccttatggaaatggaaaacctgatggatagcatggatagagagaaaaaaataagtctttcatagacatgttcagtttgaaacactttttggatttccaagtggagatgccaaagctaggagttagtcaaagctaggtgttcagggtagatgtcaagactaaagataaaagtttggtaattattgacacatagatcttatttacagatgatatttaagatccatgaaaggaatctgaaaagtgcaggcagcaagttaggaaaaccacagcatggtgggctgaaggccaaaggtagacagggtttctaagaagggatatcatcaggaaccaaggttttaaatataaaagaaaaaagatacaagtatctaaaatcaaagaattaaaaaccctatattcctaaatgtgaattcacaataactacataacaaacccagcagcaataagcatgccagcactcaaattgtgatctccaaataccattactaaaagatggctaggcaaggtgactcacgcctgtaatcccagcactttgggaggctgaggcaggtggatcactcgaggccaggaattcgagaccaacctggccaatatggtgaaaccctgtctctactaaaaatacaaaaaaaaaaaaaaaaaatttagccggggccaggcgcagtggctcatgcctgtaatcccagcactttagggggccgaggtgggcggctcacctgaggtcaggagttggagaccagcctaacaaacatggagaaaccccttccatctctactaaaatacaaaattagccaggcatggtggcacatgcctgtaaatccagctactcgggaggctgaggcaagaaaatcgcttgaacccaggaggcagaagttacggtgagccgagatcacgccattgcactccagccggagcaacaagagggaaactccatctcaaaaaaaaaaaaaaaaaattagccggtcatggtggtgcacgcctgtaatcccagctactcgggaggttgaggcaggagaatcgcttgaacccaggaggcagagttcaagaaaaggagaaggcacactagagacaatcctaaggaaaaaataaaaatggggaggcagctggagtttcatggaattaagagaggatttttatttttaatcaatggaaataaaaagcttattttactgcttataggaatattacaaaaaaagggggggggaactgattatataagagagtggagagatgaaagcaggaacatcttgagtaggtgagaagagctgggatccagcccacaagtgagggactggttttggttagaggtaggggaccattcatctatttaaataggctcaaagcacaggtgaagatataagcaaattgataaatttgctggtagaaagaacataattttaattgcttctatgttctcagcagaatgtaacggaaagccacaaggaaggtgtgtaagggagaggaaagtgcttaaaggtttaaagacataagctgtgaaattagtcaccttggagggtggcacattattttttataaacttcttggagagtggtacataattttttataaacaccttggagggtggtacatcactaagaaaacatagtagaaatatcagacagcactaaaggctcatctgaattttgtgattataataaatttaaagtaaaaccttagctaggtgtggtagcacaagcctgtagtcccagctactcaacaggctaaggcaagagaatcacttgagcccaggagtttggagctgcaatgagctgtgattatgctgctgcactccagcctgggcttcagaaataggcctagtcactttgatagatggatgggtgaatggatggatagatcatttaagaaaaaagtaaaaccaatcatcatgttttatgttattttttagccacgtccagctactctggtacaggaatggacaaggccaagatgtggtttaaccagggttgagatttttgtcattcaagtatgatggagggagagaggggaaacacgttgaagaatgcaatggagtgattatgatgacggattacagaaaataagcagtagaagaaaggaagaatgcgtataaaggaaatgcttgggccccacagtagggtttaaagaatggctggaataaaaaaacagacaaaacatggtttaaagataggaggtggtagttaaagagtaatatgcttgcaattgagatttgacagtggttatgattactggtaatagctaagcaagagtaagtgattttgaaactaagaggcaggtactggattgattgacgatacagaaataattaagaatgataaaagtagttgaagtagagaaaaagacaacgagtcagatcctaaaatcactgatgaaaagagacttgtggatgagtgcaaaaggacaagggatagtttaatctaggggcatgtatttcttttttttttcttttctttttttttttgagacggagtctcgctctgtcgcccaggctggagggcagtggcgcgatctcagctcactgcaagctccgcctcctgggttcacgccattctcctgcctcagcctcccgagtagctcggactacaggcgtccgccaccacaccccggctaattttttgttatttttagtagagacaggatttcaccgtgttagccaggatggtctcgatctcctgacatcgtgatccgcctgcctcagcctcccaaagtgctgggattacaggcgtgagccaccgtgcccagccgttaggggcatgtatttcaaagaaactggagtttataaggaagaacagtggcctagaagaggcaaagaagaaaaacatctatccctcctctcagccgtgtgatatgtgatgtataaaagaaaaagccattacttagaagggctgcaaagaaagcagcatcctcagaagaggaagggccaggtgtcagtgagaactctaactgaacagcgtcacccaaatcacagcctatcaccacgtcaaaactaaagattgtttcactgccactgccagaaaaacagttttatcacactgtcatctaatgtgcctggttatttaactacttcgaaaggtaacattacaaaatgttcagccgttacttaccttcctgttgtaattgagccaagaaaagtgcaagatatgtatctgatattaattctggacccgtcaagagagaattcaagttaaaccactggaaaaaaattgtcaatatttaagttagtgtatattataggtaataaggaagtttcacatgttaagaatagatacaacccatcaaagcttagtaagattgtttaaactctggaaatatttcaagttgagctcttttctttgactgaataatatgatcttaaaaactacaagagaatactgcagatttatcactattaaatacttttttttttttttgagaagagtctcactctgtaacccaggctggagtgcagtggcatgatctcggatcactgcaacctctgcctcccaggttcaagtgattctcctgcctcagcctcccaagtagctgggactacaggtctgcaccaccacacccagctaatttttgtatttttagttagagacagcacatttgccacattggccaggctggtctcaaactcctgacctcaaatgatccgcccgcctcagcctcccaaagttctgggattacaaacatgagccactgcacctggcctctgctaaatactctttttttttttttttttttttttttagacagagtattgctctgtcgcccaggctggagtgcagtggcgcgatctcggctcactgcaagctccgcctcccgggttcatgccatcctcctgcctcagcctcccgagtagctgggactacaggcgcacgccgccacacccagctatttttttgtatttttagtagagacagggtttcaccatgttagccaggatggtcttgatctcttgaccttgtgatccgcccgcctaggcctcccaaagtgctgggattacaggtgtgagccaccgcgcccggccctgttagatacttttttaaaaacaacagtttgctttaaactataaacattaaaccctcccaaaagaataaaaatgcatagtcagtagtttaaatgtctttattaatagctataattaaatcttttttcaaaatatcagtccaacataactccaatcatatctatcacactgatgggaggaaaaatgacaactacacaaagttttcccattactgataatttttgtcaaaagattccaattgtgagaaagtcagaagttccaggaagagaatttataattaccagctcagtttttaaaaatcactaaattagctgggcatgcagctcatgcctataatccgagcactttgggaggttagctaaggtgggaggattgcttgagcccaggaatttgagaccagcctgggctgtaacatagtgagaccctgtctctataatttaaaaatgtttttaaaaagcactatcacatataacatataaacacatttttttaaaagagatggtcatctagtctggagtgcagtggtgcaatcatagctcactgcagcctcgaacacctgggcttaagtgattctctcgcttcatcctcccaagcagctgggactacaggtgtgcaccaagatgcttgacaaattttctaatttttttgtgtggagaaggggtcttacactatgttgtacaggctggtctcaaactcctggattcaagacatcctcccacctcagcctccctacatgctggaattacaggtgttagccactgcactcggccctaattaacatcatttatcactaccacatagtaatcctaatttaacccacaagatacaaaaagtttctaaagttaacgatcaatatcatgaccaactacttttcctggattttgacaatgttaatactttttccagccttctttttcattatacagggacctcgagagacagaaagagtctatagtgaaaaatatagttttaaacaaaaatataaattagaaccaaagaaaataaaccaaaatttgacatcttctgtatttgtcaaagataacgtaattcaaaatgtgaaaatgcaattttgaagaactaaaattttttaaatctctcaaaataataagatagacatttatttgcaaattaatacaaccttaaaaattcagtgcttactttatacaaaaaaaagtaaaaaatactggatcataatttttaaaaacacataaataaaacccagaggttaaataatctcagcagtacgctacactggtttttacctagaggtgattcccactcgcatcagcctctactgctgtaagctgcctttttttttttttttttttgtagagacaaggtgtcactgtgttgggccaagctgctctcaagctcctggcctcagtgatctccctgcctcagcctcctaaagtgctgggattacaggcgtgaaccactgcacccagctagcctccactgtaagcttctaggttacatctccttaacttgctcttggctcctcaggaagaactttaagaaagaaccaacttagggctcggcatggtggctcacgcctgtaaccccagcactttgagaggcagagacggacggatcacctgaggtcaggagttcaagaccagcctgaccaacatggcgaaaccccgtctctactaaaaatacaaaaattagctgggtgtggtggtgcgtggctgtagacacagctatttgggaggctgagacaagagaattgcttgaacccaggtggcggaggttgcagggagccaagatcccgccactgcaatccagcctgggcgatagagcaagaatccgtctcaaaagaaggaaagaaagaaagaaagaaccaacttaggatgaagctaagtaggtgacttttcccaaatttgatttgggtgacttaaaagataacaatagggtttttgtttttgaattatctcttacagatttaattcaatatattttcttgacttataccttttttggcttgtatttacattttaaaaaaaacagatttattggggtataagtgacatataataaactgcacatatttaaagtgtataatttgaaactttttttttgagacaggatctccttctgtcacccaagctggagtgcagtagcacgatcatgattcactgcaggcttgacctctgtgctccctcctcagcctccctagcacctgggactacggccatgcatcaccacgcctagccaatttttttttctttcattttttttttagagatggggtcttgtgccattgcccaggctggtcctgaactccttgagctcaagcaatcctcctgccttggcctccaaaagtgctgggattacaggcatgagccactgcatctggcctctgaaatgttttcacatttgtatactgtactcccatgaaaccattactacaaccaagatagtgaacacattcctcattgccatgtttcccgtgcctctctgtaaccctcccctctcactcctccatagccttctcgtccccaggcaaccgctggtcaatctgctttccatcactacagatgaatctgcacttttctagacttttaataaatgataccatacagcaggtagtattttgtttgtgggttattctttcagcataattattttgagattcatccatattgctgcatgtatcactagtttattcttttttactgtcctagctggttttcaataaccctctttcaaagattcaaaattctaataacaaggacgttaaatgattgtttcttaaaatagcttgctcaagacatatttcatgttttatttaaaaaatagaagtgattttctgtagacgtacgtattacatggcttttggaatcataatgaataatcttacactaaagcaaacataattgaatgctttattcatgcttgacactatttcaggctttgtgacagcactatgctaaatacaaatctataaatgtaataattaactgacagaacatagtcatcacataaaaacccacttaaaagtaaccacatttgtattatctttaatatagaatttttcttatgatatagttaaattgcatatacttgtcacaaataaatttataaggaaaactgatattatcttttaaaatgacaatttctatctatcaagaaggataaaccatgctacacacacacacattactggtcagtttcctaattttaaagtcagcaatccttttttttttttaatttttaaatatattttttttatttttatgttttatagaacagtcttactctgtcacccaggctggggtacagtgacaaaatcatagttcactgcagcctcaaactcctgagctcaagtgatccttctgactcagccttccaagtaagctggaattacagatgtgagccaccatgcctggctctttgtttttttttttatttatttttatttttatttttattttttttttaagagacaggacctccctttgttgcccaggctggtctcaaactcctggcttcaagtgatccccccacctcagcctcccaaactgttggcatgagccaccacacctggcccacattttagttttaaatggggtacaatataagaaaaaaagacaaggaagggtaagaaatgttacctgttttcctaattttctaactgtaaaccagtgttccttataattgcatataaatgatctttcatttctaaaaaagaaaacagacaatattaacttgaaatattgaattcatatttatgttgtctactggcaaatattatataaaatttgtgataatttaagattatatttatagttaagtgtcactgatgtttttaaaagatcacacaaccatatgaacgtctctgcagcagcttagtgatgctgtgccacaagatggcctcatgcaccacttatggggtcagctctgtgctgccacagacactggggtgccaggaaggctacagggcagatgctcatggacatcacaaaggtgaaataggaaagtctgagtgaatgaaacagggaacatcaaaacaaaagtattcaaaatgtatttctcttctttaagaaattacaactttaaaaatcaaatttgggaaaagaaatgtatgaaatgcaaaacagaatcttacataggatcgatcctgagcctctgatactctggactgttgaacaggattagttctaaaccccaaactttcaaggcattgcttataacctgttaagaaaaatagcaacttttcataagctaaaccactccattccaaatttaggaagtgtagctatgttagttgtgtacttcatatataaatttctctagaaggctataggtttttttttttttttttgtgacagagtcttgctctgtcgcccaggctggagtatagtggcacgatctcggctcgctgcaacctccgcctcccaggttcaagcgattctcctcctgaggctcccgagtagctgggattacaagcacacgccaccacacccagctatttttgtatttttagtagagacagggtttcaccttgttggccaggctggtctcaatctcctgaccttgtgatccacccgcctgggcctcccaaagtactgggattacaggcatgagccaccacgcccagccggctataggttttaaaaagtgtgtgtgtatagatatatcactaaatccataaaaaaaaacacatatatattagaagagtgcttttcataccaggtctctgagatgttccagaaaaccacacaattcctaaataaaactgcctcaaaaatccagatgtatattctacccataagtgcttttcttaaaactagtctactatatacatctgataatttggctgctgtgggtgctactttagaaaaattatattcaacttgctacctgcaatgtcagaaatcatatctaccaaaataagttctccctgggcatttaaactgaaggttccatagatgtcagacttctagggtcatgggcttgccgcttgtagaaaaaacaaaatgcaaacctgtttatttcaatctgtctgacaaaaaaagggaaatttctgaaaattcactatctgccctccaaggtagccaacaaagaagcaagtgagccaggtaccagcaaagacagaaattgagtgcaaggtagtgggcacacatgaacaggcaccaagagcagcaaggcacaaataggaaacgccaagtgctgggcctactctggcctctgatttcagccctgcagtagccattacctgttagcagtggcacggtaaagcactagatggaaatgctggtggatgaggaagagtccaggagggcagtacaagggaaacataaacaaagatatctgcagagataggtcgctcaggagaggttccgaaagtactctggatacaactcacagtgttagaaaaagaatgaaagacccacagataaaagaatcttgcgagtacatatatatataaccaccaaagaattcaaagagagctatacattaaaaaaaaaaaatcaaaagccacaaaccataataaggaaatccagtctggtaggctgatttaaaaggatggtagcaaggtattgcattttctcaaatttacccaacagatggtaagtttgagacattgtgacttattagaattaaggatttctttttttctttgagatggagtctcgctctgtcaccaggctagagtgcagtggcgcgatcttggctcactgcaacctacgactccctggttcaagcgattctcctgcctcagcctcccgagtagctgggattacaggcacgtgtcaccacgtccagctaatttttgtatttttagtagagacggggtttcaccatgttagccaggatggtctcaatctcctgacctcgtgatccgcccacctcggcctccccaaagtgctgggattacaggtgtgagccaccgcgcccggccagaattaaggttattattagcatccagatgcaaattaatctttctcaagaaggaatttttaaatgccccactctaatatgaagattctacaatcctttcatgtttatctatataaaaatctagtactctagttggccaggtgcagtggctcacacctgtaatcccagcactttgggaggctgaggtcaggagttggagaccagactggccaacacggtgaaaccccactatctctactaaaaatacaaatattaactggtgtggtggcgggtgcctgtaatcccagctacttgggaggctgaggcaggaggatcgcttgaacccgggaggcagaggctacagtgagccaagatcacgccactgcactccagcctaggtgacagaacgagactctgtctcaagaaaaaaaaaatctagtactctagagtataatctatactctgtagacagaagaacttccgaaggtcgccttgttacagtgactattgaaaggctgtgaaacggtgcctgggatgtaagcaacacatagtacatgcttgtgactacttacctgaatagagaaaaaaccactgtcatccatatttccagaaggctgctgttaattttgacaggtagttgaagcaagggtgggggtggggaaagaaggatacaaactgtcattagcgtgcatatttaaaacaatatcttgtgcattcccatttccaaagttaacagcacagttataattcaccagtcagatccctataggaagaatggcccatccttttctaaatggtatccacatttttaaaagaaatgtaagccgggtgtggtggctcacacctataatcccagcactttgggaggccaagacaggtggatcataaggtcaggagtttgagaccaacctgaccaacatggtgaaaccccatctctaacaaagatacaaaaaattagccgggcatagtgccgtgtgcctgtaatcccagctacttgggaggctgaggcaggagaatcgcttgaacccgggaggcagaggttgcagtgagccgagatcgcgccattgcactccagcatgggcaacagggcgagactccgtctcaaaaaaaaaaaaaaaaaagaaatgtgacttagtgagtttaaaatcagtacctgtaaaaacgtgcgataatcttcactagtaactcctccttctgccattctcatcctctcctcctcatccagctgatgtgcaattgaggataattccacagggctaaaatattctccttgcaataagttattcaggcaatgttgagcacaaagtgagccttcttgctaatatttccaaaagaaaaaattaaaatgtgacttgttaaacagaattgtatagtatcttcccctaaataatttttttttttttttgagacggagtctcactctttcacccaggccggagtgcagtggcgctatcttggctcactgcaagctccgccacccgggttcatgccattctcctgcctcagcctcccgagtagctggtactacaggcacccgccaccacgcccggctaaatttttgtatttttagtagagacggggtttcatcctgtgttagccaggatggtcttgatctcctgacctcgtgatccgcccgccttggcctcccaaagtgctgggattacaggcgtgagccactgcgcccggctcccctaaataatttaatcattaattttttttttttttgagacagagtcttgctctgttgtccaggctggagtgcagtggagcaatctcagcttaccacaacctccgcctcccgggttcaagtgattctcctgcctcagcctctcaagtagctgggactacaggcatgcaccaccatgcctggctaatttttgtatttttagtatatacagggtttcactctgttagccaggctggtctcaaactcctgatcttgtgatccgcctgcctcggcctccaaaagtgctgggattacaggtgtgagccgccacacctggccaactttttttttttttttgagatggagtcttgctctgtcacccagcctggagtgcagtggcatgatctcggctcactgtaagctctgcctcctgagttcacgccattctcctgcctcagcctaccaagtagctgcgactacaggtgcccaccgccatgcccggctaattttttgtatttttagtagcgatacggtttcacaatgttagccaggatggtctcgatctcctgacctcgtgatctgcccaccttggcctccctaagttctgggattacaggcaagagccaccctgccaggcccctactatgttttaacatagttgaactgaactttcagctttagataaggataattaacataggtacatgcattttcatttggtaacatttattttacaaatctaccattaatgaaactataattacatgatcaaaaatttaagaattattttaaacaaacatcatctatcaaatgcatcaaatctcatattttactaaaaactactgtataaaacatttagtctccctcattttcagtacctaaaataagttcattcttggagattctacagtaaattactaatggtgaaaggaaattttagtccctagaacagttatttatttatttaaaaaaagagatctcactatgttgcccaggctggacttgaactccagggctcaagggatcttcctgcctcagcctcccgagcagctagaactacagaaacatgacactgtgcccagctccctagaacatttattcttttaacatgatgatgtcagtcaagcatggtggctcacacctgtaatcccagcagtttgggaggccgaggtgggtggactgcttgaggctgggagttcgagaccagcctgaccaatacggtgaaacctcgtctctactaaaaatacaaaaattagccagcatggtggtgtgtacctgtagtcctagctaatcaggacactgaggcatgagaatcgcttgaacccaggaagtagagcctgcagtgagccaagaccatgccactgccactccagtctgggtaacagagcaagactctgtctccaaaaataaaaataaaaaaatctccacacaatctaaatgcttgttgatagaacttcaaatcttaagaattaatacaggtgagaaaaattctgttccatgttaaaacttgcagttacagtgctgaagttctcttcatggaactctacagataatgtatacacagtgtaaagcaatgagcagaactgtcccaaacaaccctggagctcactcctggacaagccagcaagagggactgcacccaagctcagctcccatgggatgacaggattcctcctcatgggaggtaggtacaacttctcatgggttcagggccttcaggtgctgggcagtttctcacacaactggcaacctgaatccaagtccagggtgcctggtactaagtagcctgcgtgtgaccctcctccccgcaacagtgtagctttcccatgctacctgataagaagggagaatcacagatggatggatccctccctgtgaacacagacaccaggtttgcccctccctgaattgacggcagatgagagaacatttccttctcctgctaaccttggccctccaagttctctctttccccaataaggtctattccttaacccaacctatctgacatcacacaatttgtcctgagctatgtcacacagcagactctaaagagaaccaccttgcaagacggatatttttcctgatgaatcaattttctaggagcaaaattcagctggtgaaaaaaatatgggttatatgtgtataatggaataggaagacaacattgagacagcctcagtctgagataagtttatcttcaacttttcgtaaggaataagtagcttggagctagagagaacactatcccccaagtcttctcatgagaatagactttttgtttccacttctttctcctccttatatatttctactaccagagtgcaactcttactgaataatatgcaaattgaagggatatacagatgttctacttatatccttttgaaaaatagccaaggctggctgcggtggctcatgcctgtaatcccagcattttgggaggccaaggcaggaggattacttgagcccagaagtttgagaccagcctggacaacatggtgaaaccccatttctacaaaaaataaaaaattaactgagcatggtggtgcgtgcttgtagtccagcttcttgggaggctgagaaaggaggataacttgagccccaaaaaggtcgaggctacagtaagctgagactgcaccactgcactccagcatgggtgacagggcaagaccaagaaagacagaaagacaagaaagacaagaaagaaagacagaaagaaagaaaagaaggaaggaaagaaagaagaaagaaagaaaggaaggaaggaagaaaaagaaagaaagaaaagaaaaataggcaagacaaacaagcacttcacaagacagtcaaatggctataaagaacacaaaagaggtactcaactttattagtcatcagggaaatgtaaattaaaaccacaatgtgttagtacacaaactctaaaatggctaaaatgttggagattagagatacagaaactgttgtatactactgatgagaggataaattggtataaccaataataactaataattatgtaatgcatccactaaagcttaatatatacatctcctatgatctagcaattccattactaggtacataatgtaaacaacagcaatgcaaacatacattcatcaaaagacatgtataagaatgttcacaaaagcagtatttttgtgccacaaatagcattactatttgtagtaatacaaaatagcattacagatagcattactatttgtaatggaccccaaactggaaacgacccaaatggatagctgggatcacagtagaatggaaattgtgtttactcacaaaagaatactagataacaatgaggatgaattaactacaacagtagttaattaacaataattaacagtagttaattctggaacagtatggataaatttctcaaacaatggtaaactaaagaggacagaatcgaaagggtatatacactgtacacttccagtcacaaaagctcaaaatcaggcaaaactcatttatgatgtcagaattcagcatagtggttatatttggtgggaatgcagtggagagacagtacctagaaaagggaataatgggaggttataggatgcaggtaaatcttttgttacttgctgtttacacatgttcactgtgtgaaaattcgctgagctgtactcttaatgatttgtgtgctcctctctgtattgtatctaatttttaaaaaattcaaacagtaagaaaaaagcctttgctaacacaaatttcctgtcttgctgtcagtttggagtttacaaactatggtcaccatacttaataccatatatagcaatagtgacatccaaatatttgattaaaattctctctataaaaaatagctttaaattatgaaaaataagtacttgaaatcaaacttcatcaaagaaaaactgtattgctacaggaaatatcaagttctgtacttctaatatgatttaatggaaggaaaggacaaactgttcagtacaaatttaaaaatcacttaaggctaggcacagtggttcatactataatctcaactgtttgaggggctgaggtgggaggatcacttgagcccaggagttcaaggctacacggagctaagattgtgccactgtattctggcccaggtgacagagcaacatcatgtctctcaaaaagacacaaaataaataaaaataaaaacaaaaataaacataacttaagtcataggacggatcaaattccacatggaccaaaagaattgtacaatgacaatgagcccacgtaagattatgcattttcctgccttgcccttatctcaaactatccccagccacctctctcatcaagctttaatcaaagcagaagttcactttgccataatcaaagttcagcggtattgaaatctcatgatttggctgggcatggtggctcatggctgtaattccagcactttgggaggccaaggcaggttgatcacttgagatcaggagttcgagaccagcctggccaacatggtgaaaccccgcctctactaaaaatataagaattagccaggtgtggtggcaggcgcctgtagtcccaggtgctcaggaggctaaggcaggagaatcacctgaacccaggaggcggaggttgcagtgagctgagattgcaccactgcactccagcctgggtgacagagtgagactctgcctcaaaaaataaaaaataggctgggcgtggtagctcacgcctgtaatccccgcactttgggaggctgaggcaggtggatcacgaggtcaagagatcaagaccatcctggccaacatggtgaaacctcgtctctactaaaaataagaaaattagctgggcatggtggcacatgcctatagtcccagctactcgggaggctgaggcaggagaatctcttgaactcaggagacggaggttgcagtgagctgagttcgcgccactgcactccagcctggtgacaaagtgagactctgaagaaagttcgtgccactgcactccagcctggtgacagagtgagactccaaagaaagaaaagaaagaaagaaaagaaagaaggaaggaaggaaggaaagaaagaaagaaaaggaagaaaggaagaaaggagggagggagggaataaataaattaaaaacaaaaaaaaaaataaaagaaattctatgattttaggcccagacttcattgtgttgggctcagagaattagcaaactgcagttctacaaagataatgtataaaatcacaaaagagaactgctaccaaatcatttacccccaacctccccaggttttcaagaccaacctgaaactagttcaaattaccagagacactactaactacaacacaaatcaggtataaacctaaggtgctctcgggaatgggctatctggggacaagctgtcaatctagcagcatttctcacctcctcttagtgctctccgagcccttactatgaggttcagcaaacacaagcacctgagtaatggcaatggccagtacttctacagcactatctgccagggagccttctctacactctaactctcaggttatgtctatgttattatccccacactacagaggaggaaactagaggacagggatactaagtaacttgctcaggatcacacaggtagtaaaaggcagagctgagactcaaacccaggcagaggtttcaaaacctgtgctattagcacttcaagtcatttatacagaatttggcttctcctaaagctcaaatgtcctaaagatggctaaaatccagcaatcacaaaagggcataatgaatgccacagagtcaatgctcagcatcttttcaatcttttcaataattttatgtacaaccccagcaagtttagatattattaccagtttgcattacattaaaagcaccaatacaaatggcacagtaactgcaccaagaaacatcagcaagaggattaaaaaaaaaaaaaaaaacaaagcaggcaccagaactaaaacaaacaacaacaaaaatccagtagtggtcataaagttagtacaaaggtttaagttaggggttggcaaactctagcccatgggccaaattcaacctgccccagtagctaagaatgcactttacatttttacatggttgggaaaaacatgcacaaataagaatgtgtgacagagactacagctggcctgcaaagccttaaaatatttacagaaaacttgtttactttagataaacagcaccatatatatctcagaaactcaaagccatctctttatccattcaaatatatacatttttttcttttgagacaggatcttgctctgtcccctaggctggagtgcagtggtgcgatcatggctcactacagcctcgacctcccagactcatgcaatcctcccacctcagcctcccaagtctacaggcatgtgctaacacgcccagctaattttgttcattcttgtagagacaggtctcaccacgcccggccccattcaaatatttattgagtacttactctgtgccaggccctctctcaggcactgcagatatatcagtgagaaactgtttttacattctaacttaataaagggtactcaaagtgactactcagaaagaggaaaccaaggttccaagaggaaatggttgcaaggcccttcgtaggcagatattgctacctacacagcttctttagggccaaagttggttctctggctctccaaacccaggacctagcaagggttaaaggtatattgcagaggggaaggcagtgaacggaaaaatggcacagtaagcccaaacattcccagaatggactgtataggagattaacaattgggccatatggttataggtgcgtactcttgaggacgcccaaaaaactaaattgttgaatcttcacatgctatgtagatacaagttgatgataatggtaaaggtattcctgaagtatctgtaggcctatacacatgctgataattaagagggactcttttttccttttcttttttttgagacggagtctcgctctgttgcccaggctgaagtgcagtggcacggtctcggctcactgcaacctctgcctctcgggttcaagcaattctcctgcctcagcctccagagtacctgggattacaggcgcctgccaccacacctggctaattttttgtatttttagtagagacggggtttcaccatgttggccaggctggtctcaaactactgacctcatgatccgcccgtctgggcctcccaaagcactggtgtgagccactgcacccagactaagagggatttctttcgggtaagtagattttcactaggctagcactcagctttttttcatcccatgggtcagtacaaatgtgtcccaactaggtaacaatattgttaaaaatcttgtctaattctcaggaagtagtgtggaacatgtttaaggccttccatgttgaaatgtggtcccacaccaaagcctttgaaaattaataacaaaaatatggccgggtgcggtggctcacgcctgtaatcccagcactttgggaggccgaggcgggcggaccacctgtcaggagttggagaccagcctggccaacatggtgaaaccctgtctctactaaaaatacaaaaattagctgggcgtggtggcgggcgcctgtaatctcagctactggggagactgaggcaggagaatcgcttgaacggggaggcggaggttgcagtgagccatgatggcgccattgcactccagcctgggtgacaagagccaaactccatctcaaaaaaaaaaaaaaaaaagtacgtgtgtatttttcacgcactctactcagccaagcaaccaaatctctattgtctatgatttacgagtcatgtcaatcaagtcaaaaaattagtgacaactatacgactgagtccttcctcccccactgaacatcagcctatttcaaaagtttccgagatgttttctacaatgaaaagcattgtacttaacaatttgttccaggcacagtggctcacgcctgtaatcacagcacttcgagaggccgaggtgggagaatcacctgagtccaggagttcgagaccagcctgggcaacacagcgagaccccgtctctcccaaaaacattacctggccctggcgatatgcacctgtagtcccagctactctggaggcagaggcgggaggatcgcttgtgcctaggagatcaaggctgcagtgagccatgatctctccattgcacacctgcctgggtgacagaatgagaccccatctttaaaataaaaattaaaaaaaatttatgctacagatttacatttggtaaatgtattcttttgtctttgctttatttgttgtgtgtgtgtgaattttaaatgtctgggataaatgatcatttataagtatttaataaaacaaaaaccctttgctcctcctattaaataacagccttaccagcaactctttccaaacacgaaactattatgaaacatgataccatgtgccaaagctgtcctggggaaggcttcactcacacacaaatggctggataatagtatgagagaaacgaggagtttctttacatatcacaaacagtatcttcaagtgcatggtcacggaagagttaaagggacagcaggctaggcagactacaacaaaatcatcccagtccactcctaatacctaaaaacaaagctggccgcctgctccggaaagatgggagtaccaaaagaaaccaaacccaaacatcccgtaataaaaactcttgtgacgacttccctgtttaggggcacgccgggtttcctacttcacttcctaaatgtcaggccctacagtgggcgagccaaggtctcctccctcgggaggctcgcggacctagtgcaggggaaagacacgaacaagaccccaaagatctacgtgtagggaagactccaatatagaattgagcagtccggaggaggaaaagttaattctgccaggattagggtaggaggggttgagggaggtgtcccagagatgactctagctagaccctagggagagggaaggattggggaggggtgaaggaatcctccgaaaagcgatggaaagtgacggagaaaggcagaagcaaacccactgggcgccaccccactcccgtgtcccgagacgcccccggccccgcccatactccctcccggctcccagggcgggggccgcgggggaagtaggggcgtaggtgatgctcccctcctcgagccgaggaggcgggaggctgcggcgtcgcccctcgccgggcgagatcggcatgggggcgactcgggccccacccagccctccgagaggcggtgatgccgcgctccacgcccgccaccgcgcggcagacagctccccaccgaacgcggacactcactttctcgtggaagatggactccatgtttatttgtctggagccaacggcccccacgccgaaccaccccctccagctccgccccctgcccctctcctccgcccaccccgcccctccccggcccgccccggtaccccgcccacgtgccgcacgcagaccaatcacccgtgaggatgcgagtgtcgtgaagcgaagagcgagtgaacgccggggacacgtgaccttggtagcgcgtcctcctagcttctgttagcgggccttctgggggatgctacatcgccacctgctgtctggaggatcttctccgcttcccacccatttctatggattcttaggtttctggggggaggtctggaccgctcacctgggttctatgttctttttgttttccactttgactttctactgtgttcatataactatttactttctttctcctcctcctgcactgaaagtttagtaagaaaaaagccatcattacattctcccaaaacccagcacttgtataaaaatgatagctaggccgggcgaggtgcttcacgcttgtaatcccagcactttgggaggccgaggcgggcggatcacctgaggtcgggagtttgagatcagcctgaccaacatggagaaaccccgtctccactaaaaatacaaaattacccgggcgtggtggtgcatgcctgtaatcccaggtactcgggaggctgaggcaggagaatcgcttgaacccgggaggccgaggttgtggtgagccgagatcgtgccattgcacgccagcctgggcaacaaaagcgaaacccctcccccaccaccccaaaaaagaaaaaaaatgatagttaatatttacataaggctttctatgagctaggcacttttctaaatgctttgcatatattatcaaatttaatacagcaaactttgatgtaggtgttgatgttattcatacacatgaggaaaccgaggcacggagaggttaagaacagcacaatgtccaaggtcagatagtaagttgtcttgccaggattcaaatccaggtggcttgttaccagtgtaggtgttcggaccctttagagggaacttagaagtcccataaattgtgtgggagacggggaggtagcagcggtttgatgaaacttaaatggaaggataggtgcagatcttgcaccttgaaaccagattaaggtgtactttttttttttttttttttgagacggccctctctctgtcccccaggctggagtgcagtggcacaatctccccgctcactgcaacttctgcttcctgggttcaagtgattctcttgcctcagcctcccaaacagctgggattacaggcgtgcaccacgaagtccaactatttttgtattcttagtagagaagaggttgtaccatgttggccaggctggtctcgaacccccagcctcaggtgatccacctgccttggcctcccaaagtcctggaattacaggcgtgagccaccgcacctggccaaagtgtaccttttaaaggatgtggggagctatataaatattttaaaagaagacatgtggtcatgtttgccttttagaaagatcactggctgcagaaaaaagcagttgctgttgaaggaatcttgggagagacgatggtggtttaagagagtgtcttaaagatggaaatagcccattttgagagattctttggacgtaaagagactcaacagaatgtggtgatgataccgagtggaggaatactagcctttttcgtcttgagtcgaattacataaaacgacatggacaaacgtggagtggttttaaggagcggagagtttaataagcaagaaggaagggagaagaaagaaagaagcagctcccctgtacagagacagagggatgggtgctccaaagctgagagaggagacccagagtgcgtgggagataccagccagttataggaggaggatgcaggaggcggtgtctgatttgcatagggctcaggggactggtttgaccacgcatgtcattcatgtagccccctaataaaactggccattccaccctagccttttaatatgcaaatgcagggcgctatgatgttctactcatgtggggatatgtgggggtggccatgttgccaggcacttgtgagaacaagggcaagaggacgatggtgggaatcaccgtgttggtggacccagtttctaactgccggcatttgcatatcaaacgttgccagctcgggtctaaaagtcagggcttttatgctagacaggaaacgtctcaggagctgcttcaaaagagacaaaaacttttcaaggaccccttttcctctctatctgcctaaaataatttcttaataactcctaccacaatgagggattggggaaggtaggagacagaaatgtgaaggtgacttctgggtttgtgacctgggcagccactgtggcaggagtggtattgagagcagaaacatgggaggagcagcaaggttttgggaagagaataagatagagtttacattttggagatactgaatttgaaatatctatggacatttgagtaattatgttgagtaatggttggataccgagtctgaagttcaggaggctgctttgaactcaatgaggaattgtcattaaaaaacagatagctaaggccattgtggtggtgcatgcctgtaatcccagcactttgggaggctgaggcaggcagatctcttgaggccaggagttcaagaccaggctggccaacatggtgaaacctcatctctacaaaaatacaaaaattagccgggcgtggtggctcatgcctataatcccagctactcaggaggctgaggcaggagaatcacttgaaccgggaggtagaggttgcagtgagccaagatcgtgctattgcactccagcctggacaacagagtgaaactgtgtctcaaaaaaaaaaaaaaaaaaaagtaactgaaaccataggagtgaataaaatcattttagggaaaaggaagtgattgagaagagggctagagctgagccgtgaggataggagaagcaataaccaaggaggagggaggagaagcaagagagtgtgacattgtggaaggcctgggcaggggatgcttcaaggggtagtcagtgtcagttgctgccaagaagtcaagcaatataaggtcgtataagagcccactaaattttgttgctatggagaccattggtgactttggggactgcaggttcagagaagtagagggggcagtgagaggtaagagaatggagactgccagagaggaccaggtgctgaaggagaggattcggtaccatttatcgagcatctctgtgtgcacggttcacagccttgtatgggggaaagtccatgttcttaaggatttgtgtggcctacccagggaaataaattatagtctcatgaagtgaaaaaaattgcaaaccaccttttctgtttttgttttgtttttttaaattgtagttgatgtctttcaaatgaattaatgaagtcgaaggtcttagtctttttggggcgctttaacaagatatcttagagtaatttataaacagaagtttattacagatctgtaataaatttacaggctaggaagtccaagatcaaggctctaacggatttagtgtctggtgagggcccattcctcatagatggtgcatttttttgtcctcacatggtggaaggggaaaaggggcaaacaagcttcctctctgcataagggcactaatctcagtcacaaggcttggccttatgatctaatcatctcccaaaggccccatctgttaaaccaacacactggagactacatttcaacaaatgaattttggaaagatacaaacattcagatcatagcaccaagtatctgggaatcattttttattctcttcccacaacttctccacgtcaccccttattccaatcagtcctcaaatgctataaatccactcctaactctctcttgcccttgtcttcattgctactacttagttcaagccctcttggtatcttgtgtactctagtccaaggatctttgaattggtcttctgattccagtctcaatatgtctaattcatggtgctgtcagtgatcttccaaaaatgcaaatctcacaagattttcttttgtttaacaagaataactgcatatcaggccctgggactataaccatgaaaaacacaaacagtcccaccttcaggggacttacattggcagggattcttaaatgattacacaactctgacttcaaaatccttcagtgatggccgggtgcaatggctcatgcctgtaatcccagtactttgggaggccgaggcgggtggatcacctgaggtcaggagttcaagaccagcctatccaacatggtgaaaccccatctctactaaaaatacaaaaattagccgggtgttgtggtgggcacctgtaatcccagctacttgggaagctgaggcagaattgcttgaacctgggcggcagaggttgcagtgagatgagatcgcaacagtgcactccagcctgggcaacagagtgagactctgcctcaaaaaaaaaaaaaaaaaaaaaaaatccttcagtgacttcctattgccatcctattgctggcctgaaaagctctgtgatctggaccaaccacctgtcctgttctgttctccccaaattctctctgccccagtcactccagactctagtcatactagcttcttccttttacttctggaaagttcactaaggaaaagtattttgtgccaccgctacaccttgagcatgcctacattacagcaccattacatcatactggaagtattactttatatactactgaactatcagcttttgaggggcagaggaatcttactcttcttttttttttttttttgagacagagtctcactctctcgcccaggctggagtgcagtggcgtgatctcagctcactgcaacctccgcatccagggttcacgccattctcctgcctcagcctcccaagtagctgggactacaggcgccctccaccatgcccggctaatttttttgtatttttagtagagacagggtttcaccatgttagccaggatggtctcgatctcctgacctcgtgatcggcctgcctcggcctcccaaagtgcaggaatcttactctttaggtcaagggttgctatagagcaatgaattaatgcatgaagtctttttgattgactggcacaaaaaattaccaataattcagtaggagagagagaagttactgagctaatcaggaaagagttcatggagacagaatagaccacatagatgcacttccagtacactttctatgtcatcttaggctactcaccttttctgtaatcttcttcattgaaatcttgtgttggccgggcatggcagctcaactcctagcactttgggaggccaaggcaggcagatgacctgaggtcaggagttcaagaccagactagccaacatggcaaaaacccgtctctactaaaaatacaaaattagctgggtgtggtggcatgtgcctgtaatcccagctactcgggaggttgaggcaggagaatcacttcaacctgggaggcagaggttgcagtgagccgagatagcgccattgcacttcagtctaggtgacagagcaaaattacatctcaaaaaaaaaaaacaaaaacaaaaacaaaaaggtcgagcgcagtggctcacgcttgtaatcccagcactttgggaggccaaggcaggccgatcacgaggtcaggagatcgagaccatcctggctaacacggtgaaaccccatctctactaaaaatacaaaaaaattagccgggtgtggtggcaggcgcctgtagtcccacctacttgggaggctgaggcaggagaatggcgtgaacccccgggaggcggaggttgcagtgagctgagatcgtgccactgcactccagtctgggcgacagagcaagactcccgtctcaaaaaaaaaaaaaaagagtaagattcctctgccccctcaaaagctgatagttcagtagtatataaagtaatacttccagtatgatgtaatggtgctttaatgtaggcatgctcaaggtgaaaccccatctccactaaaaatacaaaatttagccgggcgtggtggcgggcgcctgtagtcccagctactcaagaggctcagacaggagaagggcatgaacccgggaggcgaagtttgcagtgagccgagatcgtgccactgcactccagcctgggcgacagagtgagactccatctcaaaaaaaaaaaaaaaaaaaaagaaaaaaaaaaagaaatcttgtgttaacaagagagattgcatagagctatttccatcttcttgaacactgtacctattaaatccaaactcgcatgaattttgttacccaaaatgaaatagtttaacagaatttcaaatgtttggcattttaaaaattatgatgtgtattaatcaacacaaatcagtggtaactaaatggtatcgtttcagcgtaatcttctcctaaattaaatcctacctaaaacaattaataaaatttggcttccaagaagaggtagtagaacttggcaatttatttacttacttatttgtttgtttatttaagatgggtctcactctatcgcccaggctggagtgcagtggtgcaatcttggctcactgcaacctctgcttcccgggttcaagtgattctcctgcctcagcctcctaagtagctgggattacagacatgcaccaccatgcctggctaatttttgttctttagtagagatggggttttaccatattggcaaggctggtctcaaactcctgacctcaaacaatccacctgcctcggcctcccaaagtgctgggattacagatgtgagtcaccgtgcctggctatgtttttaaaaattgataactgaatcttgatgatattgtgttataaaaaatgaatcaagagagaatccaatttactattacagatcttggcattagcaatttatgtttcataaaaaatactacacgtatttccaggaaagggaggtagaaaaaaatacacacaacagcattgtgttgaaactctccatatatcccttaaggacaaaagacttaggtgtaatattgcttgcaataaagtatatatgcttgaaacaaaccaaagaaaacaaaagaaataaaacctaatgtttctgattagtgctatttttgtcctttctaaaaatattctgctcttcctgattacagatttttcaagtattattcatcaatctcctctttcatatattgaaggcaaaggaatatttttaaaagagtttacttctctattgtttttattttatattttattttttgacacgggctcactctgtcttccagactggagtgcagtggcacaatcacggctcattgcagcctcatcctccacaggctcaggtgacctcccacctcagactcctgagtaactgggactacccaccacaccgcaccacacccagctaatttttatatttttagtggagacggggtctcaccatgttttccaggctggtctcaaactcctgggctcaagccatctgcccaccttggcctcccaaagtgctaggattgcaggcattgccactgcgcctggcccagcctccttgtaattctttataacaccttccagaccttgatctctcaaccactgaactgctttgttactgcagattgctgtttataacattttctatttatataaacagaatcctatagcatgtgttcttttttatctggctactttcattcagcactgttagtttgaaattcatccatattatgtatcaatagatcattccttttcattgctgggtagtagtctatgatatggattcaacacactttatccattcctatgttgatagacatttgggttatctcatttttggctgttactaatcaagctgctatgaacattcatgtaaaagtctttgtgtggatatatgctttcatttctcttgggtaaataaatcagactgggatggctgggtcaagtggtaggtgtgttttacctgaaactgctaaacttatttccaaggtgggacaaccactggtggctacattttatattcctgccagcagtgtgccttctagctgctctacatccttgccaacaattggtagtcagtctttcaaattttaaccgttttatttttacttatttaaatctattttttgagacggagttttgctcttattgcccaggttggagtgcaatggcatgatcttggctcactgcaacctccgctcctggggttcaagtgattctcctccctcagcctcccaagtagctgggattacggacatgcaccaccacacccggctaattttgtatttttagtagagacggggtttcaccaggttggtcaggctggtcttgaattcctgagctcaggtgatctacccgcctcagcctcccaaagtgttgagattacaggcgtgagccagcctaattttaaccatttaataggtgtgtagtgccatctcattttgctgttaatttccatttctctagtgactactaatgttgagtatcttttcatgtgcttacttgccatcctcttatctcttttggcagtgtttgttaaaatcttttgcccatttaaaaagttaagttgttgaaggtgggtgcagtggctcacgcctgtaatcccagcactttgggaggctgaggtggatcacgaggtcaggagatcgagaccatcctggctaacatggtgaaacccagtctctactaaaaatacaaaaaattcgctaggtgtggtggcaggcacctgtagtcccagttactcgggaggctgaggcaggagaatggtgggaacccaagaggcggagcttgcagatcacaccactgcactccagcctgggcgacgtagcaagactccgtctcagaaaaaaaaaagttaggttgtttattcttaagctataaggattgtttacatattctggatgtgtttttcgaagagcaaaattttaaattttgataaagtacaacttattttttaaattaattcatgttttgtgtgttgtattttaaaaatccttgcttcctgtgtgtatcctacatttggaaaaaggaaaaagctttgccaaagctaaggtcacttaaaattttcagtatgtgatttttatcaaataaaatcttggcatcatcctttttaagtcccgttgaagcacaaggtttgaaattttttttgaaaaatatatgataaaaaatttgctccatgatttaataatactgtggttcaaaatgagaaacagcaaattaaatgctaattataaatttaataccacggtatacaatcaggtacctaagagttattattttatttattatttatttttgagatggagtctcactctgttgcctgacaggacaggtatgcaccaccatacccggctaattttttgtatttttagtagagacggggtttcaccatgttggtcaggctggtctggaattcctgacctcaggtgatctgcctgcctcagcctcccaaagtgttgggattacaggtgtgagccaccgcgctgggccctaataattattttttaagtatgcttgttaccagaagggctacctttgtatgaaaagaaagacatttcagattcttcatgtttttatttctctcagaactttaaaatgtgaacattcgataatctagccagtctttacttccaggtaacttcttcactgggttgcaattccctgtgtggaaagcaaaaaaggaagaaatggaaaaactgtaaataaaactgtgatacgagataaaaggggaagtcagaagaatgattgcaatatttcattttcttttttttttttttttttttgagacgaagtctggctttgtagcccaggctggagtgcagtggcacgatcttggctcactgcaaactccacctcctggcttcaagcgattatcctgcctcaccctcccaagtagctgggattacagctgtgtgccaccacaccgagctaattttttatatttttggtagagacggggtttcaccatgttggccaggctggtctcgaactcctgacctcaaggaatccacctgcctcggcctcccaaagtgctaggattac

SEQ ID NO: 1037 - DNA, 26214 bp, Homo sapiens
tctgtcccccatttccctgaagttcctttctcagcccttcattacagcagtttggacatgcctctcccttgcttaaatacccttgagcctcctagacccttttttgggttgttggtgactcttcagcatggtgtgccatttcggtccccaggggattaccccaactatttagaattcttctttgggtccccaggcccttcctttcccttgcttgcaccttctctactgggactctgcctaggcctaattaatctctggagctaaagagaggcaggcacagaacatcttagcaaacgtggttgcacattttctgagctaagtaagctaggctgattgcaattggagccagcaggagaagggcaagaaggggccacgggggcaggagggggttttgggggcagaaaggtgggagtggtgagcagctgggcaaccatgccggtgctgggggagttgccccaggagctgcaacgtcagctagctgagcagaggagtaagtgggcaacaggtgggacagccatggctgagtccgtggtacattcagctgtgatgggcttactgctcatgaccagtgaggtagggagactagaatacctagtgaggggaatagggtagagtttggggatgaaacatgcatgggatgggggaggcagtgggcagcatgctgttgaaaggttaaagtgccaggtaggatatataggaacttgccgattgtactctgaccttccaggctcatcacacactccttctgggctctggtcatgttggccttcgaaacctgggaaacacggtgagagctattctcctatctttcctctctaaaaggaatgtgaaatggtgctgggggtggggaaaacccacgagcttggggaaggcatgtggaaggagagctctgaagctcttctaaggcttcctgggcagtggtctggagagataacagcagtgtccctactgctccccagtgcttcctgaatgctgtgctgcagtgtctgagcagcactcgacctcttcgggacttctgtctgagaagggacttccggcaagaggtgcctggaggaggccgagcccaagagctcactgaaggtggggcaacaactcctgctccctctgttcaagtccctttttccccaaccacttgcaggtccatctgccactggtggtggcccccaacccttaaatctggcagttgtatctacttttcccagtgcctactttcctaaaggttattttctaccctctgagccaccttttgcttgcctcttccagacattaacctttgtttgccttccccactcccatcccaacagcctttgcagatgtgattggtgccctctggcaccctgactcctgcgaagctgtgaatcctactcgattccgagctgtcttccagaaatatgttccctccttctctggatacaggtgggagagctggaggctatgggatttctctctggccatgtctgggggtagggccaagcaagggccctggcagcattgttctgagccttgagatgttcttcatccaggaagtggggaccaatatctgggcagggaatagtgtctgtggactaggagaggagtcagttgcccatactctttgtctggctgtagccagcaggatgcccaagagttcctgaagctcctcatggagcggctacaccttgaaatcaaccgccgaggccgccgggctccaccgatacttgccaatggtccagttccctctccaccccgccgaggaggggctctgctagaagaacctgagttaaggtaagggtcgttccctctacctcctttccccgtagtttatcagcatcattcacacttcatagaactaaactagtaaagattgaagatgtagggtccagggaaaccctttagtatagaaaatagtatgagaagcaacatagaagtagaaggaaggaaggaagagggggagtctaagggagcagatggaggcagaagatcatgctagggatgtcaccaaattgaagaaggggataattcatttacaggtagaggaagacagcatattcttcccttatgtacattcctttcttttcctctcacctcggatttccctagaaagttcattgaggcattattcttttgacttttccttgaaatttagggaaggagcaggggtgtggatggggagtagggctctgtaggttgtttcagtgggtgttgggggtgcccagtgttcctgctgtctcatgggtgctccccacttcctttgatctgtggtagtgatgatgaccgagccaacctaatgtggaaacgttacctggagcgagaggacagcaagattgtgggtatggaatggggcaaagcaatgagggaaaattagtgtgtgaggggggtacaggcttggggggaaaaatcgatactatcaaggggtatgggaacaagactggatgatgcaaatgtgaagctgtgtgaagagttgattaggagtgttggtagtgggaaaggaagggtcaagcaaaggggcaggaagagatggaaatccaagaaatcatctcataacatccaacaatgaccttttctcctgtccctgtgcttctgtctagacctgtttgtgggccagttgaaaagttgtctcaagtgccaggcctgtgggtatcgctccacgaccttcgaggttttttgtgacctgtccctgcccatccccaaggtgggattccagaggattccggggtggacaggacaggggctctgtgacccaagcctacccacccccagagtgtgggcgggaaccctgtgggtttctggagcagaactgaagcctggattgattgagaagagttggaaaaggaaattcagaacatgttgacctttcttccccttttcccccagaaaggatttgctgggggcaaggtgtctctgcgggattgtttcaaccttttcactaaggaagaagagctagagtcggagaatgccccagtatgtggaggttcacaagggatacagtaagggtgggagacctggggggactccatgtggataaaagggattgcatgatgtcttcatatggggaataatatttatgtatctgggtttgtgttggagtctcagatctgttctagtactcctagagcaaaggggagaagccaagaggatccagctgtaatgaagagcatactaaatttgtatgtggatcggggtgtcagaaaagccaattgaggttaggagcatattaacctaacactgtttgccatttattcaggtgtgtgaccgatgtcggcagaaaactcgaagtaccaaaaagttgacagtacaaagattccctcgaatcctcgtgctccatatcctaatcttcagattcttacttctcttaggatacctcccatacattctctttcctccatgtttccagagaattgaattttccttaggaaaagtctgccacccacttttccacaagatgctcccagtgtgtcgggagtggggagaggacagctttcaggatagaagaagttcccctcagaggcccactgcctcccaaatgctccttaaccagggcttagatctgaatcgattttctgcctcccgaggctccatcaaaaaaagttcagtaggtgtagactttccactgcagcgactgagcctaggggactttgccagtgacaaagccggtgagtctggtggggaaagtcctaaggagccaaaggagtgggggcacagctctgattatagaacttgatcatctccaaccccgcaggaagtcctgtataccagctgtatgccctttgcaaccactcaggcagcgtccactatggccactacacagccctgtgccggtgccagactggttggcatgtctacaatgactctcggtgagaatagcctcctatttacatcctgccccattcccactcagccctgacaccctccccttctatgaagctccaggagagcagagtgccaggtgaaaggagaggtggaggtcttgcctgatcatttcctggatgctctgaggttcggtcttgtagggagaagggagtaaacaggaatgaccacaaccctttcccgatctccttttttcctagtgtctcccctgtcagtgaaaaccaggtggcatccagcgagggctacgtgctgttctaccaactgatgcaggagccaccccggtgcctgtgacacctctaagctctggcacctgtgaagccctttaaacacccttaagccccaggctccccgtttacctcagagacgtctatttttgtgtctttttaatcggggaggggggagggggtggttgtagctccattattttttttattaaaaaatacccttccacctggaggctcccttgtctcccagccccatgtacaaagctcaccaagcccctgcccatgtacagcccccagaccctctgcaatatcactttttgtgaataaatttattaagaaaaaatgatgtgcttatttgtatttttgcttagggggtgatagagaactgagccaaattggagtcttcttgggacccaagttccctctctaacaggtgggggcgctctcagagccgagggggaaggtttcggggatggtgctggacccggacctgtgtcccccagcagtgaaggttatgtactgggaggaaaagaggaaaggcatacttgagtgaggctgcgtgcaggctctggggcgactggtttggtcggcgatgggggagtgccactgttgacaaacactgggtacgttgccgggcggccctagctcccgtaggcccggtctgttgctaacatcaaggagctgtttatggagccgcctccccgtggactggccttaagtgtccctatctattctccctacgaccaaagctcctgcggccttccctctagggttgtcaccctagctggacctggtaagcttgtgctggggaacgctaactccagcattaagcgctcgccgcctcggtcctgaggagggcagtgacgggtacggccgctcactcccagctcggcgctaacacggttaacctccagctcttacagctgccgtcgctccgcctctgccagttcaatgttttattggtgaacgtgatccggggccttccaagtcccgccaatccagatgtaggagaggtagggttaggcgcgtgccgcgagaacagagtggacggagcgtaggagagaccgaaaaggctgggggtgggagtagcggatttgaagcacttgttggcctacagaggtgtggcaagcagagcacctcagaactcaggcgtactgcccgccgcccgagccctgcgagggccgatagcgagggtgtggcccttatctgcacccagcagagcgccggcggggtacggtcttaggacctcgatctccttctccctcattttctctcatccctacctattgtgggtgagtcctggcccctggacggggacctcgctgttccaccagcccatccgtgcacacttagtttcccctaaagcagtgagtggccgggatagaactcaaaaccggcggggcttctggagcgcaggttgtccccggtctgcctgtccatatcgccccctttcccccaggtttccgcatgggccggaccgtggtcgtgctgggcggaggcatcagcggcttggccgccagttaccacctgagccgggccccctgcccccctaaggtgagtgctccacttgtgccagagggagcttcatttaatgctcttcccatttccatcaaaagctagatggatcctggccctctgaatatgcctcttcccctcccctcctgacctctcgccggcggctacaggcggtgctgcagtgtctctccctcttgtcgccaggtggtcctagtggagagcagtgagcgtctgggaggctggattcgctccgttcgaggccctaatggtgctatctttgagcttggacctcggggaattaggccagcgggagccctaggggcccggaccttgctcctggtgagaggcttgtgggatgtctaggagaggttgtggagggggcttccattggggaatagagtttaggggaggaagtatgtttggtgggtcagatcttcccttagtttctcctcttctgagggcatgtggagagcaggtttctgagcttggcttggattcagaagtgctgcctgtccggggagaccacccagctgcccagaacaggttcctctacgtgggcggtgccctgcatgccctacccactggcctcaggtaacaccagcacctccgctccttttactgtgccctcatcctcatatgccttccatttctttcttcttttctttttttttttttttttttttttttttgagacggagtatcgctctcgcccaggatggagtgcaatggcgcgatcttggctcactgcaacttccgcctttcgggttcaagcgattctcctgcctcagcctcccgagtagctgggactacaggtgcctaccaccacgtctggctagtttttgtatttttagtagagatggggtttcaccatattggccaggctggtcttgaactcctgaccttgtgatccgcccgcctcggcctgccaaagtgctgggattacaggcgtgagccaccacgcccgacctgccttccatttcttcatctccctgtcagccttcccagcaaaaggaagccaaatgagtggaaatgaccccagcgcctggagctggggaggtatgtcaggagcttccccctcactatgcctttctccatgcagggggctactccgcccttcaccccccttctccaaacctctgttttgggctgggctgagggagctgaccaagccccggggcaaagagcctgatgagactgtgcacagttttgcccagcgccgccttggacctgaggtgacacttgcccagaggccccaaacctcttccctcctaaaccagctgcagagctccctgttcaaatctaccacctaggggctcttctgtatcatttggggatgccctcttctcttcataccccaccccctcataattcccaaaactcattattgggagtgaaggccttcatttccatccgtcacagtgggaatgtcccccaacccaaaccctatcccaccctcattccctaccaaataggggctgtggaaatcagtcagtgtagattattttttcgctccttagtcctagtctcacccttaaggtggcgtctctagccatggacagtctctgccgtggagtgtttgcaggcaacagccgtgagctcagcatcaggtcctgctttcccagtctcttccaagctgagcaaacccatcgttccatattactgggcctgctgctgggggcaggtgaggggggattgattcagagggtgaaaatattaagtactgccaaagtgagggagtggggacaaggggtgctattcaatgattctttttttcttttttgagacggagtcttgctctgctgcctaggctggagtgcagtggtgcaatctcagatcggctcgctgcaacctccgcctcccagattcaagcaattctcctgcctcagcctcttaagtagctgggattacaaacatgtgccaccactcccagctaatctttgtatttttttgtagagatgcagtttcactatgttggccaggctggtctcaaactcctgacctcaagtgatccacccgcctcggcctcctaaagtgctgggattacaggtgtgagccactgcatccagcctcaatgattcttctttgcttcctctgcagggcggaccccacagccagactcagcactcattcgccaggccttggctgagcgctggagccagtggtcacttcgtggaggtctagagatgttgcctcaggcccttgaaacccacctgactagtaggggggtcagtgttctcagaggccagccggtctgtgggctcagcctccaggcagaagggcgctggaaggtaggggaacccctggagtgtaatgaacctgtcagtgtttccatctttatccaagtggcttaactaggccagggccgataggactggagttcctcattgtttttgtgccttagaagctacttagacatgggctaccccagaatcctaggccctatttgtgaaccttcctcaaagagcctatgcaagtctgtggatagaagtagtacttataagtggcttagagataggggaaagaacccagcttcactgaacatttcagaacagccacactggcctgtctggtccacttcctggagtacacagaggaatgattttttgtgaagtctacatagtcacccaatctcttcatcctgggtcagtacacagtctccccggccacatgggtgcctgggaaactgagagtgaggcaccagaagtctcttttcactcatcaaattctcattttctgggtctctcaaatgttttcatgctctcaggtatctctaagggacagcagtctggaggctgaccacgttattagtgccattccagcttcaggtaatggaatagccaccttccccttccccaacccctaccagtgagaagcaaaagctataccttcctgggtcagcaggaccacaccatgcccctgaactggtcatctctatgggagtctaatcccaaagaggactgacaactgtaatgggaatgccttctgagtcaggcctctgcctgatctctagtgctcagtgagctgctccctgctgaggctgcccctctggctcgtgccctgagtgccatcactgcagtgtctgtagctgtggtgaatctgcagtaccaaggagcccatctgcctgtccaggtatgataaagggacggagaggctgggcatggtggctcacacctgtaatcccagcattttgggaggccgaggtgggcagataacaaggtcaggagttcgagaccagcctggccaacatggtgaaaccccatctctacgaaaaatacaaaaattagccaggtgtggtggcttgcacctgtaatctcagctactcgggaggctaaggcaggagaatcgcttgaacccaggaggtggaggttgcagtgagctgagatctcgccattacactccagcctgggtgacagagtgagactctgtcccccccacccccccaaaaaaatgggaaggagagacagcctcagctagagccctttccttctgacgcatgaatgtccttctctccagggatttggacatttggtgccatcttcagaagatccaggagtcctgggaatcgtgtatgactcagttgctttccctgagcaggacgggagcccccctggcctcagagtgactgtgaggaggaggaaactttgcctagtggcatttccagagggctcctctgtgctccattgtaggcaaggccagactgatcagtgctatattccctccttaggtgatgctgggaggttcctggttacagacactggaggctagtggctgtgtcttatctcaggagctgtttcaacagcgggcccaggaagcagctgctacacaattaggactgaaggagatgccgagccactgcttggtccatctacacaaggtaagttgggataaacttccctcagctctccactgaaggccttgaagacagagactggaacatttgtcactgtatgtcagccaaggcctaggacatcaataataaacttttccctgcatcctctcctctcttctcagaactgcattccccagtatacactaggtcactggcaaaaactaggtaagttgggaaaacagctgggctgaggagggccaaggacatcagacccccagctaaaacattcctttcatcctttccttccagagtcagctaggcaattcctgactgctcacaggttgcccctgactctggctggagcctcctatgagggagttgctgttaatgactgtatagagagtgggcgccaggcagcagtcagtgtcctgggcacagaacctaacagctgatccccaactctcattcatgaaaataaaaattgctggagcttggcttggtctggctgttctatcacctataggcataagaatgcggggcagcaaagaggcaaagtgtgcctgggatgcagaaagcaggagcagatgcgagacaaagtcctttattagaaaatatatcaaaatcccagccccctgagccaggaccagaagagggagctattccagcataggcagaaaatgcccagggaggggcttccttcaccaaacaacttcccgggaaccataaatagaataaatattcacagaggtccgaggagaagccagatcactcttctctccatggaagagggaggggcttggggtccagccctgctcctactctaggggcagggactcctaggaatcgtcacataaaatcatgacatcaaggattcacagtcataagccctacaggagaccctagagagagggacccctcaggtctacaggagcccagctccagtccagcagtgagggagaggcccctaccccctagcacggcaccagagttcagttccctcacatccctctgagaacagtgaggagctgagggtggggagaatacaaccccatgaattcggtttcatgattaaggtagacaggaaggaggagtcagtgtgaacctcggagggctgtgtggttggcagtagatagaggcccaggcctggctgggggccggcgttgcagcatctcttgacggaaggcttgggaggaaccaggtgggtaacgtggcccagaaggagcccgaggaccccgagggtcagtcccaatgtctgctgtgatgttggtataaagaggccccagctctcgagccagcaactggtatgtcagtgagttcatcccatcttgcgtccaggaattctgggtacggaccaggaggtcaaatctgagggttagaggttggagactaagacccagaaaggaacagccagaaatctagggacctttaggattttcctggctaggggtacagaaccctgaggatccagtaacaattcccaggcagtccttccttcttcctacctgtggggattttcctcattgcccttatctcctcggtgcttcaccatcttatagtgtcctacagatgtggggggccgagagatcttcatcccagccaggcgcaccctatgggaaaagtgagggtatcatgggggatccagagtagagaaaagcaaggaagggattaaatgtttctgtacacacaaaaaaacaactattacttagtaggcaaaagaaaaaaaaagcccaggacagaagtcaaacagaaagaaggaaatggctgaagagaatataaaagctggatgtatccaaatcctcagggcccagtgccagtcaccctagggcctttaaacagttggcaacctattcccttggcttcctaaagggctcctaggagctgcccttgcagtctaggaaggacgcagagagaggccattctgtcaaaagaataagagaagactgggagttgctgagaatcttagaatagtgactgagctaccccagcttctctcccacatcccccatgttaagaaaaaggtaggccaggtgcagtggctcacacctgcaatcctagcacttttggatgccaaggcagaaggatcacttgaggccaggagttcaagaccagcctgggaaaataatgggaccttgtctctagagaaaaagaaaaaaaaaaaaaacgaaagaaagaaaagaaaagggtagaaccaggtaatcaggaccttaaaagaaacaaactccacttctgacacacagaagcatggagtgcagatggcctgggaaggaactagaagaatacttatgtatatttacaattcactgggtatttcacacacatacagaggatgagaattcacagagatgtcatcacagaggacacagggggaatggaggcaattggtcctgcataccaagcccaaatattcataccacagacatgaaattgggtcagctgaggctgaaggtcagaatgtttcacatgctaaaaatgagttggccctgtgccaatggcacaggccttttacaaagcgattctgggaacatggagcagagcccctctctcctaaccccataggaagtggcctggctggaaccccagcagaaggcaagactaagctgtctctgggcccctttccagttctggaatccgacgatactatttcctattgatcttatgtcctctcccaagaacaaactaaccaggagactgaaggatgacacaatgggcagtagcatgcaagcctgacctgggtatcctaaaaagactaagggaaaggaatgggctcagtgcaggaccagggagctaaaggttagtgttgaagggctatggtcaaaggtggtcttagaggacagggatccagactggggtcaggagggaggaagtggcaggaagtctgacctggtagcaatgtcgtcatcctcaccaccccagccccagtattcattggggaagccattcatcttcaggtactggtcaggagtaagtgctgagactcctccgaagtactgggggtacgggaggctagggagagaaagatccttgcataccccgagtcttctggggacacatccccaaccacaatccgcttggctctcctccttccacaggatagtaggcttccctgtttcccagtacccttccatgccctctacctgtatccaaacttgttcatagcaacggcaacatggcggggtccccgggggtcacacacatacagattgtggtcattttctggcaagaggtccacatcgtgcaagaacaggcagtcccactcttcatcacgcagggcctctcgcaccccaacgttcaacagttttgccctgttaaatgttccatttccagcctggaagataatggaggggaaccagactatgtctgtaggtggcacggagaaaagggggctaaagaataaaagtgaaggccgggcgcggtggcttacgcctgtaatcccagtactttgggaggccaaggcaggcagatcacaaggtcaggagattgagaccaccctggctaacacggtaaaaccccatctctactaaaaatacaaaaaattagctgggcatggtggtacacgcctgtagtcccagctactcaggaggctgaggcaggagaatggcgtaaaacccgggaggtggagcttgcagtcagccgagatcgtgccactgcactccagcctgggggacagagtgagatctcaaaaaaaaaaaaaaagaaaaaaaagaataaaagtgaaaagagggaaatcaaagtggggtggagggcaaggagaatgaaaaagaaagactatctttttcatttttccacttagtcatttgacaaatcttgcttgtgtattggtatggacctgatacttaagatgctgctgtctaacatttaatcctgacaattggcaaccaacaatggtgtggtgtggaacagatggtatattagttatcttatgctctttcctcatgttagatgtttaagtatcttgctcagagtcatacatgtaacaagtgacggaactagaattttagccctattgtgtccaattccaactctgcacaagccattcaataaagaaaaaatcacaggagagtgtaggacagtgggaataacctaagcagattaaggaaaagtatgggactaacaaagttggaagagcagtgccgggtgcttctccacactctaacagtctggccttcttaaaattattctagggacccatttagatgaaagtgaagtggcatgtgcttgaggcttccttagaagaaagtcagtcaaaatgaggtggagattgggggtacctggtggatgacatagatgccataagcaagctgctggcgctgcaagaaggggtgcaggtggtagagcagcaggcgcaggtggtgctcccgggcacgatgaggcacaatgatggctgttcgggagcggggctcacaacctgcagggcggtaccggccccctggttctacccggggattccgctccacaatctctgccagtgatggcactgggctaaaggacaccgacacaggacccactgttgggaaggaatggcaagtagagggatcagaggggcaaagagaaaagaatcaaactagggtttgggaatacctctgacactggcagtctggttctggggcttagttctcagggctcactcagaaatctcgcatgccttggattacctatcactgggacagctctacaaaggctggaaggtgcaggatccttacctagccttctcttcttattttagggttgcctaactttctcctgtcttacagggttggaagctatagttgaaggctggagagacttgcaactaattaaaccagggctcatctacaaggaaaacaattcctagcctggggcaggaagagcccataaagggacaagcagtagaaagtggaaacccaatagtctaatctaaactcccaattcagagtctactctatctcaacctcagccctctatctcaacctcagcctacctgcagcctcagcctacctatcctcttctaagttccacttctgccactccatgcctccctatccccaagcctccctgtctccgcaccttgtccttcctttcaccacctccttcctcctgcacttacctaagagaggagatcgttctggacagtagggcagaccttgaggagctggaggaccccctggggccccaggcaggtgactgaggttactgtagacatcacgagggtgagaatagtcaaatgtcggtccctgatctcggccaaatagggcactgagacttcggaagccccccagtgacaggtacatcatgacagccagctgggagcccacaagcagggccagcgtgcaaggccgctccagcagcctccgcaacatcctgggggtgagatctagggagggagaggggaattctgggggtaggcaggaagagagcaagccagcagagaggtcagtaggtagggttgaaggtgatgccaggggtaaagaggaaaaagcagaaaacaaagtcacagaagggagcacacaggtgcacagtcacgcaaggaaacagaatgtaaccaccagtaaccctaccacctgtcacttcagcccaagtttcgctctcctctacctccccccaaaccactcccaccatctactgtcagtcctcacccccaaaaatgtttacatcattcaaatctcatgttcatttcagaaagtctctagagaaccccctcttccaattttagaagggaagagatagactcacctaggttcaagctgtcttcttagggatcatgggggctccagggggtcccggggggacagagatgtgaggcattatctaaaattggaaatgtcacagagggcagagaaaggctccatccagcactccagcagcgaatctgggaccagctggaacagaagtggtaaaggataactagctacctgcaccgccagagatcaggatcagggtgaagctggtttcccagcaggcgaagtgaaggaaagtggttggaaaggaagaggaggagcaggagatggtaggtccctcgcctatctcccgtgctaccctggaatgataagtgtcaggttcatacttaaccacccccgtacccccaccccaacaggacagattggggagtggggacaggacagctaatggaaacattgttttcccccagaccaagaaccagttgaagtggcgacagagtcatgacaggaccgtggagtggcctaaggagtacccagggcgaagtaggaaacaggctccttctattcttcatgtgcctgggtgccaactcctcaggtgcagggaccgtgaccacctgggggctgtaagcgaacagccccggagctcggcggagagtagggtgggggtggcgtcctctaccttttctacctttcccctcttctagcgggggtggggaggagggttactgctgaagagaaagggagagggagagcaggggcagagacagtcaggggtggctggaagggctcacctagaggggcgtggtccgcgctgtggagggggttaaaacccagctctttcggagcacgcccatcctatcccagtctcttgcttttgccctacctactagcaacgtgagcccgcccggcccccgtccatacttccacctaggaccccgtccctgctcaggctcgtctccaggcgttacccaaaacttctcactctctcgaatgcccaaacctttatcccaggcctccgtgtcgacgcattcccagcgcacatacctggtcttttgctgcctgtcgtcaccgccaccccaacagccgggcaggcatcgctgccgccatcttggaagcgggcgctgcgggggcggggtctcgcgtcatggggcggggcctcggggcggagccacccgggctgactaggcacccggtcccagacaccgcgtggccgggggcttgtgagggagcagcgcctgagcctgcccacctggaacgcgttgtaggcgaccccctggggagcgggtgctagggttcaactccactacgcagactgctagtgggatttcatttcctgcccctcagatttgtaaaagcagaagctcaagcccttcattttcctctgggccgagactgatcaggaggctagtgagccggtttctggtgctccgctgacctcgttatcaccttgtggttggctgagccctctcccagtgtgtcagtggcaccccctgcagcctagtgccacttagtatcaattgttccttacgcaggctacagcgttgcggaccgctctagcgcatttttgtattcccgttgtatcccgcaggcctggaaataaaaagcgattagttaataaaacaatgaaacattgaaggtggagggaaagacagcgtcttctttaaagtcaaatgatgtttccccagatattagagtaaaatggatgctccgttaacatgcaatatgtttaccttacgacaaacactaccgcctagcatattgtgttccttagaagcagatattcacgctgaagaagcaatcagagacttgaataactcacagaatctgccccaaaaagcccatggtcttgtgtatcttgtatggagggagggatgtaaacaatataacgtgataaatatgctggcctagaagtggcaactcattcatacgtggagattctagaaaggcttcccagaagtgatggctaatgggaaacctgaaggacttgtctatagcatatccttctgctttaaagattctgttttcatgggagttattttacaattcatgtaggtaactgatctgtatgcaaattctatcctgtctggtagaggttcaattaacctgctgttccccacactgtggggaaaaaaagcagttttggcgtccattttcatattcatttctgttttcctgatccataaatatgtccgttctctagattttctcttgtattaattataacatctgctagtttcttcatgagttaggtaaaataaacacgtgttcattcttttcttaatttcttttttctttactttttttttttttttttgagagggagtctccctcctgttgcccaggctggagtgcaatggcgctatctcggctcaccgcgacctctgcctcagccttcctcagtagctgggattacaggcatgcgccaccacacccggctaattttgtatgtttagtagagacagggtttctctgtgttggtcaggctggtctggaactcccgacctcaggtgatccacccgcctcggcctcccaaagtgctgggattacaggtgtgagccaccacgcccggcctttttgtttacttttttttttttaatttaaaaatttgtgacagggtctcactctgtcacccaggctggagtgcagtggcaagatcacagctcactgcagcctcaacctcctaggctcaagggatcctcccacctcagacccgtgagtagctgagtagctgggacaacagcacatccagctaattgtattttttgaagacacagagttttaccatgttgtccaggttggtctccaactcctgggctcaaactatctgcccaccttggcttcccaaagcgctgggattacaggcgtcagccacagcatcaggcctcttaattttatttctctttttccttccttccttccttccttccttccttccttccttccttccttccttccttcccttcttcctccctccctcccttcgtcccttcccttcccttccttcttttttttcctttcctttcctttttttttttcccaaatacccagtcttcaaggagaatttttttttttttgagtcggagtcttgctttgtcacccaagctagagtgcagtggtgcgatctgagctcactgcaacctccgcctcccggattcaagcgattctcctgcctcagcctaccgagtagttgggattacaggctcccgccaccaaacccggctaatttttgtattttagtggagacgggatttcaccatcttggccaggctggtcttgaactcctgacctcatgatccacctaccttagcctcccaaagtgctgggattataggcatgagccactgcacccggcctatgtgttcatttttatgttggtattgacaaagaccatctccttaaccagactttcaacaggctcctctaaggcctctttttggctaggtcttgtccttatgcgctgtcttgggcctgcctagccagttatagcaagaatcctgccaagtcagtttagggataattccctgcccgcttctccacccttgatagctgatctatctgatcaccctcacctgccttcaggaaagatcctgttaggtcagtttagcaagaatcctcctagccttaatgtaattttccttccatccactgactctgattctgctcattgactattgcaatagtcttccttactgttttaacaagtgtcagaataattttttcttcaacagtttaagggtcataattttaccttcttctgaaaattaccttttttttttttttttgagacagagttttgctcttgttgcccaggctggagtgcaatggcaccatcttggctcaccgcaacctccgcctcctgggttcagccaattctcctgcctcagcctcccgagtagctgggattacaggcatgcgccaccacacccagctagaaaattaacttttaacagatgaatagtgttccaagcagaggaaaccataagtgcaaaattctggaaatgaggaagaaattagggagtttgggaaattaaaactgggcccgcaaggctggacagtagagtgaagggaatgttgagatatgagactggagaggtaagcaaatgccaaataatgaaggactccacaaaccatgctaaaagagtttgggtcttatccagagggcaagaagaaggcattaaagtgctgtaaatagagagtgctatgatcagaactttaggaaatgtggagcactaattgaagtagtcaagaccagaggcagggagactatttagaaagttactgcagaaatccaggaataagatgaagctcatgcagaataggtaatacccgtgggactggagggaagaaagtaactttgggaactttcaggaggcaaacaggacttgaagattgactggatgtgccaagttagggaattggactccaagaggacacccagatttctaatttggaccactgggtggtgccatttaatgagaaacaaaacttaggaagaagcacattttggggaaggggtagagatgacaaactttagacataatgagtttgaggtgcctgtgaaggctcaaaatgagataatgctgggtttaaatacaataccaactttgaaacccattggctgtgtactgagcaatacactctggatttcatctgtaaaatgaactctagccttaaggggttttgtgatcattagaactatggaaaacttttgagcacaaatagaagccaagacaaagccttgattttttttattataattttttttttttgaagagacagtctcactatgttgcccaggctggtctcaaactcctgggttgaagtgatcctcccgctatggcctcccaaacttgattttttgtttgttttacttttattattttttattattatttttagcttctgatatagtataactcaaaaagccttgattttttaagaatatcactgtgtagtggaaaagacagacttaaacagatcattgaaatgtggttcttggcctggcatcatggctcacgcctgtaatcccaacactttgggaggcccagttaggtggatcagttgagttcaggagtttaagatcagcctgggcaatatggcaaaattcccttccaagaaaaatacaaaaattagctgggcatggtggctcacagctgtagttccagctactcacagggctgaggtgggaggatcacttgaacccaggagttcaaggctgcagtgagctgattgcaccactgcactactccagcctgagtgatagagccagattctgtctcaaagaagaaagaaagagagaaagagagaaaatgtggttctcccagaggacccttcctttgagcctctgttcctccatcgcgttctgtcttacaggactgaccctcactttcttttttttttttgggatggagtttctctcttgttgcccaggctggagtgcaacagcatgatctgcagctcaccgcaacctccgcctcctgggttcaagtaactctcctgcctcagcctcccaagtagctgggattacaggcatgtgctaccacgcccggctaattttgtatttttagtagagacggggtttctccatgttggtcagggtggtctcaaactgctaacctcaggtgatctgcccacctcggcctcccaaagtggtgggattacaggcttgagccaccgcgcccagccttcactttctgtctccttctgtatctaaccatcttcttttttagagtcagagactcactctgtcacccaggctggagtgcaatggcatgattatagcccactgcagccttgaactcctgggttaaggtgatcctcctgcctcaacctctcaagtagctaggactacaggtgtgtacctagctaatttagttttttgtggagacggagtctcactctgttgcccaggctggtcttgaattcctggcctcaagtgagcctcctgtgagccaccacaaaggcctatctactatcttctggccattcctttacattaatttgtaagctccctgttttcaagaaccttcccttctgctctgtctcaccctggccacaccctggacttagtcatcacctagaactgttatgtttctgaaaacttaaattttaacatgctggtttccaccacaacatcctgtctttcaatattctgaataaatcctggggcccacactggcccagtcatggcacataacacaatagaagaaacccagtttagtaatcaaaaactaatttaaatctctacttaatttctcaaggaaatatcagagacaggggaaaggggcagtggattaggagcacattttaatggacagcccaatgtctttaaaatcctctgtctcggccgagcgcagagactcatgcctgtaatcccagcgctttgggaggccgaggcaggtggatcacctgaggtcaggagttcgagaccagcctgaccaacatggtgaaaccctgtctctactaaaaatacaaaaattagccgggtgtggcagcacacgcttgtaattccagctactcgggaggctgagacaagagaattgcttaaacctgggaggtggagatggcgccactgcactccagcctggaaaacagagggagactctgttgcaaaaaaaaaaaatattcctctccctcttccattcaacattttctacttggatgttatttcttcccaaaactatcccttccaactcccctcagcctacactgttgttccagatctctctcccactcagctctttctcttaccatattatcctccagtttctggttttctggtctgttctctttacctctttacctcactttggttttgtataacatagaagaacctgaacctgacctagcaaacagaaatcatgcccccctgacaccctcccaccatccatgggttccctgcagtcttacagctttcttttttttttttggaaacaagttctcattctgtcacccaggctggagtgcagtggcacaatcacagctcactgcagcctccacctcctgagtttaagtgatcctcccacctcagcccccaccccattccctgagtagctaggactacaggcgtgcacaagcacacctggctaattttttttttttttttttttttttttttttttttgagatggagtcttgctctgatgcccaggctagagtgcagtggcatgatcttggctcactgccacctttgtctcccaggttcaagcaattcttctgcctcagcctcccaagtagctgggattacaggtgcccaccaccgtgctggctaaattttgtatttttagtagctatggggtttcatcttctatctactaggctggtctcgaactcctggtctggtctcgaaccagagaccagattctcaaaccaggctgatcttgaactctgacctcatgatccacctgccttggcctcccaaagtgctgggattacaggcatgagccactgcaccctgcctttttttgtattttttgtagagaccaggtttcatcatgtcccccaggctggtcttgaacttctggcctcaagtgatcctcccaccttggcctcccaaagtgctgggactacaggtatgggtcactgtgcccagccttactgctcacttctagaaggagagacaggcacctcctccagaaacacttctgtggcctcatattctgtgctaggtgcccctccttgatcatggcacctatcacagaagtctgaaatttttgtcctacttgactgtctcagccaccagattgtgaactctgaggattaggaccatgtctttccttttatcatcccttcaatgtaagccagaactttttgcacaaatttacaaaatggcccttagatctgacctagacagttccttgatataactgttttctcacgtgaatgcaggggttagaagtcagggagcagacaaaggaagagatataaggaaaggagaactggcctttattgaccacttactaaaagccagacacagtgccaaacatttacatcatcatattcttaagtctggacctctctataaggcaggtaatagtacaaacgttttgtaggtaaggaaactgaggtttacagagatcaagtaattaaggttgcatcattacaggtaagtaagtagcaaggcttagattcaatttgactccaaaaatccatgtcctttccacatgctgtggaatgtttacaatgtttacaacccattggcttatttattgaacaaataaatgggataaacagtcaattctcaatgcacgattaggtcaattaatatcttttactcttcagatccattttcaggtgaaaattcttacattttccgctccctactacttatttgcatctatattatcaacagaatgtgttggccaggcaccctggctcacacctgtaatcccagcactttgggaggccgaggcaggcagatcacttgagcccgggagttcaagaccagcctgggcaacatggaaaaccccgtctctatactaaaaatacaaaaaattagctgggcatggtggtgcatacctgtaatcccagctacttggcaggctgaggcaggagaatcacttgaacctgggaggtggaggttgcagtgagccgagatcacgccattgcactctagcctgggtgacagaatgagaatctgtcttaagaaaaaaaagaagaaaaagaaaggcagggggggaggggggagggatagcattaggagatatacctaatgctaaatgatgagttaatgggtgcagcacaccagcatggcacatgtatacatatgtaactaacctgcacattgtgcacatgtaccctaaaacttaaagtataataataataaaataaattttaaaaaaaagagagaatgtgctagtgtgtctctgtgaagttggatgtgtgttatgtcaatgtgtcactgttggtgtgggtgtatggtgcctgtttgttgtgccaagactgtgagggatacttaatctacttcctcccctccctttccttcctaatgctacttaagtaccctgggtctgtccccatgtaagatcctgcctggggaagttgttcagtgttgttgctcccccgccttccctgacccccctctttctgagcatttttagcactcgtggtttcctccagctgtcatctggtttctcgtggtgccaatgattttggcttggccccagcaacagtcaatggggaaggtactcaattggttcagaaacatcctctcagccaataaaatgttaatacattgaaatccactttcttctcccttcctcccccacaagccctgaccaatgagatgctagttttgtcacttactgccaatctggtattttagaaaacaaaatactgtaatactgtatgaagattacagaaatgagactagagatggaagagaagtgtaaatgccgattccacagcacactccaggaaccctggctgtcccacctccattacaaaaatagtggctggacaaatgtccagatttcctctgtttgaaccacagaagcagagaatctcaggggcagaagggactttaggaaattggcccaacttattgcttcaacttcctcccccacctcaaacacatactcatgcacaacacttgccatctcataaaatggttgtccaaactcttcttgaacttctctagggacagggttctaatcccttgtcattcaatgccttttctttttccatttcctcttttcatctccaggaccagatacttgaattgtttcagtgcctccttacttcctgttattactgtttctgttcctccttatatatctacaccccagctcaggcccacgagggcaataagtaggcagatgggaaacagagctcactgtggctcttacagggagatatgtgcccccccacaatcccatccctagcaagaacttgttggactcctattaggtaaagcctacctacaatctgggtcttggaggtgtggtaaggcagagaccattccagaaaagggtcaggccttgcctgggattgagggctgagatgcccatcacttctcttcgatgagctagctctctctgcccctctttcactctagctcctgcttacttacccaatcacagaggtggcccctaagctcagtctcattttcagaaaaacttacttatgccagtgagaaccctacttggtgagcgaagggctttctcttaaaataacaggcagaaaagtgatttaaaagtgaatctacacctgtagtccaagctacttaggaggctgaggtgggaggattactcgagcccaggagttcaaggctgtagtaagttatgatggtgccactgcactccaacctgagccacagagcgagactgtctcaaaagaaaaggccaggcatggtggttcacactggtcatcccaacactttgggagatcgaggtgggaagatcccttgaggccaggagttcaagaccagcctgggcaatatgataagacctcgtctcaaccaaaaaaaaaagtaaattagctgggtgtggtagctcgtgcctgtagtcctaggtactcaggaggttgaggtgggagggttgcttgagcctgagagttcaaggctgcagtgagccaagatcacaccactgtactcctgcctggtcaacaaagggagaccctatctcaaaaaaaaaagtgtatctccatgaacattaaaggaaagtgagaagggctatcatgatgacctgttctccagggcccagcccaaggtagccctccataaccctcatagtccattcagttcagggctcattaggctcttatcttctagtcccttttactgtcccattgcttctgtttgcggggaaggtggagtgggagcagtatacaacctcccctgcccagaatgcagtgtgaacccctttaggacagtcgtatatattgtttgtatttgtaccttacatctacttatcacagaactctgctcattgtaccatcaactcatagtatcaaggtccataaacatactatctgtggtctcattttgcaaactagatgaaacgagtaaagatcactattgtcttgtctccatcttcttcagcctggttagtaggaggaccacaggaagggccagggggccaagcctagcagggagaaccgtgtttactggagagaagagagtgtgggcagtcttttctcattgctgcag

SEQ ID NO: 1038 - DNA, 34780 bp, Homo sapiens
tccggggcgagcgtgagggccaggcagctcagccctctaacacgtctcttctcttttgacctcctcagccaaaacagagtggagtacgagaaaagggtccgagcacaagccaagaagtttgcgccctcataagcagcgaccttgtggcatcgtcaaaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccaggtcagcatctcggttctgcgccacttcctttgtgtttatatggcgttttgtctgtgttgctgtttagagtaaataaactgtttatataaaggttttggttgcattattatcattgaaagtgagaggaggcggcctcccagtgcccggccctccccacccacctgcagccccaccgcgggccaggaccaggctctccatctgcttcggatgcacgcaggctgtgaggctctgtcttgccctggatctttgtaaacagggctgtgtacaaagtgctgctgaggtttctgtgctccccgcatctgcgggctgtagagcgctgggcagctaagatctgcataggtcgggattggcatcgagaccctggcaactgcaccggtgccagctgtcttgggggccacaaggccaggtccagaccagggctgggggctgcctgaggactcctatccgggcagcctgctggcgggggttcccctcttcagtggccaggtcacagggatggagctgcgctgtgcatagggtgccacctcaggtgtctgtcccttgtgtcctcaggaggcagccttgctaccacccgtggcaaacgccaggtgctttttctgggagagcccacagccgtggccctccagggcttccccgacccttagcgccaggtagagggccctgggcagcctgtgtctggaattcttcgtcctgaggccacctgagtgtggtctgtcctggggaggctgtgcgcctcagcagccgtcctgacgctgagccctctgcaaaggttgggccggccaggcctcttggggctgcctgagccactgcaggaagtggcctggctgggaagttgggtgccggtcacctcccagcaggaaggcacagtggacagagatgggaagccctgggggacacagcccggtgctcccagccctccaacctctggctcccaacccagtctccccatcctagcgagcttggccctcctcagtttcgtttcaagccttggggctggagctggccctgctgccctggcaccccccggtggctggagctgggtccccgtggcccaagtgcagggtcccaagagggcagggcggggctccccaaaggagcaaagaatgcagggagggcggtccagggccctgggaaggggagctcggcaccctccaggtccgtgtgggactccagccgctgttggctgggaatcgaagttagaggtgacttccaaaggccccccgagccggcagtgccccccaccacccctccagcgactctgcggtgccagtgccttgttggcttttccggctacgcaccctgcagtcactgagctctcggtctgacgtctgatgtttgtggtttgtttataacacggggccttacctggggaattcagctggtttgaatatttgtagcccgctcccagaatgtcttattttgtaatgactgaactacatttagtaatagttacacatgtatatggttaatacatatggaaattcaatatattttgtagttaacgtattctgaagtaacggatgtttctcgccaatcgtagtgacttcagctaacgaaatgttcttttgtagtaccacggtcctcggcctaacgaaggacgtgaaccttgtaagaggagagctctgaaacgcggtcacctttgtttagtggaagggaaagtgtgttcccggcatgaggtgcctcggaattagtaaagaattgtgggcaatggattaaccactgtatctaagaatccaccattaaagcatttgcacagactgcggcctgccgggtgtgtcctttcctgccctgtccctggctcccctgggctttgggggtgggagcccactggggccacagggcgtcccccgaccccaaggcccagccctaccccccagggctttgttctggtcctgcttccagccccacgtcagcccctccgggtgacatcccctctagccagcctcggggtctcttcacctgcacctccctggcctgctctacgggtctcctccctgggactcaaggctgctcttgctgtccctggcaggggacctccttggggagcagggaccccaggtgtccagagagctctcctcacagggcccatccagggctggctggagccaccaggtaggagtctggtgcacaggtgcagggaccccagccccctgcgggacgggctagccaggcctgagctggcgccgggggagacctcccttggctttggcagtcgggctagccacaggtgccctccgtctctcaggtcccttgggacctgggtctggctgggccggaggaggctaggagacttggccaccatgctggccgctgcccgcaggaatgcaggctcctggccaggctgctggtccccaggtcgcctcaccttcctggacctgaggcctggccccgccatcactcactgggatccgctgatgggaagccttcctcatgattaccatgacgacaagttgccaggttggagggccttgcactgattcggactggctggagctggtttgagccagctccagcagggaggggcctgggagtgctgggtttgggatccatccccagccgaccctgattctgggtctgggagtgtcctgaagcacctgctcaggagacacagcctgagatccccaggcaccacctggtctgaggaagccattgggcccagttggggtgggggctcctggctttggcccattgggtgggaaggggctggggcaactggtcccatccaccctgcctgtctctggcccagcctggtccaaaggcttctgcacctgccaggagatcggcttatccggctcttaggaagaaataggaacaggcacaagaaaaccaccgagcacgtgtggcttgggctcttccttccctgggcctctgcccttcctccaggatgccctccgccgaataaggcaagttcccactcctcgatgcgggctgtgccttatttatttatttagagatggagtctcactctctcgcccaggctggagagcagtggcatgatctcggctcactgcaacctccgcctcccgggttcaagcagttctcctgcctcggcctcccgagcctgggctgtgcgtttaaggagggactctgaggccgggcgcggtggctcacgcctgtaatctcagcactttgggaggccgagttgggaggatcacctgaggtcaggagttcaagaccagcctggccgacatggcaaatgcccatctccattaaagatacaaaaattaggccgggcgcggtggctcatgcctgtaatcctagcaccttgggaggctgatgcggatggatcacaaggtcaggagttcaagaccagcctgaccaatatagtgaaaccctgtctctactaaaaatacaaaaattagccctttgaggaagacgtggtggtaggtgctgtgaatcgctgatccgcacgctcctgctcctgactcaccactgtccgctctcgccaaggaacaagctggtcaggaagccacgcagcagctatggctttattattattttttaaaaatttatttattttttgagacgaagtctaacactgtcgcccgggctggtgtgtggtggggcgatctcggctcgctgcggcctccacctcccgggttcaagcgattcttctgcctcagcctcccgagtgcctgggactacaggcacacgccaccacacctggctaatttttgtatttttagtggagacgaggtttcactatgttggccaggctggtctcgaactcctgacctcgtgattcgcccacctcggcctcctaaagtgctgggattacaggtgtgagccaccacgcccggcctaaaaaattcttttggcttttaaggataccagaaaaacacccaaggagccggagatggcaattcaccaaaattcaccaaattcaccaaaattcaccaaattcgccaaattcaccaaattcaccaaaattcaccaaatctgaatcactctaacgagctacagcataaaatcacttgaaaaggtgtgtgctgacttgatcagaggcacaaaggaaaagaatctcaaagtgaaaggaccggtttgaatcctaccaacactttgagaatcactacaagaaaaactccagatgaggccaggttacagctcacgccggtaatcccagcactttgggaggccgaggcgggcagatcacgaggtcaggagattgagaccatcctggctaacagtgaaaccccatctcgactaaaaatacaaacaaattagctgggcatggtggcaggtgcctgtagtcccagctacttgggaggctgaagcaggagaatggcgtgaacctgggaggcagagcttgcagtgagccaataccgcgccactgcagtccagtctgggcgacggagcaagactccatctcaaaaaaaaacttataaaaaaaaaaactccagatgagcatccataagcaactcattgacttgcacagtccttctgagattgttaagcagattacttccatcagtattgagccaggagttgaagtggaagtcaccattgcagatgcttaagtcaactattttaataaattgattaccagttgaaaaaaaaaaacaaaaaaatacaaaaatcagctgggcatggtggcgggcgcctgtagtcccagctactcgggaggctgaggcaggagaatcacttgaacccaggaggcagaggttacagccgaaatcacaccactgctctccagcctgggcaacagggcaagactccatctcaaaaaaaaaaaagaaaaggagggactctgaagcccccagagctgggaggagtcgcctcccaaccccagctctgcacagaaggatgcacactgagggcctggcctctccctgctgggcccctaaccacagtgagcacagaagcccatctcgctgggaaggggcctctgacacccccaccctcaggctggtgggaggcggggccaggggacagggtgccatcctccctgccatccaagcctcaccgcagcaggggctgtcctgcctgcagggctctggcacaccaatggcctttgtttgggggcttggtaggaccctgtcttgggcccacttctttgtccctgccctgccctggacccctcacagatgctgctactagcacggaggcctgagagaactccagcgtgacactgggtggtcacctccagccggccccacctgtgcacgcgtggcagcaggactcccggagcttctggtgtgggatctggagaccagcatctcaggcatgaggccagacttgggctgaggccctcccacccagagcccctctcttgatggggcaaggaacaggttctggcagtcttcagggtcctccagctccggggcaggcagggtccctggccagagtccctgggctctgaccccacgagctctccaaggaccctgcccttccttgcttgggtcctcagagggaagttgggggcagattctgggaggctgtgcctgcaatttctagggctgccaccagagggtggtagcactgggccctgcgctgtgctcatgagcgtggaacaggaggggctgtctaactctgccatggcctcacctgtgtgcttcagcggctttggcgcctgcgtatccagagcctggtgtttttacctgcccccccatctccgccccccgccaccggcccggccctaaggaggaaaagctactctccctgcctgccagaccctttccagcacaaagtcctgagaatgtgaaaagagccaggcttgaaaaatggcttttctcagctttgcacaagcagccctggtgccccagcagcctcctcaagctctgaccccgtctgggcagggggtctcgtgtcccgacacatcggtgggaggtgttcctgcacctgcgccatcccctcactgtccccggagcacggcagctgtctgcactccggtccgaaggcagagacgccagggtagccccttcagagtgaggcctggggctcagggtggggagggtgggcggcccactctcctgccctctctcttagtgggaggggactcacgcgaggatgggcttccagccccaagctatggaaaggtaaattgggtcactggaggggccggagttctggctgggtggctgcagttcccatccccaccaactgggactgaggctgacctgctgtgagttgagactggctcactgaggtcccccagctgcacccaaggtgggtgctgctgttgtccccattttacagaagagggaaactgaggcccgggcagtggagggtcgccctggggcaggggtgagcagggtgctgggactttgatccaggtcagcctgtcttcagcctcagaacaagttggagaatgaaggccttggtcactgagtggggtgtcgctcggatcgttcattcctcgactcctcaccaaatgtttgtggaggggacagtcctagtgaccgtcctctcctggggaaacggaggcccagggctggtttgggactcaacctatcactatgtggccctggaaaagccctttcccgtctccggactccagtctccctacctagaaaagagtggggagaggtctccaagggtgctcccgcacccaacggactgcagtgttggtttcagggttggtgctctcgtaggggccggagcagcggctgcccctcccaacttcctgtttaccgtagctgcagagcctgtcccttcacttaaagccagtgtgatcaccatggcaaccggcctgtgtttgttccaacaggtgggcagaacctggtgcaagaccgcagaggcaggggcgtcactcccagacccggtctccagacccaccagcccctcaggagaacactgctacagagtggggctgagggcccaggccccctcccctgcttcccccaccgcgtccctgtcccagccagtccctgcatttcctgcaagctccctgccctcccccaccggcctggctgtgctgggtcaggatccggcagagcctgggccgagcgtcccgaaggagagcccacccaggggtcctgcccccgatcctgcacagacaggtgtggggcgggcatggatttgagtgagttgggatccagaagccaagacagttgttggcagacgggccccctccctttgaagagctgtgttctggaagcctgtctggccttgggctgcccaggtgcccttcgggtgaaaactccaaagtctgaccaccccccaccccttgtccccaaagggctgcgagtgtccagctgtattcgaccaagggcaggtgcgaccggggggccgctgcgccctcggcaagtctgagagcctcaggcccccgacaggaccatgcttagcacggacttctcaaagtgtggtccctggactggcggcagcagactggagctgggaagtgcaggcgctggctggcgtggggaccacacctgtgatctcagcgccttaggaggccggggaagggggatcccttgagcctgggagtttgagaccagcctgggcaacatagggagacccccatctccacaaaagaaaccaaaaaacattagccggcgggtggtcccagctactggggaggctgaagcgggaggaccacttgagccggagagttcgaggttgcagcgagtggagatggtgccactgcgctccaacctggttgagagctatttttgagagctttttcgagactctgtctgaaaaaaaaagggaaaaaacgcagatcgcgcccccacccagacttcgggaccagcgggttggggacaggacccatcaatgccttaacaaaccctgcaggagaccgcgggcccgctggggttccaggacagcgcagcggaggaagagcggggagccacccgggaggggctggcggggtccagtgcagaccccaggggctccgggggctctggccggctgtgaccccacaagcgccaactgggccctcaccagagccccagggacgatcgccccacagaccgtccgcgtgggcgtggggcgtcccgagtggatccctgcaggacgcatccccgccccgagaagagagcggcggggcccgcgaggtgtccctgagtcaggcccttccagaaaggtctgcaccgctgctggtcttcgtgaccgtggcttccctggggtccgcggaggagaccccgccgaccacccccttctagaccccacgcgccacggggagggcgcgcgcggccaggcggggtcccgaggcagccaagcccgctccccgtcccgcagccacctgtgggttgactcacagccccgcatcccgggggagggggctccggcccggctcaaggcacggagaccccggccgggtcccctaaggcgccgtggacgcggggggcggggcgagcgcggtcaggccccgccccggtcaggcccggccccgcccccagtcagaccccgcccccgcagcggcgtccgcccagcagttgctcagtcgtcggcgcgcgcggctgggagcggtagctgtgcctcggcgtccccgagctggtgccgagcgcagcgccccaggagcccccccatccccgcgccggcccacggtaagtgccgcgggctgcggccagtgctgttgggccgccgtctgggctcggccccgcgccccaacccggacggaccgacggccgccgcccccttggtccgggtcccccaggaggcacgggggtggcctccgaggcggggggcggtgggaaggtctcgacgtcccctcggccctggggaaactgaggccgcgcatgcttggaggggcggggtctcgggggcatttcccctccgaacgcgcaggagagggtgcggcggtggggtccgcactgcggagcggacggggagggtatccgggcgctggcgacggcctcccccgcacttgagccgccaagcgaggcttcgacccccgcgcctccctccccgggggagcagacgggcccggggcctcccagcacccctcccgggcgggctgcaccccccagcgtcctcgtcccttccctcctcccgcaggtcctcgtaaggccctttagtccccccgaaatccctgcgagtgcaaagcggcccctccttcagccccactcggcaaagggctgtgggctcttgcctgggccggggtctccgggggaggagtttaaagtgacacactagacccgcccccagactcaccccggaccgcccgccccctccgaggggagagacccccatagaactgggggtgtggctcctgcgggcgcccggggccccgggaaagggggtgccgcgaggcggggcagggagggggtcggtgagcagagggaggagggagcgctgcgcagacacgggcgaggggaggaagaaggcgcctcgggctccggtctcctgcgctcctgctgggcgccagcggctggaccttggcagccgtctgaggcttcggggagcccaaggccaccggcagcgcttgttagaatgcagattcccggggttcgactggaatgagaccccggggagcagcgtttgcagcgggcccgccaggtgacctgcacctgggcaccgccatcggcttcgcaggggccatctggaggagtcggtgagaccagggagagattcctgcgggaaacccccagggcctggtgaaggggagtcggggggctgagggaggaagagcagggaagctggagagaagaccaagagggcagcgtggagagccagcctgtggggcagatgtcctgccacctcccgccccaggcacacacccagggcaccatcagctaaccccctgccccaaatgtggtaagaagggcgcccccaacacgttgaaggcgtttgttcctagacagcctgcactggggaggaaggctgacccagcctctgctccgctgcccccagactcagctgcctcactgcccccaaccctgagcccccaaatggcctggcaggagacagcttggcttaagagtcccaggttcacatctgggctctgggcaagtcgcccccaccctgggctgtgaaatgagatgtgccatcctccttgcaaaatgtcattccccattcagcccaggcctgggggacagccagggagcaaggtgggatgggcaggtgtggctcagccccagtgccacaaggcaggagctccttggcggtcctccctctgctcactggacagatgggagtgtggttctggtcctggcatcaggcatgagcagagtatgggggggttcatcctgcctcatgctactgtcccagggtgagagactgggaaggagttacatcacgtctgggcccacgggaaagacggggggtcccctgcacctggctcactcctgccccgtaagtgctgagagccacccaggcagccagtgcttcctgtactggtcacagacagatgcatatgcccaccattcacagcagctccggcctctgtggcaggtggctcccagggcccacgcagttggctgcagccaggctatcagctgcccaggaagcctggggtttccaggggaaccaaaggggtttctgcgcacccaggatgagccaagtcttctgtacacctgtgccaagacgccattattgcacccatcctagcaacgggcagtgggaggggcaggagctgcagttggggtcaggggggctggcctagctggttgccccaggagcttagcactggggacaccaaagagaccttgactgccgtccccagcccacttgctggctctgggaccttgggcgggctcccagccctgcgcctccgtttgcccatctgagatgcagggagcaaagggcacccctctcgggccgctctggggatgaggaggtgaatgtggagaggaaaatgcagggagggtaccgagccccctttttctgcctggaacatcttgttatcacaaagacaccccctccccaaccccgcagttcaggccacttggctcctgcgtcacatttgtctccaggactgcgagcccccatcgcccctgtcacacgcacatgccgcggcggttgccctggcaacagctccagcagcggctgctccactggcttcgggggacagcagggggagcagcctcttccacccagcaagggaggggaagggggcttgtgactcccaggcccctgaggatttcacgactggctgtgggggtgacagcttccagaagcactgtacccagcctaccaagcccccccatcttttgggggggaggctcacaggggaaggcactgataggtttgaaggaggtgagtcccccccgcaagcattgcctctcacagggtgggagacgcaaaccctccttcctgtcctcagctctagggtctggtcccgtaagagcctgcacccagggctcgggggctggcagggaccctggaatcaagacgagatatccgggaatggtgtctgagctggtgtgggtatagcttggggctggtgaccctgaacccccacagacacagcaggggcccgggagctggctcgacaaagtccgtttggaacccaccactggcatggtgtgctcaggcccccacgctgcccactgagcttatgagtctagtgccactgtggggagctggcctggcatgcagggccaactgtccgtgagagcctgagtgggcggtagaacctgctggtcttcgtttcctctcctgtcccgtgagaatgactatgccctttgcgagggccagtgtgcccagcccggaggcaccctccgcaggtggatgagggagcactggcaagggaagggacccagacagcaaggccaggaccccggggggctgggggagcgcggtgtcctagaaatcagaggccggcaaggctgggacaggaacccaagagtgggtacctctcttgtggtggggcagaggtggcctggctctgggacagtttccatggagcggggaggagacctccctggggctgctggggggcagaggcagtgcagaggtggagggtctgcacctgcacccatgcagaggaagagggtctcaggaggctacggtgtcttagccatcatcctacccctgttgaagggggtgtgcagggcaggaccacccggccttcctccctgacacaggtgggctgggcggtgctggctcatgcctgtaatcccagcactttgggaggccgaggctggtggatcacctgaggtcaggagttcaagaccagcctggccaacatagcgaaaccccgtctccactgaaagtacaaaaaaatcagctgggcttggtggcgggcgcctgtaatcccagttacttgggaggctgaggcaggagaatcgcttgaacctggaaggcggaggttgcggtgagcggagactgcgccactgcaactcacttgaacctggaggtggaggctgcagtgagctgagatcatgccactgctctccagcctggactccatctcaacaaaacaaaacaaaaagtgggtggggccttccagggggcttccgggtctgcctgggcccaggctccgggccttggcagagggcagctctgtcccagcggtgacatctgggctgctgctgctgctgctgctccaagcaggaggctgacaggttggctcagttgtcatggcaacatgaggggaactgacgctggatggactgggagggaactgtagcccctacacccggcattttccagcggggcccggctcgcttcatgttctcgtttgtaccaactatggggagcaggccctgctttgtggggacactgccccccaccttctactgtccacctcaggtttgctgaccagctcctggggtgaggagggggcattgacccccgctgtgcttggtgagcgaggacccccaggcagtcccctccagggcctcctggccacatgggcatcctccacccaggatgtcagggttctggcgagtttttacctcctacataggagagctgggtacctggcatccgtcctggccccagagtcggcacgggggctgggggagctgagtgctgtggcccagatcttggtcctcttgatgcagccccaggaaacaggcgcctcctgctgtgctgtcgcggggaggggtgtggggggcgagtgtggcaaccgcctccctcgccagtgagaccccataagtccctgatggacccccagctctgggtgggcaccagccccgcctttgacagcatttgctacctcctccctgaagccgccctgcagggggcgcagggacttagccggtcacccagcaggtgtggggacaggagccctcaccgcctgaccaggtgcccagcgccatccaggctgtgggtgagctcccaggcctctgccccacctcttcccgccccacccccccacccccccgcctgctgtggtgcacggagggttgagtggacgacctgaggctgcgggctgtgctctctgctgtaggtcacccgccatgtcgaccttgctggacattaagagcagcgtgctcaggcaggtgcaggtgtgcccgtccttccgccgcaggactgagcaggacccagggagtgccagcgccgacccgcaggagcctgccacgggggcctggtgggtgccgaggggcccagccccacacgcccacagggccatttcccgccagacttcacacatggccgcccctgccccagcacccctgggcgggaaggagggtctgcagttagctgtgccacactgtggatgtcacatggcccttcctgcccctggagtcgagggtcccaggcaggggccagcgtgctgagagctgtgagctgacccggctctttctccaggaaacccggggatggcgtggagttctttgcccacatgcgcctcatgctgaagaagggggaaggcagacagggcttgccgtgcctcgaggtaagggtgccacccccagggcccgataccacagcccagcatggggctccccctttgctcctccccgctccctcctgccctcgctcccacctcctggggcaccacctgtcttccctgctgcaggcctggggctctccctgccgtcagagccctcaccctgggccccacacacaggtccccctgcgcagtggctcgccagcacccccggagcctgtggatcccagcctcggcctgagagccctggccccagaggaggtaaaggtgggggtcggaaccaggggcagtcgtctgcagcggctgctccctcagccgtttagaggcacctactgtgtgcacagggtctggtgatggcagagagccagggtgagtgggtgggtgagtgaggagcggaggggctcctggtgcaaagaggcagaggtggggcctgggctcaggcagacaggaggtgctgctgagggctgggggcctgggacgcggcactgtggccgcccttcccccacctgcaggtggagatgctctacgaggaggccctgtacacggtgctttaccgcgcgggtaccatgggccctgaccaggtggacgacgaggaggccctgctcagctatctccagcaggtcagcccaccctgaccccgacccagaccctgacagcttccccacctcaaccccttccccacccactgacaccatcatcacccaaacagtatgcagaatctccccgatccgtgcacagcacacagagacggctgcaggtgcacacacacacacgcacacaggctgcaggtgcacacagacacacgcacacaggctgcaggtgcacacagacacacacacaggctgcaggtgcacacagacacacgcacacaggctgcaggtgcacacagacacacgcacacaggctgcaggtgcacacagacacgcacacaggctgcaggtgcacacagacacgcacacaggctgcaggtgcacacagacgcacgcacacacacaggctgcaggtgcatacagatgcacacgcacacaggctgcaggtgcacacagacacacgcacacaggctgtaggtgcacacagacacgcacacacacaggctgcaggtgcacacagacacaggcacacaggctgcaggtgcacacagatgcacaggcacacaggctgcaggtgcacacagacacacgcacacaggctgcaggtgcacacagacacacgcacacaggctgcaggtgcacacagacacacacacaggttgcaggtgcacacagacgcatacgcacacaggctgcaggtgcacacagacacacacacaggctgcaggtgcgcacagatgcccaggcacacaggctgcaggtgcacacagacacacgcacacaggctgcaggtgcacacagacacgcacacaggttgcaggtgcacacagatgcacgcacataggctgcaggtgtacacagacatgcacacaggttgcaggtgcacacagatgcacacgcacacaggctgcaggtgtacacagacacacgcacacaggctgcaggtgcacacagacacgcacacacacacacaggctgcaggtgcacacagacacacacaggctgcatgtctacacagacacacacacatacatgcacataggctgacagacgcacctcgaaggacgctcccggcttccacctgcatgtgctctgaactcccctgtcctcccgtggcccccattcccacgcatgcacttgcgtggccctcatcacacccaccatctctgggcatgcccaggccccttggcacaaaccctctgccgctgcctcccaggcttcccccaaccctgcacccgtgaggactgaggttgggtgtctgtgacgggctgagcccgaggtcccagcacagtggccagcctcgcttcaggggttgcctaggccctgccaacccagccaccctccacaggtgtttggcaccagccttgaggagcacactgaggccatcgagcgagtgaggaaggccaaggtgaggccgccactgcctgggcaggcactgaccagcacgtgcctgcgtggcgggggcacggggcaaggccctgtcacctccatgctaagtagggcatctggggggcagctcagcctcaccaggccccccacgcccctctgtccacaggcccccacgtatgccctgaaagtctctgtcatgcgtgccaagaaccttctggccaaggaccccaacggtgagtggggacccagcagacctcggctgcgccgaggcctggcggccatggagggccagagggcgtggggccagggctgagacgcctgccgtgcccaggcttcagcgacccatactgcatgctgggcatcctgcctgcctcggacgccacgcgggagccccgtgcacagaaggagcagcgcttcggcttccgcaagggcagcaagcgcggtggacccctgcctgccaagtgcatccaggtcaccgaggtgaagagcagcaccctgaaccccgtctggaaggagcacttcctcttgtgaggccctcgcccgtctgggtgcgggaggggggctctgcctggggtccagagctgggctgtgcctggagggtggtggctcgcagcagctcccggtctctttggggccgtgtgcccactttccagaggagaaaactgaggcccagagatgggcgttgtgccaccggggccacacggctggcaacacctggcgggatcaggatttggacctgaacagcctgtctggagagcgggtgcttgtggcctggtccctgctgcttctggactccctgaccccggcctgggcagagcctcgccggggaccctcatgggcatctctgttctccttgtagcgagattgaggatgtgagcacggaccagctgcacctggacatctggtacaggcccctgcgccatgcagggcggcggggatgcacaccttttgcgggggagcaggacggactcagggcccggctgcgggctccagacaagccaggtcctcccctgtccccaccagggatcatgacgacgatgtatccctggtagaagcgtgcaggaagctgaatgaagtcatcggcctgaagggcatgggcaggtatgactgctgggacctttctacccatcacccgtgccctcagcttggtcatggggcccggcgggcagtggctccccaggagccatcagcgtgatgctcaccacctgtggtggccaggtacttcaaacagatcgtcaagtcagcccgcgcaaacgggacagcaggacccaccgaggaccacaccgatgacttcctggggtgcctcaacatacctgtccgggtgagtgggtgtggggtggggctggtgacacttagagaagggcctggggagtgtcccagccttcaaggggcagggcactgcctggagaagctcctgcttttgggcctccactgagtgcgcttgtcaccctcattccccggagaagggaagcccaggccatgtggtctctccagggtctcacagagtcagtgtggaaggggagggggaggagtctggtgggcctgacccccatgctacccccaggaggtgcctgtggctggcgtcgaccgctggttcaagctggagccacgctccagtgcctcgcgtgtgcagggacactgccacctggttctcaagctgatcactacgcaggtggggaaagtgggcgtccccgtcctccacccccgtccttggggcgggggcagagctggtgactgggtgggctctgcgttgcagagggatacggccatgagccagcgcgggcgatccggcttcctgtcccacctgctgctgctcagccatctgctgcggttggagcactcagcagaggaggtagtgggtgcgcctaggattggaacagcccggcagggggcctgaggaggggatgtggggctgtcccgcctccacccacgacagacctcctcccccagcccaactccagcagctggcgaggagagctcagcacaccagccgccaccatcctctgcctgcacggagcccagagcaacctgtcacccttgcagctggccgtgctgtgagtgggtggagctacgagtgggcggggaatgtgggcgggcgtgagcgagtggggcatcgggggccatgcggtgagtggatgtcgtggctgggagggtggggcagggaaaggggcggtgctgagtaggtggggctgcgctgattgggcgggaagggaagggggcggtgctacgggtaggtgaggcagcgaaaggggcggtgccatgagtaggtacggcagcgctaattggagggcagggaaaggggcagtgctatgagtaggcgcggcagtgctgattgggtggggcagagaaaggggtagtgctgtaggcggtgctgagtgggcatggcaggggcggggttcataccctttgaccatgggccgggccccacaggcactggcaggtcagcagccgccaccatcaaacctgcacgctggactacagctacctgctggggctgctggaggacatgcaggcacactgggaagaggctccttcactgccccaggagcaggtgggtgcagccgggaccttcttgccagccatggcgaagggagtgctggggactggggtcgctcagtgccggtcggcgaggggcagagtcctgcccgcgtgggggtcaaagacaaatggacaaactgtatgacgtgggcgagagccagcgctctgcagaaaggagacgggagactcgtgggagtcacctcggggggcggccaggacttaggacagggctggggaaagccgccaaggtggcgcccatctgagcgacaggagggagcggccctggcaggacggacgtgggaactgcaggggcacaggccctacgtgagctgcgtgggtggaaaccgaggctgggacaggccgtctgggacaggccgactgggcctgtggagggtgctgctcagagcagagctgggctgaccatgcccggggaagggtgttgcgggccaaggcagggaggatgtttctcctcatcagtggccggtcggggctgctggcactgaagggccctgtccccacaggaggagagcctggctgatagcctttccgccttctctgagttcgggctgcagctgctgcgccagctccgagactacttccctgccaccaacagcaccgctgtccaccgcctggagctgctgctgaagtgggtgcagcgccgcgtgtcagcgtgggtgggggcggctggcagggcaggccccacgtcagcgtgctgcccccacccaggtgtctgggcaagctgcagctcttccaaccctcctttgagatctgccccttcgagtcggagctgaacatggacattgctgcggccctgaaggtgtgttccaaagcccagtggaggccggctgctaagccctcccttccccttccctgccttcccgtcccctgcacctctgcaccacggtctcttgcccacctcttcctcttccctgcaatccaccatgctgtcttggtggtgtctgttgcagagaggcaaccgtgagtggtacgacaggatcctgaatgacaagagtccccgagagcaggtgcagttgtgggggaccctggccatgaggggtacgggcagccgagaggtgggtacgagctaggcttccttgcagccaggaccacagcgcctgcctgggctggttgtgctggctgacgccgtctatgatgaccttcagttctgctacagtgtgtacgccagcctcttccacaggtgggcctggcccctcagtgctgtcctggggctggggtcggagccaacagggcctgcaggtggggcgcaggtggatgaggtgtgtcccttgctctgcagcatcctcaatgtggacgtcttcaccctgaccttccggcagctggagcgtctggtgaggagggtccctgaccccgggtgcctgccaggcatggggaagtgggcagatgcccttggctaggacggtcctgggattccttgctgctggaggcctgatcctgctgtcccggacaggtggctgaggaggcgtgggtgctgacggaggagctgagccccaagatgaccctggaggtggcctcggggctctttgagctctacctgaccctggctgacctccagcgcttctgggatagcatccctggccggtgggtgccccgtccctatctcttgcagacagactttgggaccagggccccaggacctgtgagggggacggtcctggagctgtgagcctggaacgtgctggttaaggtgtctgagtcagggccgagccctcacaaccctcccaccacagggacagccgctctctggccctggctggcatccacgcccccttcctgcctgctgtgaagctctggttccaagtgctgagggaccaggccaagtggaggcttcagggagccgtggacatggacacggtgacagctgccctggcctgaggacactggggctggtccaggcccccagcctcccccgcctccccagcaaccccagcctccccagcaacccccagcctcctccgcctccccagcctccccctcaaccccagcctccccggcctcctccgcaaccccagcctccccagcaaccccagcctccccagcaaccccagcctcctcagcaaccccagcctcccccgcaaccccagcctcctcagcaaccccagcctcccccacaaccccagcctccccggcctcctccgcaaccccagcctcccccacaacccccgcctcccccacctccccagcctcccctgcctccccagcaaacccagcctcccctgcctccctagctggagcccgtggacgcctcctccaggcacagcagctccgcagccactgctggtctctgcctcagccacatccaggagttgtgggtgcgcctggcgtggcctgaccctgcccaggctcaggggctgggcacccagcttggccaggtgtgtgggtgggccctgggggtgaggggaacgggtgggagaggagatggggcaggggagggctccatggctccccaccgccatcccctcctcaggacgtgtgtgaggccaccctcttctatacggagctgcttcggaagaaggtggacactcagccaggggcggccggtgaagcagtgagcgaggcggtgagtgaccagctggggaggggagccggcaggaggtggggggccatcaccaggccccggacccatcgttgcctggccacacctcctccagctctgcgtggtcctcaacaatgtggagctcgtgcgcaaggctgctgggcaggccttgaagggcctggcatggccagagggggccacggggcccgagggggtgctcccccgccctctgctcagctgcacacaggccctggacgatgatctgcaacgggaggcccacacggtgacagcgcacctgacctctaaggtgggtggggcctggagaccaaggcgtggaggcagtccctggtgccccctgcccgtgctgagcactgctcctgccctcagatggtgggcgacatccgcaagtatgtacagcacatcagtctctcgcctgactccatccagaacgatgaggtgagtgccggggcgaggggccgtggaggactgtgtgtactgggggtagggcagaggtgcggggtaagcctggcctgaccacccctgcccgcaggccgtggccccgctcatgaagtacctggatgagaagctggccctgctgaacgcctcgctggtgaaggggaacctgagcaggtgcgggcgggtggggtgggatgggctgggctggcccgtggtcactgaggccgccctgcagggtgccggaggccctgtgggagctactcctccaggccattctgcaggtggggccagcggggcaggtggggctggcccgtggtcactgatgctgccctgcagggtgctggaggccctgtgggagctactcctccaggccattctgcaggcgctgggtgcaaaccgtgacgtctctgctgatttctacagccgcttccatttcacgctggaggtagagctctgtgaaggagtcctccccgccggcccccgcctcagggctgctctgatccctccctttgtccccactggcctgcctggtctcctgtggctggagagcagccactccagggctgtccacagcgcctcctcccgttaatgccgaggtgtggcctctggtgatggcctttccccacgcttcctgggagcttccgatgcccgccagggtgtgagaaagggctctgcccttggctgctgagcccccagtgctgcctgggcccctttgtgctgggggtctctacctgtccccagcacaagccaggctccctgacacctctgccttctttccctgccccaggccctggtcagttttttccacgcagagggtcagggtttgcccctggagagcctgagggatggaagctacaaggtgaggtgggaccctctgtggggcgggggtgtggatgaggggactgagttcaaactgcagccccacacgggctgtgtccttgagcatgaggtggccccacgggcagtcaggtctccaagtgccagcgctgaccaccagcacccaggggcccctcctgatgcgcttccccctgcagaggctgaaggaggagctgcggctgcacaaatgttccacccgcgagtgcatcgagcagttctacctggacaagctcaaacaggtagggaggcgccagggacagggtgctgcctccgaggctcccagagcccagctgcgctcacccgcctttccgcagaggaccctggagcagaaccggtttggacgcctgagcgtccgttgccattacgaggcggctgagcagcggctggccgtggaggtgctgcacgccgcggacctgctccccctggacgccaacggtgagttgcagcggggacgggtcgggtggtggtgggatgggggcaggggggctcacgactgtgctcctgcaggcttaagtgacccctttgtgatcgtggagctgggcccaccgcatctctttccactggtccgcagccagaggacccaggtgaagacccggacgctgcaccctgtatacgacgaactcttctacttgtgagtgtcctaagccccagccccagccccaggctccaggctgccggagcgagactcccgactggcctctgtccgcagttccgtgcctgccgaggcgtgccgccgccgcgcggcctgtgtgttgttcaccgtcatggaccacgactggctgtccaccaacgacttcgctggggaggcggccctcggcctaggtggcgtcactggtgtcgcccggccccaggtgggcgggggtgcaagggctgggcagcctgtcaccctgcacctgtgccggcccagagcccagggtgagtgagcatctgggtggaggcaggggcagcgggcctgaccccggcccccacacacctgcccgcgctgcttgcagtgagatctgcgctgaggaggctggaaggccgcaccagcaaggaggcgcaggagttcgtgaagaaactcaaggagctggagaagtgcatggaggcggacccctgagtccatcagctgccagccccggccctggcccccaccccaagttccctgaagcatcctccagctcactgtggccagctttgtgcaaccagggcccacggcgcccctcctgtgctgtgacgtgtgtgtcgtggctggccccgcggcgcctaccgccctggccgtgtctgtctggtgtgtgctgtgaacccctgcacccaaccccacatctgggtggccaacttggcaggacttggccagcagctgcccaggacacagtgcaggccagagcgggcttgaccacctggtgggcctccctgcccgcttccttgggctccccggccctgggtgggcggtgggcagctggtctccagggactcagtgagtggctgtgctctctgcacaacgggcaatgtgcagacgcatttttggtaatcacagctggggagtgaaaagggtgccactggcaccactgggtggatggtccagagcctccacccacagaggggatgcaaagggcaggtgagtcaagaaccgcataggtctccagtccccacggggctcccaggccggggaaaggttcccctgaggtcactctgaggccagggacgtcacccaaggctggtggtcagtgtgaagggctccgtgccaactggtcagctgtccttcacgcacatatccgtggccacctgagacctgctccacgacccttccaggcagagccgagagttcgccccaacccttccccaggcccagtgtgaaaaacagactcacaaggggcttcttggcctgcagcttcatttgcgagagcgccgaggcaggacacagagcacagctgtgctggaagtgtggggagaacccggacagctcagtcctgccagcagccgcaaagagccgaggctgccaggcccatttatgtccctcatgtctctagattttctcgtcacccagcctcaaaaatatatgtgtctgcaaccctcagtctctctgccgtttcttgattcctttccaaacctcagccggggccctggcctcagccccccgtccctgcgtctgctcctcttcacagcagctgctgctggctcctccgcgctcggcgccaggccctgggtcctcagacgcatcactgtcatcagtgtccgagggcagcctgggagaggagggggagcacgttcccaaatgacgtcctccctggctagctggagtcaacgtcatccacaaaaagcccccagccgaggacagattcctcttcctccctgtgctctccacacccaaacctctccagtgggacatgcactgcaggttttctagtcagaagaccatcggggtgttgtttacaacaccacccccaggcagcaggaagggctcaggccagaggtagaagagagccctgggtctgagtgatcatgaaattaagcccaaggacctaccgggtgctggccacaggcctgttggggtttccaaactctctccctgaatccacatcgaagggatctgagccgagagaggaaagtggcctctaagtgagctcagagcaggaccaggcctcccaccccccaggctttggagggccttggttcccaccccgccaaggctcaccgatctcctcctcctgggggctctccttggcattggccaagaactcctgctccgcctgcagcacctcctccgggctgccgcaggccgcgtacttgtccaggagctggcggttcaggtccaagaagcccttgccccatttaaacttccgcagcaaaatgacagcaaggtctggaaagcctgacggtgtgagaaacaggaaacccaaagaagtcgacggtcccctcaagtgcctcctgatcaccctgctgccggatggcggcgctctcccaagtaaccgcagggtccccagcaaacatcagctcacagtcctgagaacccgtgctgcccccagcctgcacctcccttgctacagtccacacctctgcaaccgaccaagtccccctcctttgctgcgaaacaaacattcccaccaagactgccccacgcctcatcagggcctctttagatcagcaattcagtaaggaggacgtggaggataaggaggattctctgggcagtggtgccctgataatgaatggcaccccacacaccggccctgatagaacagcgatcccattctgcctctactgcaactccacaggccgaaaacctgaagtgacagttggggctggaaccgtggtctgtctgaactgttcccctgtccgtcccttatgctcctcctggggtctgtcggcaggaaacatgatgctgggagcatagcaggaacagcaggccgccgggtcacactgctgtggggcccctggactcacctacgatgcagaaggtggcagcaaacgcttccacgcaggaaagtctgtagggccggccatagttcacggggttggcggccaccaggtagggcaacaggcgcaagtggctccctcgcatcttcccaaacggtgtctcgtccagcctggcccaggagcagtcgatgacggcgaccccagactgcgccaccagctgtctgccagggacagcatgggataagttcaggagccagcactacccaaggtggagcatgccccggagaatggcctagctaagggattcagggacatcattccgccatccccaaacaccctcaaacggacttcacgagcaagcttttgaggcagctgcttggggcacctggagcatgtgtttattcactcaacaaacgtttattaccccaaaacctcctttatcccaggctctgcgctacgcaacggaggcaaactagacagacgttccctgcccacgtgggtgtggatgtgggtgcgacatacaagtgccactaaaccatccctgaagggaaccacgcgctggaaatgaagacgacctcgggcaggcctcccgcgcctacctgtctgcgggggacgcgtactgcttgcccacggggctcagcaccagaccgccgaatctgtggcccaggcgcaggcagcgcaccagccccaggcgggccagcttgcggcccgtgcagcgccgggggtcgcagtggcccaactcccacatggccagcgtgcagggcagcgccgccgggcccgggccgccctcgccgtcagccgcccctggctccacggaagctgcacgagagagagaagggcactcggcctcagcgtgggacccccgggcaggccctcaaaccctgacccgctctccccatcacgcctcgctcaccctgcagcgcggcgccgacctcctcggcgaaggcctccagggagcgcgtcgggaggtgccgagggcggccgccttccgcccccggcccgcgcgctgccctcctgcggcccatggcgcggacctggggtgccggggactccccaccccacggccgcgcccctcggcctcccaatgggctgtgcggctgccagcgcttgcgccggacgccacttccggtccccgtggtcacgtgaccgtcacttcacgtgaccgcgcggcggccgctgcggcgcgatggcggcggggctggcgcggctcctgttgctcctcgggctctcggccggcggtgagtggcccggccgtccgcgtccccaggccccgcgcgcgctctgcaccccggcctccccgctcacggtctcgctccccgtagggcccgcgccggcaggtgcagcgaagatgaaggtggtggaggagcccaacgcgtttgggtgagcagcctcgcgggctggcggctcgagcgggggacggcccgggcccgttccccgctgaccttgccgcttcccgtagggtgaacaacccgttcttgcctcaggccagtcgcctccaggccaagagggatccttcacccgtgtctggtgagtgaggagcgctgttggccggcgcgggggtggccgcggggagcagcaacagtggaggatggatgagtgaccctgagagttacggcccggagtctaaagcattggtttgtcagccttctaaaattaatgtggaagtacgagagaatataccagaacgttcttgtagcgaattaaattatctccagacttagtccttcctttcctttccgagaggtaactgctgttaatagtctggtgactttgcagacgcgtttctgtgcttttacgtgcgtgtctatgcaactggaaaacgtatagtttttgtaatctaatcgcttttttaaaaaatcatgctgcgcgagtatttggctgatttgtcgttgtcactcgctgtatctctcgggacgcttcatggtgatgatataggtcttcgttctttctcttggtgctcagcacgcgataggatggcactgcactccccgattgtatttaggttcttgccatttttttggccattagaaatagttctgtggagaacatgctgtgtaggtgctttggtttgccctcaggtgagcggtttcccagtgcaggattccagaagtggaattggtgggtcatgagtatatatatcatttaaacgctgaatgagtattaaatataatagacaaaaatccaagaatttttttttttttttttttgagacaagagtctcgctctgtcgcccaggctggagtgcagtggcacgatctcggctcactgcaacctccgcctcccaggttcaagcgatcctcatgcctcagcctcccgagtagctgggatcacaggcatgcatcaccatcacgcccagcaaatttttgtatttttagtagagatagggtttatttcaccgtattgaccaggcgggtctcgaactcctgacctcaagtgatccgcccatctcggcctccaaaagtgctgggattataggcgtgagccaccgcgcccagctttagtaattttattatcgaatacctttatgtgttagggtctgtgctggggttgcagaaacgaacacagatataccaatgcttgtcctcatggagctgacagtctaatggggagggatggaggaacaggcactgagcctgtagaattagataaaatacatagaatggccaatgatgaaaaatgccatgtagatgtgtgaagcagaggagggagtgtgtgtatgtgtgttagagtattgtttgggggatcgctttttttattttttagagacggggtcttgctctctcactcgggctggagtgcagtagtgcaatcatagctcactgcatccttgaactcctgggctgaagcaatccaccaacctcagcttcctgagtagctgggactacaggtgcacgccaccatgcccggcaaatgttaagtgttcttgtagagatggaagtctcactatgttgcccaggctggccccaaactcccagcgtcaagcaatcctcctgtcttggtggggattgctttaaatagggtgctgaggaaaagtctaagaagtgacatttcagccaaaagctaaaggagaaaagggagtaaagctgtggctatttggggaaagggatccaggaaagggagtggccaaaggccttgagcaggacagccagggccagaggggattcagctggggtagccacagatcagagataaaggggatcagatggtgccgcaccgtgttggtaggtttggtggactttgactccaaacacatctttttaagttttttgttgtgtggctgggcgtgatggcgcacctggggttaggctcacttccctgcggctcagaagccatgggatggtggcttcccagggcctgaagtgctggagtcgggccaccacctatcccaagaagctggggaggaggcaggccactgtgtaacagcgcagttcccgaccgaaccccttccagtaggagagaggcagccttggctaatgggaccacgtctttttggaggtgagagtcctggaaagaaaacagaatatgctggtcgtggtggtgcgtgcatgttgctcgggagcctgaggtgtgacgatcgcttgaggtcaggagttcgagaccagcctggccaacatggtgaaaccccgtctctactaaaaaaaaccacaaaaacaaaagttagccgggcatagtggtatcctcctgtaatcccagctgcttgggaggccgaggctggagaattgcttgaatccaggaggcggaggctgcggtgagctgagatcatgcccctgcactccagcctgggtgacagagcaagacttcgtctcaaaaaaaaaaaaaaaaaaaaaaaacccataaaaatttagaaaagaatacctcttctagttttcccacccccatccccacatcagggccagtcaggttcacatgtgcatttggttcattatgtgtctttagtgttttaatttggaacagttctcttcccacctttggatgtaagtggcacatttgtttcccagtttcctgatctttttgttttgttgatggtgtttttctccagaccattttttcctgcgcctgtggggtcaggcgtggatagtcccccgcgtctgtagggctgggcgtggatactcccccgcgtctgtagggccgggcgtggattgtctcccacgtctgtggggtggggccgggcgtggaaagtcccccgcgtctgtggggtggggcctggatactcccccgcatctgcggggtggggcgtggatcgtctcccgcatgtgcggggtcgggtgtggatggtctgccgcgtctgcggggtcgggtgtggatggtctcccgcgtctgcggggtcgggtgtggatggtctcccgcctctgcggggtcgggtgtggatggtctcccgcgtctgtggggtcgggtgtggatcgtctcccgcgtctgtggggtcgggtgtggatcctctcctgcgtctgtggggtcgggtgtggatattctacttgttttttctgtctttgatgtagcgctccttcaacatcaacgtgtgaggcggattgtgtgcagtgggtaggagagtgtggtctgtggaatgagctgagcagaaagataatcaggctgagaaactcaggggcgtggtgattgtggcctagggctcagaaggtccccgcagaagagtgtctgccaaggagaaggaaggggtgggcttgccagggccgaggctggtggggctgggctgggcagtgggcagctccatggcctccaccagatgagtcgggagcctcgtcccttgacagcaggaggagcagaggttggtaggtctgtgatttggagacagtgtcccgctgtggcatggagagggaatggggcacggtcagtgtggtggtcctgccagcgcccagcagagtccagcatagcccagcacactgtccaggagggagctctgcctcggtggcggtgggagggagcggccagctgggcaggactctggggccttggcagggtcctggatctggggagggggcgggggaggagtagagtggccccgggatcctggctagagaagccatggcaagtgcggctcccagcatgtgagttgcaggggtcaggctgggagcttgctttcggctggggccgggctgggtctgccaggcagtccctggtgcttggagagggtcacggtgggcacaggactcaccagggggtgcgtgaggccggagggtgagggtgaggtccccggtgaagttcttggtggcgtgtgggggttgtggaggttgggagggtactgggaccaggtgtggggccgggccagggagcagcgtgggagggaggaccacccttgagaagggattgtcaccaagagacgcagccctagggggagtgctgcccaccgaagcctgaccggggcagaggggaaacggagtccaggctcagccaagctgatgggccttgagctgtggcctcgggtgcagggacagctggcagtaaggccacctgggcccgcgggagccaagggcaccggcgagtgtcctggccatgcaggccgtgaacacggagcctgcaggggacgtgcgggtgaagcaggagcagaggagaagcctcccggcaggggtggtggcatttgggggtggtggtatttgggggtagagactcccgctcaggtatggctgtgtctggcccaagaggcgtggaggggccagcccccacctgtctcaggaggacaggctgctgaaacctgagggccaggcggaggggaggggccgtggccggggttctggtgtgggccagcagcagaggacctggggtactgggcactgccagttgggggcttgtggtaccatcccctgcgggaggctgcacctcagccagtaggagtccactgaagctgtggacagcacccaggcagaggcctcctcccagctggggagccaggccaggccccgctgccctcacacagtcctgtttagacggatggccctgcaggtgcagagctaagcccggcgcccacgcccctcctggggtgtctccaagcagtgtctgcctggggcaagcctgggaacgtgagttcccaggacacaggagcttgaccagccaccctcccagcgggagtgtgagagcgggaatctgcgggcgggggtctgcgggcgggagtgtgcgggcgagagtgtgcgggcgggggtctgcgggcgggagtgtgcgggtggcggtctgcgggcaggagtctgagtggcagatgggtgagggacacatcagggtctctgggatggctccaaaggcttccctatgtgcctgttgggcagggccctagggccagactggagggaccaagcccaagcaccccaggctgtgggacagcaggtgtgacagggctgaggtagagcccccagcggtcaggctgggaggacagtgggtgagcctgggagtaggggccacccagatggtatttgacaaggaaggaccaggacctttctatatccacagcccctgtcccctgagcagggcagcctggccatcttggtctccatctgtcttgggaggggacagccccaggggtgagtggaatgtcagggaacagaaggccaggccgggccagcaccccagaggtctcagtggcattagcctctgccctccgggggcgggggccaggctgagggtggccccagtgtggcatctggctcctgggctggccagattcccagggaacagtcacccagcacctcgtgtgtatttcgactttattattattattattattattattagagccgagtgtcgctgtgtcgcccaggctggagtgctgtgtcgcccaggctggagtgcagtggcgcgatctcggctcagtgccagctccgcctcccgggttcacgccattctcctgcctcagcctcctgagtagctgggactacaggcgcccgccaccatgcccggctaattttttgtgtttttaacagagacggggtttcaccgtgttagccaggacggtctcgatctcctgacctcgtgatctgcccgcctcggcctcccacagtgctgggatgacagtcatgagccaccgcgcctggcctcgactttattattaatacggtaaaactacagagagtttgaaacatcagtctggggcgtcctcctctaaccagtgcacttgctgctgcagcgcaggcccttcaggggacggggatgggggccagtcccctccctgcctccacggcccaagccccagccttccccacagtcctggaggatggcccgtggctgacagtctcggtgggcgctgtgttaaggtggcgtccccagccaggtcccgactccccagcttaaagaacagggtggctgctgtggcttgactcacgagttgccactggccttgatgtgtacacgcccttgctctagcactgcctggggctggcctggctggagggtagggacgctgcacgccttccctcttcccccaggcgctggtgacactgccctgcaaccgtcagcaccatcatctccacaacttgctctgtccccttcaaaccctgactcccagctgccccgctcccccagccccggcacccaccattctgctgtctctgaacttggctattcatagacgtcacataggtgactcataactgtgtgcgaccttttgtgtctgaccaactcctcttggcacagtgtccccaaggtcccccaggctggaggctctcagtgcttcctttttatatggctgaggactgttccactgcaaggacagaccacgttgttgtttacccgtcatctgtccatggacactggagtggcttccaccctctgcctgggaataggctgctgtgaacttgggtgtaaatatttgagtctctgcttccaatttctgagagtagctttgctggatcttattagaattccatgtttagctttttgaggaaccaccaaactgtttgcatagtggctgcaccgtttcccattccagccagcattgcacgaggggtccagtttctccacattttcaccaacactgttttttgctaacagccatcctagtgggtgtgaagcggtaccttagggttgttttaatttgcatttccctaatgatcagtcatgtgggatcttttcagttgcttatggtgtttgtccttttttttttttgagatggagtctcactctgtggcccagactggagtacagtggcgccatcttggctcactgcaagctctgcctcccaggctcaggcgattctcctgcctcagcctctcaagtagctgggattacaggcgtgagccaccacacctggctcatttttatttagtagagacggggtttcaccatgttggccaggctggtctcaaactcctgacctcatgatccgcctgcctcggcctcccgaagtgctgggattcccggcttctctgcccatttttaacttgagtttattgttgggctgtagttctgtgttctggatgtgagtctcttacatacgtggtttgccagtgtttattttctcccattctgtgggttgtcttttcactcccttgatgggtttgtttttttttccatatagagtctaactctgtagcccaggctggagtgcagtagcacgatcttggctcacggcaacctctccacctcccaggctcaaggaattctcctgcctcagcctcccgagtagctgggactgcaggcatccgccatcacgcctggctaatttttt

SEQ ID NO: 1039 - DNA, 32230 bp, Homo sapiens
acagcttgaaggagacacagcccaagggctcaccattgacagcgatgttgaaggacacggtggggttgaccatggctgatagtatggggctcctgatggtggcgtctgcaaagccaagacagacactttctatctcatttcatgaggccaggattccatgagggaatactttctaactaattccatgaggccagcattagccaaataccaaaatcagatgaagacttcacaaaaaaagaaaaccacagaccaatatctctcatgaacataggtgcaaaaatcctcagcaaaatgctagcaaatcaaatccacaatgtatgagaagaacaatacaccatgcctaagtaagatttatcccaggtatgcaaagttacttcaacattggaaaatcagttaatgtaatccattaaatcaactggctaaagaagaaaatcacatgatcatatcaatagaggcagaaaaagcaattgacaacatccaacacccattcatgatgattaaaaaaaaaaatctcttagcaagctaggaatagagaagaccttactcaacttgataaacaacatccacaaaacatccacagctaacatcacacttaatggtgagaaactaaaagcttgcctgctaagatcagaacaaggcaggaatgaccctctcaacacagcttttcaacgttgtactggaagtcctagctaaagtagtaagacaagaaaaggaactaaaaggtatacaaatttggaacaagaaataaaactgtctttgtttacagatgatatgattgtctatgtagaaaatcaaaaagaatccacacataaaaaactcctggaactaacaagcaattatagcaaggttgcaggatataaagttaatatgtaaaagccaatcacttttctatgtatcagcaatgagcacgtagaattcgccatttaatttttttttttcaagacggagtcttgttctgtcgcccaggctagagtgcagtggcgcgatctcaactcactgcaacctcctcctcccaggttcaagcaattctcctgcctcagcctcctgagtagctgggattacaggtgtgccccaccatgcccagctaatttttgtatttttagtagagacggggttttaccatgttggccaggctgatctcgaacttctgacctcatgttctgcctgcctcagcctcccaaagtgctgggattacaggcgtgagccaccgtgcctggtccagaatttgccatttaaaacacaataccacttacattagcacccccaaaaatgaaacacttaggtacaaatctaagaaaatatgtacaagatctatatgaacaaaactacaaaactgacaaaagaaatcaaagaactaaacaaatggagagatattccatgttcatagtcaggaaggctcaatactgttaatatatctgttctttccaacttgatctgtggaatgaatgcaatctcaataaaaaacctcagtaagttattttgtggatattaacaaactgattcaaactttatatggtgaggcaaaagacctagccagcacaatataggagaaaaataaagtcaaagaccaccactacctgacttagactttctataaagccatagtaatcaagacagagtggtgattagcatagccattgtgggaaacagtatggaggttctgcaaaaattttaaaaatagaaataccacatgatccagcaatcccactaatgggtatatatccaaaggatatgaaatcagtacgttgagatatttgcactcccatattcattgcatcattattctttttttttttttttcctttagagatagagtctatgttgcccagggcaactcctggcctcaagcgatcctgctgtctcagcttcccaattatctgggattataagcacgagacactgcacctggctgcagcattattctcaatagccaagatatagaatccacctaagtgtccatcaatggatgaatggataaagaaaatgtggtatatataaaaaatggaatactattcagccttaaaaaacaaaatcctgtcatttgtgacaacatggatgaacctggaagacattatgttaagtgaaataagccaggcacagaaagacaaatacaatctcacttatatgtggagtatagaaaaagccagactcataaatagagagtaaactggtggttatcagaggctgggaggtcggggaattggggagatgttagtcaaagaacacaagatttcagttaggaagaataagttcaagagatctattgtaccttatggtgactaaacttaataacaacatattgtgtatttcaaaatagtatgagaatagctttaagcattctcatcacatacacacaaaatatgtatgtgaggtaatgtacatattattaaattgtttggtttatccattccacaatgtgtgtgtatgtatgtgcatatatatataaacatgatgtacaccacaaatgtataaaattagtcaatcgaaaaattaattttagaaagacagagtggcattggcaaagaatagacaaattgatccacttgagcagaatagagagccaagaaatagtcccacataaatacaaggagcaaagacaatacaataaagatagtcttttcagcaaatgctgctggaacaactggacagccatgtacaagaaaaatgaaaagagctctcttaaaaggttactgtgaaagccacctgtgacagtaacagaaagtgcccagcagggtctctgacacttagtaatgtaatctctctcactgtaatgtaatggctaaacttcaacatccctcagcccccatctccataagactttcccatagaggcaacaatgattcctgtcagtcacccagtcctgccaatccactgggtaggatacaatattgaggggcccatcagcacactggccttagggggctctgcagccccttgaccttgtggatgatgctggccttaatctcctcttgtccgtggctaaagacaggccccttctgcggagaccaggccagaatgctcatctgattaagactctatattaagagtcaggaataacaaaaacaacaataaataaataaacacagtaacataatctatgtgtcttagtccgtttcctgccgctataacagaatactacagactgggtaatttattttgttgttttttcagacagggtctctctctgtcgctcagactggagtgcagtggcatgatctcgactcactgcaacctccacctcccagactcaagtgatcctcccacctcagcctcctaaataactgggaccacagacccgcacgaccacaccagctaatttttgtgtttttttgtagagatgggttttgccatgttgcccaggctggtctcaaactcctgggctcaagccttccacccaccttggcctcccaaagtgctgggattacaggcttgagccaccacacccagcacagactgggtaatttataaagacaataaatgtttttcccacagagctggaggctgagaagtccaagagcatgacactggcatcttatgagggcctggctgcagtatcatcccatagtgagaggtggaagggcaaagaggctgaactgatttctatcatgccatacaatggcattaatctattcaatctaatcaaccctgaaaggtcccacatcggctgggcacggtggctcatgcctgtaatcccagcactttgggaggccaaggcaggtggatcacctgaggtcaggagttcaagaccagcctgaccaatatgatgaaaccccgtctctactaaaaatacaaaaattagctgggcgtggtggcatgtgcctgtaattccaactactcaggaggctgagacaggagaatcacttgaacatgggaggcggaggttgcagtgagctgagattgtgccattgcactccagcctgggcaacaagagcgaaactccatctcaaaaaaagaaaaaaaaaaagtcttgcatcttaataccattaggatagcaattaaatgtcaacatgagttttggtggggacattccactttagcactaggtattctggtttatgtatttttttagcttaattccttcatttctacaattatgagatccacgattatccactatatttggttttctttctttttggttttgttttttgttttttgagacaagagtctcgctctgtcgccaggctggagtgcagtggcatgatctcagctcactgtaacctctggctcccgggttcaagtgattctcctgcctcagcctcccgagtggctgggactacaggcgtgcaccaccatgcccggctaatttttgtatttttagtagagacggggtttcaccatgttggccaggatggtctcgatctcttgacctcatgatccgcccgcctcggcctcccaaagtgctgagattacaggtgtgagccactgcgcctggcctcatccactatatttgaaccgacccaaaggccagtgctttcttaattaagttcccacaggtgaacaaagccaaaattcagattctattttatttatggtttagaattacctactgtgaaaaaaaaaaaaaactagctactataaattattgggggttagtccatttagtccattttggagttcataacctaaagcagaaactcacatggttgaaatgtcactttcccaaaggattgttattagtgtatcatttagattgtcttgcaaaagtctcatttgttgttttttctaaatggctgctaatcttttaaattaacagatagagggccaggcacggtggttcacacctgtaatcccagcactctgggaggctgaggcagtcggatcacttgaggccaggtgttcaagaccagcctggccaacatggtgaaaccctgtctgtactaaaaatacaaaaattagctcggcatagtggcacacgtctgtaatcccagcttcttgggaggcagaggcataagaattgcttgaacccggcaagcggaggttccagcaagcagagattgtgccattgcactccagcctgggtgacagagcattgctctgtccacctcccaaaaatgtagttaattttttttcttttctttttttttttttttttttttttttttttttttttttgagagacggagtcttgctctgtcgcccaggctggagtgcagtggcacaatctcagctcactgcaacctccgcctcccaggttcaagcaattctcctgcctcagcctcacaagtagctgggattacaggtggctaccaccacgcttagctaattttttgtatttttagtagagacggggtttcatcatgttcgccaggctagtcttgaactcctgaccttaagcgatccccctgcctcggcctcccaaagtgccgggattacaagcatgagccactgcgcccggccaactttcaatgttaattagttgtggtttgtttaaccatatactgcatagtttcgcttatctataataacagtagtttggggctcttatattctaataattaagactttagctgtgtacacattgcaattaaagtatgagtcatgcataaccttatcaccaagatacaagagggaaagcccttctccccttaaacttttacaaaggttctgggttctttttccacttaagtgggaaaaagtcagctaatgaggaacgtaaagtctttggcctcatctaaaggtgctttggcccgcaagtgtgagaagcactgaccgctgggaagtcctcactgcctggttcctggactcttacaccatggcagaggccatcttccctcccaatgcagagtgatatccagatagcgagctggctagcagctgtccactctccagcaatcctgccttctggggcatggttttctaaggaccttcctgttcctagatgatcaaaattgggaccagccactcccttctgagccactcctgcctctgggcctgtggctatgtcacagtccagtcacaacaggacatcccttcagaacaccctgcaggaagctgacatctctatgcagactcacacatgcacggtgtgtgcacaggcctttggttctacttcaggaggtgttgggggaggctcactagtccaacagaacttgaggccagttgtaccagtgtcatatcccaggagccaaggttacaagggatacaaagtgcccagacctaccagagaaggcaaacccctacagcatgcagggctagacaggggcaagaaacaaggtcattctgggccagcaagaagagggaaagggaaatgacaggcatacctcggagatactgaagatttgtttccagaccatagcaacaaagtgagtcacacaaactttttagtttcctattgtgcataaaagttatgtttgtactatattgtagtctgttaagtgtacagtagcattgtgtacaaaaaactgtgtatatacttaatggagtctcgctctgtcacccaggctggagtgcagtgccacgattttggctcactgcaacctccgcctcctgagttcaagccattctcctgctcagcctcccaagtagctgggactacaggtgcccatcaccatgcccagctaatttttgtatttttagtagagatgaggtttcaccatgttggccaggctaatcttgaactcctgacctcaagtgatccacccacctcggcctcccaaagtgctgggattacaggcgtgagccactgtatctggccatatactttaattttaaaatacttaattgctaaacaaatgctaaccatcatatgaggcttcagctaatcctgatctttttgctgggggagggtcttgcctccatggatcaggggcatggctgctgaaggctgctttgacaacttcttaaaataagacaatgatgtttgccatttgccgcatggattattcctttcaatattgttgtgcctcagggaatagggaggcctggaaagcagagtcgggagaatggccagttggtgaagcagtcacaacacacacatttttccattaagtttgctgtcttatatgagcatcgctcatggtgtcccaaaacaatcacaatagttaacttcagtaactgattacaggtcactgtaacaagtataataatgaaaacgcttgaaacattttgagaattccacagcgtgacatggagacatgatgtctgcctgctgttgggaaaatagcaccaatagacctgtttgatgtgcttgacacagggttgccacaagcctccaatctctaaataaaaaacagcatctgcaaagagcaataaagggaagcacaataaaaggtacatctgcaaaggggaatcagcacttaagcaaggtcaggatgagctttcaagtcaggtggacctagacatgaaccctccaggccctaccaacaaccagctatggaccttcgagcacatccagcctagagctgcccccaacagacacttccccagtgaatgctgaatgaaaccatctgagccagtttcctcaggtgcaaaccagtgaggtaattcctaccttgcagagtgaagtgagaaaagacagtgttaagaaatgccgggtgcggtggctcacgcctgtaatcccagcactttgggaggccaagacgggcggatcatgaggtcaggagatcgagaccaccctggctaacacggtgaaaccccgtctccactaaaaatacaaaaaattagccgggcgtagtggcgagcacctgtagtcccagctcctcgggagggtgaggcaggagaatggcgtgaacccgggaggcagagcttgcagtgagcccagattgcgccactgcactccagcctgggcaacagagcgagactccgtctcaaaaaaaaaaaaaaaaaaaaaaagacacaagacctgtggtagcctttcctttctgtctggcagcagccactgggtaaaccaagatggtgcatacaagtacatccagaagctatggaagaagcagtctgatgtcatgagctttcttctgagggtccgctgctggcagtaccaccagctctctgctctccacagggatccccgccccacccagcccaataaagcacgctactgggctacagccaagcaaggttatgttacatataagcgccacggtggctgaaaatctagttcctaagaaggcaacttaacagcaagcctgtctatcatggtgttaaccagctagtttgcttaaagccttcagtctgttacagaagagcaagctggatgccactgtggggctctgagtcctgaattctcactgggctggttaaagattccacatacaaagtttttgaggctatcctagttgatccattccataacactatcagaaggaaacctgacacccagtggtccacaacaagcatagggagatgcgtaggctatctgcaggccaagagagccacggccttggaaagggctgtaagttctaccacactattggtggttctcgccatgcagcttggagaaggtgcaatactctccagctccacagctaccgctaatgtttgtaaaattcatacctaataaacactagatcaaaaaaaaaaaatcacagacctgtggtaggctgggcaccagtgctctaaagcaagttctgcctaaactggcagggacatttttcacatcaggaacaggagttgttcctggactctgtctggggccaggctgggagagacgtggggcagagtggggcaggggcaggggcagggctgggggctggggcctgggcagggccaggcactcaagtgaggccaagtcctggagcgaaccagttcctggtggccgttggacagctcacacagctccctgccaggtcacccgccatggtcctccctctgccctggctctctcggtaccatttccttcgcctccttctgccctcctggtccttggcaccccagggctcccatgggtgctgctcccaaaaccccaaagcaagcatggaagagcagaccagctccagaggaaatgggaagatgacgtcccctcccagggtaagtggcaccacaggtaggaacagagggtgtgagaatttacactggggtgtgggaaaaaaaaaccctcaatcccaccctgcaccaccccacaccatgcctacccctgcagctcttttcttagttcagctaccaactcctctccccacctcccccagcccagacctcagggttcccttccctcaccccacccccacccacaacagcacagtccacaaagtccttgaacaggatctattccccctcacctaacagttaattatttcttagcggggaggagcagctgatcctctttccagtgaccccatatccttgttcaaggaagccagttacagcccctgggccagggaactctatttgctccccctactaccacccagaggcctatgcccaagacaggaagctacctggccttctcagtacaggtgtccttaaacgaccggttcaaaaacgaatagggaaggtggaatttctcacttccagccacagcctgcaacaaagcttcccagggcctcagccccctgccctggctgatgctccctcccttaattccctgaccagggccctgggacccaccgcacagctgagctggcccgagctgaagagttgttggagcagcagctggagctgtaccaggccctccttgaagggcaggagggagcctgggaggcccaagccctggtgctcaagatccagaagctgaaggaacagatgaggaggcaccaagagagccttggaggaggcgcctaagtttcccccagtgcccacagcaccctccggcgctgaaaatacacgcaccacccaccaggagccttgggatcataaacaccccagcgtcttcccaggccagagaaagtggaagagaccacaaagcgcaggcaattggcaggcagtgggggagccagggctctgcagtcttagtcccattcccctttgatctcacagcaggcagggcacccaggccttataggaattcaccctggaccatgccctaaaataacctcaccccaaatacaataaagggacgaagcacttatagataccacagacacatgtgtttcatttttagttttgttaaaaaaaaattctgacaaatcagaaatgggggttcaggagtggtggtgatgcaaaagatggaagccatggggtgggggctgtcaggggtgggggcagtagtgtctccttcacccccaccctggtgtcctctcctgaaggacagacggtcacattccaaaatgggcgagtcttctaccgtgtctgttcaactgagaagaaaacgtagcatggtcagaataaggcatgaaaaggggaaagtgaggcaggaacacacggcacacatgcagacactggtgtactgcctgggttcagaggacggacgtgggggtgagggaagggatgtaatatgatgagagaagacaagacaccccacataaaggtcagaaaaacatcccaacacagcatcaaagaccagggggcatgaaccagtcaagtgtccattatgcatcagatgcccatgacctatgtgatgggatttcggacaaacacactaaggaacagggaggacctaaagggtttcatgagatcagtactcactgtaggaggagatgtctatctcatcaggcagctcactaatattgacctcaaagcgatcctgcacatcattgaggatcttggcatcattctcatcggacacaaatgtgatagccaagcccttggtgccaaaccggcctgctctggccacctggagggagacagagggtagcactggaagaccgaagaggaaagagacccagaggcaggaatgaagatgtacaaacagaaaacaagggaatgggagagtgggattttttcagcctgtgaggtttacccgatgcaggtaggtgtcagaatcctcaggcatgtcataattaaaagcaatgttcacccgctcgatgtccatgcctcggccaaataggttggtagccacaagaattcgtcgttgaaaatctttaaactgctgataccgagaaagcctttgtgagaaaggaaatttaaaacatgttgagattcccttctctcaactgtctttttctcccaaggacacaaaatatctttcccatcttcagctcacctctcctcctggggcatcccacggtggatggcaatggctgggaagttctgctccactagtagctgggccaaggcaatgcaccgctgcacagacttcacaaagatcaccacctgttgtggggtggggtggggggtcgcaaattgggggaataggggtccatggtgtgtgagagacattacgtgggagaggggagtttctagtaattacgttctcaggaattcctcttcatttctcttattcccccactatatatttagagcagaaaaggaaatataactttacttcagcactgatttttccctaaggaagctggcctctgaggtagcacagagttcagaaatcaaaattgccagacatgctaggagatgaggatgagatcacctcatgaaaaagtgataaaaaactagaattaagatctggaggggtaactgatattcctgctcaccaaaacattaaacctaagggagctatcctaattctagaaagcagttttaaatgcaaatagaccactcacaagtatattaattaaacacttttttgagatggggtctcactctgtcccccagactggagtgcagtggtgcaatcgcaagtcactgcagcctccaccctcctgggtttaagagatccttccacctcagcatcccaagcagctgggaccacaggtgcacaccaccacgcccagctactttttttattttttatttttactatttgtagagacgggcgtctccctatgttacccaggctggtcttgaagtcctgggctcaagcaatgctcctgcctcagcctcccaaagtactgggattatgggcatgagccactgccctgcacccagtcagaaatgcttctcttgaataagcagttattagaggaattaaacattcaagaaccctaacatgcccccaaacatcgtttcaagacttttaacaacttcctaaaatccttcaaggacttttggagacaagatctcactctgttgcccaagctggagcacagtagtgcaatcatagttcactgcagcctcaatttcctgggctcaagctatcctctcacctcagccaccagagtatctgggactacaggcatacaccaccacacctggctaatttttttcttctttggtagtgatgaagtttcgccatgttgccccgactggtctcaaactcctggactcaagtgatccacctccctcagcctccccaagtgctgggattacacacataagccaccgtgcctggccaaggatcttaatttttgaagtttattttccttgaggttattgaggacatacccgtgccagccatagaatagaaaagcagctcccaccttactcatgctcagcccctaagatatttataccctcattattctctcccacatcacacatgtgatttcctcaataaaagtgtacttaatatccaggtttctgctacagctggagtgctccaatgctcatccccctactggacgtctaactgacctggttgaactcaaggacatccagaaggtcaaagagcttccggttcttctcgttgtccttcagtttcacgtagtactgctgcaacccatgcagcgtcaacttcgtctcatcatccacgaagatctccattggctgggggggaggaagggggtggggaacgggaggagggcagagtgggggggttaaacctgggggggtggaggaagttgatctccaatacaccccatggggggatggggaggaaagagaagattgaaaaccccaccccactcccaaaaatacccacattttactgtggtctctctcacattacatctaatttccttcctatcagatgagttttaagactgcccaactaaaaactatcatgggaaagaaactgcaaatgaagtcaaggagcagtgaaaccacccaatggcacagatgccattacctcaaatagaggtgggagaggaaagaaaatgggagatgattctcaaagggagagcaaggaccaaacatctgggaaatgatgggaggcagtgactcaaggtcagaataactccatcagaggtgcttctaagaacatggggtggggggaggacaactgctccatttgattctcctacttcaactaagagaatctcgtgtgcattagcaaagtggatgtcttttaagatcagaatgctgcaatggacagtcaaaatgccacttaaggagaaacaaaaattactcaagatgagttacttgccgtcagaccacaacaggatagttttagatgagactggtctcttgactaagaattaaaccatctacaggtttacaggaaaggtatcagtaagtggtgttaaaataccaaattcagagcagcagatacacttttaagggacaggatctcaccatgttgcccaggctggagtgcagtggctattcactggcacaatcatagcacactatagcctcaaattcctgggctcaagtgatcctcctgcttcagtctcctgaatagctgggactacaggcacacaccattatacctcactgcattcatctttaaaattaaaaaaccccctgaaggggaggaaagtaacaaagacagaaattaccacaactccaaagcccaactttcctaacactttttatactatcctgggggaagatagttaatatgaagacccagaggacaaaataggaaaggatgcgtgtgtcatgggaaaaaaaccagaagcccaatcccagaaggcaggttttgttttttgttttgttttgatacagggtctctctctatcacccaggctggagtacagtggcacaattacagcttactgccacctccacgtcccgggctcaagcaaaccctcctgcctcagcttcccaagtagctgggactacaggcatgcgccaccacgcccggtttttctggtagagacaaagtctcactacactgccccagctagtctcaaattcctgggctcaagcaatcctcccaccttggcctcccaaagtgctgggattagaggtgagccaccaggcccagccaaggcaggctttctaaagagaagttccatggcctccttcaaatctcattctagccccaaatacagctaaagagtgatcatcccacgggaaggaacactgcagggaggggaagaacacactccactgcttatgcaattggccccacctagccccaaaccctaacaaccacccgattacatccactttacctttcctatgtccctctcctctgagtattaaaaaaaacaaaaaaatttttttaagaaaaaaaatctaccaccccattcaggacacccctccccaacacatattgggggaaacggggcacggcacgcgttgggttcaggaaaaaaaccgggaacggaaaaagaggctggtttggtcctcagcttcctggtcaggtttccccgcggcctccgctgccgccatccaccgctgggtgccgtctgcattccctcgccgcgccacggtgcttctctgttgccggctcacatcaaccgaggttccagatgggtgcaaggagatgtgggtgggaaggagtagggtatcggggattgaggtgccaaaggcccccacccctggaggtggggaaggggaggattcatttgtgctgatgctcttcttttggacatgccctgccatctgtctgtccctctcttgctctcctgccaccgggaagtaggagttttggtgagcagaaggctccagctgtacgctcgatgccaccttgagggtgcgtggctgtagggtgcatgtaagagacgatggatgggtgggtggtagggcagaaaaatcctgccctcccccaaagggagaagaggttcaaaaatgttgtgatttatgaaaaagtcgaacactacccgctctcacattaacccgaccaagtcttccggagtttccctggcacccgcgcaggccctaacactagctgtctctgcttctgtatgtctcttcaaggagtcattactcccagttgggcacaagccgccttcttggcacttgaatgacaagggagtctgaggaagagggcgaggaaggggaggaggcagcgggcggggagtggagggagagaaggtagaagggtatttacatcttgcatgaacttgcggcagactggacggatctctttgctcaaggtagcactgaacatcatgacctgcttctcgtggggggtcatgcgaaaaatttcctggacatcccgacgcatgtctacaagaacaaggaaaaaaattgtaggagaaaataagcaggtatgataaacaaagattagaggtagacttcccagtgaggtgaagattgctggaaatagtaacaacacaatggaaagagcaatggacttggaatcaagaagtgggatcagattccagctgtttgttttaaccaagcaagaaataaggtaaaaccccaaagttcccaactatgaaatggggataaagcccagtgcagaggctctcaaggccttcaaaacatgctttatgggaccttctcccaaccctttcctgcccaagccccagccagccttcagcagactacaaatatcaagcacatattatattccagatatcagagtccatctatgactctctggattacttttctatcaagtcaggcaaatatgacatccctacctggagcccacctttatagctcaccatatagaattgccaaagatcatttgtaatgacttatggggcctatgtccaaccccactctcattcaccaagattcaattcttacagaaaaatcttccattaaccccacctggcacactagaataccacatcacacaaactgctacaaacactctctacattaatcccagacctgagtctagacacttattcagctataaattctgactgtaaatgctgtgctggagatgccagaagggtactgtcttctctttcagtttagaatctccgctatgactcccagtatatgaatctataatgaaaacggtggtggtggtgatgacttatgcctaaaattatcaaagtcccctattctcaaaggttaaaaacaaaaatcatagaaagatgatagatgacaccctttactgtgcttaaaagcataataaagaccaaccagggaacccagagccatcagtcatgggtgatagataagagtcgtccttgcactgaggtgctcctgtttcaaataaacatcatttggctccaaagaacaactccccagcattagccaagccccagcactgccactcaccgagctgttcaagcatcttatcacattcatccaaaataaagtgtttaatgtgtttgaggttgaggctcttatttcgagccagggctaggatacggcctggagtccccacgacgatatgcgggcagttcttcttcagcacctcttcatccttcttgatagacagaccaccaaaaaaaacagcaacctgccgagccagaagcaaagagtctcaaaacagaggaaggaaagagtccaatccccccagggttcccactctgtttgagctaaaccaatttttagcatgtttccaaactaaaactaactttagagggcacctaatttaaaaattttatgtcccccccaccaaacactgagggtgattgcctaaagttacatggctagtcggagcagtcaggacaataattcagttctactgacttaatctaaccaacttccttcatttatgaggccaggcttcatttaaaaaataaaggagccaggtgtggtggcacacgcctataattccagctactcaggaggctgaggcacgagaacctgggaggcagaggttgtggtgagccaagatcccaccgttgtactccagcctgggcaacaagagtgatactccatctcaaaaagaaataaaataaataaaaataaaataaagccaggcccagtggctcacgcctgtaatcccagcagtttgggaggtcaaggaaagtggatcacttgaagccaggagttcaagaccagcctggccaacacggtgaaaccccatctctactaaaatacaaaatttacaaatttactactaaaaaacaaaaaatacaaaatttagccgggaggctgaggcaggagaatcgcttgaacccgggaggtggagattgcagtgaggcgagattgagccactgtactccagcctggatgacagagcgagactccatctcaaaaaataaaaaataaataaataaaggacagcaagaaatcaccagattagtgtaaagtaccacaaaaaacacatggaacattaaggtttcctaaataaacccagaatctcaaactcttttcacacaaaccccatgaaattactgcttcgggctaaatattatcatttcatgttaaaaccattaggtgaatagttgtttggggatctgggccttggtacagtatcaaataacaccagaaactactttctggtttcaagggggaaaagaacaactgtggaatcagactgtcacgacgctaatcctatggtaaatctaaaatcattaatgaggccaggtgcagtggctcactcctgtaatcccagcactttgggaggccgaggtgggtggatcacttgaggtcaggagttcgagaccagcctggccaacatggcgaaaccctgtcactactaaaaaaaaacaaaaattagccaggcatgatggcacactgtagtcccagctactcggggggttgaggcgggagaatcgcttgaacgtgggaggcgcaggttgcagtgagctgagatcgcgccactacactcacagcctgagggacacagcgagactccatctcaaaacaaataaataaaaataaaataaaataactaacataagtcgaccagatttgtggcataacaggagatacagtatcacctatgaaggattcttgccaaaaatgcttaacttcaatcagattttttctttttttttgagatgggagtctcactctgccacccaggctggagtgtaatggcacaatcccagctcactacaacctctgcttcctgggttcaagcgattcccctgcctcagcctcccaagcaggtgggactataggtgtgtgccaccatgcacggctaatttttgcatttttagtagagagagggtttcatcctgttggccacattggtcttaaactcctgacctcaaataatccacacgccttggcctcccaaactgctgagattacaggtgtaagccattgtgcacttggccagaatcctcaatattcacacaccactggagctgttttaaagtttccggctttctctgccacataccccaaaattattaaactgatatgattcaaagtcagtataaagtagtaagaaaagggtggtcttgtgttaagcatcatccatagcccaattacgaatcctcctgttacataggaactcaacactctgttacaccacagcaaactaaagcttctccaaaattaaagagactattggcctacaagtttcttatccctccaacttgccacaccctcactctcaggtctctttaccttggcttaccttgacattgggcatgtatttagagaagcgctcatattccttgctgatctgaaaagccaactcccgagtgtgacacatcaccagtacagacaccttaggcaggaagtagacggagacatatggtaaatgtagctcttcattatcccctctagggaagtgactgtcacaaaaacacacctgggccgataataaatgacttcaattatgtgatctaaatcatgaaccccacgcttgcgacagaacatcccccacagctgtcaggttgtcaagggtaacagaggtcatgtgctcatggctctgcaagcatcatgtagctaggacaaaaacacccttcccttatagtcctaaccaaaatcccctccccagcactctccccaaatatacctgcccagtaactggctccagctgttgcagtgtggccaagacaaacactgctgtctttcccatgcccgacttggcctggcacaggacatccattcccagaatggcctgagggatgcactcatgctggactaaaagttggggggggaggaagataaattagacttcagtctccagataactctacctttttcaccatgccaagcccatttcttaccactcaattctcaaagtctagtatttacctggttcttgccaacttccagacccattttacctctctctgctcaattacattcacctcaaaatcagactctcctaattcctcctagctttagcctcctccagatctaggccttcccagtcctagtaacaaaccccttgcatctaccaaccgctcaccttcaatgatcctagctctgtccttatttttcttaatctgtaacaattcatgacatttgaatacctgccacagaccacttctcctgcttaggttgctatacttcgggtcacgtaactactacaaccctggacaaaatgaaggacttggtacctgacccagaagccagtcatctctaaaccagtcatagaggtttccagagaccacagttggcctggcccaacagagggagactacaggtccaagcaggacctttctggaaatttaaaattagaagtcaagtgacaaaattaaaaataagcagacaagaaaagccagtcacaagaatgaatggcagacctggaagtcacttttggatcattagcactttggtgctatcacgaaagaaagaataagcctgtataagcctcctctatccaaaattgtttttgatacttatcccctgattttttcttcctcactgtcgccccggctggtgcacagtggtgcaatcacggctcactgaagcctcaaccttcacctgcttaatttctgaacgttttgtagagacaggagtctcgctgtgttgcccaggcttctcttgcacttttgagctcaagtggccaccctcctgcctcggcctcccaaagtgctgggattacaggcgtgagccactgcacctggccctgatctagccttaagtataaacccttaccaccacctgagcaacgacaaacacatctttgtattgtacccttaaagagcccaatgagcactacatgcccaagagaaaatttaccttctgacggatgctcaaagccacagtcgacaatggcccggagcaactctggcttgagcaggaagtcacgaaagccagagctgtggatggagacataggagcccttgacatccttcttggcaggggcctcagccccatctcccccagctgctgtctccacctcatcatcttcatagtccaagagctcattgtccacatcgttctctgccataactgggccggcaggggaagaagggaagggggatctggatgggttctcgcaaaataggtgaaaacaaggggtgaagagtaggggattgaggaacagcaaaggaaaacaaagatactatttctaacagaagagctggaggggggaaaaaaaaaagcaagacttaatcacgagcacagccttcaccacctcttttccatccccagttcccactttccctaaaccaggaaacttttacctggaaagaaaaacagatacaaaacataaaaacgaaaagcaaatataacagaacagaaaaagcagtaccagggaaagtggttaggacagaggttcccaacaagattagcaatcacagtagcggaaaccagaaaagttggaaggggaagaccaacttataaattcttgatctgaaagtaacagtgaggaaatagaatagataataaaaggtaaaatacgactaataacttagtaaagtggaaaatggagatgacaagtagagtcctgaaaagtcctcaaaggaagactccgctttccctattataatcccaccgttatggatgcctaactcagcagccatcagtcaagggtgatagatgagggtcatcactgcgcaaagcgctcacctttcgaaaagaaaacatcatatggccgccgtccacctcccatagctctcagcctcccacttctcagtatcctcccttccgctgtttaagcaagccttgtgtaattagcatgggggggaggggcggtgcaagacaaatggctcggccacaaaaaaacaaaattcatgtctccaccctacaataagaaagctaataggtgacagagaaaggcaatccccgcccaggctttaacaggatctttaccaagtggtctcacatcactgttacgctacgaaggtgagactccttttggagaaacatacaatgacaccaatcgtatcgtaaacacttggaaggcactccaaattaagttgggcaagtcaaggtgagaaaaatccaactgggcccagaaaccagctcctcctcccagtcccaccgagggccgagaaagagctcaagaaaggacaaggaaggtgagaagagccccgccctccgcaaataccaagaccaagggacgccgagcgccgcctctcattgatgctgaggcctccaatatgagaagaacccattggaagaagggagcaaaacgaacacaatggcgccgaggacaccatcttggattgggtccccccttagcttcccttccttcccccaggagctctttgctctcgaaagggatgcaagctaaggaaatagcgaaccaactaggccccagcgaccagaccatcgcctgtgaaaagggtatcaggaacccatgtgacgggatgggtgcggagaagcgcagatggaaacggattgtagcgaaggccaaagcttacctaaacagggagagcgcgtatggcggcagcaacagcgacgaaggagggaaatctgccttcacttccggttgcaggcttccctctactccagcctcccgccttcttggctgcaagagcgcaggcgcaagggaccggaaacagggccttccgcggttatacagatccgtgcgctccaggcttgcctttggaaaatgcctgtctgaaatttgttttaaaaccgtttctaacttcactgctaccgccagtaacaaaagatataaaggaaactaacgtctcccccccactgttatctttattctcttatcctactcctctccatgcccctcatctcttcgtttaggtttttgccacgcaggtcttctctgtaggcacccctccatggatgcgcgaggaacgagtgtggcgaaggctgcgagttcccacggggtccttggcccggtagtgaaggtgacctgaggactgctgggcacgcactaggaaccggcaggccctagctgaggggagggaggagggaagtctcagggaactggattgctcgggggtgtttcccgactctttcccagtcgtggggctggtgggcggtattttcccaaaaggatgctgtccgaggtagctgatgccctagggccagtgagtcaggaaggtgttctgaatccgagcgggaagacggggtctggattcggccccaagtgttaatagtagggcttgagggttatactacattccattaatactgtttttgtttttgttttgagacagagtctcgccctgtcgcccaggcgggagtgcaatgtcctgatctcggctcactgcaaccgctgcttcccgggttcaagcgattctcctgcctcagcctcccgagtagctaggattacaggcgcccgccaccacgcccagcaaatttttgtttttttagtagagacggggcttcacccatgtatgacctcaggtgatccacccacttcggcctcccagagtgctgggattacaggcgtgagccaccgcgcccggcccattaatactgttaattcgagcagaatgttcttggccccgccccaacagccccattgttcaacctggatttttttcctgaatgaaacatttgctatccccgtctttgagatggggagctacaaaagtaagacctgatgtcctgctgtgtaataaaacaacaaacgtttggccctctccctgttaacatacttaatcatttaatactaaggagtaggtaccgttattctcatcttattgacagaagcgaagcaaagcaacatatctcaagcagtacggctggtgaggttacagccaggatgcaaacatctctcattctctattgtattctgcctccctgctcaaagaatctggttagtaaatacactgcaggttaccttattggttcaaattcttggtgaagtaagcttgtcttcagtgacaaatgaagtaactaattcaagaatggtgtcatagaaggtattttcccaagtatcatttaatttattcaaaagtatttatcaactgcctcccttgtgccacatgttgtcctaggatctggggacacaacggtgaacagccctgttctcacagtgtttacattacaggaaagaaaacacataaacacaaatataatgtcaagtatcgataagtggtcagggtgcagtggctcaggcctgtaacccaacccttgaggaagccgagcccgaaggattgcttgagcccaggagtttcagaccagcctgggcaagtgagaccccatctctacaaaaaattttaaaattagcaaggcatagtggcactcgcccgtaatcccagctactcaggaggctgaagtgggaggatcatttgagtccagggggtcaaggctgccgtgagctggaactccagcctgggcaacacagcaggaccttgtctcaaaaaaccagtagcagtaagtgctatgaagaaaatgcaaggtaaaggggcaaagagcacttgctcctacactccagcttttctctacagttgcgatctatagtcctcagattcccaaatgaggaaccatgtttctcactttagagaaataataaagtactacttgttcttgtttctccaagaagtttcaaaggatagccatttgggctgtttagggaatatgtaaacaaaaaacaagaaagtgactgaaggccaggcacagtggctcacacctctaatctcagcactttgggaggccaaggcaggtggatcacttgaggtcaggagtttgagaccagcctgaccaacatggcgaaaccccatctctactaaaaatacaaaaaatagccaggcgtggtggcacacacccataattccagcaacttgggaggctgaggcaggagaatcgcttgaacctgggaggcagaggttgcaatgagctgagatcacgccattgtattccagcctgggcaacaagagcaaaactccatctcaaaaaaaaaaaaaacaaagtgactgaaaatgagaaatgatgaggcaaaaggaggctgcttcaactcaccaatttatttgccaataattattttattgatactttttttattgttacaatgggaaagtaaggtgtcaaggatatagaaaggaagggcatgcatatgagggaacacagtatcattttagatcttagaaagcaatgagcatctgataagtctttggggaaataggaaaggaggaaaatctaataaagacaaagatcagcaaaagaaaaacaaagagaggctacaaaatgcagttatctacctggaattataagagaggggctaaatgtagtcatctcctctttttggagatcagaaggtctctgggaaaagagaagaaccaatttttcagaaaataactagggtcacagaatgaacaagtggaattagagagccagtgatggacgtgaggaaacagctgtgtaggttttgaccagtgagcaggtggtggtaatagtatcacagggttgctacttactgaatcactgctacaacatgcaaggaactgtgctagactttacagaatgattcctaatcattgaagcaaccctcacaaggtaggcattattatcatcccagtttcacagaggaggacatcgaggctaccaagttaagtagcttgtcctggtttcacagccagcaagtgacagggtcaagagagggacccacatcggccagacactgaagtcaggatgttttccacattcctacttccccatattacaaatttcacagagggtttaggtgagaatgacttggaagtttacaaagtcccagtgagggttaaagaacaacaaggagattcagatgtgagcaggatatttataagtgtcacaggaaaattattggatcctgcctcccaggatttctaggggatggaaagaagacagggattatggtgggaggtgattttgattggaggatttctttgagggagggaactggcagaaggagtcaggccctacggtggccctaggcagaaatccggtagttggggtggacctggggcctgacgtcgcagaccatgccaagaagctgggccaggacacgctctcggtttctctgctgggagctctgcatgccctgcacctggcgccttgtagcctgctccacctcagcagacaggttcccctgggagcccatggcctggggggtagggagaggggtggaagagagaaagggaaaagcagaaacagacaagggtccaggcatatgaggggaaagatcctgaaacaaagcctagaagaaaggccctctcagaaaccacccccatcccacagaaatatcccaacaccaaagagatcaacacagtcccctttccccttagacctaacatgcaacttcatcctaaaacagaccgtaatatccccaccacctcaccatccatgaccataaaactctaccctccaccacaaatgttaatcatactccacatagatgttatactttacacagactgtggcattccgcccacaagctctatgtggccttcaaaactcccagactctcctacatatcatcacaaagtttcaccaatgttgtggtccctgccagggtcccctcagcctcagccctctgccaccatattttcttgttgagtcacccttacacacctcactagatgcacccaccaacttgcagtggggtctcaacccgactctgcctcaactcaccgcctgctgcttgctctggaattcgtgctctcgctctctgcggtattgctccacctccatctgtgcctcctcctttgcctgcttcagtcgccgggccttccctggaggcagaagaaaggacagtgagtggggatggacccacacacacacaatgtaatagcaggagtcagtcccttccagaaagttatacagccttctctcagccaaccaggtgccagattctaatatccatccatttcttccctcctaaccagcctccagaccctagctgtctgtcttcccgccagccttgggttttcccaaaatgtttgctgtcccccacccccaattttctttccaaactcctaagggaggaaagaggagactcactctttctggcatctgccaccttctcagctgcccgcttctcagcttgcagaagctgctggataccttgggactgactggccatttctgttgttatggccgatgctgttttgaatgctgtcaaagtaccagatggctcccaccccccaccgcttacttctcctcctccagctcgttgctgcagtcctccactacccctgggtcttagtgctcccctgctcactcagcctcctgcaccgagtgtctctcccaatctcatcctcctattgatgactggtcctcctctccagcacttcttgctcaggcagtacccaaaggggccgcctgggagcagcagagaccaggcccaaagctgcgggcttacaacaggttagccatcccagtcggaaaggtctagggatgaggcaggggcggagacgggggagtactgaggtgagagaaggagaacttgattggtggtaacagaggaagcataaagggttgtgaatgcggtgaaaaggtaaggatgtcatcatgcaacctgtgttgggaaaagagcattctgggcttaattctaaactaactctctacctttctctctctctccaccatcccgccccctcccctgcctcccgttgttaacatctccatctttttctacatatttctcaagtccaaatttttgcatctcacttgccccatcctacgatagtcttcttccgtcttttgtctgtattttttctttttttttgatctgtccctgttgttgtcccactgtggtttttgtttttgttttccatgtttaatgtgatttttatcctgtctttatctcctctattttctctgtcttctcatcttttcgtccatcactgaaccatctcctctctctgccaagttagaggaggcgggaaaaaacctccaaataactctcttttctccctcccctcccctcgcctccttttcctcgcctccagtccagtcttctggtttcagacggcccctttaatttaagttccctagtttcccctgggagatctggccaagaactacccggtcggggcggaacgacatccggtaacgcccctcacagttcacttccgtcctccacctgcgtctctgcttgcgccatttcctccagcctggagtgtctccgcccttcccgcctcccgtctccgagcttcttaaacacaggccttgggcctacggctctgggggtacttgggggggcgggggcaggtctgatgagtaacccctccccccaggttccagaggaagaagcctccacatctgtctgccgggtacatgatattcaatttctagatcattattggagattatctgtgactttttaaaactcagatttctgctgataaaaattttccccatccggccctgttgggtttttttaaagttctttgttaaaaattaaaaatttacctgggctcctgagccttaaaccaattatttacccttttctcgaattttacattaaaaaaattaaacctctgatcctatcacccccctcaaaaaaaattttttttcaaatctatcatctgataaaggatcagggttaggttaggcctcatctcttgctgaagatattaaaaaaagacggaaccaaagggagaaacaacaggggatgtcagagatggagggagaaggaccagccaaggctgaagtcctgactgctgccttttttccttccccagcccaagagttccatggcctccacttcccgccgccaacgccgagaacgtcgctttcgtcgttacttgtctgcaggacggctggtccgggcccaggccctcctccagcgacacccaggcctcgatgtagatgctgggcagcccccaccactgcaccgggcctgtgcccgccacgatgcccctgccctgtgcctgctgcttcggctcggggctgaccctgcccaccaggaccgccatggggacacggcactgcatgctgctgcccgccagggcccagatggtgagtctgctcagtggggaacaaggtcataagcagctgaccagacctgaaatgaaagccaaccaatagttgagaaataagctggttatttggtcatcaggacctagggaaggagttaaccaagttggcatgtggctgtcatttgtccctttacattactgagctaccattgtctgaagaacccaacattccccaaagatcaactggtcttcaaatttcacatctgtttagattagtagctactttgtttcttgacagattgtttgctcgtagccaaaaagtagcatagaaggtaggctctggagttagattgcctggattcaaaccccagctccaaatcccagctccacacttcatagctacgtattcttggacaggttacttgaggcttagtttgcccatgtgtaaaaattaaaataataacaacctttgctatgtgccagacatttcttataaagtaacacatttaatcctcacaacaatcttaggaggtgagtactgatattatcccccatttcccagctgaggaaacagggcatagagaagtcatttgccagagttacagttattcactggtagagcagagattataacccagatggactagatagagtgtccatgcttttaacagctacattgtcctgtgttatacattatagcattgtacattgattgtgcccatgttcagagtacccatgttgtgccatatatgttttgagaatcaactgacatagtacataattagagtacctggcacacacgataagcacttggtatatgctggcgattgttgttcctgtttctctgttttttgtttttgtttttgttttttatgaagtttcactcttcttgcccaggctggaatgcaatggtgcgatcctggctcactgcaacctctacctcccaggttcaagtgattctcatgcgtcagcctcccaagtagctaggattacaggcgcatgccaccacgcccagctaatttttatatttttagaagagatgggttttcgccatgttggacaagctgatctcgaatgcctgacctcaggtgatccaccaacctcagcctctcaaagtgctgggattacaggtgtgagccaccacacctggccttgttcctgtttttgttatcaacaggtccatactcccttaaccacaattctaaactcaaaaacactctgagaaccaacatttttcatcaggctgccaccaaaattcatttggtgacagaaacctaatctgaactaaagtaagactattatttattttcatcctactgatgtcaatattcatacatttccctgcagaaacactcatgtgtttggttcttgggctgcctaggccctcctgggctacctaatatagagtgagtgtacttttaggtcagccctatcaagtcccaaaaacatttgaattctgcaaaacctttggcactgaaggattcaaatggggaacctggtgatattataatagtggtggaggccaggtgcggtgggtcatgcctgtaatcccagcactttgggaggccaaggcagtcagatcacgaggtcaggagttcgagaccagcctgaccaacatagtgaaacccccatctgtactaaaaatacaaaaattagccaggcatggtggcacacacctgtagtctcagctacttgggaggctgaggcaggagaatcacttgaacccggaagacagaggttgtggtgagccgagattgcactactgcattccaacctgggcaacacagcaagactccgtctcaaaaaaaaaaaaaagagtggtggaagcagctctttataggtagagccctgcttactagaataaaagctgaaaccttctttccccatctagagatttccttctggagtaagaacattacaggaaaacctctagatccagatgaacaaccctaacatcccccagctcaagtatagacagaaggcccctcccccaaaactcccccaaatggtcaaaaaaccccctatttaaaaatttcctttaacgtacctgagataggctagcatattcagatttgtttcttgttgtttttacttaaaacagagtaggtttactgagtgcaggcatctaacttgacagctcatattgtaagaggcaggaccctggaaggcaaaagagcggattaccccgaagcagacctgcatccagaccccagctctgccatcaacagggacatgcagcttacctctgtgagcccaatttgcctcgcaaaaatgggagttttgttttttgttttgttttgtttttttgagatggagtttccctgttgttgcccaggctagagtgcaatggcgcgatttcagcccacctcaacctctgcctcctgggttcaagagattctcctgcctcagcctcccaagtagctgggattacaggcatgcaccatcacgcccggctaattttgtatttttggtagagacggtttctccgtgttggtcaggctggtctcaaactcccgacctcaggtgacctgccagcctagcctcccaaagtgctgggattacaggcgtgagccaccgcgctcagccaaaatgcccctgatagtgtggtagggatttcctttattgtttgtttgcttgtttgttttgagacagggtctcattctgtctcccagcctggagtgcagtggtgcaatcatggctcactgcagcctctacctcgtgggctcaagcagtcctcccacctcagcctccctagtagctgggactacaagcacacaccaccatgcccagctaattgtttgtatttttggtagagactgttttgctatgttatccaggctgttctgcatctcctgagttcaaacagtctgcccacctcggcttcccaaagtgccgggactagaggcgtgagccaccacacccaactccattgtattgaattttaagaagctggtgagactgatattatcccatttacagatgaggaaagcagggcccaaaaggttcgggaacttgtctgaaatctcacagctctcaggtcattgtcttccaaagggggacccaagctcagtgccttcactcccagaccctggtgtcctctctggccttatttactcctggtcctctgccagccctgccaccagatggccttctaactccttggttgaaaggcccatctcattcagcttccagcttcctttttcttttccttttgagacggagtcttgctttgtcgcccaggctggagtgcagtggcatgatctcggctcactataacttctgcttcctgggttcaagcgattctcctgcttcagcctcccaagtagctgagattacaggcacacaccaccatgcccagctaatttttttatttttatttattaatttttaaatttttatttgtttatttatttttgagacggagtctccctctgttccccaggctggagtgcagtggcagtatcttgactcactgccacctccgcctcctgggttcaagtgattctccttcctcagcctcctgagtagccgggactacaggagcctgccaccatgcccgactaacttttgtatttttaatagagatggggtttcaccatgttggccagactgctctcgaactcctgaccttagatgatccacctgcctcggcctcccaaagtgctgggattacaggcatgagccaccatgcccgacctaatttttgtgtttttagtagagatggggtttcaacatgttggccaggctggtctcaaactcctgacctcaagtgatccacccacctcagcctcccaaaatgttgggattataggcatgagccaccgtgcccatcccacagaatgtcttttggttttgtttttgttttctgttttgttttgttttgttttgtttgaaaaggagtctcattctgtcgcccaggctggagtgcagtggcacaatctcggctcactgcaacctccacctcccaggttcaagagattctcctgcctcagcctcccaagtagctgggactataggcgtagggactgtaggcgtatgccaccacgcct

SEQ ID NO: 1040 - DNA, 64071 bp, Homo sapiens
gaaacatggcaatcttggacttcaaaggaaggacatacaagtctttactataactgataaaacaattattagaatatttttaattaaaaaacaaggcgatatatatatatcgcgatatatatacatacacacatatacgtatatagtgtatacactatatatgtatatagtgtatatatacgtatatacgtgtatatatacacacactatatacatagtgtatatatatacacactatatacctatagtatatactatatacgtatatatacacacactacatacgtatatatacacacactatatacgtatatatacgtatatacgtatacgtatatatacacacactatatacgtatatatacacactatatacgtatacatacgtgtatatatgtatacatacgtatatacgtatacatgcatgtatatatgtatacatacgtatatatgtatacatgcgtgtatatatgtatacatacgtatatacgtatacatacgtgtatatatggatccatatatacgtatacatacgtgtatatgtatacatacgtatatatatgtatacatatatgtatatatactctgggcaccagagtatactctatatatatgtatacatacagacacacgtatacacacacgtgtatacatgtagacacacgtatacacacacgtatgcatgtagacacacgtatacatacacacacgtatacatacacacacgtatacatacacttgtatacatatacacttgtatatacacttgtatacatatacacatgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcacatgtgtgcgtgtatacacatgtacgcatatgtacatatatactctgggcaagagtgagatgctatctcaaaaaaagtgtatatatacacacacatatacatatatgtgtgtgtatatatacacacacatacgtatatatgtatatatacacacatacacacatacgtatatatgtgtgtatatatacacacatatatatgtgcgtgtgtgtatatatatacacactttttttttgagatagcatctcactctgttgctcaggctggagtgcagtggcatgatcagggctcactgcagcctcaacctcctaagctcaggtgatcttcccaccacagcctcccaagtaaccgggactacaggcagatgccaccacacccggctaattttttgtatttttttttggtagagatggggtttcaccatgttgcccaggctggtcttgaactcctgggctcaagcaatctgcctgccttggcctcccaaagtgctgggattacaggcataagccagcatgcctggcccaaaaaaagaaagatatcggatttcttgtgagaaataaggtacctatcattttcacaccttatgtctctaaccacttattttgatctggactacatctggactaaatcaagttaatggtatacagaagcaaatttttgactgctgagttcatttttgtatgaaaaaaggtttttttttcatttcttaacaaataaatataacgtcgactgatctttgataggaaagtaattctgaatgcagtgctctgcccaaaatgttttgtgtttttttttttgtcttttttttttttttttttgagacgaagtctcgttcttgttccccaggctgcagtgcaatggtgtgatctcggctcactgcaacctccgcctcccggattcaagtgattctcctgcctcagcctcccaagtagctgggattacaggcatgtgccaccacacccggctaatttttgtatttttagtagagacggggtttcaccatgtttggccaggcttgtctccaactcctggcctcaggtgatccacccgcctcggcctcccaaagtgctgggattacaggcatgagccaccgcgcctggtccccaaaatcttttaaaactgaatttgaggctgagcacggtggctgacgtctgtaatcccagcatcttgagaggctgaggcagatggatcacttgagtctaggagttcaagaccagcctgggcaacatgatgaaaccctgtctctaaaaaatataaaaactagctgagtatggtggtgcacacctgtagtgccagctacttgggaggctgaggcaggagaatcgctggaacctgggaggtggagtttgcagtgagccgagatggtgccactgcactccagcatggagacgacagagtgagactccaaataaataaatattgaacttgaatgttttacccttcagtgtgactttctaagcttaaaccactcgggaaaaaggtatctcaatataattcagttcaccattttacacttataaaataatttcttaaaaatttctgtttaagacagacttgaaaataagtaattaccaccaagtaaactaaacttctagaacagtactatccaacagaactttgtatagtaatagaaatgttctgcatttgcagtatgatacggtagccactactgacatggttactgagcacttgaaatgtggctactacaaactgataaactatgatttaaatgttatttaattttaattaatttaaatgtaaacaagtcatacggctcgtggctactatacttgccagtgcagctccagaagttcattcaaacagcaaaaatgttttaaatatgaacttttcggccgggcatggtggctcacgcctgtaatcccagccctttgggaggccaaggccagcagatcatgaggtcaagagacagagaccatcctggccaacatagtgaaaccccatctctactaaaatacaaaaattagctgggtgtggtggtgcatgcctgtaatcccagctactggggaagctgaggcatgaggatcgcttgaacccaggaggcagaggttccactgagccgagattgcaccactgcactgtccagcccagataacagtgcaagactccatctcaaaaaaaaaaaagtatgaacttttaaccattctcttaatcattgttctagcattttttacattaaggcattaattaataactataatttaaatgctttccaagctaaatgaaaagattaaaatatttgtcatatgtaaataaagcggcagaaaacagtgacaatagtgttacttgatggcctatttttttcaggttcaaattcacaagttccttatcacagaaaaaaaactattctggtgaggtctagactttgagaatcttattagtttgcatttcttagcaactgaattactagtttcatttttggaaataaaaaaatgtattaaaactaacatatgtgaaaaaagtatgatacacattcctgtgagagtccaaattctgcttaaaaaatacatagataagggaaaaaactggaagaaaatgaccaattcttaacagttctgagatcataggtgattttcttcatcttttttcctttttttttttttttttttttttgagacggagtctcactctatcacccaggctggagtgcagtggcgcaatctcagctcactgcaacctccgcctcctgggttcaagccgattctcctgcctcagcctcccgagtagctgggattacagacgcatgccaccacaccagggtgatttttgtatttttagtagagatggtgtttcaccatgttggccaagctggtctcaaactcctgacctcaggtgatccacctgcctcagcctcccaaagtgctgggattacaggcgtgacccaccgtgcctagtcgattttcattttcttctttgtgctttctatattttccaagttttccaaaatggacattttaaaaatgtattaatttttaataataaaaagggggtggtagttaggtaacatggatacacactaaaaaatcagaacgtgtggaacagctctcaacagtcacattttgaaccaagcatttttgtattaagtgtgctggggtagttgtgagatccaagacaaggtatcatacatcaactcactatctgatcaccagtgattcactctacaaaatggcaatgtgttccactctgaaacacttctggtatcattattcttttgatgtggtcctcagagagttttaaatgttttttatcctttgttatttaatatatttttctataatctttccaaatgaactcatccttcagctgaaagacgtaatagttctaccccaaaatattaaagtaattgaagtgaaacaaattttagtttacctgcttgtcagatatccaatcgcggaggcagcataacaagcctacgagaaaacaacactgggacttgagcatattgggatccttatagtacatttatgacagcaacttactattaaataatagacaagaacatagtggtaaaggcagaattaaaatatttccaaccttagtaataaatgttctacacataaatttcaaataatggttatctaaattttagtttttcaggaaatttgttcatatgtatgttattcaaaacatcctcttacaattgcttaaatatctgcaggatcaataggaatgtcctcttttattaacaatattggtaatttgttttctttcttttattcttcatcagtctcatgaggggtttatcaaatttatccatcttttcaaagaacaaatttttttagttcttcgaaaatttttgttggtttttctctattgtttgttttctatttcattgatttctgttcttgtatttattatttcagtcattttgaatttgatttgcttttctttttctagcttcttaaaatacaaatttagaacactggtttttaattttctttactaataatttgtttaaaatgattccaagaactgctttagttataggttacaagtttgagttgcatcttttcattatcattctattcaaaatattttctactttccattgtgatttcttcttcaacccattggttaattaggatctgtagtgatacctcctttttcattcctgacattggtaatctgttttctcttttattctcaatcagtctatcttgaagtttattcattttgttaatcttttcaaatatttacaaaataccaaaaagtatgttgcttaatttccaaaggtctgagattctttttagtgatctcttattgagttccactttacttccacatggtcaggtgacatatactgcacgctttcaatccttggcgatttattgagatttcctttatggcctgcatatggatagtttttaccttgtaactctacttcagctcataatcaggaagagagggggcactaaattaaatgcacacaagataacctgggaaaatgctgagtgctctctcaaattcttcttagtctgggacatcatttttttcccagtattatttcttctcatttctttagaaataataatgaattgcgtatttcctagccttcattcagctttaaatgaagtagtatactgtcttaaagaactccacattaacgacataaatgtggaaaaaaaaaaaaaggaaatgtttatggatcataatcttaactggctctactatcatacacccactgagaacctgcacaaagactctgctcttttcctgtgtcgctattctctactggccccatctctctttccttttgcacataaggccaaattcacattaggagaataagacaactcctaagaaatgcaggcatgtaaatacctgctgcaataagaacactttatttagacacccaaaagaattgcccacttatgatagctaggtaagaaatgttgctaggcaatgcaaaatatacaacaacacgtaacaaaaagtatattcctctggtaggaaatgtcaaaagttgagaggtaactgttttgttttgttttattttgttttgttttgttttttttttttgagacagagtttcggagtttcgctcttgttgcccaggctggagtgcaatgatgcaatattggctcacggcaacctccacctcccaggttcaagcaattctcctgcctcagcttcccgagcagctggcattacaaacatgcaccaccacgcctggctaattttatatttttagaaacggggtttctccatgttggtcaggctggtctcaaactcctgacctcaggtgatctgcctgcctcagcctcccaaagtgctgggattacaggcgtgagccaccgcgcctggccataactggttttatgaccataaaagatctgttcctctactaaactacctccattcacaggcagaacagtgtacatggtacttagagagtggactctcgagccaatctgttttgatttaaatcccagcttccccactttctactgtgtaattttggcaagttgctctaaatctctgtttcttcatctataaaatgaaaataattcaaagcactgctgtgaggatgaaatcagttcgtatgtgtaaaacactcaaaatagtgcccacacacagtaagctctcaagaacaatgaacttgctgacaatctgcctacttgctggccaattggtcagtatgtcttgattactctatggatctaatcaaagacaatgaagtcacacccaactacatctttctctttatcacaaacatgtcctgaatgccttagcctgttttcatgttccctctgaatcattctgtcactacccttagttcaggtaccatttaagtcttcctttgactaccatagagtcaggatgcttgagggacatatgcactgggatgttccaccaacatctcaaatgcatgtgttcaaaattgaacatcacctttctcctccaagctggctcttccctctatattcccagtctcagtcacagacaatatgatctacacaatcaatcaagtaagcccaaaatctaggaatcatctccagaggagcctgcctcctctttcctaactggttaatgcctgcttatccttcaggacagctcagacatcatctcctgtgggaagctgagcctgggtactccttctctgggctttatagcaccctggatatctctctatcacagcacttaccaccttataatacaattgtctgtgtctgtctccacagcttggctgtaagccccttaaagccaggaactatcattcatctctgtatccagcacccaacacagcacatgggacctaaagaaccctcaactaagcttataggggctgaaataaaacttagagacagaggtcgtgctatgttgcccaggcagcctctaattcctggacttgagtaatcctcctgcctcagcccccttcgtagctgggattactggcatgtacaaccatgcctcgcatcatctttctgaagtacaaatctaattacatcgcccacctgtttagaaaaacctttagtctcccccattgcctactgttaaaaaaaaaaaaaaattcaaactctttttagatttcccacaacctcccctcaacctacctaccagtctcacagctcaccatgcctttacctaccttgagggaaccacatgaactaacattacctctacaggcaatcttctctgtcctcaaagagaaccagtcaccccttctgtgctactacatctattgtgagagttataatagatgagtctttttctgtaagtcttaccctcaccttccaggactgatcaacgtgaagatcaagactaaacctcactccttctttacatccctctctcctacaggttatgtagcacaatccttagtatacagtacttagtcaataaatgtttgctgtatgaagaaatcagtggcagatatgtcatctctacaaaaacagttaagtataggttccattcataggtcaatagcttcattttttcacacagatgaaagaacagaatgttgttctaacaaagacaagtaaaatgtagaagcaacagaaactcaaaacctcctagttttaagattaaaaaatacaaatctcaaaccttgtagataaagaatgtcattcaataaagaatgtcattcaataaagaatgtcattcaattaataaataatgtataatattaagcatctacaccacgtgaaagcacaaaccaagccaggcactgtggtgatataacaaatgaatcacaacttctgccctccaggcactcatgtatgatggcaaaaggcaccacttagggtggccaggcagttgtttgggcaagaggaggcaagaatttaaattagaaggcaacggtgggagtgtaaagcaggaatatttagcctcagctggactgagagtatgtgatatcacagaagtggattcttgacctttcaagcccgcactactgagagaagagcaaggtggattggcagaggatgcacttaaagtggattgacaaaacgtcgtatcttccttatcctgcttccaaataagcctctaagaaaggtggcagcatgatgtggtggaaaaagcatcaggctaggatctgagccatctgagtttccatcaaggcactaccatttgtgatatcctccaccctgccccgaaccaatcatacaacaaagccttggccttcactcatttatcccacaggtaatctctgaacacctttcttatgcaggcaccacactaagcactgggggtacagatgtgtcgtgaagaaataatatccctgctctaatggagcttgtagcctaatagggaagtcagactttactcataaactgtccattccaatcatgacatacagtatagtagtaagagaatggactcagacccagaatacgtgggttcaaaccctggctctgctactaccagctgtgtcaccaaaggcaagttttacttaacctgtgtcttttctcatctgtcaacttggtgtaacaacagttaatattcaacagtgattgatatgatatatgtaaagtagcagaagagtggtaagcgctatctgggtgtttgcaatgcatacctaccgctattactgatcattcccagtaacgcattcagccacctgagtccatactcaccgcttgctcattcctcatcccgatgtacttgatgcctagctgctgggcagcaatggcgatttcggtcactgggatgcctacgatgccaaatatgtactccacatcctgaggaacgaagaacaggggagtaaactcccaaggccccaccatatcgccacatccttccctccctcccgggcgctaaaaggaaaaccccccgacccccatcgcccatttctactcgtctccaagacaacatcgcggtccccgccagcttccgtaggagcctttcattccaggaaggtccatcgtacttgcgttttcagggcctgagcgatgactttagcaccagacacctgctcctcgctgcgctctgcgaagttactgtccggcatcttccaccgaaaagctctaagcactcacgcagccggcaaacaagcggaatcatccagcaaggcaaacgcgaaatcggcagcacgccacctctggtactgcacctctgacggacaggagggcaaccaactgccttaaacaacgggaaggaagaggcggtctaaattcgtccacttcccgggagaggtgagaatgtaaacacgcgcgttctccaatcagaactgcgctctcttctcggctcctccattcgcgcgccagaatgccagagggaggcgggactagcaggagattgctgcctatgcaaagcaggtaagaagccgaactctgaggcctctcgccattgtctccgagtcggccagctggagcgttttcggggctgtaaagggagaatggcgcatgcgcatattcagggcggaaggcgcgctaagagcaggtacggagggggcgtggtgcggcgcggagggggtgtggtaagggcgtgcggtccagaccccgccccgggcgcccagttggacttggggagggctgcgcaaaggctgccgggagctgggaagcccggcgcgcgtcgtttgctggggctgtttgtgcgttgctgctgtgctaccgcgttgcgttttctaggcatttacttacacgctttgtggtttacgctctcataaccttgtggttttatagtccttaaattattgtagcgcacgttacttaaatccagaagcagatgtgtaccccagcaagagataaaatgacgctcagagtcagtagatccagaccgtgcctgagatcctgaatcctgtttcctacccactattcagccattgggtcacaagcgatgaaaagagcaccttgaaggtagtatagagcactgttttctccagcccttgctactaatccatattactctccgctaatatctttccaaaattaggaactatggcgtttcataattcttaggttgggtccctacctacaaccagccctgcacccgatagccttttaaaacatttttgtgtgaaaatcgtttgcaatgtgcaatatctgaaactactgccttggagtcattagaccctctgctcagtgacaataaacataaaatttccaattgtaataaacagtggaacttttaattttttgaggatttggagtcattttaagcaaaaagaacagtgataagtggacagtaaagagatgagaggggagtgggtcatgggtagtgaaatgagtgagaagcactggaagtgaaacgatttctaaacccagacattttcaaactgtagtcctgggtcttttcaaaaggtcttcccctctttttctcaacccctcaaccccaccccaagcagaggagagtgaagtggttgcctccctgcatatgtggacggtgttagtccattttcatactgctataaagaaatacccaaaactgggtaatttataaagaaaaagaggtttaatggtctcacagttccaaatggctacggaggcctcacaatcatggcagaaggtgaaggaggagcaaaggcatgtcttacatggtggcaggcaagagagcgtgtgcaggggaactgccctttataaaaccatcagatctcatgagacttactatcattagaacagcatgggaaaaatcccctccccatgattcagttacttcccactgggtccctctcaccacatgtggggattatgggagctataattcaagatgagatttggatgaggacacagccaaactgttctgcccctggcccctcccaaatatcatatcctcacatttcaaaaccaatcatgccttcccaacagtcccccaaagtcttaactcatttcagcattaactcgaaagtccacagtccagagtttcatctgagacaaggcaagtcccttccgcctatgagcctgtaaaatcaaaagcaagctagtggctgggcgcagtggctcacacctgtaatcccagcactttgggaggccgaggcgggcggatcatgaggtcaagagatggagaccatcctggtcaacacggtgaaaccctatctctactaaaaatacaaaaaattaggcgggcatggtggcaggcgcctgtaatcccagctactcaggaggctgaggcaggagaatggtgtgaacccgggaggcagagcttgcagtgagctgagattgggccactgcactccagcctgggggacagatcgagactccgtctcaaaaaaaataataaaattaaatttaaaaataaataaataaaagcaagatagttacttcctagatacaatgggtgcacgggagtgaggtaaatatacccgttccaaatgggagaaattggtcaagacaaaggggctaaagcccccatgcaagttcaaaatctggcagggcagtcaaatattaaagctccaaaatgatctttggatcattttgacttcgtatctcacagccagatcatgctgatgcaagaggtgggctcccacagccttgggcagctctgcccttgtggttttacaggctacaaccccctctcccagctgctttcacaggctaatattgagtgtgtgcagcttttctaggcacatggtgcaagtggtcagtagatctaccattctggggtctggaggacggtggccctcttctcacagttccaccagcagtgccccaggagggactctgtatgggggctcccaccccacatttcccttccacactgccctagcagaggttctctatgagggctctacccctgcaacaagcttctgcctggacatccaggcatttccatacatcctctgaaatctaggcagaggttcccaaacctcaatttttgacttctgtgcacctgcaggctcaacaccatgtggaagctgccaaggcttcaggcttgcactgtctgaagccaggcctgagctgtacattggccctttttagccatggctggcatggctgggatgcaggacaccaagtccctaggctgcaaacagcagggggaccctggacctgacccatgaaaccatttttcctcctaggtttctgggcctgtgatgggagggcctgttgtgaaggtctctgacatgccctggagacattttccccattgtcttggtgattaatagttagcttcttattacctatgcaaatttctgctgccagcttgaatttctccctagaaaatgggtttttattttctactgcatcgtcagtctgcagatttttcaaatttgtatgctctgcttcctctggaacactttgccatttagaaatttcttctgccagataccctaaatcatctctctcaagttcaaagttccacagatctctaggacaggggcaaaatgccactagtctctttgcatagcaagagtgacctttactccaactctgaataagttcctcatctccatcagaaaccacttcagcctgaattttattgtccatatcactatcagcattttggtcaaagccattcaataagtctctaggaggttccaaactttcccacattttcctgtcttctgagccctccaagtctctaggaagttccagactttcccacattttcctatcttcttctgagccctccaaactgttccaacttctgccagttacccagttccaaagttatttccacagtttcggctgtctttacagtagtgccccactctctgcattaccaattttctgtgttagtcccttttcatactgctatgaagaaatactcaaaactgggtaatttataaagaaaaagaggtttaatagattcacagttccacatggctggagagacgtcacaatcatggtggaagatgaaggaggagcaaaggcacgtcttacatggcgacaggcaagagagtgtgtgcagggaaactcccatttataaaaccatcacagcttgagacttatttgctatcacaagaacagcatgggaaaaaccctccccaatgattcagttacctcccaccaggtaccgctcatgatatgtagggattatgggagctataattcaagatgagatttgagtggggacataaccaaaccatatcagggacccatctcagagggtgacttctttcaagtctcagagtgtatctaaaaagaaaatgcagattttgtattatactctagaatgtatccatattttaattttaaaatgacatttattgagatataataaagatacaattcaatgtccagattttaaatgttagatgagttttgacagttatatatatatatatctatgaaatcaccacccaaaataaaaatgacattttaaactgcttacctgtcaagtaaaattgacattccagaaagatgtgaaacgggctgggcacaatggctcatgcctgtaatcccagcactttgggaggccgaggtgggcagatcatctgaggtcaggagttcgaggccagcctggccaatgtggtgaaaccccatctctgctaaaatacaaaaattatccaggtgtggtggcacatgcctgtaatcccagctattcgggagactgaggtgggagaatcgtgtgagccagggaggtagatgttgcagtaaaccaagattgcaccactgtactctagcctgggtgacagagcgagaccctgtctcaaaaaaaaaaaaaaaaaaaaaaaagatgtgaaatcatctttgcactttgagtagtccttgacacaatgcctcctgtccttgttgaagaagtacagacttccccttccatcatgtattatttatatcagtaccttttgtgacagtctctgcccctgttgcattagagtcacttggaaagctttttccaaatagttacttgggccctaccccagatctcctgaatcagcatcttaggacaagtcaggcacctgtattttttaaaagctgctacctgattttgctttgcagcccagagttgagaaccctagctctgttttcatgccagaagcatgagttactaattaaacatatgattgcctgtcaccaaagtaatactgttgattaatttggattgacaggttcaagactgatttgacattgacagaacaagctgtatcgatggtagtcagttcactgggcctacttctgtgtcaaaagaaacagtgacagaaccactcagtatgaagtgcaatgaaaactgaactctgaattggaacaaataactggaattcagttaactggttttgcaaaaggataaatactcaactggttgttttctgccatttaacaaagagaaaaatcattgggattgtttaaacttgctttcacctttgcacctttcagttcaggatgcagtgttcaattgttaacttgggcttgatgattcagcagaaagaaatgatttgagttctggctcactggattaacagggccaaggagcaagtcctttgcaatccaattgtaattacagccagcttgtccaacccttggcccaggatggctttgaatgcggcccaacacaaattcataaactttcttaaaacattatgagatttatgcaccgacccttttttttgttgttgtttttggtttttttttttttttttagctcatcagctatcatttgtgttagtgtattttatgtatggcccaagacaattcttctttttccagtgtggcccagggaagccaaaagattggatacccctgacaggattccaggattcttttgtaatttctcagaggccctctgtgcatactccgtaaggactatccacattctttattactttcattggcaataggtataaaattttatttgttggatattttactgaaatgttacttgtttttgcttatttactgattggtgggaggaagtcaaaggatgaataaatctaacctttttaaaagaaaaggctaaaatactcataacatgctctccaaagagcagagctagtcatcaaagaatctgcataccaattactctatttgtaggttctggatttgagattatgaaaaagagcaaattggtggttttcttctctctgggccagggagatatccaggcaaccaggtaatttagtaagaattgcaaatatagtgcctggagacaatttattctctaaagactgcagcttctacaggcagtaactcttaaagcccccaaattgggatagtgcattttaatttccgtatactaacaaggacactaaaaatccttgtgattattttaaagcataacactagctgaacttgtgattaagtattctcacaaatgtattatcaaaatgtgaaatgtttacttatcaaatgaggaaatgaatcaaggtcatttgtgatacattatagaagctaaaaatgaaattgcctgacataagataaaactgatactgaatatcttaaaaataaaaaggcggaaacaacaaaaaaaggagtctatgtagaacactattttttatagcaatgcaaaaactgtacagccggaaatgtgttgtaggaaatatgtcaacataggaagtaaaataatgtaatgaaaaggttctttgaataaagtgggttaaattgattttctttgcttctcattaaatctgtggacttcagagtaccaaagctcagcaacaggcttgaaacaaacccagtgaaaagcaactttattattgagctgaggattgatatcagtaataactcattaataaaaaagcttgataataaaaactcccagtgcctgatgccagctgacagacactgggagttttcccaggtaccctgtgacctagagaaagcttggattcctgcctttggcttgggctggcaagccctgtgcctttactctacattttaatgccagggagacctggaactggagaagggagtgctgtgggaagaaaacagaaggaatgttgttcccttgttttagctttgtgttcatccattatgggttttgggtttttttgttttttgtgtttttttaagaacatttgagatagtttgacagcagcagtcattacatcactgacgaggacgtttacttgtgtaaaatgcaccaggaaatagtgacaactgtatgttgtgctatgaggatgtaagagatttatctcaaatggcttagaaatcaaaatataggtcagtgcggtggctcacacctgtaatcccaacactttgggaggccaaggcaggcggatcacgaggtcagtagattgacaccatcctggccaacatggtgaaaccccgtctctactaaaaatacaaaaattagctgggcatggtgatgtgcgcctgtaatcccagctaccggggaggctgaggcaggagaaccacttgaacccaggagttggaggttgcagtgagccgagattgcgcccctgcactccagcctggcgacagagcgagactccgtctcaaaaaaaaaaaaaaaaagaaatcatagtatttctccgtatgatggaattccatactcgggggagtgtcccacagggtaggcaagcagctatcacccatgtaatatggtactagtgttgaaatattttctgttttcacttgcttcttctgccattagcattcattacagccctttcctttaactttttaatttgtactttattgctttgttttgataataatctattctccatgtcagcaaaacaaagatttatctctagggaagaatctctgagtgattcccagggtttgggggttgaactggggacatcttcatgatgaacttaagcccttaaacttctttttacatcataacgtttgagttcttctttggagcttagctgtgatttattcttttcacttcaaaaaaaatacatttaacatttatgacatctttcagacacatgaataggatcagagattaatatacacccatgtacccagcccctggcttaagaaatacatcacaaatataatgaaacccccgtgtgtcctttccccattacacctcctttcctgtcctacagaggtaaccactatcttgaatttggtgtttgtagttcccacattatccattctttagatgatcgatatttggtcatttttagtttttttggaaacagtgtgctctgaaattcttgcatgtttccttcttgtgcacatgtgtgagagtttctacatatatatcaaggtggaggtcatcatcatttgatctccaaagtattgtaccaatttatactcccaacatttgtgtatgagagctaccctttctccatagtctcaactgtggagctttaaaaatttttaaatgtgaaatggcttctcagttccatttctctgactacaaatgaggttaagttatatttgtatatatatattggccatgcgtgtttctttttctgtgaattacgtgtttacatctgttgcacatttccttattggattatcttttgctttttgatttgtagatgtcctttatgtattctgaatgctaattatttgtcttttaactttgttaatagtgattttagaggtataaagggtttttttatagtcacatttgacaactggtcttccttattttttttttaatttttttatttttttggtaacttgctaaagaaaactttttgtaacctgaggttatgaagatttttttctatatcaaaaagtgtaaagttttatttttcatatttaagtcactacctggaattgatttttgtttgttgagaagtaagaatccatataatatgtcaattagatttgctgtgtaattaaccaccccaaaacttagtggcttaaaagaaccaccatttatttaacatatattcctatgaggctggtctcaactgggctcacccatgtatctgttagtcagttgccagtgaactgagtcactcagcccctggaggttagctggttgtccactgggatagcgggcatattgccagtgagccacatagctctaccactcagcaggctagctggacttcttcattggatggcagcaggttgcaaaagggaatgagcctcattgtgcaagcctctatgtgcggtgtttgctaacatctcattagccaaagcaagttatgtggctgggctcagactctaagttaaaggcattcgagttacatgataatggaacatggatacagagaggggagaaattgctggccttttttatagtcaatttaccataacatccagttgtccaagcaccattcataatatagttcattctcatcccagtgatacataatttcccctctgtggaatgtcaagctcgcatatttatgggagtatttctgtactctctgttcttttcctatcctaacaccaatcccacactatcttaatttctgtgtttttaaaataagtcttgatgttggtaggacaagtagtccctggacttcattcttttgaagccatcttgtttattatattaattttaagcaactagaggggatggaagaggaacctttagattaaaagagatttaaaagatagggtattttttaatggacaagactaaactacagtgtctagggatgcacattgggtgataaagctattttaaaaaacaaagaagtgatgagtataaaagtcagggtcatggttacttgatccctcatgggtaatgttgtcagatttagaaaaaaaaaaaaaaacaggactccaaaactcccagttgaatttgaactttagatgaacaatgcataattttttttagcgtaagtatgttccaacatatttatctgaaagttaaatttaactgggccacctgtattttacctggaaaaatcctgattttattcaaggtgataatgcagtttacattgcccagccttccttgtagctaggagtggtcacgcgtccacacatgggccaaagcaatttaaataggagtcactgggcagggcttttaggaaagctgatgaaactggcaagtaccctctgtactcttcctctgtacaacatgataattggagttgtagaagtcattttggaaccacaagatgactctgaaaatggaagctacatgccaagaagttaggcccagaaagagagggatcctgggtcctacatgactcttgcctttgtcaggttttattatcagatttttatcacttcataagaaaaaaatgccttcttttactatattctcacacacattgagtagcattaggattattttttcctttatagttagaaagaattcttctagaaactatttgggcctgttttgagggtggagaatgggagggaatgattgtttgataactatttcttctatgattgttggcatggtttagttttttcttttatccgaagttttggtaaaaatatatttttcagtcccagctactctggaggctgaggcacaaggattgcttgaatccaggaggcagaggttgcaatgagctgagattgcaccactgcactccaacctgggtgatggcgtgagacagtctcaaaaaaaaaaaagaaaaaacaaataatgtattttttttctaggaaactactcgtctaaattttctagcttatcaatataggattgaatgaggtgattattcttttttaaaaaaaattcttctgcatttatagatttctctttgttttgtatatttgtttctcttttttttcttaattaggctagccgatcatttgtctttacctttttttttctctaaacaacaactccttggacatacttattcattctgtcatttttctgttttctaatttaatttccactcttatttttatttccttccttttgctttcttgagcatgccattactcttttcctcactgttaccaccttttgttagttttacaatttctacattgccagagttaataacatttgcactgtgttctataaatataatcctcatgtttattttacattcaaggctcttgccagtttttccattcacctcttaattggccgaagattaccctctatgcattttttcaaagaaggctgatgagactgatgagaataatagtccctgagttcttatattttcatacctattatctggtttttttctttacttcaaccataggttggcataatatataatttctggcttatattttattttctggaaggattctataggcttttactggcattgatgttattgtagtaaagtctgaggacagcctgattattttgcccctaataaatacccttgatctttttatttagcttcccaaatgattcttactttatctttgaagatcaagaattttgctaggctatctgccgatgttgatgttctgttcctttctttcttgagttttgctatctcttttcaagctataaattgaaatatgcttttatttctggtgagttttcttcaattacatctttaattttttttttttttgcttcattatatgttgtctattgttgtataaaaatttaccctacgacctattcagcagcttaaaacaagacccatttattatctcaaagtctctatgtgtcaggagtctgagcatagttttactggatcctctggtcagcatctcacaaggctacagtgaagttgtcagctgacctcatggtctcatctgaggctgagttttcttccaaattcaactgatcgttgaaagaatgaatttccttgcagttgtagtattcatggtggcttgcttcttcaaggtcagccggggagagagtgtgtctgaaatcttggagcaccccagttctttttttaaagacctgattaattcagacccaccagggtaatctcttttgattaactagattaactggcttgggattttaactacatatgtgaaagcccttcacctttgtcatattctattggctagtaacagagtacaatttccacctgcactcaagaaaagaggattatacaaggagtcaccttagggtgtgtccaccacacattatttttttcttttatgcattttccaattatgcatatgatggatctcgttcactgttctccctgtctatcattttctgtggactccttttcaattctgtatttccattcatgttgcttatttatttacagcatcatctgatttcttttgctgcttctatctttgccataatttcttgatgttttaattttttcttctgcttctttcctgagccctgccagataatatttcatctgtctcccagctttctattccccactcccttctcccttctctcttcttccctcttccccctccttaccttctcctcttctcctcctttcctccccttctcccctttttccctttcatcttttaattctcttggtctattttgtgcttttatttaatataagcagttttttttcactcgtggcagaatgttttgtcacagtttttatttgtgttgtggcaattttctggggtataacctttgttttcgtatagtatctttcaaaagatcttgagctttttatttactcatttttgagtgagtttttcctctactgtaggaggtttatgtgtgaacaaggccattctggttcacagttattttttcttagcacatttaagattttgttttcttacttctattgttactcttgaaaagtctgctgttttcaaatcaccatatctttgaaggcaatctctcttccctctggttgcgtctaagatttttttcttcttcaaatatttcgtgttctggtttctttatgttgtgtatagatttctttttggttgtcttgaatctatggatttctgtattttattattaaaattctcacctattataccttcaaacatgtgtaatgtgtcatgtgtcattttatgtattttctccctctttctttctttcttttttttttttttttaagtcaaggtcttgctctgtcgcccaagctggagtacagtggcacagccgtagcccactgcagccttaaactcctgggctcaagcaatcctaccacctcagcctcttgagatgctgggaccgcaggtgtacaccaccatgcccagctaatacttttttactttttgtagagattatattgcccaggctggtcttgaattcctggcctcaagtgatcctctcatcttgacctccaaagtgttgggattacaggcatgagccattgcacccagcctctattttctccttctgaaattccaattagaaatatcatggaacatcatatatgtcttccatgtctcatcttctttttttcccttttgtcatctctgtggtacattctaaacaaattttttaatgattctaacggccatgccacaaaatgtctccatttggttttatttgacaatatctttttctttttttttttttttttgacacagagtctctctctattacccaggctagagtgtagtggtgtgatcttagctcactgccacctccgcctctgagctcaagcaatcgccctaccttagccacccaagtagctgggactacaggcatgcaccaccacacacagctaatttttgtattttttgtagagatggggttttgccatgttgcccatgctggcctccaactcctgggctcaagttatcttcctgccttggccttccaaagtgctgggattacaggcatgagccaccactcccagccaacaatatcttattcttttacctgttttagagtcctctgagtacttctttaatcaacttcagtgtacttatttgaaaattttcactagtaatccttccatctgaagttgttgggggcctgattttgctgtattctttaactttcttgcataatatttgcttccttgtgtgttttgtaattttgaattttgagctcttgtttaccttgttcttcaacccaggacactcagtcttcaagaagagagtatgtggataggcttttccaggcatcttaggactgataacatctcaaaatcactttgtgctcatttcttggcatagagttacctgggtcatgtatgttgtgagtttttgaatcatgaacccacataaggaaaacctttgattatgttggttatgactttcaaggagtactattttcccctgctcagagcccaagatgagatgtacaagtttctacgtcagatagttactttggcaggcaggcagatatttgtttttgtccatcctttcaataaaggaatcattccttaaggttcctagctatatgcacagatctcactccaacctccacatcttgtctttctgtccttcatggtctttaaaatctaaaccccttggatatcaagattgggacatgttccagtatcacctcaccactccagttttcagttacttgattttagtttttattttttaaatgctttttttaaaagagaagttttatgctcacaataaaattgagcagaaagtacagaaagtttacatatactccctgtcctgatacatgcatagccttccctgttatcaatatcccagactagaatggtatgtttgttataatcagtgaacctgcattgacacattattataacatgaagtccatagtttacattaggattcacttctttctcccttaacacttggcaaccactgatcattttaccatctctgcaattttgctttttccaccactggaaatgttacatattggaatcatacagtatgtagcctttacagattggtttctttcctttagtaatatacatctaaggttcctccatatcttttcatggcttgatagctcatttctttttagcactgaataatattccattgtctgaatgtatcacactttattaatccattcacctactgaagaatatcttgattgcttccaagttttggtaactatgaaaaaaactgctataaacactcctgtgcagtttttttggagacataagttttctactcctttgggtaaatacaaagaatacgattgctgaatcatatgataagagtatgcttcattttgtaagaaaatgccaagctgtcttccaaagtggttggatcattttgtgttcccatcagcaatgaatcagacttcctgttgctctatattctcaacagcatttggtctttttaaaaattgttttgggccgggcgcggtggctcacacctgtaatcccggcaattttgggaggccgaggtgggtggatcacctgaggtcaggagtttgagacaagcctgaccaaaatagagaaaccctgtctctactaaaaatacaaaaattagccggtcgtggtggcaggcgcctgtaatcccagctactcgggtggctgaggcaggagaatttcttgaacctgggaggtggaggttgcagtgagccaagatcgcaccattgtactccagcataggggacaagagcgagacttcatcttcaaaaaaaaaaagttttgtttttttcctttcaccaaactaagcatttagtcttgtcagtgttttggattttgactattctaataggtgcatagtggtatctaatttttaatttgcaattcccttgtgacatatgatgctgaacatcttttcataagtttattgctatttgtgtatcttccttggtgagatgtctgttcagatcttttgcttattttattttatttatgtatttttttttcgagtctcactctgtcacccaggctggagtgcagtggtgcaatctcggctcactgcaacctccgcctcctgggttaaagcaattctcctgcctcagcctcccgagtagctgggactacaggcacgagccaccacacccagctaattttttgtatttttagtagagacgggggtttcactatgttggctaggatggtcttaacctcttgacctcgtgatctgcctgccttggcctcccaaagtgctgggattataggcatgagccaccatgcccggccttttgcctattttttaatcaagttgtttactttcttattgttgagttttaacagttctttgatattttggataacattcctttatctgataaatcttttgcaaatattttctctcagtctgtagcttatcttcttctgttcttgatagtttcatttgcagatcaaaagttttacatttagtgaagtgcagtgtatcaattctttcttttttgtccaacacaagatcatctagctattctcctatgttatcttttaagagttttatagttttgtactttatatttagatctatgatctgttttgagttacttcttgtgaagggtataagatctttatctagatttgttttttacatgtgggtgtccatttgttccagcaccatttgttgaaaagactgtctttgctccatcacattgcctttgctcctttgtcaaagatgagttaactatagcctggtgtgcagtggtacacacttgtagtcccagctgctcagtagagttcaatagttttctttaggaggctgaggtagaagaattgcttgagcctaggaatttgagtccagcctaggcaacatagcgagacctcatttgtaaaataaataaataaataagaccagttgactgtatttatgtgggtctatttctggattctctattctgttccatctatttgtctgttctttggccaattgataaaatatcatgttgtcttgattactacagttttataatgtcttgaagttggtagtgtgagttttctgacttcattcttcttcaatattgtattggccattcttggtcttttacctctccatgtacaatttatttttatgtatttatctagagacaggtctcgctctgtcatccaggctggaatgcagtggcgtgatcatagctcactataaccttgaactcctgggatcaagtgatcttcccacttccatctgctgaatagccaggactataggcacacaccgccttgcccagctaacttaattttatttttaattttgtagagaatggggtctctctattttgcccaggctggtggtctcaaactcctggcctcaaatgatcctcctgccttggcctcttaaagtgctgagcttacaggcataagccactgctccatatgcagtttagaatcagtttgttgatacctacaaaataacttgttgggatttcagttgggattgtgttgaatctatagatcaagttgttcgcaagaactgacatcttaacgatattgagtctctgcatttatttagtgctgctttgatttctttcaacagagttttgtagttttttcatgcagaccttaaacatttttaaaagatttatacctaaatatttcatatgtagggtacgaatataaatagtattatggtttttaaaatttttttcttttttatttttttgagtctcactctgtcacccaggctagagtgcagtggtgcgatctcggctcactgcaagctccacctcccgggttcacgccattctcctgcctcagcctcccgagtagctgggactacagacgcctgccaccacacctggctaatgttttgtatttttcatagagatggggtttcaccatgttagccaggatggtctcaatctcctgacctcgtgatccacctgcctcagcctcccaaagtgctgggattacaggcgtgagccactgtgcccagccaatagtattatgttttaaatttaaaagtccactgttttttgctgatatatgagaaataaattgatgtttgcatatgaaccttgtatcctacaacattggtataataacttattagttccagatattttttattaattcattccaattttctacatcgatgacaatttcatctgtgaacaaaggcggttttatttcttctttcccagtttgtgtatcttttctttgctttttgcattagctaggacttacggtatgatgttgaaaagcagtggtgagaagggacatcattaccttgctcccgatctttgtataaagtctctagtttctcaccactaactgtgatgttagctgtaggtggttttttaaatcaagttgagcaagttcccctctattcgtagtttactgagagttattatcattccaaatgggtattgtacttcgtcaaatacatctatttgacatctatttttctgtgtctattgatataatcatgtgatttttcttttctttttttgagacagggtatcactctgtcacaccagctggagtgcagtggtacaaacacagctcactgcagcctccacctcctaggccatgtgatctttcttatttagcctgttaatgtgatagattacataaattgattttcaaatattgaaccaacctttcatacctgagataaatctcacttagtcatggtgtataatttcttctatggattgttagattcaatttgctaatatttgttggtgtaaaagtcattgtggtttttgccattgaaagtaatggcaaatgacttttgcaccaacctaaggattttgctaaggattattgcatctatatttatgagagatattgctctgtagttgtattagtctgaattctctagggagatactgggagaacccacccccaatatttcaacgtaagttctattttccataagtgtcagctggctgagaaataaagagagacagtacaaagagaggaattttacagctgggccgccaggggtgacatcacatatcagcaggaccatgatgcctgcctgagtctcagaccagcaagtttttattaagggtttcaaaaggggagggagtgtaagaacagagagtagatacaaagatcacatgcttcaaagggcaaaaagcagaaccactgataagggtctaacaaagatcacatgcttctgagggaacagggcaaagggcaaaagcagaaccactgataagggtccaacaaagatcacagggcaaagggcaaaagcagaaccactgataatggtctatgttcagcggtgcacatattgtcttgataaacatcttaaacaacagaaaacagggttcaagagcagagaaccagtctgaccacggatttaccagggctgagttttcccaaccctagcaagcctgagggttctgcaggagactaggacttatctcaatccttacctcaactgcacaagacagacattcccagaacggccgtttatagacctccccccaggagcgcattcctttcccagggtattaatattaatattccttgctaggaaaagaatttagcgatatgtttcctacttgcacatccatttataggctctctgcaagaagaaaaatgtggctcttttagcccaaccccacaggcagtcagaccttatggttgtcttcccttgttccataaaaatcgctattattctgttctttttcaaggtgcactgatttcatatttttcaactacacatgttttacaatcaatttgtacagttagcacaattatcacagtggtcctgaggtgacatacatcttcagcctacgaagataacaggattaagagattaaagacaggcataagaaattataaaagtgttatttgagaactgataaatgtccatattaagatgaaatcttcacaatttatgttcctctgccgcagctccagctggtccctccattcagggtccctgacttcccataacagggagacagtgccaatgggatatatatagagagatatacgaaagagatttattagaggaattggctcacacaattatggaggctgaaaagtccaataacaggccatctgcaagctggagaccctggaatgtcaatggcataactcagtccaaggccgaaggcctgagaacccagggggctgctggtgcaagtcctggagtccacaggccagggagttctaacacgcaagggcaggagaggaagggtatatcccagctcctgcagataaatcaacacacttgctttttctgttttcgttctctcttgtctcttggcttattagatggtgcctgcccacattgtgagggtggctcatctttacctagtgcacttagactcacacactcatctcctcatgctgatcacaagcacatccaaaagtaacattttaccaggtttctacagtgttccttaatccattcaagttgacacctaaaattaatcctcacagtagttttcttttcttgtaatgtctttgtctgtttcagtattggggtaatgctgccctcatggaatgagttaagaagtattccctctgtttctgtcttctggaagacatagtagagaattggtataatttatttctgaatgtttggtagaattcaccaatgaacccacctggactgggtgatctctgttttaaaatattttgaattattgattcaatttctctaatacatataggcctcttcagattgtctgtttttcttgtgtgagttttagtaaattctgtcttttaagaaattggttatcattttcttttttttttcctttgagatggagtttcgctcttgttgcccaggctggagtgcaatggtgcgatcttggctcactgcaacctctgcctccctggttcaagcaattctcctgcctcagcctcctgagtagctggaattacaggtgcccaccaccacgcctggctaatttttgtatttttagtagagatggggtttcaccatgttggccaggctggtctcaaactcctgacctcaggtgatccacctgtctcagcctcccaaagtgctgggattacaggcgtgagtcactgtgcccggacatcagtttcttaaattgacatctaggttatcaaattttggggcataaagttgtttataatattcctttattattctttcggtgtccatgggatctgtagttatgtgccctctttcattgctcatgtcagtaatatgtgtcttctctatttttttttcttagcctggctagaggcttattgatttttcttgatcttttcaaagaaccagaatttagtttcatttttctctattgatctcctgctttacatttcattgatttctattctagtgtttattatttctgtcattcttcttactttggaattaagttgctcttctttttctagtttcttgaagtaaaactttagactactgatcttatatcttaattcttttgtacatttctcttgagatttcttttctgacccatttgttatttaaaactgtgcagttttatttccaagtattttgggtatttcttgctaaatttatgttattgatttttagtttaattctactgtggtctgagagcagatattgtattatttctactcttttaaatctgttaagttgtgttttatggctcacagtgtgttttgtcatggtaaatgttccatgtgagcttgagaagagtctgtactttgctgttattagatgaagtagtctatagatgtcccttgtatacagttgattgatggtgctactgaattcaactatgtccttactgattttctgcattctggattttatccattactgatagaggggtgttgaagtttacagttataatagtggatacatctgtttctctttgcagttctgtccatttttgcctcatgtattttgatgttccattgttggcacaatgcacattaaggatttttatttcttgttgaattaacccctttatcattttgtgacccactttttaatcctgataactttccttggtctaaagtcagctctgtctgaaatttatgtagctattcttgctttctcttaatgactatgttagtctgttttcatgctgttaataaagacatacctgagactgggtaatttataaaggaaagaggtttaatggactcacagttccacatggctggggaggcttcacaatcatggcagaaggcaaatgaggagcaaaggcatgtcttacatggtagcagacaagagtttgtgcagaggagcttccatttataaaaccatcagatttcatgagacttattcactaccatgagaacagtatgtgggaaaccactcccatgattcaattatctccacctggctccacctttgatacatggggattactacaattcaaggtgaaatttgggtggagacacagccaaaccatatcagttactattaggatggtatgtccatccatttactacacaatctacatgtgtctttataaagtgggtttcttgtagacaacatatagttgagtcatgttttttatctactgtaatgatctcttgtttcgaattgatatatttataccattgacttttaaagtgattattgatatagttggattattatctatcatatttgttacttttttctacttgctgcctttgttcgtagttcctgtttttgtcttccagtctttttctgagttttggtgttttaattgaacattttatgtgattttgtcacatgattttgtctgaaagtatcttatttctctgcttttgaaggttaattttgtaggatgtttatatggtttggctctgtgttcccacccaaatctcatgttgagttgtgtggcctggtgggaggtgattggatcatgtggatggtttctaacagtttagcaccatccctctagtgttgtgtcatgatagagttctcatgagatctggttgtttaaaagcgtgtagcacttcccacttagctctctccatcttctgccaccatgtgaagatgtgcttgcttcccctttgcccttctgccgtgattctaagtttcctgaggcttcccagccatgcttcttgtacagcctgtggaactgtgagtcagttaaaccccttttcttcataaattacccagcttcaggtagttctttatagcagtgtgagaatggactaatacagacgcacaatgctaggctggtacttttttcctctcaacactttaaatatttcacatcactgtcttattgtttacatgatttctgagaagtcagatatctttcttatctttgctcctctatagataagatgttttttccctctggcttctttcaggattttttctttatctttgcttttctgtaatttgaatatgatttgcctacatgtagatttttttattttttattttcgtttttggcagttaacctgattggtgttctctgagcttcctgggtctgtggtttagtgtctgatattaatctggggaaattctcagtcattattgcctcagatattgcttctattctttctccttctggtattcccattgtacatatttataacttttgtagtccactgtttgttgatttttttctttttttcagtcttttttctctttgcttttcagttttgggcatttctattgtcatattctcaagctcagggattccttcctcagccatgtccaatctactaatgaatccattaaagtgattcttcatttctgttagtgttttttaatctcaggcatttctttttttattctttcttagaatttccatctccctgcttagattacccatctgttcttgcatgttggctgttgttttttttttcagtagagcctgtggcatattcatcatatttattttaaattgctagtctgataattacaacatccctgccatatctgactctggttcttctgggaggttttttgagacaaagtctccctctgtcacctccctctgtcactgctggagtgcagtggtgtgataacagctcactgcaacctccgcctcctgggttccagcatttctcgtgcctcagcctcccaagtagctgggactataggcgtgtgccaccaagcctggccaatttttgtatttttagtaaagacagggttttgccatgttggccaggctggtcttgaactcctggccttaagctccttagcctccctaagtgctgggattacagccatgagccaccgcacctggcctaactctggttctgatgcctgctctgttttcaaactcaattttttaccttttagtataccttgtaattttttgttggaagttggactcgatgtactaagtaaaggaacagcagtaaaaaggcatttaattgaaatgtggtgggagggaatgtgttctattgtctttagggatctttagggagcctgtgtttatggactgtgaactttacaagtgcttctcagcccccaaccccactcaggcgggacagaatggggctagagttgggtatttcccttcccccaggtcagttaagctttgataaaaccccaataggtaaaaatagtttctctggaggagaggcctgctaaagaccagaatgctttgtttcctttccctcttcctctggcagaagcatgggaggatttttttctccagtcttcattgtgagaacctggtagaactcctagaggtaaaacctacaaaagtgcgggtgcctccatctaagactgggtccctctggagttgttttttgtttgtttgtttgttttgttttgttttttctgtttgttttgagacggagtctcactctcatgccaggctggagtgcagtggtgcgatctcggctcactgcaatctccacctcccgggttcaagcaattctcctgtctcggcctcccaagtagctgggactacaggcacccgccccctcgcccagctaattttttgtatttttagtagagatggggtttcaccgtgttagccaggatggtctcgatctcttgacctcgtgatctgcctgcctcggcctcccaaagtgctgggattacaggcgtgagccaccacgcctggcccagttttaattttttattttgcatataagttcaaagccttccaaagtgtttgtttatgatttattttcttgttaaaatctgttcttgttcattgcctgtttataagtgttgtcttgatgtttattttttgcatgtacattttaatttgtcaatctgtttcttcttttatttcaactgttccaaattttagaaagttgtttcaagtatctgatacctaattctaatttatgctagcttttctaacatttgatattcaacttctgattttgagtttatttttgtgtatggcctaagatgctattattcctgttgttattcatccatcccagtatcatattcaatcaacctcccccaccaccaccactattttgagtgtggttgcattaaaaagcatgtgggcttttggtcagaatagatttgggtgaaatcctggctatgggtagcagtctccttctactttaagagtaacttcttcacaaaaggagctagatgatcctctgctttgcctctaatgctgaggaatgttgcacctacaactatcatggaagacgctgaaacctccattacccaatcctgtactcccagcaccctcagggagccccacctctggaggactcagacactcatgccaggtaaagctgtaggacagaggccaggcatggtggctcacagctgtaatcccagcactttaggtgagaggattgcttcaggcctggagtcgagactagcctgagtcacatagcaagaccccatctctacaaaaaattaaaaaattagtcacacatggtagcatgcacctgtagtcccagctacttgagaggctgttggggagggatcacttgagcctaggagtttgaggctgctgtgagctatgtatgatcatgccactgtactccagcctgggcaacagagcaagaccctgtctcaaaaaaaaaaaaaaagaaaagaaaagaaaaagaagctataggacataggggagctagtcatatgtctgtcctactgagactctagatggcacaaggcaatggcacttgtgttagaaccagaatgcagctatggctgacttggaaccgtctgtcagaggaaaaaaggcatgcaaatagttactcatttgaccaaagcagaagaaaaccaaaatgtccaatgcctccaggaagaaaggcaaagatagagatactaatcatttctctacacatctgccatgccatgggtgaagaagacagccaagttggtgaacagatctggaaaggttaccatcattcttgattgagctctgccctccaaccgaacacccctgagcagccacggcatgccggctcaccgtgcttcccaccacgcatggatcaagagcacctccacaggttctcagaagctacggcaccaggacccatttgcctgctttttgctgttcctcttaagacagggtcctgcaatcacagctcaccgcaacccctgcctcccaggctcaagtgatgctcccatctcatccttccgagtagctaggactacaagtgcatgccaccatgcccagctaattaaaaaaatttttttttggtagagacagtgtttctccatgttgcccaggctagtttcaacctcctgggctcaagcaatcctcctgcctcaccctcccaaagtgttgggattacaggcattagttactgtgcctggcctctcttggtaattttgactatgccactcctaaatatatgcctcttggcctctgcatgagagaaggtggcctttgatgtgttatttccagcactgtggtttactttagctttttaaattgtttctttcataatttctactatcatccagcgtcagtgtttctagcctatcctattaagggttattcttttgttttgttttgttttgttttttgagatggagtttcgctcttattgcccaggctggagtgcaatggcacgatctcggctcactgcaatctctgcctccgaggttcaagctattctcttgcttcagcctcccaagtagctgggattacagtgcctgccaccacgcctggctaattttttgtgcttttagtagagttggggtttcaccatgttggctaggctggtcttgaactcctgacctcaggtgatctacccaccttggcctcccaaagtgctgggattacaggcatgagccaccatgcccagccccaagggttattcttttgatttggggaacagggttccttggccctattacccaccacattgttctccactctttgcatcctgagcatctccatctgcatttttcactcctgagtactggcagagatgagcacaagggtaatgggacttgatgtagtgacattgtatccaccacatgcttagagaggttacatccaccacaagcttagagattctgtatccaccacaggcttagagaggttgtatccatcatacagttatgttgcatccaccatacatctagagatgttgtgtgcactatacaatcagcaatattgtgtccatcatacatttaataatcacaaagccattacatggcccacatttctgagcacatcttccctgaaaattttgacacgtagttctaggacatcacattttccatgcactggttctttttcttctggatgtcaagccctcaggtccacattatctagaaggtgttctttaaggtagtccaagaaggaaatgggtaagaaatttcccaaaggcttttaaaagcaataccttgctgacactcattgaaactcatttcagagaatttgacgatggtttttggaagccataagcattccagaagaacagagtagctagaagtgcccccaccattcatgtgtcccaggactgactgacagtggaaaagctttatgtgtgtgtattttccttgctgcctggtcaaggtctccaatcaatagtttaagactttttcacagttcattttcgaccaccgaagatttcctttaactttcctgcaaactcaaatatgcatttaaaaataatctgtttcatttttgcaggatatggttgaaacatttttcagattatctagtctaccatattgccccccacctttttttaaatcaggaattttatttaagtaaaaaccaataacaacctggttcttcaatggtattcctgccatagctaagacaagcactgagtcctttaactgacctgcatcaaattgtttaggggagatttttccttctagtttgagtgtttaatgctttctttgctgcttattttcattaaatatggtagaaatactttgaaatctgcccagattccatcagccctattggagaggcacctgagaaatgaagatgatgtttctgactcataactttctttgacataagggaacaataggagtcagaatataggatatacattcctctatcttctactcaattggttctccaagtgtgactcagaccaggagcatcagcatcaccttggaatttgccataaaatgcagattctcagaccctattccatacctactcaatcaaaacttccaggcatgggctccagagatctgtgtgttcaagccttcaggtgactctgatggcgtgcttacatttgagaccctctgctctggtctgatcacccagaatctcccttgggagagctaccttgaaatttctgcttatttcccctgcagcgtattgaagactccacggtggttgttttgttttgttttgagatggaatctcactctgtcacccaggctggagtgcaatggtgcgatttgggctcactgcaacctccgccgcccgagttcaagcgattctcctgcctcagcctcccggagtagctgggattacagacacgtgccaccatgcccggcaaactttttgtatttttagtacagacagggtttcacctccgcagtggtcattaaagcttgaccactaaattgccctggttcttcaacatgcactaggcaggctggaccagaagccaggagacctggctcccagtctcattatcattactaaccagtcctggagttttccctcaccatgaagatggaatttttaccatctgctttctctgctttgtgtggcaggaagataaaaaaataataataatggatattcaaacggtttatattgcatgtaaaatgcaatgtggcattgattgtagatcccttaattcagacagatttccccacgcagacgctgtgtgtcacagggggaatgggcagcgtcactttttacatccagtcatattgtatgaaattgcaacaaattcaaaaagatgccatcgtgggagtgtggtgagtaaaaaacagctttcatgaaactcaaatcttgaaagtcagatgctttctgggtcttgtttaactgtaaaagagatagatgaagtattagaaatggagaaggaaaggggggaaaagccatccatttactgcttaagaatggctctgctattgcgatacctaaggtcacatgcgtagccacttgggttaatgatactcagtttgtccacggagtggcagtagcaactgtctgagaatcagtctcagccggggttccttctgtctatagaaagtgaaagacagactgttattcaaattccatgtgcaaaaaagccttcttacattaaatacctgggcatttcaggaagaagttttatttgacttaaactgtgaaggcagtttctcatttgaggaaaagaaagatataacgtgtttcagttgaaatgtcaagatcctttgattgcacatttggtttcctaggataaattattctagccaatggagcagaaactggctaatcaaaggcacagtgcacagttacacttctgtatatcattctctttttttaaaataatagctggaattttttttgaaagtgaaattacaatttaccacctcaactcagaggacatattagcttgataacttattcacagttgctggtgagttcaggcttaaatcatcagctgtcactcacaagtgtttacccttgaactttccgaatgagacatcaaacgtcttggtagtgggtgggtttaaacaaagctgcccacgcgagaaccattgtggagcttcttgttccaggggccggtcacggacaagctcatgaccagcacactcagatgtgacaatcagataacaagaggcaagagaagactttctgggaaataaaagatcatttttgtgatttctttaaattcagatcatataaattaggtgaagatagacattatttctcctgtttatgtaaaagaatttagacaatgaagtcacgaaattcatgagaataatttaaagactgttggaacttcccaatgtttttcttggcattcagtcactacacatagaaatgtatactatgccggttcctaatgacttagcagttccctcaggctttgttccacaggatgtgacatctcctctgccaacttttcctgcctcctttcctaatcataggattgctattctccctgacaagtaaagaatgacaagatattttattaaaaagatgttttatttatcttttaaagattttttaatgtatgtatctgcctctgaaattattaagaatgccttaataataatccctctcattttatttcagaagacactattgtaatagcatggctaggaaggaaacacagctaattattaagatgaatcatttagcaaggtggggaaaaatcccttgtgtgtaaaaatatctagtgattgacatattaccaaatttacatgaaatagatttccatgtaattgagactgatttttcctattagatggaaagaaccttcctgatcaggactggtgttgggggaatgttttccttatgaaatcagaagcagagcttctgtagggccgtccaagatcaggatgcttacttcaagatgccactctgcatctctccccacctgccaagtgtttcctgtctcccagatgctttctattggcttattgtaaggactttgacttctgcgctacgtgaactggggagtcactggaagagtttcagaggtgcaccttggtagactcaggctttctctggatctcactggctgctcttatgagtccagaatggaagaggatgaggacaaatgcagggggatgttaggagaccactaagcaggtccctgtcatttctctctctgtgattccttttgctgccactttctccttgtccccttggctccagccccctgctgtccttgctgtttcttgcacccgcccgtgaggcatgctcctgcctcaggctctctgcctgccgtgctctcacctcgcagacccacgtgatttcctcccgaacccccttcaggcctcggtccaaacatcaccctctcatcgaggtcttccttgaccacactgcttaaaattgtccccctcgcctcaccttaccaccttcactgcctcatttctcctttgtgcttaatcaccatctcacacagttatccagagcacgagccccacgaggaagggtctgtcttgtccactgttggacccctgacacctaacccctggggctggcccacagttgggaattgcatggctgtctgaagccagcaccttcctggttctgctgttccctggaagtggggttcagtacaccccacgagccaaggccctcatctcagagggcgtgcacatggttgcctcaattgtgctttcacactggacccttcctgcagtttactctcctatgtcagatgcccttcaatgaaagcaagtacattgccaccttgtcacacctctagttaccattttctttatggtccaggtcctgaccagctctaaagatgggtcagctgctgtatttccaagaaccccatgacttccagggccccttgttcccaggaaggccccgcaccccagtcgtcccgtgcataacctcacgggccagcacctggtagctgctggaaggcttctgggggatgcctgggcccctccagccctacctctagtcctgccactttacaactgagcacctcccgctgctgcctgctgaacccttcagagtccttgccacaggccctatttactttttcctgagaaggtatgtgtgatgccaaagagagaaaagcagcatttgctaatttgggtaaaatgtttctttgggaagggcaaattgatgtacagttgtccctcagtatctgttgggactggttccaggaccccgtggataccgaaaccctcagatgctcaagtcccttatatcaaatggtgtagaatttacatgtaacctaaacacttcctcctgtacactttaaatcatctctagatcccttacactacctaatacaaactaaatgctatataaataattgttatactgtattttttaaattgctattattttttattgttgtgctattatttttattgggctccctcctccccctcccaccccagtaatttcaatccaaggttggtggaatccatggatgcagaaacaatggatactgagggccggctgactagacctatttttattgtaattactcattctcttctacctcattaagcttggttctttcaagcatgaatacctggttgaatctgcataacctcttattatcgacctacctttgttcacacacaaatgattgccacttagagctctcctaccgggctccttttgtaaaataaattttatcttctccagatagaaagaaatgtgataccttgcggattttgcggtttccttgttttgctggattgcaagtcctttagacataaacaaatgttctgtaccccgacatcggtggtacccagctctcagttgagaaagagatgtaatgtgaatgccactcttggccccaggcactcctcacttgcccccactggggactggttcataccctcctctcctggcctcagtttccatacctcttagtgaggcctttgcgttatacttcagaaatattgtcagtatgactttgaagatgaaagtttgcccccaaaatcactctctgttatcattgtgaaaccagagatggaatggaaaaatgggtttctgagacattttaaattattccttgcttgtctttagaggcaaaattcagataagaaagcttatcaattatacttttgtttctactcaaaaactcatgactgctcactcaaagactccttgttcttatcttaaaacattgtttacagtgtcccagatgaatggcaacaaatcctggggtttggtgtttggatggtacatttccctggggaaagaaataacagtttgagatggaaccgggttggggtgggagaatacttctcattctgaggaatatttaattttgccaagatgagcatttctagttcttagtctgttgacgaaaagagctatggtttgtttctggaacttttgataaaaaataaagaaatttgtagcctggggagtttggttttaaaatgcaaacacaggagttatgagttgagacttggacagggtgtcattttctttttaaagggcagcaatatgattctttgatttgtctttgttatcttgacttttaatccggattcctgggcagttgttcagccccaggacatctccatgggcaggtggcctggccttggcacactacccagtaaatctctgcctgagaggacgctttagctgggaggccaggctgatttttaaaggcagaattggactatttactctaaaacagtaatgcacactgtttagaaagaaacattcctattctgggaggaaggaggagacacacagaagtatcatttatttctagtcttttctggtagaagctatgaagctgagtttactctctggaaatttgtagtttattttctagaaaattgcattttatcactgcaaaaaggattttatttccaaatgagtaggcttttgagcaagagttttggagtcacagagatggggttaagaaagtgataatgtgcaatggcgattctcaagttcaaggagaaaaaataacatgcttttattgggatactttgcttgtctataaaagaaagtagctattggcatttatgtagaagtcagcagtttcttggcaccaaataaataattttgtgctgaataaagggagagttatccatagtatttattactaaccaaagaaatgcagggagaattgtaattcattaggttttgatggccaggaaagccaagctgtgttattagggtcatgacaatcacagacattacggatggctgacctgtagtatggatagagggcagagggtagagtgtgaaatatatcacagaattatgtcaaataatctggatagttactactgcttaaaatctaagtgcacagctagaaaagtgggtagtgacgcactacagtcttgctgaacactgggtaagaaaatcatagcaaacgttgagtctgttttggaaatgttctaaaaccagactattaacacagtgagccattttaaatgtggcttgctacgtgtttggagagaaacacatactcttttattaggaacatgaaacaaactctttgagccgcagtatcactgcgagtgagtttaattgctgggattaataaatcacagctgcaaacgttaaattcttggcaggattctttattcagctgttttccccttgccccattacattccagatttgtggtctgcattatgtctggagccagaagtaagcttgctcttttcctctgcggctgttacgtggttgccctgggagcccacaccggggaggagagcgtggctgaccatcacgaggctgaatattatgtggctgccgtgtatgagcatccatccatcctgagtctgaaccctctggctctcatcagccgccaagaggccttggagctcatgaaccagaaccttgacatctatgaacagcaagtgatgactgcagcccaaaaggcaagaatgctcctcggaacctgagtttctctcatacagagcagattgctctttaccccttgatcagtggttgggtaatcccaggcttcctaccaccctctgaaaaagcatccaggtagttaacctgagttgagttagtcagttgaattaggagccttacccctcagagagtggtccgtggaccggcatcccctgggagcttgttagaaatacaaaatcttgggcggcaccccagacctactgaatcagaatgtgcattgcagcaggatccccaggtgatgctttcacatggcaagtatgagaagcccaggactagatccccagttctcaagtgtggttgtacataagaatcacgaggtaagtggtaaacactatggctgcccgggtcctggagagtccgttgtaattggtgtggaaggggtgtggactggcactgggattgttttaaggctccccagtgcagtctaatgtgcagaaaaatttgaagatgactgggcgtgatgacctctctgagtcattcgaagcttcactgaagtagtaagcatctgcaagaatgccgtttgctcccttcagactgtttgaggctcgtttccggtctctatgtcggactacgatcagtctgagaccttcgcccagatagaactgaccccaaactgacaaagggaaggtcagtgccagcctttgtgaaggcttcctggttggcctgaatttcctgctcccttcaggaagggtggggacaaaggagaggcccccctgggggcaaagagggaaatatcagaggttgcctaagaaaatgccctgctggaaaacacaaacccgaagggaagtttgggctgtaactctggtggcagggtgaccaagcgcagctgcttgaggaagccctgctgtgcctcaacaggatgtaaactcattgtgagcaacactttcctgctctctgtgaacttaaagggcagaaccagcaggtcctgccccaaacagtccctgccttagagcagggtggtcgggatggcctggacagccacagcaattaaaaaattgcaacattttaaaattttagtctataatatatatacaaaggctatgtgtatggggtgggggggtgtttgggggcagggggtgtgtatgtgtgtataacatgatgttgaaagggaacttgaagacttggtccagcttcttttttttcaaccaagacaacttttgcaagggtgacacttttctttagtcccaacctgacatacggtttctccttgaacaccttcagtggctcagactcacaggtccgtttgttccaatggtgggaacttctgaacaggtcttcctttcaatgagcagcagtcagcctccccgtaactgccaccacgattctatcgtcagagctaaagggagcaggaccgtgtcccttatcacggcatgccatcttctccacctttgaggacagctgtcatgatccccctggcatctgtcccccaggctgtatcctcagtcccttccacagttccttaggagactcagtttccaaaccttctactgaagacttccatgttttctctgtgctcagaactgtatgcagctatcccgattctgtctaataagggcagggtagagaactctcacctgtcgcattctagatgttgtccccagaaaactgctggcagccacatgtctcattatgggtgtataaggcacttgctgtcaactaaaacaccttttcacatgagcagacacacatgctgccattgccatcctgtacttataaattataaaggtgattgatttaagctgagggcaagacttcacatttatgctgttaaatttcatcattccagcctgttgggctatttagggatctttactgacatcccaagtatcagttacctttacgtcattcacacatatgatacacacctcatttatgtctatgctgaagtcagtgtaaaaaaaccccaggctgtgccctcagacctcctgatgacactgatctcctagagggcaggcattctcttgatagagatgtttgcctgcatggcactgagtccagcacctgaaatgtcatctgcctcttgcttccctcccctatccaccggaccattctgagacatttggcaaatgacacactgaaacccagactgtggctgtagaattctcctgcattcacctttcaataatctgcccccagaggaaacacttaacacggttttgttgaaaccacgccagctgcacagcatcactccgtctctatttgttttccaggggccaggattaagctgttgatatgatcacttttagaatttacagatatctcagctcccatacgtggttatatgttttttgtttgtttgttttccagcagcacttttatttttccttacacgatgacatgttgctggggcctattgttctcacataacagtagaaaaccaaaatttgttgtcatctcttcaaagaatcgagaattgcatacagaaaaaccttacataaattaaaaggatgaatacatttacaggtgtaaatgcaaaccactttcaactcagacaagtaacagcccatggtgttctggcagaaaacatcagctaagaaaggaaactgggtcctaagtcttggactttccaacccttacagaccggcagaacagaaacaactggttcaggagcccttgccagcctccagagaaatcccagaacacgcagccctgacgtattaataccctgcacagatcagagactgctggccacgcagactcaccaagccacagacttgtcttccacaagcactttcttatcttagccacaaagtgaccaagccacatgtactaagggttgaaatcaaagatatgtacagggtattaagcaaatctggttatatgttttaaaacaacttctaagacaaattgatggcaagtttgtgtgaaagttttatatcaaagttgttataagaggttcctgagcaaaccaattgaaatacagtcatgcattgcttaatgacagggatatgttctgaaaggatgcatcattaggccattgtgtcattgtgcatgcatcatagcatgtacttacacaaacctacatggtacggcctactatgcgcctaggctatatggtatggcccattgttcctaggctataaacctttacagcatattactgtactgaacactgtaggcagttgtaacaagtggtaagcatttgtatatgtaaacatagaaaaggtacaataaaaattcagtattataatcttatgggaccaccatcacatatgtggtctgtcattgaccaaaatgtcatcatgcagtgcatgactatatttctgtctcagtaggggcattcataggggaaaaacggagtctagtttcaagatgattaggctgggcagtcacttgggattgtaaccttcattcctcagaaggaaggggttcttgatctcattgagatctaccagaaaattgctgaagccatttatcaagaatgcaacttacttcctagataggattactcatcacatcagacccaaaattttgcccagctcaggtttggttcctctcctcattcctggttgataataatctagtatgtatacataatttaaatgttattctccatgaaaaaccaaagttttgtttttaataaagaaaaatgtctatccaaatataattttcaaaaatctgaaaagatgactcatacaaatatagaatgaataaagcttttatttaattcattaattaaggaaccagtaagatggtaaagctggttcaaaggaaaattcaaggaatggaaatgtgtatatcagtcagtccagtgattgttgaaatgaatttcctaatagatgcaaaactgggtaatgtcctatagggcaaaacattgtaatctttgaggtgatcttttaaatagcaaagtcaaacggtggtacattctccagctaattaaagaataattgagtgagcctattaaacagtaccctagtataatttggaaaggctgcatctccatcttgccttatttttaggtttgagataatttttctttacatggtcattgctaagtgtgcaatgagatgatactgtactggaaggaacatacattggtatagtatttctggaaagcagtttggcagtgtgtgttaagaacttaaaagtttaatttttaggccaggtgctgtggctcatgcctgtaatcccagcattttgggggtccaaagcgggcggatcacttgaggtcaggagtttgagaccagcctgatggtgaaaccccatctccactaaaaatacaaaatttagccaggtgtggtggcgcatgtctgtaatcccagctactcaggaggctgaggcacgagaattacttgaacccaggaggcggagattgcagtgagccgagatcacaacactgcactccagcctgggcgacagaccaagactctctctcaaaaaacaaaacaaaacttaaaactctaatttttataccctttgatccagtaatttcacttgtaagactttattccaaagaaataatcaaaagatgcaatcaaagatttgtgtgaagtgtataattatgcaataagtgttttgagcacactatgcagatggtcaccacagttttctttttattacaaaaagttgggaacacttcaaattccaataatagaggataaattatggcgtcctcttaaatatgatgtggccccattacaaatggatttttgaaagttttttttttttccttttttttttgtggtggagtttcactttgtcacccaggctggagtgcaatggtgcgatctcagctcaccgcaacctctgcctcccgggttccagtgattctccagcctcagcctcctgagtagctgggattgcaggtgcccgctaccatgcctggctaatttttgtatttttagtagagacggggtttcatcatgttgggcaggctggtcttgaactcctgagctcaggtgatctgcccacctgggcctcctgaagtgctgggattacaggcgtgaactgccatgcttggccgtattttttaaagttcttaatgagggaagtcaagatgtaaaaccatatatttattattatctccattatatacacacatacatgtatacagagagaaaaagtaatgaaaataaccaaaatattaacaataagtatctgtgttatagaattatgattgttttttcccgttttccaaattttctacagtaaaacttttgaagcttttataaccaggaaaaaaatttaaaagtttgcaatgcattccagaaataagtgtctcaaactttgctaatttgaattgttcatgccttctctgcctgccttctccaccttcctccctggggctggtgttcccggcttgacattttaaaccctgtaagtggagagcagtggaagaatgatgccccagccctgagagctgagggcggccctgtttgtattttcttaggttgctgtagatgtcacagggagttccgggccatcacagccagggaacacaggatgttgccaggtgtgggaaaaggcctttagggtggtcagagtcccgaagggagcctcctaattcccagttggggaatggagatttcaagcgagttcttgtttccaggctgagatgagcacacttgcctcttacccactggcccagtggatcctaaccttggctacaaatgagaatcacccgggggacctttaaacaaacactgttgccactatcccacccacagtcaatcaaatcagactttgtaggggtggtcccggcatcagtggtttttcagaagttcctcaactgatttaaatgcacaatggaagttgacaaccaccagactgaagataccacgtgtgttaatgggcccaatgtattcaaggcccagtagttggccccatctcccctggtatcctaagaactctaaatcctttctagctattcgcttgtcaaactcctgagcttactttcaatggagcttacacattccctccttccctcacatgaccccaggcacagttaatggttgttcctagaggactttgtctttgttccttggggatcaggtggagtgagacagtatccccaagactaagatctctgaggagagtaaagacaccatctctgtgcctctggttcctgctacagagtaacttcctgatggttgccaaaagaatgaacagaagaatgaatgaatgcagcggttcttcctgccatctgataacagactattctttgatgttttcattttcaggatgtacagattatagtgtttccagaagatggcattcatggattcaactttacaagaacatccatttatccatttttggacttcatgccgtctccccaggtggtcaggtggaacccatgcctggagcctcaccgcttcaatgacacagaggtgattcctgcctttttcctcagtaggctgagggtacacagaggtgatctaagtcagggaccagaagctgtgacatgttaactaagattgataggagaccttaacatccccaaaatccaacccaaactcccaaagatccatgtgccacatgttcattccattaaagaatgtctgacgttacaaggcagttattcatctatggatctttccatttattaattacacaataaatacaggaatgtatacttaaaccaaaccaaaagtaaaaaaagaaaagttcatcttcaccacagcctgcacctcatcccatgcccttgcttagagaaactgccatcaacaatttgatgtgcattcagttgtattcttttctatgcatttcatagttattgacatcctcttttttttttttttttttgagatggagtcttactctgccacccaggctggagcgcagtggcgcgatctcagctcactgcaagctctgccttccgggttcatgccattctcctgcctcagcctcccgagtagctgggactacaggcacccaccaccacgcccggctaattttttttgtgtgtgtatttttagtagagatggggtttcaccatgttagccaggatggtctcgatctcctgaccttgtgatctgtctacctcggcctgccaaagtgctgggattacaggcatgagccactgtgcctggccttgacatcctctttttaagcatactatatgcttattcattttaaatttttgctattatatttttgtaaacatgttcaagtttttctgtaaaataaaatttttagaaatgaaatccctcaggccaggtgtggtggctcacacctgtaatcccagctacttgggaggctgaggcaggagaatcacttgaacctgggaggcaggagttgcggtgagaaagatcgcgccactgcattccagcctggacaacaggagcaaaactctgcctcaaaaaaaaaaaaaaaaataaaataaaataaagaaatggaatccctcaaaggatatgtacattttaaattatattaaagagtaccaaatttcccgcttaaaaaactttgatttcactttacagccccagtcatacagtatgagtgcctctttttccatcctttggtcaatgcaagatagaataatcttttgagcctgggcacagtgcttcacatctgtaatcccagcattctgggaggccaaggctggtggatagcttgagctcatgagttcaagaccagcctggccaacatggtgaaacctcgtctctacaataaatacaaaaattagctgggtgtggtggtgcatgcctgtagtcccagccactcagaaggctgagataggaggatggcttgagcctgggaggcggaagttgcagtgagccaagattgtgccactgcactccagcctgggcgacagagccagaccctgcctcaaaaaaaaaagaaaaagaagaatcttttgaatttttgccagtcttatgaaggtgagaaatgatagctatttcattgttgtaatttgcacttctctctcactaatgagattgagcatcttttgagatgtttgtgggtcacttttctttgtccttctgtgaatcacctgtttatatcctttgcacattttcagtagtggttgcttttttcttattgatttatgatagctgtttattatggataaatataagtacttttatatttaaaaattgtgagagccaagtacaatggtgcacacctgtagtcccagcttcttaggaggctgagacgagaggattgcttgaggccaggagtttgagtccagcctgggcaatgtaacaagaccctgtctctgaaaaaaaaaaaaaagaaaagaaagaaaaaaaaaagaagaggaagcaaaaggaaggattttaaaaactcatttatttaatttatttatttatttatttatttatttatttatttatttatttattttgagacggagtcttgctctgtcgcccaggctggagtgcagtggcgcgatctcggctcactgcaagctccgcctactgggttcacgccattctcctgcctcagcctcccgagtagctgggactacaggcatccaccaccacgcccggctaattttttgtatttttagttgagatggggtttcaccgtgttagccagggtggtctcaatctcctgacctcatgatccacccgcctcagcctcccacagtgctgggattacaggcaaaaacctcatttatttacacctttttttcctctaggtgctccagcgcctgagttgtatggccatcaggggagatatgttcttggtggccaatcttgggacaaaggagccttgtcatagcagtgacccaaggtgcccaaaagatgggagataccagttcaacacaaatgtcgtgttcagcaataatggaacccttgttgaccgctaccgtaaacacaacctctactttgaggcagcattcgatgttcctcttaaagtggatctcatcacctttgataccccctttgctggcaggtttggcatcttcacatgctttgatatattgttctttgaccctgccatcagagtcctcagagactacaaggtgaagcatgttgtgtacccaactgcctggatgaaccagctcccactcttggcagcaattgagattcagaaagcttttgctgttgcctttggcatcaacgttctggcagctaatgtccaccacccagttctggggatgacaggaagtggcatacacacccctctggagtccttttggtaccatgacatggaaaatcccaaaagtcaccttataattgcccaggtggccaaaaatccagtgggtctcattggtgcagagaatgcaacaggtgaaacggacccatcccatagtaagtttttaaaaattttgtcaggcgatccgtactgtgagaaggatgctcaggaagtccactgtgatgaggccaccaagtggaacgtgaatgctcctcccacatttcactctgagatgatgtatgacaatttcaccctggtccctgtctggggaaaggaaggctatctccacgtctgttccaatggcctctgctgttatttactttacgagaggcccaccttatccaaagagctgtatgccctgggggtctttgatgggcttcacacagtacatggcacttactacatccaagtgtgtgccctggtcaggtgtgggggtcttggcttcgacacctgtggacaggaaatcacagaggccacggggatatttgagtttcacctgtggggcaacttcagtacttcctatatctttcctttgtttctgacctcagggatgaccctagaagtccctgaccagcttggctgggagaatgaccactatttcctgaggaaaagtaggctgtcctctgggctggtgacggcggctctctatgggcgcttgtatgagagggactaggaaaagtgtgtggtctgtggggcggactctggccatcatgttgacagccttgcacttccacaggctacaagccctgggaccatctttctgccttaagggcaggagcccacttctgtggcaccagattccaccctgggaactgtggaaaaagtaggagaggcagattccctcagtgtcttcctcttaaacctcaatcatcgagacattagggggtattttctgttcacatttatctttttcaagccacatcttcctctaacaaatctctcagtatgcgattggtctcaagctaaaacaaaaataaatgtcagtttatattttacacatccacaaagcagtggcttggggtttttttttttttttttatcttgttgatcaagtgacacccaggacatgtaaatatttcataagccttaaacatttcctgaggtaagaaacaagctctcaaagcaaaagctcaattagaaatggcccttgtggggaaccttcccattctggtcgaccagaactctagccagatgaaatggcaatgctagcgccaccagcaacgtcagaaacgtagaccttaaagcggcttttaaaaatagaaaagaagcgttcctcacatctgccagtaatggaattttctgtcagtaaatggaatgtgtaggcaggacctggaataactggagagagtgcaacgcttcggggtgaagggcgggtggggactggaaatgttgagacgggggcagccatgggaaggtatgagtaatagaattctttctgtacgacacagctcatccagggattccagggaccttaataaatcacggtagctttgggcaagagttgggcacgttgcccgactgtgcaggatggattgatgctggtataatttgatctggagccctatagaggatctcgttgctttgcagcgatgcctggcaccccatagagataagttgcagggactgccgtgaagggcatgaagggtggcccactttagtcatgcatttattcaatcacccaacaggcacagagcaggagcttcccatgttaggaattccagatgcaaaattatcagactcaatatggtgaagacatttttaggccactgatttctgtgtaatttgtgtccaatatttcaaagccatttaaaaaaggattttgactgcatgcctagtagctgtttcagatcattttttaagtacagaatggataattagtcttcagtgatttgcctcttaaatgtggccatttagtttgaactcctttttagttattttaaacagtatatgcttaaacatcacacgattttataaagcaagaaaaatgaaatgatctccctattcccccacggtgtaggcctccagatccttttctggcttttaggcaggacaattaacaatgtggattctgcagtcagactgatggggtttccatgcatggcctcaccattaactcctcactggggagaccttgggcctcggttttttattcatagaatgcatgttgaataaaccatgtgggaaaaagcagagccagcaccagcccctgctgactcactgatccctcggaaaggtctgggatgagtcaagtcttcagggaataagcagcaaggacttggaattcctgagcaagccttgggttccccacgccctaggaagtccctctggaaggggagcaggacctctcccaccagatgacggagttcgctttctcgcccagcgcagctcccaccaggcgtgagctggcagtccagaagcggccccagatgtggctacccaccgcccagtctgcttccctgcctcaaaccccagggagacagaaattacctaaaaatgcatatcattgccttatgccaagatgattcaaataagcctgagaaagagaggccagcgctaaatacagacttggcagaactacttcacccagtaaacatctaatcagcacctgcaggatcctcattctgcccttctgggcagagcaccacgaactttccctgagttattttctaccaacaatttagaatgaattgctcgtgaagtagaaatgaggggaaaagcaactaatggtggtagaacaaagtaatttttacaattaaaagaagtagctgccagatgacagaacaaagtagaggacgggaaaataaatcattttcagggaaaaaatatatctatgactaatggttgtgattatgtttttgtcgattgtgatcctgaaactcaggaagcaaatggcaatcttgaccacaacatggagacaggaaatcaaatgcatttttggctaaaccagacttgggggaagtggcttggtttgcgtggtttctcatgtaggtgcagctgtgcttttctgtggtttttctcacacgggaagtgagaggcacagtgagctgtattcacactggatttaaaagccctgttcttagagaggaaaaaaccaggcctcctcacagactgccaagtcccagagcccaccatgtctgctctcaagacacaggcctgtccagagcccctgctgagggaaacccacccaggccacttttccccacaggtggccctgcttggtacctgtgcccccaccccccagccatggtatattgaaccaggaggaggcacccagcccaaggccagccaatcagagcactggctagtagcccaggaggtgtccctgcacagaagatctcctcagagaggaccgatggtgagtcggccgctcttgattctcaatgaaactcagaaccgctcaagtgaaatgaccactcaaagaacaatttctcaacaaagtggatttatataggacaaaataggcataaaagtatgaaatgttttgtgcacaaaggcctagatttgagacaagagctgatgtggcctgaagatctgtgagtgggactgcttgggaggccatgttccttctcaggccagagaaaggtcctggtctcctggcttcagtctttcattccctaacctccctttgaatgttagttacctattcccacataacaaagtgccccaaaacttaatggcataaaacaagcatggacattgttagttcacccagttctgtggggcaggaaagcgggtctctcatgaggctacagtcaagatgtcagccgaggtgacagtgaagatatcaaccaaggctgcagccggttgaaggcctcactggatttggagaatattattgattaaattgcgtcttccccaaaaaagatacgttgtagtcctaacccccaatagctcagaatgtggccttatttggaaatagggtctttgcagatgcaatgaagatataagttaaaatgagatcacactagagtaactgggcccttaatccaatatgacatgtccttatcagaagaggagaagacacacacacagggagaagatgaccatgtgacaacaggggcagagatcacagggatgcctctactagacaaggcacaccagaaattgcttgccaacaaacaccagaaattagaagaggcaagaaacaactccccacacacaacccacccctgcaggtttcagaagaagcatggctctgccaacaccttgattttggatttccagcttccacaactatgagacaataagtttctgttgtttgaagccacccagttcagggtactttgatatggcagacctaggaaacaaatacagaggatcacttgcaaaatggcccattcacacagctggcacgttggtgctggctgctagcaaaaggtctcagctcctcaccacttgggtctttccatagggatagctgagtgtcctcatgatgtggcccctggcttcccctgaagcaaatgatccaagagagcacaggtggagccatgatgtcttttattaactagtctcagaagtcacactgcatcatttggcaccatcttattgagttacacaggtcagccctgctccctatggaaagagacagagggtgttagatgcccagaggtgaacctcattgggtaccatcctgcaggtgggctgccactctgctcaatccaaatcacagctctcccgtttctcacctcccaacagttgctgttcctcaggccaaagttcacattctgcacagcctcagctccgcctgacctctgagctcacatgatggcccttactgtgaacctgggtttctggtccagccatagctacttctttaagctcctccagtgtgctgagcacagtctggcccctgtactgttgtctgcttgaaatggcgtcttctgatgaacactcatccatccttcaaggtctactctctcatcacagcttgtgactcttccactttttgaactggtgtttcccattcccagttcacagagccctttctcattgaactatttatctgagttccctctgccggaacatgagccatgcctagagtagccacctagtagtgagtgacagctctgtgctggatgcacataaatggtctcccttaactgccatgagccctaaagaaggtttgctacagctattttacagatggggaaaactgacagagagatattaatgaattgcccacatgcaaatatgtgctgagtcttggatttgcatctttatcgtgactccacggagacccaccctctaagaccagagccagtgtcctattcatcttttgtctctgcagcgttcagcatggcactgtcttggcttacaaaatctgctctatgcttgctgactgctgaatgaatgaatgaatgaataggtagtcacaaagaatgtttagaatgtttctcagacaggctgagaaaaaacacaacgaaacattatttccgtttggaaagtttttttatttttgtgttcagtactgaagtaaaacaaaaatctgaataacagctgcaccgttaaaaatgaaattaccaatatatgaactctaggcatcatgcatatataattttttgtagataacttttcttctcattttccttctcattctcttcatctttttctttttgtttgagcaaaaaaaaaaaagaatatattaactcgtaactggggagtctaagaataaattctcttcagccattgctgaatctaggggctcaaatggtgtctctggacacagtatcacactctactctgcactcttctttatcattttctcccacagacagactctcgtgtagttgcaacaatggccatgacttctaggcttcatctgcccctctcagcagctctagagaagaagctcctctttttacacagtccctaattaaagtctcagagatgaacaacctgggctcttgcttagggcacgtgcccatcctgaatcaatgatcggccagagagctgtgatattcttttgtttttttgagatggagtcttgctctgtcgcccgggcaggagtgcaatggcatgatctcggctcactgcaagctctgcctcccgagttcaagcgattctcctgcctcagccttccgagtagctgggactacaggcacgtgccaccacgcccagctaattttttgtatttttatagagacagggtttcaccatgttagccaggatggcctcgatctcctgacctcatgatctgcctgcctcagcctcccaaagtgctgggattacaggcgtgagccaccgtacccggccagggctgtgatattctgatcagccagcactgagtcacatggccactattagggtgagggatgataggcttagctctgacctgaaattcatggattgaggggtggggactgtttcccaggggaacactgggacagcgttaccaggggaaggggagtgggatatagttgggccaaaacagtaaatgtccacgaggcttttttcctctgagcagaaatttcactgtgatgccagtcaggtattgctgccgtaagggccatagcaggagggagactgcaaatcttgattgaggagatcttaagaacagagtgatttacacagctgtgggcaggatgtaggggaacccagaaaggataatgcactacccagcggccagcgacagcaggagctatgagcaccccaggcctgaaggtgtgaagggctgaaatggttaccagaagcaggagagggaagcttatggagagagcaggctggcgggagcaggggctgtgagagagacagccagaccgtagcggtgtgacaggcagagagccaggcgatccatatcctgtctcctctctcttctccgctcctgactcctgctgcggcctcccactggctggacccaacaggaaagcagaggataagagaatctggttggtgctatctagaagtcagtgttggggaggtcacagaacagaatggagaggggtagagtatgcagggaagataaatgcagccctggcatggttcttccagaacattctgcaagctcatggaccagttcatttgagaagaaatagaggagttaggggagagagaagcttcttaatgaaaataaccttggtagctagtctcaagattagcccccagtgctccccacctgctggtatccgttgtacaacacttcccacatttttctggggtcgttttgtgtaaccaataaaatatggcagatgcgatggcatgttacttctgaaattgggttataaaaggtactgcagaccgggcacggtggcttacgcctgtaatcccagcactttgggaggccaagcctggcggatcacaaggttaggagttcaagaccagtctggccaatatggtgaaaccctgtctctattgaaaatacaaaaattagccggcatggtggcacacgcctgtagtcccagctagtcgggaggctgaggcagaagaatcgcttgaacccgggaggcggaggttacaatgagctgagatagcaccactgcactccagtctgggcaacagagcgacactccgtctccaaaaaaaaaagatactgcagcttctatcttggttgctcacttgctatcttgggtccctccctctggggaaagccagttgccatctcccaaggatccctatggacagacccatttggcaaggaacagccaccagctagctgcatgagcgagccatgttggaagtgggtcctccagctgcagtcaagcttccagatgaccactgccctgggaaacgactgcaacctcatgagagaccctgagccggaaccaccccacaaagtcactcttgatttcctaagtctcagaaactataaaatataaatgtgtgttgttttaaaatcctaggttttgaggtaatttattatacagcaatagaaaactaatacaatagtcttgctaccagcaccttaatctcccacatccaagttaaaattcatccaacactcaatctcccagctatcctgactgctcctatacaggtatctctcccactatatatatatcaagtgctattagtggctattatttgttgggttacacaaagccagaaatcatctacatctactctcttttcttctggttttgaatagcaaaatgcaacagggagatgttctcagatagagggagaacaacaaaaagaagggtccatgctgaacaaacttgtttgctttgaaatcggaagttctagaggaggtattctgacagtggccaggaaaacctcctgcccgcagaattttgtctaatccaccccagacagagttatccaacagcctggtatggtgcagaccaggggctctcgaaaggtgggctccaggcagcagcaccagtagcacctgggaaattgttggaaatgcaaattcttgggctccaccccagatcaacttaatcggactctctgggagtagggcccatcaatctgtgtttaacaagtcctccaggtgattccgatcctaatcaagtgtgagcccactgtctaatgcggtgcataccaaagcaggtgcacgggtcttaatcatcacctcagtcctctgaaacaggcaagtgtgtccattttacagaagaaggaactaaggcctggaaggcaagtccttgcctgagactaaacagaatcccagcaacataggacgaggctggaattcccacacctggactaatgcacagccagtgtttcaacgtcgccaacccagaaatgttttctctccctgtcatgctaattttcagccctttctgggtgacttgttcatcatccaaatatattatttttgttttgtttgactaaaggcaattatatttacattttctctaagtactggaatgtaatggttgaaattcctattcagtgatctggaagaactctaatgttctaaagtgattctttgataattaaagaaagatgtaattatgtataatgtgatttgtaagataaggtataactttgggggtgttctaattctttaaaaattgttgatccgactatggatgtcttgcaactctcaaaaaatcacgtgtgaaagttaagcattagttccgtgtaaaatactgtgctagaaattgtggaggatgcaaagtcacataagactgttactgttttttaaaatttattttttaaaatagagacagggtttctccatattggccaggctgaatctcaagtgatctgcctgctttggcctcccaaagtgttgggattacaggcgtgagccactgcgcccggccaagactgttacctttagcgagagcttattatcacctagtgttcatataaacatgggatttaaatacacacacaacccccaaaacaaattgctaaaagatatttgtgcagattttatttttccaaatggctacaacagtatttgaagaactaacaagtttaaaaatgtaaaaggccagtaaggcaacattgggcactggggcaagtgaaggggagggaaggagcatggagtcaggggagagggcattggctggttctgcaggctctgcaggctgggggaagagttagggtttatgtgggcagacagcattgcaggggattaggcaggggaataacatggtcatttaaaatgattcttctggctgatgacaggttttcagatgcttcacctcctcctaagtcagtcacacctcatatccaagccatgaggactcactgaggggaatgtaataaatagctatttaagggaaaaataacaattaaaaaatctataatagcagtttaagggacaaaaaccaaaacatttctttggaattattcatgttaagcttaacattttctaatatagtcctgcatccttttttttgtttttgagatgaagtctcactctgtggcaatcttggctcactgcaccctctgcctcccgggttcaagcgattctccttcctcagcctcctgaataactgggattacaggcatctgccaccacacttggctaattttttttttttttagatggaattttgcacttgttgcccaagctggagtacaatggcatgatcttggctcactgcaacctctgcgtcccgggttcaagcaattctcctgcctcagcctcccatgtagctgggattacaggcatgcgccaccatacccggctaattttgtattttagtagagacggggtttcttcatgttggtcaggctggtctcaaactactgacctcagatgatctgcccgccttggcctcccaaagtgctgggattataggcatgagccaccgcgcccggcctgcatcagtttttaaaagacatcagacacgtcaaagccacaggaggaaaagcccctacattcatgcacaacagaaaggctttgttttcagtaaacacgcacatcttcaaagaatggttgcaatccaaattgtttagtaactattagaggaacaaagaaggctgtgtcctctgaattataatgtgcatatcctctaaattgctgcatattaggggttgaagcatgctgggagtttgacgtatgtaaggaaaattattaggttgatggaatataaagatacttataataaaagccagtattttggcatttataaatgaatctgaaaagggtgaagaacttcattgttttgcaattaataccacaaaatgtggcccttgtgttctactggcccctgaaaattgtttcagatctttccttggtgcagtgtatattgaatagtaaaagggacatatgtcacaaaacagatttattcctacaaatttacataaaaaataagaagtgaaaaaataaacccagattttgaatgcgctggcttgggagcccagagaccaggcctggcttgcttttaaattgttgtgtgacctcagccatgtacctgtgcctctcaaggcctaaggtcctctctctgtaaaagaggggactacatgagatgatttcagctcaaatatccttggagactctcattgttttctagttgtaaattatgctttttctaatagtaaataagaaacgaaacagtattcatgtatgacagagaatactttgttgtttttactttgttttgttt

SEQ ID NO: 1041 - DNA, 130653 bp, Homo sapiens
actccgtcctgggctctcggatttctctttcctttgtcttccaaattggcctgtccagtggcttcagatcatttctaagctggctctggagtctgactacctggttggagtcccagctctcagcttccctgctgttgtctatagccacaatttctcctttgtgatctggcagcctcagttttttctttggtgaaatgggggtataacagcacttactgcatagagttgtgataactgaatgaggaaatccaagtgcatcttatgacgcagagtttaattcatattagctgttatttttatttataacttctattacataaaaattgcattactggctgggcattgtagctcacgcctataatcccagcactttgggaagctgagttgggaggatcacacgaggtcaagagtttgagaccagcctggccaacatgttgaaaccctgtctctactaaaaatacaaaaattagctggacatggtggtgcatgcctgtaatccccactacttaggaggctgagacaggagaactgcttgaacctaggaggtgaacgttgcagtgagccaaaatctcaccactgcactccagcctgggtgacagagtgagactccatctcacacaaaaaaagaaaaaaaaatgcattatcattttacttttcaccagacaactcaagaacaggtgctgaggactcaccagatcacatcgagacaggtgtttaattctatttcattgaaatgacagcaagaacaaaccactagctgaccatgagccctgtgccaggcctggtactaagtttttttcctgacgtgcaaagcaggatttctgctccagagagcttgcctatggtgaataaacaggagagcaacatagaggaatatgtggaaaagtcaggcagctataataggtgcccaattattaagagaccagtagttgccaaatagcatgctatgaaactcattcttcagagacacttcaaggggcgtcctcaaacttttgaattccaatttctgttttaaagtatgttttaaactacagtcagactcctgacttaacaataaggataagttctgagaaaggcatgattaggaaatttcatcattgtgtaaacgtcatagactgtgcttacacaaacctgggtggcataggctacgacacatctaggctatatgatatggtctattactcctgggccacaaacctgtacagcatgtgactgtgttacagttgctactgtaagcaattgtaacacagtgataagcatttgtgtacctaaacatatctaaacctagaaaagctacagtaaaaatacggcattataaccttatggggccaggtgtgatggctcatgcctgtaatcccagcactttgggaggctgaggcggatggatcacctgaggtcaggagtttgagaccagcctggccaacatggtgaaagcccgtttctactaaaaatataaaaattagcccggcatggtgacgtgcgcctgtaatcccagctgctggggaggctgaggcaggagaatcgctcgaacccgggaggtggaggttacagtgagccaagatctgccattgcactgcagcctgggcaacaagagagaaactccattccctacccccccccaaaaaacttatggaccactgttgtatatacagtctgtcattaactgaattgtcattatatggcacatgactgtattttaaaactgtagtttaaaaaactaagtttggccaggcacagtagctcatgcctataatctcagccctttgggaggccgaggcgggcagatcatctgaggtcagaagtttgcgaccagcctggccaacatagtgaaaccccgtctctactaaaaatacaaaaattagccaggcatggtgatgtgcacctgtaatcccagctacgcgggaggctgaggcatgagaatcccttgaacctgggaagtggaggttgcagtgagcccagattgctccactgcactccagcctgggcaacaaagcgagactctgtctcaaaaaaaaaaaaaaactcacttatgaatgtattgaaggcgaaatttcaaaacagtggagatcatcaacacattaagttctgtttcaggttaatagatttttgtccaggctgtaatgaagtgtctgcttccctctctgtttaataaaggaaaatcttgattcacccagataaaagttgcaagagaaactattttttgacagctttattgagatataatccacatcccatacaattcatccatttaaagttttggtttttaaacagttacagtttgcaattgcttatttgagtgaatcaagattctcttgagtttgtgcaaagaaaaatgcaaatttagagtgaaatgaggatgctaggagatggtgcctgatgtccacaaatgtccatagcatcaattttcaaatttttatgtacaagcgagctaaaacatttcatttggctgcctttctaagtaatcatatacatttgaacatgtaatgttcttatatgttctcatgtcttatttcacactaactaaaaacccttcatttcgctaggtgtggtggctcacacctgtaatcccggcactttggcaagctgaggcgggtggatcatctgaggtcgggagttcgagaccagcctggccaacgtggtgaaaccctgtctctactaaaaatacaaaaatttgccggggtggtggctcacacctgtaatcccagctacttgggaggctgaggcaggagaatcgcttgaacccaggaggcagaggttgcagtgagctgagatcgcgccactgcactccagcctgggcaacagagtgagactccatctcaaaaaaaaataaaaaaataaaaacccttcatttatctgcttgatatattgagattgcagctaagagtgagtgtgaagagattctgtttgacacatgtttactgactctatgccatgtgtcaggctctgttggaagctctggaactcagccatgaacaggcagacatgaagacctgctcttgtgaagcttagattccagagcagggagatggagaatagctagagagaaaacaatggaatggtatatcagatggcgataagtgctgtgaaaactaaagcaggtccagagggatgaggagctggcgggggtgggagacacgagacagggagctactttatggagggtgccaggccaggcctcactgaggatgcggccttggagcaaagatgtggagatcagggagtgagctttgtgcttgccaggtgctgctgccaaggaagcctgaagcccttgaaaggcaataagaatgagaggagctcagagaagcgagagcaaagggaagggtttgtgacgcagatgagagcaggaagagaaaaaggctctggtgagcagaggagcggggttggtcttctgtggggtgccgggggagaaggcagttggagcaaatgtgtgcaggtggaagtgtcttcgtggttctggaaacaaggagtcgactggctgattagctcagtgaggaagcaatagggccaggtgggagtcgagcgtacaagtgtagggtcagtccctgtcctcgtttaaaattttggtactgggttcatcatggaatttttgtggtaactttgattttaaaaaaattagcactcatattggttactgagttgtttggtgctcccttaaactttgcactagtttcaccctagtttctgcccttggagcagagtctgtgtcagtaagttcacagtccctagaggagggccgtctaagtctttagacttgactctgtggtcactggaaaggcccttgaagaatttgtgtgtgtgtgtgtgtgtgtgtgtgtgtgtgtgtgtgtgagagagagagagagagagagagagagagagagacagagttttgctctgtcacccaggctggagtgcagtggcatgatcttggctcactgcaacttcacatctcaggttcaaggcatcctcctgcctcagcctccctggtagttgggactacaggcatgtgccaccatgcccggctaatttttgtattttcagtagagatgaggtttcaccatgttggccagactggtcttgaactcctgacctcaggggatctaccaacctcggcttcccaaagtgctgggattacaggcatgagccaccgttcccagccccttgaaggatcttgaacaaataaatgatgtaaccaaaatattggggacgattggtctagaagcaatgtggaggatgaagaaagggaccggagagcaaggacctgtcaggaaatggattgtgatgccccaggcccatggtataggaacagggggtatgggaaggaaagctggctgctccttgcctttcatgggtctttgcctgtctctaaaccacccccagaattcatcatttcccaaacaactgaaaagacacaatgaatgcgggcctcgtgcctctttctgtttttattatgactgatttttgcaaaacaggaagtgctgccgtgacaatggtattatttgtggctgagaaatatacttttgaaaactctgcaaaccctggaacccttgcactgaagcctagttgtgcttctggagactccctgttgggtgggctccattccaacaggcaccatgactttcctctgctccaacagcagcgtggactcaagagccgctgtgttcctaggactggggacaagttgcttcacctttcaagaaaggtagtgagggcctggcactgtcaaggagagtggctggctgggtgccaccaggcaccatgaagacagtatgatttatgagaaaggtcacaggaaaccctccctgccccaggctttggtcctagatcaacattttcatcagcggtagttagtggctacaggctgcagggaacacggaggtaattccctgaggcagaagtgggtcagaacatatggtggttgggttctgatgaggttcctcttcctggctcccagatggccaccttatcactatgtgctcacagggcagagaaagagagaaaggaagctctctggggtctctaaaggtactgatcccatcagaccagggcctcacgctcatgagctcatgtaaccctaactacctcccaaaaacccatctccagaacccatcacatt[450 bp omitted]atatttgacattccttgcacctctggccatacacacagtttaaccttctgaggctctgcatctcatctttaagccttaagaaaaaatggaaaaggaaaagctagggcatgttgcaagccctgcttggtgtcaaggaatccttcaagctctgcttggtttgtttttctttctttctttctttctttctttttttttttttttttttggagtcagtctcgctctgtcacccaggcttgagtgcagtggtgcaatctcagttcactgcaacctccgcctccagggttcgagagattctcatgcctcagcctccctggtagctgggactacaggcgcccgccaccatgcctggataatttttgtatttttagtagagacaagggtactccatgttggccaggctggtctcgaactcctgatctgacctcaagcaatctgcctgcctcaacctcccaaagttttgagattacaggtgtgaaccactgtgcccggccaatagtttgggtttctaatcaagttttttcattgtagtaaaatatgcataacataaaattgaatcatttttaagtgtaaaatttggtggcattaagtacattcacaatggtatgccaccatcatcactaaccatctccagaacttcttcatttcagtaactcctcgttctccttctgccaccctttggtagctgctgttctacttttgtctctgtgaatttgcctaactccaggtacttcatataagcgagatcgtataatatttttttgtgtgtctggctgatttcagttggcttaacgtttttgtctcagtctgttaaggctgctagaacaaaataccattaatagggtggcttataaacaacagaaatttatttctcactgttccggagattgggaagtccaggatcaaggtgccagtagataatatgtttggcgagggccccttttctttttatttatatatatgtgtgtgtgtgtgtgtgtgtgtgtgtgtgtgtgtgtgtgtgtgtgtatatatctatatatctatatctatctatatatatatatatatttttttttgagatggagtctcactcggtggccaggctggagtgcagtggcaccatctcggctcactgcaacctctctgccttccagattcaagcgattttcctgcctcatcctcccaagtagctgggattacaagcgcacactaccacacccagctaatttttgtatttttagtagagacctggtttcaccatgttgaccaggatggtctcaatctcctgaccttgtgatccacccaccttggcctcccaaagtactgggattacaggcatgagtcactgtgcccagcctttatttatatttttaaaaacttactaggctatcactctcagatcttagcgagggcctactttctgattcatagatggtgccttctggctgtgtcctcacaaggtggaagaaacaaggcagttctttggggcctcaatgccatcattagggctcaacatacaaatgtcaatgcatgaattttggaggaatacaaacattcagaccatacagccttcaagtttcatccatgttgtagcatgtataggaatttcattcctttttgtggctgaattgtattctactgtgtgtatgtatcacatgttgtttacctactcatctgttgatagacacaatttgtttccaccttttggctcttgtctaataaagcttaacatggcctggcaccgtggctcacgcctgtaatcccagcacttggggaggctgaggcaggcggatcacctgaggtcgggagttcgagaccagcctgaccagcgtggagcaaccccgtctctactactaaaaaaaaaaaaaatacaaaattagctgagtgtggtggcacatgcctgtaatctcagctactcgggaggctgaggcaggagaatcagttgaacccaggaggcgaagattgcggtgagccaacaccgcaccattacactccagcctgggcaacaagagcaaaactctgtctcaaaaaaaaaaaaaaaagagtttaacataacaggtggcagatgggatctctctcctttgtgagcctggcctcaatttaacaactaccttttgattaattctatttcattctctggaaacatgacaccatgacaccaaacagagcaacttagacagcagggctctgcaggaaagctggggctggagaacacacgtgatgggtagctgtggtcattatggaccttcgcagagcgttgcctgagggtccagcaggtcagagatggcaccctgggtgggtgaggctgcatgacatggggtttttgattctataataaaagagatctttcacttttcactttaaccctttcatttattcattcactcactcattccaacattattgaatacttccaaaaaaagaaaaaaaaggaacaagatgcatgataacaaaagagaaaaagaagcaaaaacaaaaaaccaaaaccaaaatgaacaaattaaaaaaaaaataggctgggagcggtggctgacacctgtaatcccagcactttgggaggccgaggcgggcagatcacgaggtcaggagattgacaccatcctggctaacacggtgaaaccctgtttctactaaaaatacaaaaaattagccaggcgtggtggcactcaggaggctgaggcaggagaatggcgtgaacccaggaggcggagattgcagtgagccaagatcgcaccactgctcccagcctgggcaacagagtgagactacatctaaaaaaaaaaaaaaaaaaaaaaaggccaggtgcgatagctcatgcctgtaatcccagcactttgggaggctgaggcaggcggatcacaagggcaggcgctcgagaccagcccagccagcatggtgaaaccccatctctactaaaaatacaaaaattagctgggcgtggtggcgcacacctgtattcccagctactggggaggctgaggcagaagaatcgctcgaacctgggaggcagaggttgcagtgagcggagatcgtgccactgcactccggcctgggtgacagagcaagactctgtctcaaaataacaacaacaataaaagttatacaagaattttcgactgcacgaggttcagtgctccacgttgtccaagggtcaattgtatggggtccaaaggtaagtcctgatggctttgaagcagatcaggagaaaatcatggtcatagttactatcttttgagcactttctaagtgctgatactgttctagtgcataatgcttattatctcagtcaatcgtcagagcagccaagcaagataagtgaggaggaaacaggcctaaaaacttaccaagacctctaaatgtgggtggcagaatgcagatccaagctcaaaacatcacccttgctattcacagtgtggcccacggaccagcagctgcatcttgtgggagctttttagaaatgcagaatctctgcctgaccctagatcttctggatcaagcctgcactttcacaggatcccctagtgatcccagtgcacactgaagtttgtacagcacagatggcgattcaccagatcggctgcacattggaatcacttgagggatttcaaaaatccttagtgcccaggccatacacccctagatcaattacatctgcatttctgggtctgtcacccaggcatcaggatttttcaaaattacccctctgttgagccggggagagcaggttaactcttgcagggagaactgggcttgcagggtccagccagctgccagcagctctgcagctttaagaactggggcgggctagctgccgaggagaccacgctgctgcatgggccacgtgagctcaggctgtgggagcggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacagtaagtcagaagggaacagagcacagcacagtccctccctccgccccaggcagtatccaccttgccccgccccacctaaggagcccaagggtattctgggagcccaccccaggacaatggcagggcaaaaccagtgagcaaggcagaaaattcctgaaattctccactgaggcccagctgttcctctccttgaaaagtcaaggcttggttcaagccagatagcacctgaggacagaacatatcaggtattggtagtgtttctcctctgttctctctcctgcaaggccctttcagtccttgtcactgcccttgagaactcccaggtcacatgaaggcaaagaaagtaaaactgaaactgcctttgagccacaggcttgctggggatgaggtgacaaagctaatcgaggtggcaattggggaaggggttctgggctgccgcaggcacacaggccagagcttcgtggatacctgcagggcccaaaggtccctccctgttttgaagagtgagtgatggctatgaggtagcggccaggctgatcacccctgcgttggctggaggcagaattctgtaaatcctcgccaagtctttctccaggccactggttagctcatctcagcctcctctgggagcatcaacaccaacatggcacaggggactgcagtggtgtgctttggacctgtgtacccacccaaggctaaaggcagagccaggtgactttgcgggggtctcttctctaggattatctgtacttcccctctgtcctcttttactacgggagatcgagctagctataacccaccttctttcatgagaaccacactaaattgcaaaaattatcccagtgctggaggagggcagcaggttgagattatgttggcaggaagaatgttggcattgattggcacgcaggggacgagagctgctttgtgctttaaaggtaactgagtatgagctaaaaagaaggaaaggagaggccgagagtaggaagaagaaagaaagctgacttggctggaggggtggagtgaagctgaggaagcaggaaggggaaggaggtgatgggtgggaagggcagggcagggtggagttaactgaaagaaggctaaactgtggcttgtacataattatgaggaagcacctttttttccccccttcattttgagacggagtcttgctgtgtcgcccaggctggagtgcagtggtgtgatctcagctcactgcaacctccatctcctgggttcaggctattctcctgcctcagcctcccaagtagcagggactacaggcacatgccaccaggtctggctaatttttgtagttttagcagagacagggttttgccatgttagccaggctgagctcaagccatccatccggcctggcctcccaaagtgctgggattataggcgtgagccaccacacctagccaggaagcatcttaaaagagtcagatgtcacttccagctgagggctagatccccggaggccaactggtggcccctgacatgttttatttgtaagagtgaggactcttggaaatttggaaaatttcacgcgttgtgaaagaatgggctcacgtttccgcagctcggctggcgctgtagctgctggtttgccaaagtccccacctctcctgcactgagctttgcattccttgacccaccccaaaacttctgtacctgcctggttcctgtgggcaatgcagattgctgctccttctggtttgataataatgattctcgtccaagtgcacaggtatatgctctttcaattaatttcaattaatatctccctttttcagtggagcatggcagatacacaaaaccaaccctctccttgacagatttctcagcctttccaggcgatctgccaagttgctagagggtatttgcattaaaaaaaaaagtttattttcttattttgggtttaaggattttccaacctgccttaaggcaatatttcatttatgccacactttacagctttcaaagcatttcttaaacagacttgaatttgttttatccttccagaagctccatgaagtctgtaatttggatctcctcatgctgtcttggaggaaacagaattgtagagaaactaaatgactgcccttggtccttcagtaatgttgaggttcacattcaggcacagctctctggaagaccaagctgtgtctttttgactgtgtgaaattgtaaaaagttatgctttgaaaagcatagtgactgaaagtatgatctcaatccagaatacttgtgttaccagaaaggggcctcaaaccagaccccgagagtgttcttggaccttgtgcaagaagcaactgggggcaagttcatagcaaagtggaagtgaaagcaagtttattaagaaagtaaaggaataggccgggcgtggtggctcatgcctgaaatcccagcactttgggaggccaaggcagacagatcacaaggttaggagatcaagaccatcctggccaacatagtgaaaccccatctctattaaaaatacaaaaattagctgggtgtggtggtatgcacctgtaatcccagctatttgggaggctgaggcaggagaattgcttgaacccaggaggcagaggttgcagtgagccgaaatcgccccactgcactccagcctggcgacagagtgagagtctgtctcaaaaaaaaaaaaagaacggctactccataggtagagcagtggcatgggctgctcgactgagtatacttaacggttatttattgattatgtgctaaacaagggatggattattcatgagtgttccaggaaacgggtgggcaattcctggaactgagggtttctctcctctttacacaaaataaggtaatttccagacattgtcatggcatttgtaaactgtcatggtgctggtgggagtgtcttttgcatgctaatgcattatggttagtgtataataagcagtgaggacgaccagaggtcactttcattgctatcttggttttggctggtttctttaccacaaagtgttttatcagcagggtctttgtgacctgtatcttgtgcctacctcctatctcatcctgtgactaggaatgcctaagttcctgggaatgcagcccagtaagtctcagccttattttacccagcccctgttcgagatggagtggctctggtttgaaagcctctgacacttgggcttgactgctggtttggccactcaatacctatgagtctttaggcaaagtactgaatcatcctgtgcttccttttctgtaaaatagggataacagccctcatctagggagtgttgtatggattaaatgacatagtacatgaaaagtgtttagaacaatgcctggcacagagtaagcttttgttcacatacacacacacacacatacacacacacacacacacacacacgccaaactgtaaaatatttgaagagacttattctgaggcaaacatgaggaccctggaggtcctgagaacatgtgcctgacatggttgggatacagcttggttttatgcagtttaggaagacatagacatcaatcaatacatgtgaagtacacattggtttgattgattcagtccagaattgaggtattcaggtcataggtagattcaaagatttcccaattggtaattagttaaatgagttaagctttgcctaaagttgaagttagcaggaagaaatgcttggattcaagataaaaggggttgtggaagccaagggccaaggttcttgttatgtagatgaagcttccaggtagcagacttcagagagaatggatggtaaattctccccgccccccccccccctttttttttttagacggagtctcactctgttgtccaggctagagtacagtgggatgatcttggctcactgcaccctccacctcctgggttcaagcgattcacctccttcagcctcccaagtagctgggattacaggcaccaccacccccaccacgcctggctaatttttgtatttttagatttttagtagagccagggtttcaccatgttggccacattggtcttgaactcctgacctccaagtgatccacctgcctcggcctcctgaagtgctggggttacaggtgaatctctcttatcaggccttaaaaggtgccagactcttcataactctcttcaaggtgggaggacttggaaggggaaagagctagttaatagatttacagatacaaaaagcagtttcaaaatatggtgaagaaacatatttgggggtaagatattttgatttccttctttatctgtcatttgatagagtcaggttggaatttggtatcttatggctacaaagagtctcttttatctgtcttaagatctctgttttaatgttaatgctggtcagttgtatctaaactcccaagtggtgggggataatgaggcatgttcagccattcacctcccatcatggcctggactagtatttcaggtttctttggaatgcccttggctgaaagggggtccattcaattggttgaagggcttagaattttacttttggtttatactttcaagaaatattcctatcagtggggccaggcacggtggctcatgcctgtaatcccagcactttgtgaggccaaggaaggaggattgcttgaacttgggagttcgaaaccagcctgggcaacatagtgagaccctaaaaagtctacctaaaaagttaaaaaaaatttttttaaattatactactactactaaaattattattatctgtgcctttgggagatactctgtattagttagggtacaggctaaattgtaaaaaagatcccaaaatacatttgctcaaaaagggtagaagatttttcctctttcacataatagctaagaggtaaatggtcagtccaggacaggcaaacaactctgctccacagggtcattcaggaacccagcttcctccatcttgttgctcccttttctgcatagtcaaaagtgactcaacatcaccttcaccttctgttcctgcctgtagtgcgaagaggggaggaattagagggcaaacagctcccttctaaatgatatacctcagagttgtacatatcctttcactcatattccctgacccactctgtttccctgaccaaatttcccaggcttttctaccttgatctgaccttgtctttctggacctttggtaccactgtgctcccatacctgaagactctttctcactgcagtgctactctttctaagttcccaccctactttgctagacattttttttccatttccttcaaagagacctcctgttccactcactccctaaatatcctctgggtctctgtgttccacccacagcccttcctgccttttgccctctccctcggtgtgatggcttaatgttgagtgtcaactggattggattgaaggatgtaaagtcttgttcctgtgagggtgttgccaaaaggagattaacatttgagtcagtgaactgggagaggcagacccgccctcagtctgggtgggcaccatataatcagctgccagctcatctaggacaaaagcaggcagaggaacatggaaggactagactggctgagtctttcagtcttcatctttctcccgtgctggatgcttcctgccctcaaacatctgactccaagttcttcagctttggactcttggacttacaccagtggtttgccaggggctctcagggctttggcctgagactgaaggctgcattgttggcttccctacttttgaggttttgggacttggattggcttccctgctcctcggcttgcagacagcctattgtgggacttaaccttgtgatggtgtgagtcaatactccttaataaactcctcgtcatgttagtcctgtcccatctagagaaccctgactaatacacttagtgtcctcagccacgcaaaagctgatgactcgcagctctccctcctccgggcaggtgtccttcctgacttctggtgctgaatgtccaccctgtcatggacctctgcctggggctgtctcacaggctcctcctacttagcattctaaaaccaaattcctcatcagtctcttcttgtatttattttcatgaatggcacagttagctagttgcccatcccaggaaaaagaaatctgataattattattattattgttttttgagatggagtttcactcttgtcacccaggctgcagtgcaatcacgctatctcagctcactgcaacctgcagcctctacctcctgggtccaagccattctcctgcctcagcctcctgagtagcagggattacaggcacccaccaccgcgcctggctaatttttgtatttttagtagagacagcatttcaccatgttggccaggctggtcttgaactctgtcctcaggtgagccacctgcctcagcctcccaaagtgctgggattacaggcatgagccaccccacctggccctgataattatttgtgattcctttctttcgttgcaccttttgcatacattcaatcaggtatcaggttctggcaagtctacctcttccagttcctcaaatcagcccttcctctcattctctcactttggggaaagcctggattgcttctcaaatacttacgacagagggtctctgagggatgttcttcttcacattcatcctccaccaagtgctgcctgttcaggggatcctcctacccttagtgctcctggggctcttagatgaagctcatactccttcaggttatgcacatgctccctcccaagcatctctttgtctatcttcccagcccctctccctctttaccccaggtgtgccaaccactcacactgtcacctacagagacttcttcagcctttctcctagtgctgatttccagctgtctgtcaaagctcatgcaatgtctcccaggccatacctgcctgacactgtcaacacagttttccttgcctcttcctcattagcagctccagtgcttaagcacatttcccgacacacagaaagtgctctgtaaatggcaaaagagtgaactgtatggctctttccatgtcctactccacctccaatcatgctacctgctctgtacctaagcttctgagaagaccctcctctcctgtggggatgtctgtaactctttcttcaagaaataatatttttggctgggcgcagtggctcacgcctgtaatctcagcacgttgggaggccgaggtgggtggatcacctgaaatcaggagttcgagaccagcctggccaacatggtgaaaccctatctctactaaaaatacaaaaattagccagatgtggtggcgatcgcgccactgcactccagcctgggtgacagagtgagactccatctcaaaaataataataataataataataataataataataataataataatttcaagaacaaactcaactaatgtcttcagtgaaggcttctcctacttccccagccagattttcattatttatctatcatcaagtatttttaaaatgcctatagtgtgccaggcactgttcagtatactggggatagagcagggggaaaaaaatgacaaaaacccctacccttaagaggttcacagtatagcatggggaattagaagtaagcatctgtctcttctctggtctttaagcacctcacaggcactggccatgtctgctcatctgtttattcccatcatctaacagagtgctcaacacatttgcttgatgaatacgttttgagcactgggagatgatcacagaagagctaagaagtgatagcagttgtatttagtggagaacagtattcacaccttgttgtctagattgccttgaaatcaggctctgtatgatatcttttttttttctcttagaaaaaactgttaacctatttagagtaattttattaaggagctttttatttttttatttttttttttgagacagggtcccaccctgttccccaggctggagtgcagtggttcaacaaccacagctcacttcagccttgacctcccgggctcccacctcagtctcctgagtagctgggaacacaggtacgtgccaccctgcccagctaattttttattttttgtagagatggggttccactgtgttgcacaggctggtctcaaacttctgggctcagtcaatcctcccgccttggcctcccaaagtgttaggattacaggcgtgagccattgtacctttaaaagaaaaaaagaaagattttttttattttaaattaaaaattatgacattgcatatcactgtgagtgtatttaatgttactgaattgtacactttaaaatgattaagatggtcaatgttatgtgtattttaactataataaaagaaaaaagttttttttttttttttttgagatagagtctcactctgtcgcccagactggagtgaagtggctcgatctcggcttactgcaacctccacctcccgggttcaagtgattctcctgcctcagcctcctgagtaggagtagctgggactgtaggcgcctgccaccatgtctggctaatttttgtatttttagtagagacaaagtttcactatattggccaggctggtctcaaactcctgaccttgtgatccacctgcctcagcctcccaaagtgctgggattacaggcgtgagccacggtgcttggctagttctttcttttcttaaggctgcatttcattcagcaaagaggcactcactatgtagccggcactactctgggtttgtgggccataaagacagataagacacagtccctgtctttcgaggacttaggcttagcaggagacaggcacctgagccacagagacaatcaagagttgctcgctgtgctcagggagaactctgttcggcccacaccaccttagttactagtgacggccaccagacttgaagtatcatgagtacctggatcatcacagaggagtcaatccatttttataggtctaacttgggtgtttccaaaaatgtcaagtaacgaacacacaacagaacatttataagagcaggattccaaggtatcagttagacagtaaacggaggggcccagccaagcatattcccatgctgcaaagccacttgatattagcgcacatcttgaagcaataaacgctgccctggcaggccctggcaaatggcacttgtgaatatttagaaacggagcagccctgtttgggaaaactgtcatactgacgcgctaggttgggagagatgaggtggagacagttaaaaaaaaaaagaatgaactgtatgcttccagaaacgttaaactctcactcatggagcctagtgcatcaagtttaggtccattgtaacagcactttaggttgtttctgattatttttttcaagacagggtctcactttgtccctcaggctagagtgcagtggcacagtcatggctcactgcaacctcaaccccctgggtgtagatgatcctctgacctcagcttcccaggtagctgagactacaggtgtgcaccgccacagccagctgattttttgtagagacagggtttcgccatgttgctaggctagtcttgaacttctgggctcaaacagttcgcctgccttggcctgccaaagtgctgggattacacgcatgagccactgcatccagcctgtttttttcaatgttttaacagcgcatcttttggctttaataatcagacttttttttttttttttttgagatggagtctcactctgtcacccaggctggagtgcagtggtgcaatcttggcttactgcaacctctgcctcccgggttcaagcgattttcctacctcaacttcctgagtagctgggactacagtcgcacgccatcatgcccggctaatttttgtatttttagtagtgacggggtttcaccatgttggctgggatggtctcgatctcctgacctcgtgatccacccacctcggcctcccaaagtgctgggattacaggcgtgagccaccacaccctgccaatagtcagacttttaaaagcagcagacccagctaactgggagtgaagcagctgctcctcactaatttgctgtcaaggagctgagcagatggaagcaccatcctccctcctcctgatgcctcctcttctctctggggtttccacatttattgtattactgcatttggtctatggggttgacagttcagcaggacttcaggctggaggtaggaaacaggtccactgtgggcatagctgcttgttaattcatggcagattaggctttctgtgaatggcatggcttttttcaaccacgagttctctgaggcctgaagaaagtgctggtggaaggccgtgttgcccgggccaaggaaagtgtcctgttacacaggggttggttgtaactcactctgattctgtggttaatcagaaacaaatcagcctgtttcatagaagcctttgttgtttgttctgatgagatttttacctgctgtacttgagacatcagtaaaaagtgaagtagaggttcctcttcagagactttccttcccatctaattaggaataaatagtaacttctcttagaagcaaaatttattcaaagacctgtgctaacattcttaaatatctgctatccataataaagaaatcaatgtactttaatgttcttagctcccacaatttagcctgaatatttgccctggcatgcttatactggtccaagcaagtattaggtcatagcctgttcctcttccttatttgaaggtgtttttacctttctcaacattgcacaagttacttcctccttcctttgttctcctctgcctttgcctcttttaaaaggttctaagttgccagccaattgggacaaatacaggatctgaggtcccattccagccaatggaaactggacacagcagtagggtggacgagtcaggttataaatgaccctgtctcctttgttctatatactcatggggcacaactactggcgagtgtaccctttctgcagaaagtgtaaaaatggccttgctgaggaaattaaatttatgttcaagtactatttctttacggcaccggggaacaagcatttcaaacacgtacttgctgcagactctgccctctggaatggctgcgatcctgtctcaaatggatttgagcagaaaaggggaagtgactggcagaaaagcccagagatagatctgtgtttaggtaaggttgtttgtccagagatagaactgtgtttagatagggttgcttgtagggccagggatgacagcgtcaagccctgcctctttttactcttggctctctgctttcttctctgttggcttccttctcgagccagctctctctgtggggtgacaaatgaccactggcagcctatgctcacattgtccctgtgtctagcagtttcagaggtaagaaatacttctttcccgacagctatacaaatacaaaggttaaggttgggcacagtggctcactcctgtaatcccaacactttgggagaccaaggcaggcggatcacctgaggtcaggagttcaagatcagcctggccaaaatggtgaaatcctgtctctactaaaaatacaaaaattagccgagcctgggctactcaggaggctgagtcaggagaattgcttgaaccgaggagatagaggctgcagtgagccgagatcttgccactgtactctagcctgggtgacagagcaggacacagtctctaaaaaacaaaacaaaacaaaacaaattcaaaggataactctggttggctagctggggtcatgtgaccatcctcaacccaagcattgtgctaaggaggatgggctattttgattgtcacctaggtctgagatagtgactgacagccccactgggtactgggggacacttttccaatttgctgggcacgtaatggtttcttagggctgccacaacaaatcccaacttacttggtggctaaaagcaacagaaatctcttatctcacagctctggggggtaggagttctacgtcaatgtattagggggactatattccctctgatgcctctagggaatgatccttccttgcctcttgcagcttctgtggccccaggaaatccttggagttccttggactgtagctgcgtcactccaatctctgcctccatcttcacaggatggccccttctgtgtttctcctgtcatgtctgtgccttcttataattacatgtgttggggtgtgctcagagcagggggcccgaagaatgcctcctctgtttacaacacacccaataggaatctggggtcattgtgacaagggacacagagcttgtgacctccctacaaacaaatgccctacacattgaaaaaacaaaaaacgtgtcagaccaggtgcggtggctcaggcctgttatctcagcactttgggaggccaaggtgggagaactgcttgagcccaggagtttgagacaagcctgggcaatatagcaagaccccatctccaccacacacaaaaaaatatgttactggttttagggtccactcaattaatccataataatctcatctcaagatctttcacttaattgcatctacaaagacccgttttccaaataaagtcatattcacaggtatggggtgagggttgggacttggatttatctctttgggggccacattccaccccctgtagggcagaaataaatagccactgcactccaccccttgactgcctggcatccatccatggccttttccacataaacaattccagaaatgcaacaccccagtgtggtacaggctgcccacatccaagcaaagctggccgatgtacattcttctcagtcaggccttgatgatactctttttttttttttttttttttgagatagaatttccctctgtcacccaggctgaagtgcagtggcacaagtatggctcactacagcctcaacctcccaatctcaagccatcctcccacctcagcctcccaagtagctagaaccacaggcatgtgccaccatgcctgggtattttttaaatattttgtagagacaggatcttgctgtgttgcccaggctggtcttgaactcctggcctcaagcagtcctgcctcacccttccaaagtgctgggattacaggcgtaagccaccatgccaggaccttagtccattttctgataactctgtgagctgccaactggagctagaaactcaagtcaagtcatgctgtagaatctggaccttgtcctcgctgcacctgccccctctacaccccgttctccctgagtcttccttcagactgcagccttctggcctctgccccaacacactgggcctgggccagagggatgaggccgggctgtctggcccttgccttcaggctgtttgcggtttggccaggcagggaacgccgggcagaagtggctggcagggagccaggggaaactgcttcttccggtttctgtcccctctcacactgtgtcgtccttctcccagcctttacctgtgctcctagcctggggcagggaatctgacttttgcaatcctgaaatatgattttctggttctcagctcagctgaattacttgccccaggcagaaagagaaactcatggctttcttttctccttccctgctttcagaaaggtcaactgggactaaagtgcatctttttctcaccgagcttactgaaggctgaagaaggggcagcacaccccaggcacctggctttttttttttttttttaacaagtcctaccaatttccagcctcattgagcatgtggtctgactcactgggctcaacaggagaggctttggctaccttgcaccacttgagaggtgttgctcaccccgagtcaggaagggagaccccaccttacacccacctcaacacagcaaattccagatattagggtctgtcatttgcaaaaccctgctcctggtacagaattctgagttacttaggacacttgattgcaattgatgttaagaaagatccaggccggtacggtggctcacacctataatcccagcactttgggaggctgaggcaggtggactgcttgagccgaggagttcaagaccagcctgggcaacatggagaaaccccatctctacaaaaaaaaaaaaaaaaaacccacaagaatattagccgggcatgggggtggtggcatgtgcctgtagtcttagctattggagaggctgaagtgggaggatcacttgagcgcaggcatggaggtcacaatgagccatgatcacaccactgcactcccacctgtgtgacagagcgagactctgtctcaaaccaaaaaaataaaataaaacaaaaaataaaagaaagatccagaaaggggattgtattagcctatataactgggaagcaggaaaggctggatccagatacctaaatgacaggataaggactttgtttctcaccccccctttgtcccctgttactctccagcccttctctctgcttgtctttctactggttttaatgggatttcaggctgattttcatggagctctaggctcacagtgcatttatgtctagcaatcctcttagattctgagttgttccaacagaagacacaggaagggctctgaatggactcgcttgggacctctgctcaccccctgtattaaataaccaccgaggccagatgagtggaaataccctggttagttggcctgagtcacatggcactattgatgggacaggtaaggccccatgattggcagcccttctgggttgggggaaagacagtttctgaaagaaaaaaaatgctagggagacaaaatcaaatgttaaggggctgggctctcagcacattcttggtttgcattctccagtgggtcagaagcctgacaatccgcctagcctctgctttgagcgtcaggggacccagttctattcctgcatccttagccatcatctacacactttttatcttttcttttaaatttttaaaaattgtgaaatctatatacatataagccatatgttcaacttaaagaatagtaaacaactgtgtccctaggatccaagttaagaaatagatcagagtcagtttcttagaagcttctatatgtgcttctccccagtcatgtgctctcctgtctctacctgagggaaattacagatttcatgcttttctttatagttttcctttacacacatacccttaagcctctaagtactatatggttcggttttgcaaagcccagaagcctattttaatgctgtatataagaatatgctagccgggtatggtgactcatacctgtaatcccagcactttcagaggctgtggcaggagggttgctgaagcctaggaattcaagaccagcctgggcaatatagggagaccccttcactacaaaattaaaaattaaaaaaaaaaaaagaatgtactatattgctgtgacttttattcaacatgatgttttttgttttttgttttttttttctgagacggagtttcactcttgttgcccaggctggagtgcaatggcgcaatctcggctcaccacaacctctgccttccgggttcaagcgattctcctgcctcagcctccctagtagctgggattacagacatgtgccaccacgcctggctaattttgtatttttagtagagatgggagtttctccatattggtcaggctagtcttgaactcccgacctcaggtgatccacccgccttggcctcccaaagtgctgggattacaggcatgagctaccgtgcccagcctcaacatgatgtttttgagcttcgtttgtgttgatgcaggtagctgtagtttatttttcaccactgcatagtgttacattgtatgattttcccacattgcatgtactgtttagagtgtataactaagaatggattgctaggtttaaaggtgcttccactctatgggataatgctaatttttttccctaaagtggtttataacaatcaacccttgcactacaagtcagtaatggtgtttcagttgacttcattcttgtcgattttaatttttgtcaaccccacaagtgtggcctgtgtctcattatagttataatttgcatgtatttaattactcttgaagtgaagaatcttttcttttctttttttttttttttagacagagtcttgctctgtcaggaggctggagtgcagtggcatgatctcagcaaccagcaacctgcaacctccgcctcctgggttcaagccattctcctgcctcagcctcccgagtagctgggactacaggcacaagccgccatgcccagctaatttttgtatttttagtagagacagggtttcaccatatgggccaggatggtctcgatctcttgaccttgtgatccgccctccttggcctcccaaattgctgggattacaggtgtgagccaccacacctggccaagaatcttttcttatttatttatttttatttgagacaaggtcttattctgtcacccaggctggagtgcagtcgtgcagtcacagctcacacagcctcaacctcctaggctcaagcgatcttaccacctcagcctcccaagtagttgggaccacagatgtgcaccaccacacccagctaacagtgcataatcttttcatagttataaaccaactgttttttctgtactgtaaatgcctgtttatatctttctccccatttttttaatgaaggggtggtctttttcttattgattaatgagagttctttatatattctggatggtaattattccatatcagttttatgtttttttctttttgtgacagggtctcgctttgttgctcaggctggagtgcaggggcaagaacatgacttactgcagcctcaacctccccggctcaagcaagcctcctgcctctcaccctcccaagtagctgggattacagccacgtactaccacgcccggctaagtttggtatttttagtagagacgaggttttaccatgttggccaggctggtctggaactcctggcctcaagtgatcttcctgtcttggccttccaaaatgctaggattatagacacggaatatcatgcctcagtgttatatgcttgtatatctacttgcagtttgggaatgcttttgcattttatttatggtgacttttggacagaagttcttaattttgatgtcaaatttatcttctctaggaaacctttcccaacttgagatattctcttttttttttgtctttttatgggcaattttattccatttacattcattgtcattactgatatagttggttataagcctaacgtcttttttttttcttatacttcaagttgtagggtacatgtgcacaacgtgcaggtttgttacatatgtatacatgtgccatgttggtgtgctgcacccattaactcgtcatttgcattaggtatatctcctatgctatccctcccctcttcccccaccccaccacaggccccggtgtgtgatgttccccttcctgtgtccaccaacttgagatattctttcctgttataaaagtttctaatttcatccttcatatttcgtacttcatatttaagtatttgatctacctggatttgatttttgttactgataattagcttccagttttacttttatttatttattttcagacggagtttcgctcttgttgcccaggctggagtgcaatggcacaatctcagctcactgcaacctctgcctgggttcaagtaattctcttgcatcagcctcccaagtagctgggattacaagagtgtgccaccacacccagctaattttgtatttttagtagagacagggtttctccatgttcgtcaggctgatcttaaactcctgacctcaggtgatctgcccaccttggcctcccaaagtgttgggatttcaggcgtgcgccactgtacctggccccaattttacttttgtacccacttgtctgcaattactctgtgtcagaaatcaagtttccagacatggctatgggttttattttgtcttgttttccctgagctctcaaatttcctgtgttgaacttcatttttttccaaaattcattgtagaccaatatttttgtaagtacaataaatattaattactatgggcagggtgtggtacctcactcctataattccagcacattggaaagtaaaggtgggaggatcacttgagcctaggagttcaagaccaggcagggcaacatagtgagatcccatctctaccaaaaaataaaacaattagcttagcatggtggtgcatgcctgtagtccaagatacttgggagacccataactttttctttttttttttttttcttgagacacagtcttgctctgtcacccaggctggagtgcagtggcacgatcttggctcaccgcaacctccacctcctgagttcaaacgattctcctgcctcagcctctcaagtagctgggattacaggcgcccgccactgcgcccggctaatttttgtgttttagtagaaatggggttttgccatgttgtccagggtggtctcgaactcctgacctcaggtaatctgccagcctcggcctcccaaagtgctgggattacaggcgtgagccactgcgcccagccagaactttttcatcttcccaaactgcaactcctcagtcatccctcccttcccccagcccctggcaactaccattttactttccatctttatgaatttgaccattccaggtccctcatatcagtggaatcatataatattagtccttttgtgtctagtttcttttacttataatgtctttcatgtctccaaggtacacccatgttatggcatatatcagaatttcattcttttttggctgggcgcggtagctcacgcctgtaatcccagcactttggaaggctgaggtgggcggatcactggaggtcaggagtttgagaccagcctggccaacatggtgaaacccctgtctctactaaaaatacaaaaattagccgggcgtggtagcaggcgtctgtaatctcagctacttggggggctgaggcaggagaattgcttgaacccgggaggtggaggttgcagtgagccgagatcttgccactgcactccagcctgggtgacaacagcaagactccgtctcaacaacaacaacaacaacaacaaagaatttcattctttttaaaggctgaataatattccattgtctgtatataccaaatttgtttatctattcatccatcagtggacattggcttccaccttttggctattgtggataatactgctatgaatattggtatacaaatatctgttcgaatctctgcttcccattcttttgggtatataccagaagtggaattactggattacatggtagttcaatgtttaatttttaaaaattatatatattttttctagagatggggtcttactatgtttcctaggatagtcttatactcctggcctcaagcaattctcccgtctcaatctcccaaagtgctgggattacaggcatgagccaccgcctgtagcccaatgttaattttctgaggaacagccatactgttttcacagagggctacaccattttaccatcacaccagcaatgtacaagggttccagttactccgtgtcctcaccgatacttcttttctaattttgcttttgtctttgataatagccatcctaatgtatgtcaagtggtatctcactgtggttttgatttgcagttctgtaatgaggttgagtatcttttcatgtgctcagtggccatttgtatagcttctttggagaaagggccattcgagtcctttgcccatttaattggactattcatttgttttttgagttgagttgtgggagccctttcactccatcttaattaccatagttttctgtgtcttaatatctggtagaggacaagcccccaaccccaacacacacctgtctgttgctcttgtttaaaagcgatttgttattttttggcccttgacccttccctgtaagttttggaatcagcgtgttcagttcctttttaaaaacctgttaggattttgattggaattgcctagaatatacaatttagggagaacagatatatttacaacattgcgtctttctgtcgtgaacatgctgtctctccatttattagttcttctttaatgtctttaagtaaagttttaccatattttccataaacgatttcacatattttgttagatttattcctgggtaattgatatttattcatgctattatagatggtatcattcaaaattacatttctttttttttttttctgggatagagtctccatctgtcacccaggctggagtgcagtggcaccctctcagctcactgcaaccttggcttcccaggttcaagcgattctcttgcctcagcctcccgagtagctgggactacaggcctgtgccatcacgttcggctaatttttgtatttttagtagagacagggtttcgccatgttgcccaggctgctctcaagctcctgacctcagatgatccacctgccttggccacccaaagtgctgggattacaggcatgagccaccgtgcccggcctcacaattacatttctaactgttactggtgtatagaagtgcagttgacttttacatattgattttatatacagaaaccttcctgaactcacttactaattttaataatttatttgtagataatgttgggttttccacgcaatcataatatctgcacgttttttcttccttcccaagcctttacacatttttttctttttctttttgtgacaggatctcactctgtagcccaggctggagtgcattggtgtgatctctgctcattgcaacctccccctcccaggctcaagcaatcctcccactagcctcccgaagtagctgggactacagccgcacaccaccatgcccagctaattttttaattttttgtagagacagggtttctctatattttctaggctggtcttgagaactcctgagatcaagcaatcctcctgcctcatcctcccaaagtgctgggattacaggcatgagtcactgtgccctgctgccttacacatttttatttgctttcttattcttgttctactacacaggctggtataatatgatggtattgggagttcttaggccttgctcctgatcttcacggggatgctttcaacattcaccattaagtatggtataggcaggccaggcacggtggctcacgcctataatcccagaactttgggaggccaaagcgggcggatcacctgaggtctggagtttgaggccagcctggccaatatggtgaaaccccgtctctactaaaaatacaaaaattagccaggcatggtggcgcatgcctataatcccagctactcgggaggctgaggcaggagaatcacttgaacctgggaggcagaggttgcagcgagccgagatcgagccactgcactctagcctgggcaacaagagtgaaactctgcctcattaaaaaaaaaaaaaaaaaaaaacaagtatggtataggcttttgctgtttttgtttttaaccttgctagatgttctttatcaacttctagttcaaattagttgagtttttattattgacagacattaaatgctactaattttttttctgcatttattgagatagtatctttttgcctttaacatggtaatatgatgaattacatgaatcacttttgtaatagtaaaccaatcttggattcttggggtaattccaacttggctaggatacattagcttttttttttttttttttttttttttgagatagagtctggctctgtcgcccaggctggagtgcagtgctgcaatctcggctcactgcaggctccgcctcccaggttcacgccattctcctgcctcagcctcccgagtagctgggactacaggggcccgccactatgcccggctaatttttgtatttttagtagagacggggtttcatcatgttagccaggttggtctcgatttcctgacctcgtgatccacctgcctcggcctcccaaagtgctgggattacaggcttgagccaccgagcccggccacattagcattttttatactacaggggtaaaagaaaaggtgtgatacctttccttcccatcaaagccaatactcctaaaacaaaagacaagttaacaagagaaaagcataacagattttcttaatgaaagttttatgtgacacgagagcctttagaaattcagacccaggccaggcgctatggctcacacctgtaaccccagcactttgggaggccaaggcaggcagatcacttgaggtcaggagttcaagaccagcctggccaacatggtgaaaaccccttgtctactaaaaatacaaaaattaaccaggcatggtggtaggagcctgtaatcccagccactcgggagtctgaggcaggagaattgcttgaatctgggaggaagcggttgcagtgagctgagacataccactgccctatagcctgggtgacagagcaagactctgtctcaaaaaaaaaggcacggtggctcgcgcctgtaatcccagcactttgggaggctgaggcaggtggattacctgaagtcaggagtttgagaccagcctggccaacatggagaaactccatctctaactaaaaatacaaaattagtcaggcgtggtggtacatgcctgtaatcccagctactggggaggctgaggcaggagaattgcttgaacccgggaggtggaggttgcggtgagccgatattgtgccattacactctagcctgggcaacaaaagcgaaactttgtctcaaaaaaaaaaaatgcagacccccaagcctcagggaaaactctatttttatgcttaggttcgctgaaaaatggccagctgtgtagaaatatggttggacagaagagagtgatctaatgctcatagagtgatgggaggcaaaggcccagcagaacgtgtctgttcaggtttttttttttttttcccgtagagacatggtctccctatgttgtccaggctggtctccaactcctggcctcaaggggtcctcccaccccaggttcccaaattgctaggattacaggcatgagctaccatgcccagccctgttcagattcttcttggtctctctgtgtctcgttcttttacctggagtgtagaatgtgacctcttttggaataagggtcttatggcctactatcagaaaaggtagagaatttcttttcttttttttttttgagacggagtctttctctgttgccaggctggaatgcagaggtgtgatctctgctcactgcaacctccaccttccaggttcaagcgattaccctgcctcagcctcctgagtggctgggactacaggcgtgcgccaccacgcctggctaatttttttttttttttttgtattttagtacagacggggtttcaccatgttggccaggatggtcttgatctcctgacctcatgatccgcccgccttagcctcccaaagtgctgggatcataggcgtgagacaccgtacttggcctgagaatttctctatggctagctcttacacagaaaggcaagggaaggttagagtaatatttctaggttttatggctggctttgagagagagggtttctagtttctatcacctgccttagggaagaggaattctagtttctatggcctgccttgggagagaggggagcaggagagatggagacaggaaaaggtcagtaacatcttgcttctgagccccccaatgtccttcagttcaaactactcagcatgacaaagcaccaaactttgggatatcattttctgagccccaaaaagacactgcgtgattcagtttgctaatactctgtttagagtttttatatctatactcattagttacattgacctgacactttcctctttggtcctgcctttgtcttctggtcctgagggtttttgttgatccagataaatgttctgggcactaaggtagtgtcccctgcctatctagaccatggggtatcagaccattctcacactgctataaagaaatacgcagctgggcgcggtggctcacacctgtaatcccagcactttgggaggtgaaggtgggtggatcacctgaggtcgggagttcgaaaccagcctgaccaacatggagaaaccccatctctactaaaactacaaaattagccgggtgtggtggctcatgcctgtaatcccagctactcaggaagctgaagcaggagaatcgcttgaacccaggaggcggaggttgcggtgggccaagattgcgccattgcactccagcctgggcaacaagagtgaaattttgtctagaaaaaagaaaaagaaaaaaagaaatattcgagactgggtaacttataaaggaaagaggtctaatccccagttccacatggctggggaggcctcaggaaacttaaattcattgcagaaggcaaaggagatttaagcacctccacaaggtggcaggagagagtgagcaagagggaggggggaaatgtcacaattttaagccatcaaatctcgtgagaattcactcactgtcatgagaacagggaaactacccccatggcccagtcatctcacacatggtcccttcctcatcatgaggatgatgatgattacaatttgagatgagatttggatggggacacagagccagaccatatcagatggggcatgaatctaagttatattggccttcgagaccatgagctcaatcaaaagtcagctcctgagcaggagctcaacaaacttttaggtaaagaaccagatattttaaatattttaggcttccacgacacatgcatctctgtttctattagtcattgttctccagagaaacagaaccaataggagatacagatatagacaaacagatttagtataaagaattggctcacaggattatggaggctgaaaagttccactatctgccatctgcaagctggagataaggactaaattccagtctgagtccaaaggcctgaggaccaggagcactgatggggcaaatcccagtacagggacaggaaaaggcccagctcagtcagccaggcagagagcaaatgctcccttcctcctcctccttgttctcttcgagtcctccgtagactgcatgatgaccactgccattggtaaggatgggatcctccttactcagtctactgattcaaatgctaatttcaccccaaaacaccctcacagatgtacccagaaataaccagaccgggcgtgttggctcatacctgtaatcccagcactttgggaagccaaggcaggtggatcacttgaggtcaggagtttgaaacctgcctggccaacatggtgaaaccccgtctctactaaaaatacaaaaatgagctggatgtggtggcttgtgcctataatcccagctacttgggaggctgaggcagtagaatagcttgaactcgggaggcagaggttgcagtgcgccgagatcgtgccactgcactccagcctgggcaacagagttgaggctttgtctcaaaaaaaatgaagtttaaccaaatgtctgtgcaccctgtgatacaatcaaggtgacacataaaattgaccatcacactgtaaaccaaaaagtacctgagacagttctcaatcaatttagaagtttattttgccaaggttaaggacaagcccaggagatgggtctgtgcctttctccaaagatgattttgaggacttcaggatttaaaaggggagaaagcaggatggagggggaagagggaggctgtggtcacatgactgaatccccatgttgcaagagaaagggagcaggtaggggaatagtaagtcagcactctctgtaagataaggtgaacatagagtaactacctgcagagatctttaaccttttatgtgtagctatctgcttaggaacaaaaggaaagacagattcttgcatgactcagctttcagcttcattttcttccttctggcagagtgaaccagggttcaagtttttgtttttccttcacaatactgttgtttctcctcttccctttcctcctcctccttcttctccttcttcacaactcctaaaaatgtaaaacctattcttagctcacaaaccttacaaaaaagtttgccagtttgatttaaactgtctcccaaaatctatgtctcaatgacatgttgttgtttcctacaatatagtgatgcttgagtgattatctaaagaaaataatttatgggtcgggtgcggtggctcaagcctgtaaccccagcactttgggaggctgaggctggcggatcacctgaagtcaggagttcaagagcagcctggccaacatggtgaaaccccatctctactaaaatacaaacattagccaggcatgatggcacatgcctgtaatcccagctactggagaggctgaggtgggagaatctcttgaacctgggaggcggaggttggagtgagcctagatcacgccattgcactccagcatggatgacagagtgagacccctttccaaaacaaacaaacaagaaaataatttatgaaagtcaagagcctgataaacagtcaccacccattcgtaatctgtgctgccacacctctagccagcagatctgccatcttttgaaatgagtatcaacctggacattcccaagtaaagtgcccacaacacctaggggttgtgattcaaacagcaatggttagactcaggctctctcttgctgccctctcctggctggtctattgttgaggatcagatgtgaatcctgtaggatttcatgagactcaggaaaccttcaggtctgattgctgacctgtagacttgtcaaaatttctaccagtggatagttcttaaggctggtcatgatggccgagtttgtctgttatttcttgtagggtgctccgactttcttgagtgtaagtgttatagaaaaagaatagttatcaggctgggcacagtggctcacacctataatcccagcactttgggaggctgaggcacgtggatcacttgaggccaggagttcaagaccagcctggccaacatggtgaatccctgtctctactaaaaatacaaaaattagctgggtgtggtagttccagctactcaggaggctaaggcaggagaatcggttgaacctgggaggcagaggttgcagtgagctgagattgcaccacttcactccagcctgggtgacaaagcgagacgccatctaaaaaaaaaaaaagaaaaggaaaaaaaggagttatcgtatattgaacatttactatgtgccaaacactgctaaacaaatattattccatttcatccttagaacgatcacatgagatccatatcccttgactgttcagcattaccttcacacaggtgatacaatggatactcagagaggttaatttttttttttttttttgaagcggagtctcactctgtcgccaggctggagtgcaatggcgcaattttggctcactgcaacctccgcctcctgggttcaagtgattatcctgcctcagcctcaccagtagctgggattacaggcatgcaccactgcacccagctaactttgtaattttagtagagatgggctttcaccacgttggtcaggctggtcttgaactcccgacctcaggtgattcgcccgcctcagcctcccaaagtacggggattacaggcgtgagtcactgcgcccggcctttttttttttttcagacagagtcttgctctgtcgcctaggctggagtgcagtggcgtgatctcggcccactgcaacctctgcctcccaggttcaagcgattctcctgcctcagcctcttcagtagctgggactagaggtacgtagcatcacgtctggctaatttttgtattcttagtagagacgaggtttcatcatgttgaccaggcaggtcttgaactcctgacctcaggtgatccatctgcctctgcctcccaaagtgctgggattacaggcgtgagccatcgtgcccggccagagaggttaattaacctgctcaaggatcacaggtggtagagctggagcttggcattcagtctatatttatctgactctagaacttgtggtctgaattgctacccaaggtttacaatcatttatgcagagtctaattcagtaggaatagtgtggtgccagaaatttgcatttttgacaagcactccagggtcctggagagctacactttgagaacacttcctgtcacaaatagaaactgcacggcttccattagaaagatgaaactctttagtaacagaagacttattctggggtggaccaaatgctgggctttccctccttctttgagtagaagaggaagttagaagagggtaataagatgcaaagatttcttatctcttcctgtccctcaggcctccctgcccccacctaagccccagaaaagtgcacctcaaatgaatttgcctgaagaggtataacattgccctttgctgacaaacccctgagcaaacatgtactggttatttggtaacactcaaaagtctaatcgtagctggccacggtggcttatgcctgtaatcccagcactttgggttgggaggctgaggtgggcagatcacctgaagtcaggagttcgagaccagtctgggcaacatggtgacaccccatctctactaaacacacacacacacacacaacacaccatctctactaaacacacacacacacacacacacacacacacacacacacacactagccggcgtggtggtgcatgcctgtagtcccaactactcaggaggctgatgcaggagaatcacttgaaatggaaaggcggaagttgcagtgagccgagatcgtgctactgcactccagcctgggtgacacagcgagactccctctcaaaaaaaaaaaaaaaaaaaaggatctaatggcagttttggcagttctttttttgttttgttttgtttttgtttttgttttttttgagacggagtcttgctctgtcgcccaggctggagtgcagtggcgcaatctcggctcactgcaagctctgcctcccgggttcatgccattctcctgcctcagcctcccaagtagctgggactacaggcgccctccaccacgcccggctaattttttgtatttttagtagagacggggtttcaatgtgttagccaggatggtcttcatctcctgacctcgtgatctgcccgcctctgcctcccaaagtgctgggattacaggcatgagccaccgcgcctggcagcagttctgaggaacagtttgctcaggctgtcagatctggaagtgttcgtggcttgctgagcagagacaagaggacaaagccttaggtgtaatctaaatacaacggatttgcaatgaaacaagtggcctggtctccaaccgtttctccacacgctctgcctttctgacagcaaatctatgtttggcaaggaatgggatggagacttcttcccacctggtggccaatgttttcttgaacctctatatcacccttcagctcctgggtggggttgatggtcatccacagagaatggggggacaatatacctgtgagggcccagccactggtcagtgttcagcagaggagaaatacagtagagaaagagcaagactatgccagacattgtgctgggtatttgactaacatgatttaatcttccaataacccagagaagtgtagggattccatcttcatttgccacatgaaaaaacggagacacaaatatgcaaagtaacttgcccaagatcatccacgtaataagtagagtcaattattaaacctaaaggccttgtcctttccatccagctctgtgccaccgcgaagggccaccgctctctgcattagttcctctgtgtaagatctcctcttccaatccaaacaggctccactcacaagccttggaaaaacgccaccagcccttgggtccaagaataacataaatgcaatgagccattttctgaaaatgagatgacatatgtcaagcattcagcccagagcctggtacttttcagactgctcagccggggtgggagggtccctgggacagggtgtttctggtttcaggagattctactggccgtttggtaacaaacatttatcaggtaactatataaatggtcaaaacaggaagagcagggctgggcacagtggctcccaggactttgggaggctgaggcaggtggatcaccttaggtcaggagtttgagaccggcctgaccaatatggtgaaaccttgtctctactaaagatacagaaattagctgggcatggtggagggtgcctgtagtcccagctactaaggaggctgagacaagagaattgcttgaacctgggaggcagaggttgcagtgagctgagatgacactactgcactccagccttagcaacagagcaagactgcgtatcacaaaaaaaggagtcatgggagtcatcctgattggaccagcttagatctcaggaatccatccctgcctgccagggggatggaatgagctgactggcttagcttaagtggcatgctctgtccttggaagcacatggaccctcaaatgaaaattgggagctctcgtgggaagtggggtttgtcagggagacagccacaaagatcacaacaggaaagttgcttttgtgaaataaaaaggcaggaaggcacaagcagtatatgattgtagcccacagatttgtttggctagagcagagcattctttgttcttgaaagtgagttgtgagaaatggagcatttgggagggagttgggggtgctggaaggggccttgtggggagcctgcggggcctcaggctttgtgtgagtctgggagttttagtgcagcatttaccggattactagcaaattcaggaaatgagcctgtttcctcctattatagagcctaatcctttattcattaaatggagtatttactcagccttaaaatgttcagcgtggggggttagaaaagaagggagcccacagctgctgagagcccactgtgtgctgacactaggctggaggcttctcctacgttttctcttttaatgctcccaacctccctctctgccccatttcacagatggagaaggaaaggcaagtgacttgtccagagccactctgtcaaaaggggacttgagtcctcagggctgttgactccaaagctgacaagcaggtaaccacattggggttttctccaggacatgagaattcctttgtcctgtgtatcacatcgagcacctgggctgatgacccttctgcatggtgtacccacctcacagcctgagcttatcctcagctacatccactatgcccagagacactgatgaatgcatctgggagtctggagggaggggtccacttgtgagttgaggccccatttgtacccgctccaccaggactgaggacaggaagtcacgcctaggagaaccaagacggggttgacaccaatggtacccacagagcatccttgtcccaactgtcaccaccatccccctcctcctcctcacacctgcatctccagcagttattgagcgcttgcaacatacccggtgctctctcagcactttacatacatcatctcctggaactatcccaaagcttttttgaagcaggtgccattatcctccccattttgtagatgggaaagctaagaaatgaccatggaggccgaggtcacagcaaggggcttgtccctgtaaggtctatacactcatccccatttccttttccctctttaattttcttttttatttttggagacaggctctcaccctgttgcccaggctggagtgcggtgacgtgatcatggctcacagcagccttgacctctgaggctgaagcaatcctcccgcatcagtctcccgagtagctgggaccacagctaccatgcctagctaatttttgtatatttttgtagagacagggtctcaccatgttgctcaggcttgtctcaaactcctgagctcaagccatccaccctcctcagcctcccaaagtgctggaattaaggcgtgtaccaccatgcctggcccatgccccattttaaaaatgagtaaatttaaccttcgagaggttgcccactaatctcacatggctggcaagtggctgagttgggatctgaactcaagttctgtctgactaccatggatgggctgagcactgctgtgaaggataattgttgagttaaagaaaacctttggagaagtgatttggccttgtggatctttccctgagcacaatttccagcatgttcctgagaaagcttaggatcctctttgttggaataagcgcaggtccttcctcggggcatctatgcccactaacgtcacagtcatcctccactcccactttttcccctttcccgaaaacatctcatatggggctccgagcaagccctgggaggagctgcttcctgggtgactgtgtcccccggaggaatgtacacctgcagcaagacgagtgggacatttttgaagcctcaggccacacacattgtccccaagacaaggctgatgcggctagtaagcctcttgtttttgaaggtcacaaacaacaaaaacatggaaactcagaatggaagggggcccatgagagcaatcttgaggcataacaacagctgcagaaggtgactgcagggaagcggactgtgctcctattctttatgttctgtttttagctgtgtttttcagagcaagtaggtaccatggtgataggtaccatagaaatagatggagcgcaccacccagcacggggctgccaagctgttcccctggaaatgcaccgagagctgccagggagagcccagggactctgcttcctggggcctgtcagctgcacggccagggaagaagtcccctgtagaatggtccccagaggcttctcactgtcttgctgtcattgtccaaggtccctgatggtgcatcctcctcctggagcacctgtggccttcctctctgagtcctcaggaaactcacttaagggggtttgcctttgcctagtgaagcaattatcttggccaacagtgacctcaaaagtagcactgccagcattcctgtctccatagttaggagtgcgtggtcctcatcctgcctggatgtggcactgtcactggttttatgcaatgtcataaagaatttgtggggcaggagctgagttctgaacatttggtaatcaggaatactcataaaatgaaatttcagaggatctaacccagaaagccgagcaaggtagggcataaccacgtctgatatggtggttttcagtttgtgaagccacaggcagtacagaatagggcccagcctcaactatttttggatgcagcttgaatggactgaaagaccctttgaaacaagtgctggaaccatcccgtagcacttacataaccatctctgcaaggctgttgatagatgaatgtaaatgaacctaggcagagcttagctcatttttatttagatttagaccaatttcatgtcttctgaaacgtaacccatatatacacacactaaatctaactcttttattttaggcctagcatgagaggatcaagttgaaagggcatctgttattatatctgtcccatcatatctgcttctgtgatggctttattatgtacatttctttctatacatttgtgctctcaggtggcattcttcttcagagcagggcaagtgtaattctggaccaatgtgtgattctgagaccagaccaaccaactgaaggtaattttattctcaattaaagaaacacagacggggcgcagtggcgcacgtgagcctgtagtcccagcactttgggaggctgaggcaggtggatcacttaaggtcaggagttcaagaccagcctggccaacatagtgaaaccccatttctactaaaaatacaaaaattagccaggtgcagtggcacgcacctgtaatcccagctacttgggagggtgaggcaggagaatcgcttgaactaagtaggtggaggttacagtgagccaagattgcaccgctgcactccagcctggatggcagagtaaatctctgtctcaaaaaagaaagatacacacatctctaacaaaggattttttttttttcttgagacaggatctctctccatcacccaggctggagtgcagtggctccatctcggctcactgcaacctccacccccaaggctcaagcgatattcctacctcagcctcccaagtagctgggaccacaggtgtgtaccaccatgcctggctatttttttgtatttttagtaaagacagggtctcaccattttgctcaggctggtctcgaactcctgagctcaagcgatccacccaccttggcctctcaaagtgctgggattataggcatgagccactgtgcctggctaggaatttattttaacaaccaaaaacttaaaactcaataacatcattaactcataaattattgtttagttacagattacgaaaatgatagaaccagaaggtgctaacaaaatgtctgtcctgcatgtgtggcatttgacatgaagaaactgaggcccttgctgggcgcagtggctcatgcctgtaaccccagcactttgggaggccaaggcaggaggatcacttgagctcaagagttcaagaccagccttggacaagatagtgaaaccttgtctctaccaaaaaaatacagaagttagccaggcatggtgcagtgtacctgtagtagcagctactgaggaagctgaggtaggaggatcgcttgatcccaggaggtcaaggctgcagtaagccgtgattgtgccactgcaccccagcctgggcgacagagtgagaccctgtctcaaaaaaagaaaagtaaaggctacgcgcggtggctcatacctgtaatttcagcactttgggaggccgaggcgggtggatcacctgaggtggggagtttgagatcagcctgaccaacatggagaaaccccgtctctactaaaaatacaaaattagccaggcgtggtggcgcatgcctgtaatcccagctactcgggaggctgaggcaggagaatcacttgaacccgtgcggcggaggttgctgtgagccgagatggtgccattgcaccccagcctgggcaacaagagcgaaactctatctcaaaaaaaaaaaaaagaaaagaaaagaaaagaaagaaactgaggcccaaagagtttgcatactttgctattagttcagcctgtcttctgtgtatgcaggtggtgtctctaggtcgttatcactctggcaaattctctcccagtgatggagatgtgtggagcccccagtctctccaaccagggagtggtgctcatggtgaccctgaagtaggcttgtgggtcaggccgttggttgagctgtgcagtgccagaagtagctaaacatccttaaaggaactgcctagtttatcattaggactaaccatggaaccgatgactcagcgtttactgttggcagtatcatacactcaacctgcatgtagatttcgtgcatcatattttgtggttacaggaatttggcctgatggacccgttgcagaaactctgtactaaataagcaaacacgtgtgctctagttttacaggccaagcaaactgtgaaacagaagggttggcctttcttgcccttagcagtcataccttggacttttgccacttggttgggttgctttatttggctaagtaactaaaagcagatttactttgaagaatgaggttctcaaatattctagaactctctaagaatggacattcacagtcatgctgggcagacagagttattcccaaattttcagagtcataaagcttatgtttgggctgggtgcggtggctcacacctgtaatcccagcactttgggtggccgaggcgggcgtatcacaaggtcaggagtttgagaccagcctggccaatatggtgaaaccctgcctctactaaaaatacaaaaattagccaggcatggtggtaggcaccggtagtcccagctactcaggaggctgtggcaggagaattgcttgaacccagtaggtggaagttgcagtgagtggagattgcgccgctgcactccagcctgggtgacagagtgagactccatctcaaaaaaaaaaaaaaaaaaaaaaaatccagtttggcctgtgtgaagcacccacacaaaaccttcctttcccaatattagcgccttcctgtggagctggaacaggggccccggggctagaatatttgatattcaagacacacactgagtctggtgtggtgcttttcagcaacacattgaaaaattgttgcttttcacaccaacaatttgaaactaaacatttaatgtgaatgtttctttttttttgagagaatgtctcactgtcccccaggctggagtgcagtggtgcaatcgtggctcacagcagtcttgacctcctgggctcaagcaatcctcctgcctcagcctcctgagtagctgggattacaggtgcacgccaccatgccagctaatttttttagtttttgttttttgtagagatgggggtctcgcactcctggactcaagggatcctaccgcctcagcgtcccaaagtgctgagattccaggcatgagccaccacacctggccttaatccgaatgttttttaacaatcacaacttgatttttaacattttaatttaaaatttttattatggttaaaaatatacaacatacagtttaccattttaatcatttttaagtgtacagttctgtggcattaagtacattcacattgttgtgcaaccatcaccactctccatttccagaactctcttcatcttcccaaactgaaactctctgcccattacacggtaactccccattccccaccccatctcctggacccagcctgtggtcaccaccattcagctttccatgtctgtccatctgtctgttgtgggtgtcttatagaaatggaatcatacaatatttgtcacttatgtctgacttatttcagtttgcataacgtgctcagggttcacccatgttgtagcatgcatcagaatttccttcctttttaaggctgaagaatattctactgtatgtatataccacattttgtttatccataatttttctatagtttcttatttctttgttgttgttgttttgtttttttgagacggagtctcgctctgtcgcccaggctggtgtgcagtggcgtgatctcggctcactgcaagctctgcctccggggttcacgccattctcctaactcagcctcccaagtagctgggactacaggcgcccaccaccacacccggctaatttttttttattatttagtagagacagggtttcaccatgctagccaggatggtctcgtctcgatctcctgacctcatgatccacctgccttggcctcccaaagtgctgggagtacaggcgtgagccaccatgcctggcctattttttttattttaaaataattgcaaagtgacaaaacatttcaagaatggtactaaagaaaatcttttttatatctcattattcatcttttttattttttcttttcttttcttttttttttttttgagatgcagtcttgctctgtcacccaggctggagtgcagtggtgcgatcttggctcactgcaacctccgcctcctgagttcaagagattctcctgtctcagcctcctgagtagctggaattacaggcgtgcgcctccacacctggctaatttttgtatttttagtagagacggggttttgccatgttggccagactggtcttgaactcctggcctcggcctcccaaagtgctgggattacaggcgtgagccaccccacccagcccttcttttttctttatagacagggtctcatgtcataagagaccctacccgccattccccaccacggagtcctaccttactcagctccaccttgtggctttaggactggattgtttagaaaggggaggagaagggaccaccatttgctttcattgaaaatatttgttttggccaggtgttgtggctcatgcctgtaatcccaacactttgggagtccaaggcaggaggatcgcttgagcccaggagttcagaaaatacagcctgggtagcatagtgagacccccatctttacaaaaaaataacagaaattagctgggcacagtggtgcatgcctgtggtggtcccaagctactcaggaggcttaggtgggaggatggcttgagcctgagaggttgtggctgcagtgagccatcattgcactacctgcactccagcctgatgacagagcaagaccctgtctcaagaaaaaaaataaagaaagaaaatacttgtttcattaacaattctttgcatgtggggagcccttgtatttaacctattaaataaacaaatcttaattatgactaccagcatttccccaatcttgtctctgctattataataccattttttaaataaaatgattatacagttaggatgccttcttccttgcagcaacacttattttgcaaatttgcagttgtatttaggctaccaccagcaactctcttggcaaacattgagcaactcctaccacaaaaattaatgagtagagagacaaggtctgcacacctactcattttgttcttccattatcaagttgtgggactctggggaagtgatccaggggacatctacagaaaccaaaaatggagttttgtaacactgtgagttgtttattcttgtaaataataggatcttcttgactggactggaagcttcaaggaagctgtgtcttctgtttttcgtgtgcatccttcgtggttctaaatatgatgctacatgaatataaggtgtttcctgtcgttgtgggctggtggagctgtgagggcttcagtgggataaactggaagaaggagcctgggttatgaagttcagtggatgcttcttgggttttctcttccttgacctccccggaccgtaaattcctccttgaaatacttgcttctgaatcacaaagtttctctcctgcctccctggccgccttttctcagctgcctttgtgtgagccacatgctctgcccatccctcctgacagtgagctttatttacttatttatttattatagacacagtctcgctctgtcgcccaggctggagtgcagtggcgaaatctcggctcactgcaacctctgcctccctggttcaagcgagtctcgtgcctcagcctccccagtaactgggattatagacatgcgccaccacacctggctaatttttgtatttttagtagagacagggtttcaccatgttggccaggctgatctcaaactcctgtcctcaagtgatccgcccacctcggcctctcaaagtgctgggattgcaggcgtgaggcaccgcacccggctgacagtgaacatttattgggcacctcccgtgtgccaggcactgttgatgctgcacatccagcagtgagtacaacagatggaaaggcttgtcttctctgaactgaaaggaaaagaggaaaaccccctcccttgggtgtgagcctgcttgcttgtttctgcgtcacgggaacaacctcagctgttccccatggtgtgatgagcactgcctgctcatgcaggccttgccgggcccatgaaggatgaaggcagcctctcccctgcaaggttctttcctatgtgaacccaaaagtatctaagacagagctcaatcaacttagaaagtttattttgccaaagttaaggatacagcgttaacatacagcctcaggcggtcctgaggacatgcacccaaggtggtcggggtacaggtttttattatttttgtttgtttgtttgttttttgagacagggtctcactctgtcacccaggctggagtgcagtggtgcgatctcgactcactgcagcctctgcctcccgggttcaagcagttctcctgcctcagcctcccaagtagctggaattacgggtgtgcaccactatgcccagctaatttttgtatatttagtaaagacaggattttgccatgttggccaggctggtcttgagctcctgacctcaggtgatctgcccaacttggcctcccaaagtgctgggattacaggcgtgaaccaccatgcctggccacagcttggttttatacattttagggagacctgagaaatcaatctatgtgtgagattgatcagcctttcactgaatacacaatttccatgtgagaggagggtagaggagtagtcacttatgccttagtctggctcagtgaatctacatttttacataaacaatagggcagaggaagcaatcagatatgcatttgtctcaggtgagcctcagagggatgactttgggttctgtctattctttgtcgggcacccatgaaaataagctgtcaatttacattgccagggtgaaattcaatagaactgttttagggtaaagatgttgaagcccacaaggaattcatcttttagcgatcttatttaggaacaaaatgagaggcaggcttgcgcagttcccagcttgacttttccctttggcttagtgattttggggtctcaagatttattttcctttcacacctgcgagagagactttctgatgctccttctctgccctgcgctcccatctcatctgccaactttgcgctttggctgccctgctgtccgtccccgacctgcagccctactagcttcctaaaaggcaagtttcacaaatcactcactgctcagtaccttctgtgatttcctgaggctccgggataaatccaaatttcttcacatgacaggtgggtccccatgagccagccgctgctttcctttccagacccagctcccgccacctcctgccttgtgtcaggctctgcagcacggacagctggtccccccagtacctccctgccttgctcctgctggcccctgggcctagagggccttctccctccccagcctgcttctagtctgacccctactctccttttagactcagccccttctcctccaccctgagtccacaggccccggagcgctaagcacatggtgttatagttaactatttacttttctatcttttcctggaagacagacacgatggtagatggtaattatgcgtttaatgtctgtctcctgggacggtaaacccctgtgagtgtgggctgtgactgtcttattcaccactgtgtttttggcacggggcccagagtaataaacatgggtaacacttccacagcgctaactgtgaaccggccagaagtgtcctgagagccttacatgagtttacaactttaacccttaccaccactcagtgaggtactgtgatattatgagatatgtatttggtcttcctctggtttcctggcatacaacttctaaaatccttggaatctccaaagagataaacgtgtttttataggctagagagttgactgatggccaggcgtggtggctttggccttgcacggcggctcactcctataatcctggcactttgagaggccaaggctgactgatcatttgagcccaggagtttaagaccagccccgtctctacaaaaagaaaaatttaaaaattagatgggcgtggtggtgctcacctgtagtcccagctactcaggggactgaggtgggaggattgcttgagcccaggaggtttgaggctgcagtgaattgtgattgtaccactgcactctagcctgggcaagagagcaagaccctgtttccaaaaaaaaaaaaaaaaggacagaaaagacaaaagagcagaaagcctctcttccatcagggccaccccaaggcacaactccagagggcgccattcacataaaatgtagtgcgacagccactcctgctcaggccccagtctcccactttcccctctgagggcaccactgataccaagctcttctccatccttccacagatgtctatgtggatgtgaacagaacatgggcatgtcggttaatagagaattctccaccttgccttgttaattttgcatcattgggagattatttcagataaggtgtgtagggtagcctcattctttttttttttttttgagatggagtctcgctctgttgcccagactggagtgcagtagcgtgatctcggctcactgcaacctccgcctcccaggttcaagtgattctcctgcctcagcctcccgggtagctgggattacaggcatgcaccaccacacctggctaatttttgtattttttgtagagatagggttttgtcatgttgcctaggctggtctcaaactgctggggtccagcgatcctcccaccttggcctcccgaagtgccgggattacagccatgagccactgtgcccggcctgtttctaaatcatttcttttacaaacagtgctgctgtgtactcagtcactgtttgagcacatctgtaggatacagtcctaggattggattgcttgggtaaacagagaaattactttctaaaggtggaatttcagaaatctgtgacaagcatacatgagatatttttacactgaagtttggggcttgtcagatctggctaggggttgactgtctgtggggctcctctctgatatatttgatgttagggaatgatgtttctgggtttgatagtttgttctctaaagagaaaagagagagctcagagcagaaaggtagctttttggattctagccagggctcactgattggatctcatctcacctcacttctagaggaagaccactccggaaaacaagatacctgggccatgcagcagtgggttccccagtgccctgatagaaagtctgagaagttcaggattcagtccctaaaagcatatgggctgaagaggctctggccctaaaatcaccttgttggggatagtgggaaggtccctgttatttttaaaatatactgaggatgtgattcctaacaccacaaaatgggtgggtgggtgaatggatgaatggctgggtgaatggatagatggatgaatgaatgggtgagtgggtggatggatggatggatggatggatggatgaatgggtggatggatggatggatgggtggatggatggatggatggatggatggatggatggatgaatgggtggatggatagatggatggatgggtggatagatggatggatgaatgaatgggtggatggatggatgggtggatggatggatggatggatggatgaatgaatgggtggatggatggatgggtgggtggatagatggatggatgaatgggtggatggatggatggatggatacatacatagattcatacatatagaaaggtaaatagtgatcaaacaaacatgaacttagacctgctttattattaggtaacttctttgagctcgttggacctcagtttctgtctgtaataggattaacaatgccttttttgtgtgtgggactatagtgacaaactaacagatgatgtacgtaaacgccctagcatggtcctggcacactgtgggtcaccatatatggtggtagttgctatcatttactgtgagtgggcattctctgattggtgtatattgaaggcattttttttttgactttgcaggagccaagttacaccctgtttaaccctgccttcaaagggacgactctgtaaggtaggggctctcagccttcttttcctcccagcatgcacggtgggtgacactggggtgcctggcacactcccagcatgcatttcacagggcaggatttctggcaacactcatttctctccaggccaggaaagcaacctagaaatcaacttacatttacattaaaacagtacataaataaaggaaagagaaggcaataaccctcagactttggtctcctggctaaaatgtatttgcaaaacagcacacagcttgcacctgctgccctctagggtaataatgagggtgggtggaggtacctgtggggtggcccattccagtgggtttgggcaaatgaggacggttatcagaggagtggctgctattccccacaaggttatggaaagcttctctctttggcctttgctgtgtgccaggcagaggtgctaggtcctctctgcagtgtgcagtgaccctggggaaccacagacattcaggaccctggctggtagctcagttgcttggctaaggtggtcaggcttgccaggcccaggcgttaggcaagcccaggcctgacctgccaaagcagctgctttaagcctcagaatcttcactgggcaatggaatcctacctcacctgactcctcccagcaccccctcccactagcctgcggggactaagtgttctctcccctgtgtccccacagcactttgttcccacagctattaaagtactcactgttggctctaagtacatctctcctccttccaaagcaatattctttttgttttgtttgctagagatttcatgtaatctcaaattctttgttaaaatggccctggggtttacattattttctatctaggagattagagttgaaaacataaattggtggtttggaattccactgagttcttctctttagatagaattgtggaaagtcaggcttgtccagaaccctcactatgggcactgtccttgaatcctgctctcattcattctgcagtcagctagtcatccaacaaacacttactgaactcccacctttgtgccactatgctaggcactgggtatatttggatgaaaaggaccttggctatgctttagagaccaacacaatgtggttatctagctctagattttgttgacatactaaaacctatctttttttttttttttttgagacaggtctcactctgttgcccaggctggagtgcagtggcgtgatcttgattcaccgcagccttgacctcctgggatcaagtggtccttccacctcaacctcccaagtagctaggactacaggcatgcaataccatgcctggctttttttttttttttttggtagacatgggtttttgccatgttgcctgggcatgtcttgaactcctggcctcaagcaatcctcctgcctcagcctctcaaagtgctgggattacaggcgtgagccaccacacctggctaaaacctctttttttaatagcataagtcaatttaggccaggtgtggtggctcacgcctgtaatcccagcactttgagaagccaaggtgggctgatcacttgaggccaagagtttgagaccagcctggtcaacaaggtgaaacctcgcctctactaaaaatacaaaaacaagccaggtgtcgtggcacatacctgtaatcccagatattcaggtggctgaggcatgagaatctcttgaagccaggaggcggaagttgcactgagctgagattgcgccactgtactccagcctgggagacagagtggcgagactctgcctcaagaaaaacaaacaaacaaaaaagaagtcaacttacaggattcctttctgagcacaatttcctagagatttgagaccacctctattttttaaaaatcatattttttagcttttaattgtgatttaaaaaacacattctacttttaaaaatctacaatatctatttactcaccaaagattgtataaggcactgtgcctagagtggggttaggggaaggacaaagaagaaaacacaaagtccctataccttctagaaacctaaatctaaataagggaagtcacatgtcgacagaaactcggcctcttatttcacttgcgattgcggtggtattcattcgtctgttcattcaactgtgtgtattttgggcacgtgctatgtgcataggctgtgatgggtgctctggagcctgtggaagaagtctcacatgtgtccctgccctcgaggccctagggagagaagggagttcagagtcaagtagaataataggccacggtgcctcctggccaaggagcccagcaccagccttttggagaagactctgcagctcccgaggaatggaaagctgttagggaagggaagggggacgttccaggccaagggaggggcacagggaagtttgcgttaggaatttctcatcagaaaaggagatgtgacgggggagaatggattccaaacaatgcccaccacaaggcaggcccaggaacagggccaggaaagggtaggatgtgatgtggtatgtgaagctatgtgaggctgaatctgctgccttcagggggccacactttctaatttgttccctttccttccctcacccagattctctgctacttattcaagttgacacgatgcccttcacactccacctgaggtcccgccttccctctgccataaggagtttgattctacaaaagaaaccaaacatcagaaatacatccagcatggctggaggtaagtggtgccagatagttaaaaaaaaaaaaaaaaaaaaaaaagaaagttcctgggaattaccagctgtgtagggcccacaaactcctaagacttctagattctgcataggaaacagaaagtaagagcagaatgatattagctctggtcactatttaactgctcagaagaaactggaaccttggattagactcaaggtatggaaacccatcagatgggtctaatgacacccagttctgcttggtcacctcagccccatatggagaaccaccagtgggctcaggtgatgaaaagggttgtcccttctgggaaaagtgcccccaggttacactgcagtttaaccagattttgattcagaccaattcttcctacccttgactggtcttattctctggtggcacccatttccctactgtctcctgggagtgatactgaaggctctaaaaggtcctgcaagagaaaacagataccaaatttgtcattgacctaagtccaagcaaaatttcacattaaaaaagactcgtctggttatggtataagtgcccaaggaaaaaccatcagcaccatctaaagtactagagcaagaccattttcctttagtttattaatatgtctggcctctgttgctctatatgggctaacagagttaactgttgtataacaaggcactcttttttgttgttgttgagacgtagtctcgctctgtcgcccaggctggagtgcagtgatgcgatctgggctcactgcaagctccgcctcccagatttgggttcatgccattctcctgcctcagcttcccagtagctgggactacaggcgcccgccaccatgcccagctaattttttgtatttttagtagagacggggtttcaccgtgttagccaggatggtctccatctcctgacctcgtgatccgctcaccttggcctcccaaagtgctggagttacaggtgtgagccaccgcaccaggcccaacaaagcactcttaaacttagtggcttaaaaccattaatctcacaattctgcaatcaaggttggtcttagcagggcgcttcttctgttccatgtggtgtctgttggggatagaccatccaagatggcttcttcctgacatgtctggcatccagtgggacatctgagactggctgaacatttcttctccatgaagcctcttcaatagtggtcgccaaacttctttacatgggacgccatgagacagattccaagagaataagtcctaatgcccaaacgcataccaagcttctgcttgcatcacacttactaatgtcccattggcgaaagcaaatcacagggccaaggccagagtcaatagggaaggggctacaatggggtgtgaatactggggagcatagtttatataaattggtgcaaaagtaattgcgatttttgccatttttttttttttttttttaaataaaagtaatggcaaaaactgcaattacttttgcactacctaatatatacagagagagccaccaaggtattagtctacagcaacctgttatatacgagcagcgaacaccagcttaaccccaggttgacgactgcttgctaggaccctgggaggcaacagagcagagcagccagggtcttggagcctggagggagacagcctgagtatgagtcccagcttcgctctttactagcaaactgtgacctttctaagcctcacctacacaatgaaagtagcagcagaaccttcccagtgggactgtcgggaggggcacctgagctgttccccgctgccgtgaaatgctcctcaaggagagaagctcattttaccaaacagctgggaaactccagcttggagctgtcttctgggggctttcaatcaaattagaaatgttaaagggtgttttttcctctctcttgtcattaagttaaaaaaaatgattttgaggtaaaaggactcagagaaatcactcagtttatctacaaagaaaagtgttactgccttccatggagcccaaggcagctgggggatgcacaaatcacattagaccataaagtatcctccaaaaaggtgaggcctccagagtccaccatcctctccagaaagagaccatgaaggcttctattctgtgtcctgttactaatggggacaacttggggacttttctgttcatctccagctgtggagatgaacaaaaccaaaacaaaacctgcaaagttcatttaattaaaaaggaaacaaagggccgggcacggtggcgcacgcctgtaatcccagcactttgagatgccaaggcaagtggatcacctgaggtcaggcattcaagaccagcccggccaacatggagaaatcccatctatactaaaaatataaaaattagctgagcatggtggtgtgcacctgtagtcccagttacttgggatgctgaggcaggagaagcacttgaacccagaaggcggaggttgcagtgagccgagatcgcaccattgcactccagcctgggcgacaagagcgaaactctgtctcaagaaaaaaaaaaaaaaaggaaacaaagaagctttgtgcacataccatcctgatttattgtattaaagatacaatttgtgctgggcatgacggctcacacctgtaatcccagcactttgggaggccgaggccagcggactgcctgaggtcaggagttcaagatcagtctgcccaacatggtgaaaccctgtctctactaaagatacaaaagaattagccaggtgtgggggcatgcgcctctaatcccagctactcgggaggctgaggcaggggaattgcttgaaccctggaggtggagcttgcagtgagccaagattgcgccactgcactccagcctgggcgacagagtgagactccgtctcaaaaaaaagaaaaaaaaaaatccagtttgttctcacaaggggctttggcagtaagaagcgggtgagtagggagtgggaggcctctaagccagccaaatcccctcccacctcgctccagataacttttggagccgtgctgggcttgcttgagactggcatcaggttccttgggctttcggcagctgggggtgtctcacgtgtcctcatttggaaagtctgcttgtagcattggcaggcactgtagcgactgtgataatgagctccgggccctgcgatttgagcaggagctggtcctggacattcccagcggatggttgcatctgtttcactccccagtccccatggaggacggcgctcccctcctagggaaacccagtgcctgcagcccagcagaggccactccgtgatgaaatgaggcaagctcgcgggcaccccttccaggtttaaatgctggctgtgccgtgcagcagctgtgtgaccctgggaaagtcatttcatctctctgagcctcgttcccctcatctataaaatataattacttgtgcaaatgacttggcatggggagcccggcacataaaaagcactcagtaaatattagcccacaagattattgtaggagagaaagggacatgggttgatagagcaaatctgacagggcaattgtcctcaagggtattctccaatagagcataataattattattttttgagacagattcttgctctgtcacccaggctggagtgcagtggcgcgatctcggctcactgcagcctccatctcccaggttcaagcgattctcctgtctcagcctcccaagtagctgggattacaggcacgtgccaccatgcctggctaatttttgtatttttagtagagatggggtttcaccatgttggccaggctggtctcgaactcctgacctcaagtgatctgccaacctcggcctcccaaagtgctgggattacaggtgtgagccaccacgcccggcccaatagaacataattatgtttttctttggtatggtcttaattttagaatattgagaaaagcacagagaagcaaatgacaagtatgcacagctctgtcacctggagacaaccgtgattaacttgtaatgtccttactggttctagtagatgttctttggtgtctgcacattcaagggttagatatttattgtagtctttgctatctgggcttatttgtagtcctctgttttgggaaggctttccagttatttgaaaggatttgggtgttgtgatctaagctgtttctgctttagggggcacctcaagcccagtaacgccgtcattcttgcagacttagtacaggtatgggtttgatggtcttggagaagatctaggagcattctctggtttaccaggcagagacccttgttctcttcccttactttctcccaaagagtctctctctctctctgtctctgtttggaaccacctaaagctgggggtggaatgacacaatcacccctgtagccaccaccactgtgactgtgctgggccagacctgaagccagcacagcactgggtcttgcccaagtcctgctgtaaccactccctggcaactgcctatgtttgctcaaggccatggggctctgcaattagctggtagcaaaaccagccaggcctgtgtccttccctgcagggtggtgagttcccccaggccctgggtgagtccagaagagccgtctgggagtcagggactacagccaaaaaccttagatgcctacctggtgttctgttgtattgtggctgagctggcactcaaattacaagacacagtcctttccactcttccctcccctttccttctagttctttcactcactgactttataaaaaggagaatatgtccaacacattgtttcattacctagtatagttcctttaatgacacataacaaacatcttttaacataaccgttacgtgtttcttctgtaaccgtaattttaaacatctacacaggatttcattgaacagtaactttagtccctgcttcctgaacaccgaggtgctcaataacttacatacattacctccctgaggtctcttggaggtaggtatggttgctgccatcttatagatggggaagctgaggctgagacatgcaaagccacagcctgggttcacacagctggtcagagacaggatcaggattcaagcccaggtgtgtttaccaccaaagccaaaggacttccattgcggaggaaggctggctgccccagaggaggctacagcatgtaataggaggtcttctcctgtagctctgtgaacactgtgagccagctcaggcaagaatctgccccccaaaaagatacccaaatggccaataggacatatgaaaaggcagtcagccacactagcagtctagacaatgcaaattagaaccacaaggtgatggataccactacccacccacaagaatggctaaaaggaaaaagacaggtaatatgaagtattggagatgctcacataccactggtgcaagtgtcaattggcacaaccactttggaaaactgcttggcagtatctattaaagttgcacatgtgtataacttaccaccccagaaatgcacatttatgtactccaaaatgcatgtttgtggcattaaaatgttcatggcagcaccatttgtcataaccccaaattggaaactactcagatgtccattagcaataggattgggtaaatcctcattgcatgaatatactaggcagcagtgagaatgaactattgttgaatgcaacaatatgaatgaatctcaaaatatattgagtgagagaagctagacttaaaagacacatagtgtatgattttattatatggagtctaagaacaggcaaaagtcgtatgtggtgctagaagtcaggatggttggctcttgttccttgatctggatgctggttacatgggtgcattcatttcatggcaattcatcaagctgtaggttcgtatgtttttgattgaagcattacctacacttttttgagtggggctctgcaattagcaggtagcaaaaccagccaggcctgtgtccttccctgcagggtggtgtacacttttttgagtgtaggtaatgcttcaatcaaaatttacattaggccagttgcggtggctcacgcctgtaagcccagcactttgggaggccaagacaggcagatcacttgagcccaggtgtttgagaccaacctggccaccatagtgaaaccccatccctactaaaaatacaaaaattagctgggcacagtgatgcacacctatagtcccagctacttgggaggctgaggcatgagaatcacttgaacccaggaggcacaggttgcagtgagccaagatcaagccagtgcactccagcctgggtgacaaagcgagactctgtctcaaaaaaaaaaaaattacattagaagttgggtatggtagtgtgcacctgtagttccagctacttggcaggctgaagccggagggtcacttgagtccaggaattcaaggccagcctggaatagcaagaccttgccactttaaaaaaatcacagaggggctgggcgcaatggctcatgcctgtaacccagcactttgggaggccgaggcgggtggatcacctgaggtcaggagttcaagaccagcctgtccaacatggaacagttggcccaacatgggccaataaatatcccatgtatatttttagtctctactaaaaatacaaacaattagctaggcgtggtggcagacgcctgtgatcccagctactcggggggctgaggcaggagaattgcttgaacccaggaggcggaggttgcagtgagccaagattgtgccattgcactccagcatgggctacaagagcgaaactccgcctcaaaaaaaaaaaaaagaaagaaaatcagtaagtgtctgccaagaaaccgctgactatacatttttcccttctcccaccatacccagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggtaaaaagcttgggttactgtgggttgaagcttgggagtgtccaggtgctgtagccaggtgtctctgtcatccgggacctctctgtccagcctcagggaccttcacagtgcctggcacagaacctcactcatgactgttgctcaggaacgagctgccctccccactgttctgactccttcccctatcacctggcgcctgtcctggctgagatctttgagatcatggagaaagtccagccctggagaaatcccactggctctgccatctgtccactccatcgcccaagccagaaacccgcctgtacaggattaagaagaaaataaaaaacacttgcattaccaacacccagagacagagatattgtgtctgttctcccaggcttttaaactagaacctatctagtaaatggccctactgatgctgggtcggtgtacctctcccacgagtctacctttcctatggcaccagcacagactggcatcttccctggcctagccctagtctcatcctttcttccccaaccctgtcatcatctgctttcccagcagagtgactttctaatgctaaacccgatcatgtggctctcctcttaaaactccttcagactgggtgctgtggttcatgcctgtaatcccagtacttcgggaggctgaggcaggaggatggcttgagcccaggagtttgagaccagcctgggcaacatagggaagacctggtctctacaaattttttttttaaaaattaactgggcatagcggtgcacacctgtggtcccagctactcgggaggctgaggaggattgcttgagaccaggaggttgaggctgcggtgagccgagatcatgtcactgcactccagcctgggcaacagggcaagaccctgtctaaaatatatatatataaaataaaataaaattcttcagcatcttcttatggcttggacctcagcctgatctcaagcccatggtgacctggccccagctcagtttctcccctgacccctgacactccagtcatccccagccagttcccgagacagaaaaccccccaggaacattctgtcatgatcattttaggacgggaaggtcctttggagaccccatctgggcccatgattgtacctttacatttttccccggtgcctcctgtgctgccaacttggaaactcctggagcccatcccccagtgggctttccacgtgctgcttcctctgcctgggtatgccttcttccttgcccaactggcaaactcctattcatgcctcaagacccagcaccaaactcctctgtggaagagaattgatttcttccttctctgtgtcactctacctagacggttgacattccttgctgtgtattgccagtatgtgttttcagtgaagtctcacctatcaattagggttacgagctctttaaatgctgggatgggatgggcgcggtggctcacgcctgtaatcccagcactttgggaggccaaggagagcagatcacctgagatcaggaattcgagaccagcctggccaacgcggtgaaacgctgtctctactaaaaatacagaaattagccgggcatggtggttcgggcctatgatctcagctatttgggaggctgaggtgggagaatcacttgaacctgggaggcagaggttgcagtgagccgaggttgcaccactgcactccaggctgggcaacagagcaagactctgtctcaaaaaaaaaataaataaataaaaaacattaaaaaaagaaaaaaagactgggacagtgtcctctccattactctagccccatcgcccagcatgtgcccggcatgaaggcatggctcagtaaaagagtttggagtgggtaaagaataagcttgtaaccaaagaagtctttcaaccctacagaagagtttcctttaagggaagagaaaggcctcacccactactggcactgagaggttccccaagacacatattctctgtcccctttgggctactggtcctacctctatagcagagaggccaccatttacttttcttcttcttctttttttttttttttctttgaggcagtctcactctgttgcccaggctggagtagtgcagtggcacgatctcggctcactacaacctccacctcccaggttcaagcgattctcctgcttcagcctcctgagtagctgagattacagctgtgtaccaccatgcctggctagtttttgtatttttagtatagacggggtttcaccttgttgcccaggcttgtcttgaactccggagttcaagtgatctgcccgcctcggcctcccaaagtgctgggattacagtcatgagccaccgtgcctggccaccatttacttttctcggtggtttggcttgttttggcttgcgggtataggagacacactgggtgggaggtgggggtacgttctatacgtgctgatttaatcgtttccgatctggggacatttgaaggatgccagcaaggccccctgctgaaaactatgctccctaccctggtgccagggctgaaaatttcagcactagacatcctcttctctctccgcagtccttctataatgtattatcaggggccacagtgagagtctggggccctcccagctttccccttatgtccccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgcatacaaggtagggacacagcccacagcccacaagggcagaatggcctgaagatgcagatcaacttacatattcctggggtggggagaacatgggcacgggaggtggaaaacctaagctccagccccagctcagccatttctagctgtgcaacccaggagaaatgatcaatctctctgagccagcctcggtcccactcacctctgggaccactgtgagcacccagtgtggcccttcttcatggttcagtgctgtaaaccaaacctgcttgggatttctctggctcctttaacttcaggcacctcagcgagatttttaaaaatcctccctggctccggtgagcctcagccagggggaatgagcctggctctctcaatacccagggatttgtggcagagcctcggccaggcagtagctcctgggtcaggtctctgtccagaaagctgggtcatgttcttggccggaggtggcctctggcagtcacaaacacagcacagccggcgtctctgggacgtgcctgctgtgcctctcccagcccctacttgtcaaggtgagtgcactcgattccctggttccacagacccttcctggacatctgttggtaaagtctgagagttcactctgctccatcagtggtcagccagcataaacagccaggctccaggtttctttatttatggaggacttggatcagagattttgtcttggactctgggacatttattaaaatgtcttggtttgggctcctgccagagaggccccagctgcctctgatcagcaacaaagctgcccatagtctgtgctgccttcatgggtgaagtgtgcccgagcggttctcttgaagctagggaagggtggggatgggaccccagccactggcaggcacccatggcagtctctggctctggaacacagcaccctttgtaggaggtgggagctgagagggccccatggctcgtcacatgcagattctcattttagatgaggaaaccgaggtctaaagagagaaaaggacttgcccaagtcccaaagccagatgggaacctggaacccctggctcccatctgtacaatgtcaataacagagatgtgacaattaaatgatgctttgcagtcacagggtctgctgatatggcaactgtttgttgcctacaaaggtgcaagtaagtgtccacagtaagtgctcaacagggcttcactgaccccgatgcttatcaaatagctttcagtctaatatcgacacctctgcccctgggctccagggagagatggccagacagccatctgggattccattggccacccccagacgggatgtgtctcagccttggggagggctgcctggctctgccagtggctccagcatgtcccctctcctgggtgctattatgcagacactgctggcagccacaccgaggttccatcctgctgccgccagggtggtgatagcaagctctttaggtggtggccaagactgtcacagtggattatagtcctggccatgtcctaaatctttcataagctctattgcaggcaccagaaaccattcaggaggtggggtgggggagcgaaacaccaataaaagtcacacagatcaaaccgggcaacatctgttaaggcaggaggcaccaggccgtgctccatggggtctggggacaggcttgttgcttgtgtggattcaggaggcagagtgaacaccagctcctcctgtgatgttctcccttgcctccctctgcccgtgattcaccagaggctgtttacctttggtccatggcccttgcagtccctagagaaattcagaggctccatgatattggatgggaaaaaaagtacgtttttcttttcccttcttccctccctcccttctttattttattttatttttatttttatttttgacagttcttgctcagttgcccaggctggagtggtgcagtggcacagtcacagctcactgcagcctcaacctcctgggttcaagagatcctcccatctcagcctcccgagtagctgggaccataggcatgtgccagcacacccagctaatttatggttttggttttttttggtagagacagggtttcgctgtattgcccaggctggtcttgaacttctgggctcaagcgatccaaccttcttggcctcccaaagtgctggtattacaggcatgaaccactgtgcccagcctcaattttattttcataacctcaactcacatttagcatttccttcaattatgaatgtaggcagcaaatggctgtcatatcagcagaccctgtgacttcatggctggcaacagaaatcacagatatcttcatatcacgttagagttcttcctgatgtctcaaaaatatcctatatgctgatcactacttcaaagttacaatgatagtagaactggcatcttgtttcttaggctgctactgaggaagcatgcatattgtctcacatttttccttttttttttttctttgagatggagtcttgctctgtcacccaggccggagtgcaatggtgtgatttcggctcactgcaatctccgcctcctgggttcaagccgttctcctgcctcagcctcccgagtagctgggactagaggcgcgtgccaccatgcccggcgaacttttgtatttttaatagagatggggtttcaccatgctggccaggctggtctcgaactcctgacctcgtgatccgcccacctcggcctcccaagtgctgggattacaggtgtgagccatcgtgtctggccacatttttctattatttgataactgtgcttgcaggataattggtttcctttggaatcctgtgcattttcttgtatgcagttaaaggcattactttgaccaggggtccacagctgtactagtctaccaaaggggtccgtggcacacaaaaagttaagattccctattttaaaccagtaattaacagcaaactccctctctctatgtcacataaaaatagaagctaatttctataacagctactcctccttcatttagctgccttgaactcttggtgctcagagcttggatctgtgctaattccattttttaacattttcacttgatttttttttttttttggtcagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccaggtcagtgtctctcgctcctgcccatgatcttcctgttcacatgggcaacccaggtcagtgtctctcgctcctgcccatgatccccctgttcacatcggcgacccaggtcagtgtctctcgctcctgcccatgatcctgacagcctctcttggagttgggcctaagaagcagacaggagtttgccacgttcctaagctcccatggcttgtctttgtttttaccaggggtctccaggggcaaaggccctgaacaaggctcaaaggctctggcagctgtatcagggctgggcttacagatgcccctcaggtttaaaggtgccacccttggcagaatagccagtctcactgtgatgtaagtttatatatatcacatccttttgggtttttaccgaggcttaataatacatacataggaaaaaatatatatatatataatgaatatatatattgggttttgtccacaattcctggctcataactcctaaaattcttggaacctccaaaatgctgtattttgtctgataggttcagggtggggctggtcaccagaaagactaaggtaggattagagggttgggactttcagctccacccctccccgcaacctccagggaggaaagaggggctaaaggtcaagctgattacccacggctgatggtttaatcaatcatgctcatgtaatgaagcctccgtaaaaccccaagaggataggcttcagtgagcttctacatagctgaacacatgtaggttcctagagggtggtgcctaaggagggcatggaagctccgcaccccttcccccacaccttgccctgggcatctctatctgtatcctttgcaatatcctttatttaatttaattaaattaattaatttatttatttttgagacacagtttccctctgtcgcccaggctggagtgcagcgttgcaatctcagctcactgcaacctccatctcctgggttcaagcgattctcctgcctcagcctcccaagtagctgggattacaggtgcccaacaccatgcccagctaatttttgtatttttagtagagatggggttttgccatgttggccaggctggtcttgaacgcctggcctcaagtggtctgcccgtcttggcctcccaaagtgctgggattacaggtatgagccaccgcacccggtctgcaatattttttatgataaactggtatacataagtaaatgtttcctcaaggtctgtgagctgctccaggaaattaatcaaactcaaagagtttgggtataatcaaacccaaagagggttaatcaaactggaagccagttggtcagaagttctggaggcccagacttgcaactggtgtctgtaggggggtggccttggggactgagccctcaacccgtgggttctgatgctatctccaggtggaatggaattggagggcacccagctggtgcctcctgcttgatggtggggagaaacccctacaaatttggtcacaggagtcttctgtgtggatgactgttactgcggtgtgagagcagaggaaacacaccatttaggtagagtttttttctctacacgctcacccactggggatctttgataaatgtaaagctcctatgaacttccaatgaatctggggttggaggaagccaagggttgcagcagggctctttgtccggagatttgagctcgaagcaacgtctaatctgggctgctattctttggtatatttgggtaggagatggctttgttccatatgttaatttgagctgaaatccattgatccccagcgtattcactcaatctgagagtgagtgaacagatccaagatgaagagccaatatcaagaagctgtgcaggcctcttagaaggcctgatgagagtttgagactgggccttggttgagggtccaagtttggtatacctaaacttgctcaactgcataaccgacaacattagacagaacctagccttttgtgaaaatgcagtcagtacttgctagcttcatcacatgaggatgattcagggccacccaccaggatggtgtctgctgaggagttttatcattagcggggatggattgggcccagcacatccatctttgctgtcttcgggattaggttgctgctggtagtcaagcagctgaggttaggtgcatgagatgtgacccagcctggaccaaggtcaaccccccaaggctggctttggtagcaatctgcacaatgagagtactaggctcaatgcacccaaggatccttccagaaatcacgccacacagtttgagattctgttttctgaaaccaccatgccacatggactgtaaattatggagtagcctgagttgtcaaagccttaatccctattctccttcacctcttcctcaaataccatttacaataatcctgcaatttgagtttctgttttagagaaagaaccataaactactcaaccagttctaattggatgctccctgctgaggaaattacattttccttttccatctgcagaactgttgggaatcaaagagctttccaaacctgcctacggggatgccatggtgtgtcccccaggggaggttccagtgttctggccttctccgctgaccagtctcggagctgtcagcagctgtggtacgttgggggataatgggacaatcgatctgccctaggatggagcccagtggggtctagttcttgaaagcatattctcgtagtacaatgatttaaaaataaagccatgaaacaaaacacaaaacagaggcctacagctacagtgaatctctctctggtttccttcttttatttatttatttttttttgagacagggtctcactctgttgccaggctagagtgctgtggtgcaatctcggttcactgcaacctccagctccctggttcaagcgatttttcagtctcagcctcctgagtagctgggattacaggcatgtgccaccatgcccagctaatttttgtatttttagtagagacggggtttcaccatgttggccaggatggtctcaatctcctgacctcgtggtctgcccacctttgcctcccacagtgctgggattacaggcgtgagtcatcgcgcctggcctggtttccttcttttaatcccagggctggatctccttaccagagcactttgtcttacaactcaatttttttgtcgttggttttttggttttgttgagacacagtctcactctgtcgcccaggctggagtgcagtggcacgatctcggctcactgcaagctccgcctcctgggctccagcgagggaggtgtgcctcagcctcccaagtagctggaattacaggtgcatgccaccacacctggctaatttttgtatttttagtagagacgaggttttgccatgttggccacgctggtcttgaactcctggcctcaagtgatcctcccacctcagcctcccaaagtgcttggattgcaggcatgagccaccgtgtccagcctcaaatatgttttgattaaatatatttccttccttccttcccttcttctttcttctttctctctctctcccttccttcttgtcttgtctttctttctttctctttctttctttctttcacagagtctcactctattgccaaggcttgagttcagtggcatcatcatagctcactgcagcctcaaacctctggggtcaagtgatcctcccatctcagcttcccaggtagctgggactacaggcatacgccgccataccaaaccaatttttagaaattttttgtagagatggggtcttgttacaatgtccaggctggtctcaaagttctgggctcaagtgattctcctgccccagcctcctgagtcatagggataacagcatgagccattgcttcagccgttttgattaaatatatatttttatctgctgaagcatcccagcccattctagcaggaggactaacctttagcttggctttttgagacattttggagattgatggggccttgaaaacaaaggtgaagccaagaaatataactaaacaagtcatttcctgtggtatttgcaaggtgattataaacaaggccagcagcagtacattttttccaaggcctaggtgatattacaatgaagagacacacgagggcgccctcgctagctctcagtaagataggaaggtgacagaaacatgaaaaataacagctattgcagaccatggtcatggacactggaaaattctggccaggccagccacacttgcgctgtaagcacatactgtagtgttactttaatttattttgaaagcattcgtgagagttcagctatcagaatggcctcatgcgagggaaagatcatccctaatgtggtgatgaggcgtggctgccaagatccacaggattccatttgttcatttatttaagtgcatgtgttgagaacctgctatgtgccaggcatgcacccaggcctcaggagtacagtgctccatgggacaggatggagtcctctgggcgctcatggtcttgtctgagtgtgtgtgtgggcatgtgtgtagacacacccacccacgtgcagtaaacgtcccccagcccagtggcctcaccgctttcccaccatcggtcgtggcaggtgccctgcagaggagatctcactgctgtgggcaccccagcatggcatgttccagtcctttagttctgacagcgatagcacaattgatcgtagatgagaacaaatgacatcagagagggacaatcttgaatcattctcaaattccctttttttttttttgagacaaggtctcgctctgtcacccaggctgagtgcagtggcacgatcacagctcactgtagccttgacctcctaggctcaagcaatcctcccacctgagcctctggagtagctggactacaggtatgcaccatcatgtccagctaatttttaaatttttgtggagatggggtctcactatgttgcccaagctggtcttgaactcctgggctcaagcgatcctcccacctcagcctcccaaagtgctgggattatagtcgtgagccaccatgcctaccttgaacttcaatatttaaacttctattagcaatagattatgtgcaacagacctcacaactgatgggggcaaaaccccgtgtcatgctctgagctgactgttctgacatctacctggttttggagtgaccagttttaggtgccatccaaaacacagacaagcgataattaaattcatcatcagattcaagactttttccccttacacatcaaatctaaaagttatgtatctattagatttttattttgaagtgctggctgactctttctattaaatatgaaactttaagccaagtgtggtggcttacgcctgtaatcccagcactttgggaggctgaggtggtcggatcacttgaggtcaggagttcaagaccatcttggccaacatggtaaaaccctgtctctactaaaaatacaaaaattagccaggcgtgatggcacacacctataatcccagctacttgggaggctgagaattgcttgaaccccagaggcggaggttgcagcgagctgagatctcaccactgcactccagcctgggtgatagagcgagactctgtctcaaaaaaaaaagaaactttattgtttctgtgaaatccaagatttatttactcaattcacatctgcatttgttgaacacctattatgcgcaaggccctctgtgggatcctgagatgaatgagcaatggtcgctcttctccaggagcatacaactgagtagagatgaatactcaaagatagtaatgacactgaggaaggcagaagaggtaaatagtatggtattaagcacttaatgagctaggcataaggaactaagaatgagtaagatactacgtggttcaggccaggctctgtggctcatgcctgtaatcccagcactgtggtaggctgaggcaggaggattgcttgagcccaggagtttgaggccgcagtgagctgtgttgcaccactgtactccagcctgggcaacagagcaaggccttatctctttaaaaatatatatagatgaggctgggtgcggtggctcacgcctgtaatcccagcactctgggaggctgagacaggaggatcacctgaggtcaggagttcgagccagcctagccaacatggcaaaaccctgtctctactaaaaatacaaaaattagccgggtgtagtggtgcacgcctataatcccagctactcaggaggctgagacaggagaatttcttgaacccgggaggcagaggttgcagtgagccgagatcgcaccactgcactccaacctgggcgacagagcaaggttccgtctccaaaaaaaaaaaaatatatgcttgttcaattaagcaaaccatcgagggcttactctgaaacaagcactttgctgaacactttcttaaaaatttattttttttttttacatttttaaaccacgagtatgctaaacactttttttttttttttttttttttgagataaggtcttgctctgttgcctaggctggagtgcagtgacgtgttctcagctcactgcagcctctgcctcccaggttcaagcaattctcccacctcagcctcccaagtagctgggattacaggcgcaccaccaagctgggctaatttttgtatttttaatagagacagggtttcactatgttgcccaggctggtcttgaactcctgacctcaggtgatccaccctccttggcctcccaaagtattgggattacagccgtgagccactgcgccctgcctgctaaacacttttatgtacgttttccagtttcgttctgacaatagccatatgaggcattatcattacagtcaaagaaacaggtttaaagaataaagtcgggctgggcgtggtggctcacacctgtaatcccagcactttgggaggtcaagaggggaagatcacctgaggtcaggagtttgagaccagcctggataacatggtaaaacactgtctctactaaaaatactaaaattagccaggcgtggtggcgggtgcctgtaatcccagctactcaggaggctgaggcgggagagtcgcttgaacccaggaggcagaggttgcagtgagccaagatcataccactgcactccagcctgggtgacacaacaagactccatctcaaaaaaaaaaaaaaaaagaataaagtcaataaagtcacatctcaaattccagtatattcacaatgctaaaaccagttcttaataactatgctagagtgtttcacattgcctgaaatctaacaaaggagagtctttaaagaataaaattaacataaatcaaagcaaaatgtaagtgccataaggaaaaatagaaacgatgccataaggaaaaatagaaatgatgctcacagagggttccaaacctaacatttgctggaaagcaaagcaagatggcttcatgagttttaagaatccagtaaacacttcctgatatccatgggttaaattgatggaatcgcctagagctctagctatagctgtggctgtatctcacttcttttcaacccatattcaactcatctttactttcctagagattagaggcaactgtttaaatggaacttgatgtagctataaaccagcttattctgaccttggtgccagcaggtggtatagggagtgcttaggctgagttgatggccaggtgccatcttgcctatcaacagtgggctagatgagggtaggctggacttgatgaagtggctgggctcagaccctcctgctgtgtgttttagagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccaggtaagaaacaacacatttgctcggcatagacccaggtaagaaacaacacatttgcacctggagaaaatcaccttttcagtgaaaaaggtgggatgcaaaatgtatccacaggatgattttttaaatgttgatactgcatataaatctcaaaaagactagaattaaatacaccaaaatactgacattgatggtctctaggtagtggtattgtgagtgatttttgcttactttctttttctttctttctttctctttctttcttttgttttctttcttttctttcttttttttcttttttttttgagacagagtcttactctattgcccaggctggaacaatggcgtgatcttggctcaagtgattctcctgtctcagcctcctgagtagctgggattacaggcacgctccaccacacctggctaatttttgtatttttagcagagacaggatttcaccatgttggccaggctggtcttaaactgctgacctcatgatccgcccaccttggcctcccaaagtgctgggtttacaagcgtgagccaccatgcccagccttgctttcttctttatggctttttatttatttatttatttatttatttatttttgagatggagtctcactctgttgcccaggctggagtgtggtggtgcaatctcaattcactgcaacctccatctcccgggttcaagtgattctcctgcctcagcctcctgagtagctaggactataggcatgtgccaccccacccagctaatttttgtatttttagtagagtcgaggtttcaccatgttggccaggctggtctcgaactcctgacatcaggtaatccacccatctcggcctcccgaagtgctgggattgcaggtgtaagccaccatgtccagtagtttttggctttttcttgttgttctaaactttaacactaaacgtgaggaagttcgttgagtttatttgctgggcatgttgccagccagaagcagatggggttaggtagtaagaaaaaaagagagaatggtttctaggtaggcaactgccaccattaaaaaaaagttatttatgtagtttattattattatttagagatgggggcgtggtgtctcactatgttgcccaggttggtcttgaactcctgggctcaagtgattttcccgcctcggcctcccaaagtgctgggactgcaggcataagccacctagcctgtcctctatggatttagtgatgtccctaatctccccctttagtgccattgccctggggttgggcatggaatagattagttgtatactggatagcagggatagtgatggggtaggattacttctccggggatcccagtggggcaggaccctacagccacagcctcacaacagtttgcagtcaacttgtatattgtataacgcatctcaggggaaggatagcccttctgtggctttggagccactggccttctgtacatgggagagggctggtgggatcccctaggggacctgctgattccaattagttattttattttattttattttattttttattttattttattttatatttttatttatttttatttttttattttagtttagtttatttattttattttattttattttttgagacaagatctcactctgttgcccaggctggagtgcagtgatgcgatcttggctcactgtaacctccacctcctaggctcaagcaatcctcccacctcagcctcctgagtagctgagactacaggccggcaccaccatacctggctaatttgttgttgtatttttagtagagacggggttttgccatgttacccaggctggtctcaaactcctgagctcaagtggtctgcccacctcagcctcccaaagtgctgggattacaggcatgagccaccatgcctggccctgctgattccaattagaaagaggtttgctaaaagctggttgaggggcttttaacttcctgctatgtcttcatttaagggctgaatttctaatcccaggtggccagcagggactgcagtttcacctgccattgtgtgtggtaaatccctttgttggcaaacactcatgagagaattacggtgtagcccatacctcagtttcttcatcagcgtaacaggagtgatgacaattatgcctgcctctctgggttgtgatgcatgataaggataatggtgtcacctaccaagttatactgtgccaggcaacaggctgcaagcatttatgcgtttcatcttattaaattctcccagtgactctacgtggaggcagctatgattaacttcatttaacaggtgaggaaactgaggcagataaggtacaaagactttccaaaatccacatacctagtaggtggtcagggcagaacttgaacccatgtctgctgacttcaagcctatgatttatacctgtcagctaaattagaatctcaatggaaacggtaagtcacagtcttgcctgggcagttgaaagagtgctctagcgactcctggttcacaccccagtccctcttctggaccttctcatgggccgtgctcctaaacctggggtacaaaccgcccttggcacctggaatgactggagaggagaaggcatatgtggcctccccaccggcccacctgactctcattccccagagtcaggtgggccagtgggaagatctaggtagctacctgcatcaatggtggccgacctccgtggagagctgaggggtgaggccagcctgcaaagcagcagtcagcaatctgggccagactcccagggcccagacaggactgattccagcaccagtttaaagcctacagcagctgggtagaaccccaaaacagacaggctgggaccttcccctgctggccagcactgtcacgaatctgacagtgcagaccagccctagaaatacctaattcttgggaggccgaggtgggaggatcacttgaggtcaggagttgaagaccagcctggccaatgtagagagatcctatctctagaaaaaacaataataataaaaattagctaggtgtggtggtgtcaaacgcctgtggtcccagctactggggaggctgaggtgtgcagatcgcttgagttcaggaatttgaagctgcagtgagccatgattgcagcactgcactccagcctgggcaatagagcaataccctgtgaaagaaagaaagaaagaaagaaagttggggggggggagggagggagggagggagtctgattctggaaggaaggaaggaaggaagggagggagggagggagggagggaaggagggagggagggagggaaggaaggaaatgtctgattctctcccctgggcctaggagcaaaagttgtcttccaatgacaggggcatctgtagtaactaaatttcttgctgaaccactggacatagctctttgcctgtttgtcttctgttaggttgttcattcattagttcattctgtagagaatgtggtttcctttacatataatcctatagtaaattaaggatataaacccaccacagatacacctcataggttatgctcatgactgtgtatacataaagtatcttacatagttgatcccctgggtggattttttttttcttttgagacacagtctcactctgttgcccaggctggagtgcagtggtgtgatcttggctcattgcaaccgccacctcctgggttcaagcagttcttgtgcctcagcttctcaacgtagctgggattacaggcatgtgccaccatgtctggctaatttttgtaattttagtagagctggggtttcaccatgttggccaggcttgtctcgaactcctggcctcatgcaatctgcccacctcggcctcccaaagtgctgggattacaggtgtgagccaccgtgcccagccggatttttttttttttttttttttttttttttgagacaggttcttgttctgtcctccaggctggagtacagtgatgcaatcataggtcactgcagcctcactctccagggctcaaggtaccctcccacctcagcctcccgagtacctggcactacaggtgcgcaccaccatgctgggctaatttttaatttttttttgtagagatggggtctccctgtgttgaacccctgggttcaaacaatcctccctcctcagtctcccaaagtgttgagattacaggcatgagccaccgctcctggtgctctgggtgggtatattttttaaaatttctgccataccttctccttcacaaacattcttacccaagctgatggctctccatttagcacagagtcatgagggaagatgaattattaactctaccattagctcagattaaaaaaaaaaaaagtaattgggaagtaaatttattgcagatgtggtgcacccattgcttaataaaacaagctaagaggtcagccacaaacaccacccatcaatgctgtgcagactgcaagacaaagcttgaaggatgaggctgggggaggcagatttacagctgttggatgtgttgatgtcatctgttaaggaccatctttaatcctcaagaacaacagatgcttttgatccccactatattaaataagcagatagaagattcataacagcatcttgagcgttactcactggacataataatagacccacttagtcatttttgagaggatgttggcttgcatttgaggtgcctggggaatatgaagggatatagggtttatagtaatgatttttgcactgatgataaaatcatcataaatgtatttaccaatttacagttgaccaagttctcactctcctcttctccctttggagctcaccatgccctaggaagtaggttacatcccaatttttttatttaaaaatgttgttattcttctcctcgccccccctttttttgagacagagtcttgctctgtcacccaggctggagtgcagtggtgcgatctcagctcactgcagcctccgcctcccaagttcaagtgattctcctgcctcagcctcctgagtaactgggattacaggtgcacaccaccatgcccggctaatttttgtatttttattagagacggggtttcaccatgttggccaggctggtctcaagctcctgaccatggatcaggtgatggatcaggtgatccatctgcctcagcctcccaaagtgctgggattacagatgtgagtcactgtgcctgacctaaaatttcattttacaaatgttccactattttattaatatgctgttatttaataccataaacaatgctgtaatgaacatccttatgactaagtttgtgaacatgcccatgatgactttgttaggaacagtgggcacgagaagtgactcgctggctccagtggaatgcacaaatctaagacagaaatcaccctccagacagcactgctccagtgtccactcctcccagcacactatgtgatgggccatgtccctgtgaccctcctacatctggactacctcccattctccatgtgggaaaactgaggctcagagaggtcaaaggatgaggccaggtcacacagctacgatatgccagcatctggactggaatgcaagtttcctggttctaaatcaggaactgttcctccataacagaaatccaaaccccatgtcttcttcttctttttttttttgagacagagtcttgctctgtcacccaggttggagtgcagtggtgcgatctcggctcactgcaacctccacctcccgagttgaagcgattctcctgcctcagcctcctgagtagctgggattacaggcacccaccaccatgcctggctaatttttgtatttttagtagagacggggtttcactttgttgaccaggctggtcttgaactcctgacctcgtgatccacccacctcaggctcccaaagtgctgggattacaggcgtgagccaccccgcccagccaaccccgtgtctttcatattctccaggcacctcaactataagccagcgtcctctcacgtcccttcagtccactgctgatttcagccaccgccagagtagaagttctgtgtcccacacactgccttcgcgtgcactgttttgctctgagatgacctgaatgtagacaaaggcacaatgggacctcatgagggcggctgcctggcttggtggccactggtgggcacctgtagcacacaccgcagcttccccactcgtatcctctgggctgcctgggttcacctgcatagaattatgggcggctcccagcacgacagcctcttaccataggctcaggtctctgctccatctgaggatgccctctgtccctccagagtctccctcatcacagcaggcacagcttggtagtgcagaggactcaacgccctaataggcaggtgagtaaatgcccagtctcctgtcctccgaggaccccacagtttcttagagaatctcaagctgtgctgagccccagttgcctttgaagttaacttgctcactcacaatcctttactgtttttttttccgctttccccatcttctcacttgcatttcctgggatcacctcccactgaaatacttgtgcccaggtccttgtgtcagggtcttctttgagggaatccccagctaatggtgctgtctgtaccatttcccttccctcttatgttttccctgtattagttagggtttgctagagtgctgtaacctagaagccccgggatgctttgctcaaatacagcagaagtgtgttcctctctcacacagcaggccagggtgggtcttccagggtgagtgtcctgggtcagcagaaggggatctgctccactcagtcactcagggaccctgcaggtctgccgttacatcctgtgacccccaggaggttctggctgtcaatactccagctgccaggaaaagggaacgagcttggaggtgtgtgttggaggtgcatgccaggcccagaggtggcatgcgtcacttccatcacgatccaatacagagaacccaatctcgcggccacaccagactgaagggaggctcctcagccatttacccctctgtccttcactgctggggtcagggggcgggggtagaatacactgtggcaagcaatttgcagtctctgccacagccctcaaaaaaacaaagcaaatgaactaaaaacccaaactactcttactgtaaagtttctactttaaaaataatcacttttggctgggtgtggtggctcacgcctgtaatcccagcactttgggaggccaaggtgggaagattgcttgagcccgggagtttgagaccagcctgggcaacatagcaaggtcctatctttttaaaaaatgccaaaaaaaattagcgggctgtggtggcgcgtgcctgtagcccagttgttcaggagggtgaggcgggaggatcacgtgagcccaggagtttgaggctgcagtgagctgtgatcacgccactgccttccagcctggatgacagagcaaaaccctatcataagtaaataaatacatacatacatacatacaaataattttaaaaatatagttacttttacattctatttttgtcatttcagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtaagcagtgagatgggcttggtccatttccccaaacgggctttgtggacggaggctggagggaatcagcatctgcagtacagagcattctccttccagctcagaacaactccgttgtaagctgcatagcttgatttcatagacgaagagactgaggctctgagagatccaggggattttcccaggtggaaatggtgagctggaatttgaacttgggtccaccaggctccaaagcatgggatccttcctgcacacctgctgctgtccctttgcagtgtggggaatgacctgccgagtattcttagcaatccggggcagccctggaccaccagagctggggagagtagtggagtatgaagtggctgaaaggctcagacagcagtcccacctggtcgtgatgggcagggctgcacctggagcacccaggtgggcgttattgctgtaggtgttggagacgcgaggctgtaattccactatccgtgtagccagatcagcgtcgggctcaatgtgaacaaccgctgctcacctcacctccatcctgcaggaagtgttatcaggcatgagctggaagcctggtgaatctcacctgcctcccgctaccgatcgctctgtgtccctcaaaatgcattcttcagaggtatgttttttccttttagcattcaaaaagggctttaaactcagtaaggcataccctaaagcacccattatgtcagaagtttccaaaagcctgtgtctgtacgtgtagaatccacttcatgcaacaaatgtgtgttgagctcgagtatgtgccaggcactctgttaggttctttttttttttttttttttttttttttgagacggagtctcgctctgtcgcccaggctggagtgcagtggcgcgatctcggctcactgcaagctccgcctcccgggttcacgccattcccctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctctgttaggttcttgagatccacccgtgagcaaaactgacaacagtcctgcccccacggagagtatcttccagtggagtgtgacagacaagaaacaacttgtaagatgaatgcacagtgtgttcgagtgatgatgccatggggaaaatggaccaggatgaggagactggagagtgaggggctgggcggtggcagcagtggggggcagctgtcactttacacagaatggccaggaagacctcctggaggaggtggcctttgagtccagaattcaggttgatgatgagggcgtgaggcttgggctggctgagggaagggcatcctggactgtggcagtggctggggcagaggtcattaggtggagtgggggcccagtgggtttaagagaggatggcatgctggctgactggcctggagtgaatgaggaaaagagaagtgggacgagggacagagaggtaacagggaccagatgggacagggcctcgcaggaccctgtgggcagctgggcttttgttctgggtgagatggggagcctgggatttctctgagtcagggacagccatgttctgtgtgggttgtaagcaatcactggggtgcagagacaagggtggaaacgggagactggtgagttatggaaggtgggagaggaggacggtttggagtgggggtgcctcatggcacatcccttcagccgcacttctgatttcagctgccactgcggtggatgttctgagtcacactgacccgatgggaccccgccacaagctagggccctgcagggcctctccaaagccatgtggaatcactggctgatggcttcagggcaccctcaacccctgggggacaggacctgaggtgtaagtgacacatgctacaacttggatgaccctcgaggacatcttgagaagtagattaagccagtcatattgtatgactccacgcatatgacgtgcctagagtaggcaaactcacagggcagaaagtagaatggtggttgccagtggctgggaggagaggggaatggggagagttgtttataggtacaggggttcagtttgggatgatgagaaagttctggagatgaatgggggtgatggttgcacaacaatgtgaaatattttatgctactgaacgatacacttgaaaatggctaaaacaggccgggcacagtgactgtcttttggacagttccctgtcttttggagacacataggtcctggtggaactgacgccccactccctagagcagcaaccttgaaggtgcacgttccctccttcccagcctcattctccctgttccctcccacatgcttcgtggcaccatctcccaagagaccatctgcacccaagtctcaagttctggtttcaaagaaacccaaagagacaaaaagtacagatacagagggcagggggtattgtgagaagtagccagatgttgtatctattttgcaggtacagtcaacatgatttccagatggattgggtgtgggtgtgaggagaaggatcagggcttgctctaaggtttttgtcctggtaactgaaaggatggagttgctgtgaactgagatggggaagactggcaggtttaggggtaaatcaagagtccaggtttgacatttgcgccctgatggaaggattgtaaaatggtgcagatgctatgaaaaacagatggcagtggctcaaacaattaaaaacagcaaataccatatggtctagcaattccacttccaggcatataccccagaaaaaggaaagcagggactcaagaggtatttgttccctaatgctcatagcactttatttgcgacagtcatgaggtggaaccaaaccaagtgcccatcaatggatgaacagatagataaaatgtggtatataattattactcagccttaaaaaggcaggaagttccgacacatgctacaacatggatgaccctcgaggacatcttgagaagtggattaagccaatcgtattgtatgactccacgcatatgacatgcctagagtaggcaaactcatagggcagaaagtagagtggtggttgccagtggctgggaggagaggggaatggggagttgtttataggtacaggggttcagtttggggtgatgagaaagttctggagatgaatgggggtgatggttgcacaacaatgtgaaatactttatgctactgaactatacacttgaaaatggctaaaacaggccgggcacagtgactcacgcctgtaatcccagcgctttgggagaccgagacaggcagatcgcttgaggtcaggagttcaagaccagcctgtccaaaaccccgtttccaccaggacctgtgtgtctcataacaaaaccccatttctactaaaaatacaaaaattagccaggcgtggtggctggtgcacacctgtaatcccagctacctggaaggctgagacacaagaatcgcttgaaccctgacagtggaggttgcagttagccaagatcgcaccaatgcactccagcctgggtgacagagtaaaactgtgtctcaaaataaataaataaaaaggctaaaatggtgaattttgtgttgcacgtattttaccataatttttaaaagaatgcaggtttgaccctgttaggtatgaggtgcgtctattagacacacagtggagaagtcaaggaggcagttagtgatatataaagagttcaggagagcagcgtgggcaaggagaaattgggaggctgttggcgtgttggtgggctctcaagtcaaactactgggtgagagcactgtggaaataaatggaggcagagcaaaggacccaggattgcgtcctgggtctccctgtgttaagaggatgaggagaagggcagaacagccagcgagggagacgagaaggagcagcgctgaggccagaggaaaggcaaggggccgtgtttccgtagggcagagaaaggcctcgggaggaagggctgccgacggcgtagagcaccattcacaggccaacctcatttccatctgacaacggtgttgctgggtattttcagctgcccccttcccagaagtcactctgccctctctgctcacctgacagcctggcttggagacgcctgccagactccactcagagctgggtcttgtctcttgtcctcatgggagctcagagggtagaatttgctatattggattttacagaacttacattacatttgcatgaagaaagtaaaagcaatttggccttttaatgaaaattatttcagctccgtttttaataaccaaagcctaggaaaagttttaaagaggctgagtgcagtggctcacccctgtaatcccagcactttggaaggccaaggcaggcagatcacctgagctcaggaatttgagaccagcctggccaacatggtgaaaccccgtctctaccaaaaaatacaaaaattagctgcgtgtggtggcacgcgcctgtagtcctagctactagggaggctgaggcaggagaaccgcttgaacctgggaagtggaggttgcagtgagctgaaattgtaccactgcactccagcctgggcgacagagtgatattccatcttagaaaaaaaaaaaaaaaaaaggagttttaaagctgactaggcattgtcatttctttcctgtcttgagcatagacagaccatagctctttcttcatagctcagaagtgggaacctcatcttgcccagaccctcctttttggggattctcctgtgtcctttctcgtgtgttccccactttgggatacattatgttccctgccttcctggactccctggtattttttactagtatcctatatccttgatccaattttgaggcagtaagaaagaaacatcctttacttagcactgaccgtgtgcacgacggccagccaggtagttagcacacagcatgtcattgccctgtcgcggtagtcctgggaggtgggtgttaccccattttgtagaggaggtaaccaatggctgacatagcttgcccaaggtcacatagcaagggaatgatgtgacgttcccaccgagggctgtttggctctaagttcagccccctttccagattggcaggctgcccctcacagcacagggaagggctgggtcattcccctttgttgtgactgtcccccaaccccaaattgccagcttatggcttcacatgtagaatgtgttctgtgagcatcacgatgactaacagctacttgccttccccacttagatgtgggctgaggttagggaggggggatggggaaggagccacagtgagggatcctttttttttttttttgagacagggttttgccttgttgccaggctggagtgcagtggcgcgatcttggctcactgcaacctccgactcccgggttcaagtgattctcctgcctcagcctcctgagtagctgggattacaggcgcccgccaccacgcccagctaatttttctatttttagtagagacagggtttcaccacattggccaggatgatctcaatctcctgacctcgtgatctgcccgcctcagactcccagagtgctgagattacaggtgtgagctacgtgcccggccagtgagggattctttaagatttctgacaatgattcttgttcctcatgccaacttgccccattgacccactggggtggcagtggcagctcccaaagagctcaggggcagcagcatggcggagtagctgagggtgggagccgctgtctggaagctgcatttgcagtacaagcatgcagttttaacatgggtacggtgcctccttgggctggctctacgtgaggggtgtgaggggctgatgatggagattgaggagctggctgaagctcctccaaggctaccttggcagccatcctgggctacagagcagtctgggagctcctgcaggaccagctagaccataacagtgggtccaagacaccctgctcctggctccctgccgtcttaagctctgtgtgaagactttatctttggccagtgactatgctgggattctatcccaacctgctgtgagatagatcggttaatgaaaaccaagttcattttatcttattttgggatttttgtgtatttcccacatattctacaacaatacgtgttctttttgtcattagaaaaggtcctatttttaagaatcaaattcactttgattcacttttggaaatcactccaatataagtaagtatcccaaggcacagactctgggaatttccttcagttgttcttgaccttccctgaaggtatgcagggaggtagggagtgggtgagaatttggggtgagaattggagccatgaaactgacatatatacatggccttgcccaagttgtttggcatctctgagcctcagttttcctcatctttaaaatcgcgataatgatggttttttgggttttgttttttttttttttttttgagatgcattctcactctgttgcccaggctggagtgcagtggcgtgatctcggctcactgcaacctctgcctcccaggttcaagcaattctcctgcctcagcctcccgagtagctggaactataggcgcttgccatcacgccgggctaattttttgtatttttagtggagacagggtttcaccatgttagccgggatggtctcaatctcctgacctcgtgatccgcccaccttggcctcccaaagtgctggaattacaggcatgaggcacccgtgcccagcccatgatggtttttatcacatggaattgttgtaaaaattaaatcacagtggctggcgcactgtcaccgagggcacataaatgtatgctcagccctcgtgatggcagtgggccagaacaggccgctgttcccatggtattatgggcatcttacatgcagcatatttgttaggctgtgttagcccgattctgccctccacccccgtcaaccctagagtttacccaggaccaaaagtaaacttaaatatcctctgtgtcatggcctcggcttacctaacatgttctacagatagatgttgttcaacaacagtaatgatacccttcaaagaagcttttgaaaagccaacgtgaatttccaaaagccaacactagagctgatgtgtgccctgcttgcctttattttcaaggtgttctgaagacgcagatcccgatattaacttaccaaggtggatcagtggaagctgctcaggcattcctgtgcaaaaatggggacccgcagacacctaggtacgtatgtcgcatcccagtttaagtggcggatggtggaaacgcccatatgctcttcacttagccaacaaagtgtctgcacacccaagcccttcagagggagcgaagccatgagccaaggaagatgggttctcatggaccagactaacaaatgaggctggggggtttcaaggtatcctgggggcctcacagaacatctctggaagtaacaggtccctgggcagcagagagagacagcatatcttcctgatagaggggagacatagcactaaaaaaaaaaaaaaaaaaaaaaaagtttctcagtctcaaactgtgggtcatgacatgttagagaatagtgaaatcatttcagttagggtatccagcacctttggaaaatgaaatagaaatacagcatcattgtatatcttgtatagtaatggcaagtactccctcataagactgtgtacatgcaagtgtgtgtatttcttactgtgtgttatggtcaaactttttttcttttagggggtggggatggagtctttatctgttgcctaggctggggtgcagtggcgcgatctctgctcactacaacctccgcctcccaggtgccagtgattctcctgcctcagcctcccaagtagctgggattacaggcacgcaccatcacacccagctaatttttctatttttagtagagatggggtttcaccatgttggccaggctggtctgaaactcctgacctcaagtgatccacccaccttggcctcccaaagtgccaggattacaggcatgagccaccgcgcctggccgctaatttttttatttttagtagggacggggtttcgccatgttggccaggctggtcttgaactcctaacctcaggtgatccacctgtctcagcctcccaaagtgctgggattacaggtgtgagccactgtacctggcctctctgaactgttttttaagcttacacttcagtggcgtaaaactacactcacattgctgtacagccatcatcaccatccatctgcagacctcttttcatcttgcaaaactgaaagtctgtgctccattcaaagataattctccatctcctcctcaacccagcctctggcaaccacaattctactttctgtctttatgagtttgactattcgaggcaccttgtgtaagtggaatcatccaatatttgtccttttgtgactgcttatttcacttagcataatgtcctcaatgttcattcatgtcacagcatgtgccagaatgtcctgcctttttaaggctgaataacattcccttgtgtgtatagaccacattatgtttttgcattcatctgtcagtgggcactgggtttgcttcctgctcttggctatgctgaatactgctgctatgagcatgggtggacaaataactccttgagtctttcacttctcctggacatacacatagaagtgaaattgctggatcatatggtatgttctatttttaattttttgaggaatggccatactattttatatagcagagttgagatttttgaaaaacactgtcttggaaggattgagagagatgtaaaagtacaatatgcatattcttttttttgagacagaatcttgctctgtcgcccagtctatagtgcagtggcacaatcttggctcactgcagcctctgcctcccgggttcaagtgattctcgtgcctcagcctcccaagaagctgggattacaggcacccgccaccatacctggctaattttttatatttttagtagagactgggtttcaccatgttgaccaggctggtctcgaactcctggcctcaggtgatccacctgcctcagcctcctgaagtgctgagattgcagacatgagccactgtgcccagccttttttttttttcccccttgagacggggtctcactctgtcacccaggctggagtgcaatggtgtgatcttggctcactgcaacctctgcctcctgggcccaggcgattctcccacctcagcctcccaagcatagctgggactacaggcactcgccaccacacctggctaatttctgtatttttagtggagacaaggtttcaccatgttgcccaggctggtctcaaactcctgggctcaagtgatctgcctgcctcggcctcccaaatggctaggattaccggtatgagccactgcgcccagcctgcatgttcttaaattggattgtcaaaacagtagtcctgctagtaatcatagcaacaataatcactgtaaccaacactgactgagcactgagtaggttcagggcttcatgacaagcgcctcctgtgcattttctcatgtttccctttgaacactgtgtgaggtacacagtgtggtcatgtcaccctacagatgcagaaaatgaaggttagggaggttaagcaatttgcccaaggcccgtggcaggaggacctggaatcagaacccagatgatctgctgccacagcccacattctgaccactataccatctgtgccccttatttctctgtttctatctaaagaagtttatctttgtgttagactcactccttttgtattttgagcccttttccttctgttttgtgtctgtaaactgaacaagatcctggaaggggccagcagcaggccaatagcagccaatactctcagcctcttggcctggctatccctgctggacaaaggggatctgagtgggcaccagcaatgttcccatccccatagcaaccctgaccattggcctcctgcttttatagcctctgaccctactaaagaaattgctgaggattccaatgctggattttttttttttttcaagacagagtcttactctgtcgcccaggctggagtgcagtggtgcgatctcagctcactgcaacctctgcctcccgggttcaagtgattcttctgcatcagcctcccgagtagctgggactacaagcacccaccaccacgcccagctaattttttagtagagatgaggtttcaccatgttggccgggctgttctcgaactcctgacctcaagtgatccacctgcttcggcctcccaaactgctgggattataggcatgaaccaccatgcccagccccaatgctatatcttaaactgacttaatagactagtctccagcacaggtcctggcccagagtagatgtgccaccaagttctgcaggaatgaaggaatcaaagaaaaaaagaagcgtctttcgcgcaaacacaagaaggcatgacccagcaaagcagccacctctccataggaccctctgacctctgacctttgcttcccggcagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggtaagtatggagtactggggatgcaccaagaacgtggccccatgaagtgtcttttgttgttgttgttgttatggagtcttgctctgtcacccaggctggagtgcagtggcacgatcttggctcactgcaacctctgcctcctgggttcgagcaattcttctgcctcagcctcccaagtagctggaattacaggcatgcaccaccacgcctggctaatttttgtatgtttggtagagacgaggtttcaccatgttggccaggctggtctggaactcctgacgtcaagtgatctacccacctcagcctcccaaagtgctaggattacaggcgtgagccactgtgctcagcctaagtgtgtttttattgactattgaacacacgaccagaaagagttatgtggggaccatcattttccactgcaaagacggtctttgttcattacggttggtatagacactaatgacaccaccatttagaaatccaacatcctcacaagcaagggagggaaagcatattctatttgcctgactctaaagtaataaaactaatattaaagtaatatcaatagtaaaattgaggcatggcatattattttggtcatataggacagaatgtaccatatattattttgtgaagcatgttaatttaaaaattatctaatatatgattaatatttcaattttttttttgagacagagtctcactctgttgcccaggctggagtgcagtggtacaatctcagctcactgcagcctccacctcctgggctcaagcaatcctcccatctcagcctcccaagtagctgggactacagggtgtgctaccatgcttgggtaatgtcacgtgcgtctgtgtgaagagagtccacaaacaggctttgtgtgagcaacaggctgtttatttcacctgggtgcaggcaggctgagtccgaaaaaggagtcagcgaagggtcgtgggattatcattagttcttataggtttgggataggtggtggagttaggagcaattttttgcgggcagggggtggatctcacaaagtacattctcaagggtgggggaggatattacaaagtaccttcttcagggtgggggaggatattacaaagtaccttctcaagggtggggagggtgtatcttacaaagtacattcacaagggcaggggaatatcacaaagtacattatggcaagggcggggagggtgtattgtcacaaagtcaattgatcagttagggtagggcaggaacaaatcacgatggtggagtgtcatcagttaaggcaggaactggcattttcacttcttttgtggatcttcagttgcttcagcccatctagatgtatacgtgcaggtcacaggggatatgatggcttagcttgggctcagaggcctgacaggtaactttttttttttttgagatggagtctcactctgttacctgtctcaaatgcagtggcgcaatctcggctcactgcaacctccgcctcccaggtttaagcaattcccctgcctcagcttcccgagtagctaggactataggcgcatgccaccacgcccagctaatttttgtatttttagtagacatggggtttcactatgttggccaggatggtctcgatttcttgacctcgtgatccgcctgcctctgccttccaaagtgctgggattacaggtgtaagccaccatgcccggctgcttggctaacttttaaacatttttttggtagagatgaggtctcactatattgctcagcctggtctcgaactcctgagctcaagctatcttcccacctcagcctcccaaactgtttcaattacaggcatgagccactgagcctggccttcagtcgttaataatataataatatggtctgggcgtggtggctcacacctgtaattccagcactttgggaggctgaggcaggtggatcacctgagctcaggagttccagaccagcctggccaacatggcacaaccccgtctctattaaatatataaaaaaattaaccaggcatggtggtgggctcctgtgattccagctcctcaggaggctgaggcaggagaattgcttgaacccaggaggtggaagttacagtgagccaagatcgcgccactgcactccagcctgggcgacaagagcaagactctgtctcaaaaataataataataataataataataatgtgataatttgtgtttgcacaaaactttgtacttttccaagaggcttcacattcattgtagtgtttaagcttctgtgaaaaccctgtgaggcaggtaaggtgagtcccaggaggttttcccagatggcgcagctaattagtgttgctggtagcattaggagtagactgcagactcctggggccccagccctttatcagggaatcatgcctttatgaattgcggaaaggcttagtgtaagccccaaggagaacctttcttccctctgggtgggtctcaggccctggggtaatgaagacttgtttgtcattgcatgtttccaagtgtttcccagactcattagtctcctttggcttttgaggttttgatgagacagtgagagccttctgcgctgattagaacgtttctgcaaatcgccctggcttttcccagaagaggctgtgggtgtggtgcacacagtgcggttggcttccagcttcctgttggcttccagcttcctgttggcttccagcttcctgtccctccggctgggcaggcagaggacctcagcctgtgggggaggggttctcagagtggagaaaaaagagatctctgtggctacaggggcaaacagggtctgagggagctgctagagcaatcccgtcctcccacacccgcaatgggacccccatctgtgctgtgacgaccctgagatcccagaggaggcaggtggagctggccgttcatggcttcgaaccgccccctttgtagacccttgggcccttctcacggcctcaggagcccagtctcctcctgtggcccccgccgccccagaccctcctgcccagcaaggctacctcctgaattttcctttttctcttcttcttcctcaaaacccctgttcctcaggttccatgggcaactgccatgtcatgggcatagtgctcaattgagaatcaagtcacctgggtttaagtctccaccttccactgactgcccaggtactgcccccatcagggactgccagctctatacagtgaggatcatgatacccatgacaggatggatgtgaagcccaaaagagatggaattcataagatgctaaaaagagacagctatagaccagataccagtgttacatgttgggtgttattctcctcattcagtgggctgtcatagatctagagaagtgttctgagaaaaaccatcaggatataaatctaaggtgtttggtccttcacaattgtgtcattcttttggccaaattcactccctgatgtttgagatggatcagctctagatcccacaaagaacactagcctctgacagaattcttccgcatcttccaagcctttatagaagcagacacaaaaacaatgatgtacctgttccataggcttggagagtccagccctctggccttgagagactcagacaggtgcattgcatgaaaggttattgagacagctgtaaccctcttctagaggtggattcagctgaacatctagtttacagactcctctataaatacctggacacaggagctgtgtcccccagatctacagcaccacctcaaagggtacatgcttcagggcttgataggtttttttgtgtgttttttttttttttttttagatggagtcttgctctgttgcccagtctggagtgcagtgatgtgatctcagctccctataacctctgcctcccagtttcaagtgattctcctggctcagcctccacagtagctgggactacaggcatgtgccaccatgtctgggtaatttttgtatttttagtagaggcaaggttttgccatattggccagactggtctcgaactcctgatctcaagtgatctccctgccttggcctcccaaagtgctgggattacaggcatgagccactgcacccagactagatttttaaatcttatccatacaagggtagaggtatctgctagttatttttagccaatccacctatcttgaacaccattcatttcaccaatgaattaaatcatttttaatatgtatttattctagcattcatttattacactaattaacaaattctctgatgcagactatcagatgggcctcaagactatgtagcctctttcaaatgcttactaaccacacttggagtgtgtattcctgattaggatatttcagatgttaaccaggtacccctgtggtatagattaaaatgaactaaaacacatacatttcacattctttcagcagaagcctttaaagtaagttctagaactgactttgcaccagatcccccggggggctcagtgagcgggagccactggaagggaggtcctgagtgtcaccatacccacatctcccatgggcctggcaccaagagcatagaacgtgctccatctttgctggagaatgtgacccaaaaggagacatgcccacactgtagtgtgttccaaacgtggactcatttttaactaaagaagtttctagaaggcctaaggggaagtaccacaactcctggttgtctgaaaatatatccagagccaacctttttgccctcccaaaggcaacaagcacatgtagggctgccttgcttcaggcctcccccattttgccctggtcccgtgcactgactcagctccccttcccttcaggagtcggtgatggaggcaacgagcttgggatgggtaaagtcaaggaggctgtgaggaggcacatacggcacggggatgtcatcgcctgcgacgtggaggctgactttgccgtcattgctggtgagcactcggatggccgcccagtccggccggctacccagggtgagcgacctggcttggagcctgaccaggccagaagctcttcttctctgcagtcagtccatagggcaccagggcagggaggggaggtggtgctcagcctatgacctttcattcagtcattcaacaaacatttacagtgtgccaggcagtgttctgagcactggggttatagctgcaatgaccctgctccacagagctcccattctaggactgggagatagagaatgagccctgacaaataaacacatcagatgattctaaagagtaataagagctttgggggcgatagtacaggtcgctgagagagggtgatgggagggccccttcagatcagtggtcaggaaggcttttctgaagagagtgatctgtgcttttatctgcatgaacagtaagaaaactatctggtaagtgtttggaggatgcgagaagctttctacctttcctttcacctacttctgccttgggctgccctgtgcctccctactgttgctcctctcccgcaggacccacctttcctgtgtccaggtccgtctaggtgtggcctcctcctttgacctcaccacacatttcaagaaaattgggagatccctgaaaaaggctctctcccacttcatgatcatagcctggaaaggaatggaacctcgtgggaaccagtgctagggtgggaaaacctgattcgtaattgagaaatggctggaggctcagtatgggcaagtatgagagtttaaaactccaggcgacccagtggtctgggggccctcgtgctcttgtgagttttgcctctgggcgttcaaccaagttctcacaatggatattagaaaaaaatcccctcgtgcttgcatcattggagggaaaaatgagtcattttcaagtaggccagggcattctcttcttcttcttcttcttcttcttcttcttcttcttcttctccgtctccttctcctcctcctcctcctcctccctttcttcttcttctttttttttttttttttttttttgagcgtgctttgttgcccaggctggagtgcagtagtgccatcttggtcgctgcaacctccgcctcccgggttaaagcgattctcctgcctcagcctcccgagtagctgggattacaggtacatgccaccacacctggataatttttgtatttttagtagagatagggtttcaccatattggccaggctggtctcgaactcctgccttcaagtgatttgcccaccttggcctcccaaagtgctgggattacaggccttaaatctccctggggaaagcgaaatacccaaccccacctttcttcagccttccacgtgggagagggacatacccaattccagctccctctagcaatctgtgccacgtaagggggagaggacaaaactgagaagcagtagtgaagttcacagtccagggcacaggcttactaaaaggcagagacctaatcataggactgcagagcccttcccctccccgacacatcttaccaccatcactaaaggtccatttgctacagtttcttttttttttcttttctgagacagagtctcactctatcacccaggctggagtgcagtggcacgatctcagctcactgcaacttctgcctcccgggttcaaactattcttatgcctcagcctcctgagtagctggaattacaggtgcgcactaccatgcctggataatttttgtgtttttggtagagacggggtttcgccatgttgaccagagtggtctcgaactcctgacctcaggtgatccacccacctcagcctcccaaagtgctgggattacaggcatgagccactgcgcctggcccagctgcagttccttttaccaagtaaattatgtccacctttcaacaacaaaaaaaatttacaagaaacaccgataagcaaaaacacaatttgaagagaagttacaaacagagtcagacatgtcagaaatgacgggattatcagacctggaattcttttaaaagtatgattaatataataaagtcttcactgcaaaaaataggcaacatgcaagaagagatggataatgcaagcagagacatgaaaattttaagaaagaataaataagaagtggtagatcagcctgggcaacatggcaagataccatctctgtaaacaatttaaaaattagccaggtgtcgtggtgcatacctatagtcctggctacgtgggggggctgaggtgggaggagaacttgagcccaggaagatgaggctgcagtgagctgtgattgagccattgtactccagcctggatgacagagcaagacactgtctcaggaaaaaaaaaaaaaaaagaggaagtagatagagatcaataactctgtaacagaaatgcagaatgcctttgatgggcttattagtagaccggacatggctatggaaagaatctctgagcttcaagatatctcaacaaaagctgccaaaactgaaaaaaaagcaaagagaaaaagtgctgggggaaaaaaaaacccacaacagatcagaatatctaagaactgtgggacaactacaaaaggtataacctagactaatgggaatactagaaggagaagaaagagagcgataaatagtagcatttgaagcaatagcaaatgagaatttcccccatattaatgtcagacaccaaaccatagatccgggaagctgagagaacactaaagaggataaatgccaaaaagctacatctagacatatcatattcaaacttcagaaaaccaaagataaaggaagaattctgaaagaagccagaggcaggtggggaaaaccctttacctatacaggaacaaaggtaaaaattacattcatttgacttctctacagaaaacatataagcatgaagagactggactatttttatttttttcttttttctttttttttgagatggagtttcactcttgttgccgaggctggagtgcaatggcgcaatctcggctcgccacagcctcctcctcccaagttcaagcgattctcctgcctcagcctcccgagtagctgggattacaggcatgcgctaccacgccctgctaattttgtatttttttagtagagacggagtttctccatgttggtcaggctggtctcaaactctcgacctcaggtgattcgtctgccttggcctcccaaagtgctgggattacaggagagagccaccacgcccggccacctttaatctttacattactgaactatttaaagtattgagaggtagcaaccaatgcagaattctgtgccctgcaaaatttgcttcaaaaataaaggagaaataaagactatgaagcaaataaaaattgagagaatttgttgccacaactgccttgcaagaaatgttagaagaaattcttcagagagaaggaaaattatatctgtcagagacttgaatctacataaagaaaggaagagtatcagtgaataaaataagtgagggtaaaataaaaacttttgtatttatttttgaccttacatatcagtttgctcaaaataataataacagcacaaaataataataacagtgcattccattatgtatgccatatgtatatatatgcttatgtatgtttgtgtagaagtgacccaaatgacaggccaggcacggtggctcacgcctgtaatcgtagcactttgggaggccgaggcgggcagatcacttgagcctaggaatttgataccagcctgggcaacatggggaaaccccatctctacaaaaaatagaagaattagctgagtatggtggtggacgcctatagtcctagctacttgggaggctgaggtaggcagatcacctgagcctgggaggttgaggctgcggtgagccatgattgtgccactatactacagcctgggtgacagagtcagaccctgtctcaaaaaaaatagaataagtgacacaaatgacagcaatggtacatggaatgagagggaagaattagcaatgttttgttataagttgcttgtgctacccatgaagtggtatactgttatttcaaagcagactttgttgtaaatgtatgttgcaaactctagggcatccactaaaaaattaattttaaaagtagaatttacatgctaagaaaggagagaaaatagaatcatataaaatactcagttaaaaccacaaaaggcagaaaaagtgtagaagacaaaaatggggccaggcgcagtggctcacacctgtaatcccagcactttgggaggccgaggtgggtggatcacctgaggtcaggagttcgagaccagccttgccaacatggtgaactcccatctctactaaaatacaaaagttagcaggagaatcacttgaacctaggaggcagaggttgcagtaagccgagataatgccactgcactccaacctggggaacagagtgagattcggtctcaaaacaacaacaacgacgacaaaacaaaagaacaaaacaaaaaaatggaataaagaacaaaggcaataaagaaaacagcagcaaatatggtagctattaatccaactatatcaataatcaccataaatgtcaatgccacagtgaacttaaaaaatcaagattgaggccgcgtgcggtggctcacgcctgtaatcccagcactttgggaggccgaggctgggtggatcacgaggtcaggagatcgagaccatcctggctaacacagtgaaaccccgtctctactaaaaatcaaaaaattagctgggcgtggtggcgggcacctgtagtcccagctactcagcaggctgaggcaggagaatcgctttaacccgggaggcggagcttgtagtgagccaagatcacgccactgcactccagcctgggtgaaagagcgagactccatctcaaaaaacaaaaaagaaaataaaacagaaagcaaaaaacaaaccaagattgagctatatattgtctgcaagaaattcactttaactgtaaagacactatatgtgtctttatatttaaacagattagcaataaagagatagagaaagatatgccatgttaacactaataaaaagaaagcagaagtagctacattaatttcagacatagcagacttcagaacagggaaagttatcaggataaagagggggattacataatgataaaggggccagtattcaaataagacataatacgccaggcacaatggtgcacacctgtaatcccagcacattgagaggctgaggcaggtggattgctttagcctagacattcaagaccagcctggacaacatggtgaaaccccatctctacaaaaaccccatctctacaggcaaatgcctgtagtcccagctgttcaggaggctgaggtgggaggatcacttgaggaggcagaggttgcagtgagccaagattgccccaaaaaaagttgatgggggggagcataactgataaaactgcaaggaaaaatagacaaattcactattacagttggagacttcaacacccctgtatcagaaatgggcagatcagcctgggcaacataacaagaccatatctctacaaaaacagcaaaaaattagctgagcatggtggtgtgcacttgtagacctagcctctcaggaggctgaggcaggaggattgcttgagtttaggagttggaggctgcagtctgctgggttgtaccactgcactccagccttggcaacagagtgagactctgtctctcaaaaataaaaataaaataattttttaataaaaaataaaaatcaagtaatgtaatccattacgtcaataggctaaggaagaaaaatcacatgttcatgtcaatagatacagaaaaagcatttgacaaaagcaacacccattcatgataaaaactttcagcaaactagaaatagaggggaacttcctgaactcgataaagaacatctacaaaaaacctacagctaacatcgtaattaatggtgagaaactagtttttccactaagattaggaaaaaggcaatgatgttccctcttaccactattttcaacattgtattggaagtgctgcctaatgccgtaagacaagaaaaagaaatataatgtaaacagattgggaaggaataaataaaattgtctttgcttgcagatggcatgattgtctgtgtagaaaattcaaaagaatcaacaaaatctcccagagctaataagtgattatagtatggttgcaagatacaaagttaaatactttaattgtatatgtcagcaatgaacaagtggaatttaaaattaaaaacacattaccatttacattaattccctaaaatgaaatacttaggaataaatctaaaaatatgaaggaaaatacaaaacattgatgaaaggtatcaaaaaagaactatatcaatggagagatattccatgttcatggataagaagactcgatattgtcaagatgtcagttctcccaacttgatcaataaatttgatatagtcccagtcaaaatcccagtaagttattttgtggatatcaacaacctgattctaaagtttatatgaagaggcaaaagatacagaataacaaactgaatattgaaaaagaacgagatcagaggactgacactacctgactttaagacttactataaagctacagtaatcaaggcagtgtggtattggtgaaagaacagataaatagatcaatggaacagaatagacagcccagaagtagacccacacaaatagggccacacaatgtttgacaaaggagcaaaggcaatgcaatggagcaaaggtagtcttttcaacaaatggtgctggaactggaactactggacatccacatgagaaaaaatcaatctagacatatagacgttacatcctttacaataataaactcaaaatggattatgaacttaaacataaaacacaaaactataaaactcctgtaaggtaacataggagaatatttggatgagcatgagtatgattatgacttctttttattttaatttgattgattgattgattgagactgtgtcttgctttgtcacccaggctggagtgcagtggcatgaactcagctcactgcaacctccacctcctgggttcaagtgattctcctgcctcagcctccccagtagctgggattacaggcacacgccaacatgcctggctaatttttgtatttttttaatagagacggggtttcaccatgttggccacactggtctcgaactcctgacctcgagtgatccacctgcctcggcctctgaaagtgctgggattacaggcatgagccaccacatctggctgattatgactttttagataacaacaccaaaggcattatccgtgaaagaaacagttgataagctggacttcactaaagtttcaaacttctgccctgcaaacgacaatgttaagagaaggagaaggctgggtgcagtggctcatacctataaccctaacactttgggagaccaaggcaggaggaccatttgacactaggaatttgagaccagcctgggcaatgtagcgagaacttgtctctacaaaaaaattttaaaatattagctgggcttagtggcatctctgtgtctgtttcccagttttcaaatggagataataatagtacttacacctcacaagcttgttgtaaggactccaggagctactctatgtaaggcatttacaacagtgccacatgttgtaaatattcaatcaaagaagatactctgttcattgaatataagatgtcattgatggccaggcatagtggctcatgcctgtaatcccagcactttgggaagccaaggcaggaggatcacttgagtccaagagttccaggttacagtgagctatgattgcgccactgcactccagcctgggtgacagagtgagaccctgtctttattaaaaaatgaagaaaaggctgggcgcagtggctcacacctgtaatcccagcactttgggaagctgaggcaggcagatcacgaggttaggagatcgagaccatcctggctaacatggtgaaaccccatctctactaaaaatacaaaaattagctcggcatggtggcaggtgcctatagtcccagctactcaggaggctgaggcaggagaatggcgtgaacccaagaggcggagcctgcagtgagccgagatcatgccactgcactccagcccgggtgacagagtaagactccgtctctaaaaaaaaaaaaaaatcccaccactttgggaagccaaggcaggaggatcatttcagtccaagagttccaggttacagtgagctatgattgtgccactgcactccagcctaggtgacagagtgagaccctgtctttattaaaaaatgaaaaaagccaggcacggtgactcacacctataatcccagcactttgggaggccaagacgggttggtcgtttgaagccaggagttcagggccagcctggccaacgcagtaaaactccatctctactaaaaatacaaaactaagccaggcgtgttggcatgcacctgtagtcccagctactcgggaggctgagggaggagaattgcttgaacccaggaagcagaggttgcagtgggctgagatcataacactgcactccagcatgggcaacagagcaagacttgctctcaaaaaaaaaaataataattattgatgacaagaattaacaataatttacatactactaagaaaggaaaatacaaccaattgtaactgtaagatactattaattataagatacatctcaatttcagagatgtaagtgtaacaaaagtacatcttaaaatcagtagaatacagtattatttttatcgtatggtctttacctgccacgttttgatatatggcttgtattttcatgccacatgcctttgtattcactgaagattgtttgtttgtttgtttgtttgtttgttacggagtcttggtctgttgcccagactggagtgccatggcatgatcttggctcactgcaacctccacctcccgggttcaagtggttttcctgcctcagcctcctgagtagctaggattacaggcaccctccaccacgccctgctgatttttgtatttttagtagagatggggtttcaccatgttggccaggctggtctcgaactcctaacctcaggtgatctgcccatttcaacctcccaaattgctaggattacaggcttgagccaccgtgcccggccaagggagtttttgtttgttattttttttgtttgtttttcttttttttttttaactggaattgctcccattcctccacccctcttctggcaaaattttactcaacctacaaggcccatattaaatgaccccttttctatgaatctttcctaaaccagtcagaatgagtgccccctctccatgctcccataattctgcgtgaacatctcagtcatagtggcccgtggctggccgtgtgcacagtccctcctctcctgagcagaattgacctctctttcgtggtgctctagcacttattgcttaccaggcccttcatcaattcttcttcaactgcatggagaactcaagcaggtttcagggaagagccaaggagatggtcccaaaactgggaaataagccctttgggcatgtgatggaaaaggaagggaagtctgaggctgatttgggagtgatctttgagcacatgaagaggtcatgcgatccagcgcgacggggctgtttcctgccctctgagggtgggcttccacgtggcacaggggattcagctcagccagaggggagagtttcttcatgttgagtgttttggaatgggtttctacggttattgcctaaacctttttttctgatggtcattagcagtggattaagtagtttagagcaagggttttcaaactttggcttggatcagactcacatagaggatttatcaaaactcagccaggtgcacctataatcccagctacttgggagactgaggcagggggatcacttgagcccaggagtttaagcctccaccccaatgagctatggtcgtgctagcctgggggacagagggagaccccatcactaaaaaaaattaaaaataaaaataggccaggtgcagtggctcatgcctgtaatcccagaactttgggaggccgagatgggtggatcacaagatcaggagttcaagaccaacctggccaatatggtgaaaccccgtcccttctaaaaatataaaaattagctgggcatggtggcacacacctgtagtcccagctgctcaggaggctgaggcaggagaatcgcttgaacccaggaggcagaggttgcagtgagccgagatcgcaccactacactccagcctgggcaacagagcaagactttgtctcaaaaaataataataataaataaataaatacaaataaagaaaattcagcttgttcctttcctctcctctcctgctgagctttttattcagtagttcttggctggggccaaagaatttgtgtttctagcaagctcccagatgatactggtgctacgggaccgtggaccagtcctgcagatagttctgcttcctagaggcaggctgacagacacatgacttttccaactccatgatggaatcttgttttgctgttctaggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggtaacaaaccccagccagccgctcgcctggaagcagcttttaccctggatgagcagcaggcctgaggtcccaagccgtaagccgagggctggcaccctgctgcccctcaaaagccagaggcagagccagccttgaagcagaggtctcctggattgggtgccctttaagctactcgcagttctgaatcgtgtggcaggcctgatccaagtgaccattttccttctagtttgactttgggtgagttgcttagcttctctgagcctcattttcttcatctgtaaaatgggggtggtcagcattgttgttggaggaaccgaatgcctcacccatggtgggtacttcatactgttagtggtgggcaggtgtcctgtcagccccctccaaggaattcaccacccagcgaggccactaaaacctccagagtaagtcaatcagccatactaaggaaagtgctaagggggacagacaaggtgagaagagaatcctgtgggctggaggctgcaaggaataagccaagtagaaggagaggaatcccagcgggaggaatggggggagcaggggcttgggagatgaggacaggcttagtgatggtttgtgggagacagctcttgaggtggagagcaggaggtagggggtgagacaaaagtagaagagggcttcagaccgcaggcccacaaggaggaggtccatgagcccctgaagctgtttgcacaattgttcctgtacatgtatttttctgcgcaagactctgtggtttcatcagattcttcaagtagtctggggccattaagaatccctggtccagctgggtacggtgactcatgcctataatctcagcactttgggaggccaaggcaggaggatcacctgagcccagaagtttgagaccagcctggacaacatggtgaaacctcatctctagaaaaaaaattttaaaattagctgggcctggtggcatgcacctgtggtcccagctacctgggaggctgaagtgggaggatcgcttgagcccaggaatccaaggctgcagtgagctatgttcacttcactgcactccagccttggagacagagtgggagaccctgtctcaaaaaaaaaaaaaaagaatccctgggaagggacagatcatgttagctggacccaaggacactgtgactttctccctgaggactctccctgagaggcagcagcaggtaacttttgtctgagctcctccgactgcagaccccatgctccgaagtgttgtttgcagttctaggtacactctgtagcccagtgcagaggaagggcatcaacgtgtgcccgtctaacttatgtgaactcacacatgcatatggggaaaatgcaaaagagaggtggccagcgcgcagcacccaagcctgagcagcgaggtggcagcgggactggcccttccttccttgggcctcaatttccatggccctcttagagcaagctccgcccccaacaccaattccaggctctaacccgcctcctctggggctcctcaaggagatgggacctgcccctcttggaggagaagctggtggaccagacttgcgggacattcacaatgcctcagtgcttaacgggacacctacttggggaatattcccaggtaatttggactttgggaaaacggggccaaagctctgactttacatctaaatcctgggtcagatgtgacttcacctgtgagcagacagcagcctgagggattagaggtgggtgccgaaggttgtgggagagggcgtggaaggtctggggagatgggaaagcaaatccaagaggccggagggtcctgagcactgagcctgcagaagagcccgagattgggtgggtggtcgctacaagtcccctgccagtgggcaggcccgatagcctcccaacgtctgcaaccagacgtccgcattgctgccccttttctgtcttttttttttttttttttgagacagagttttgctcttgtcacccaggctggagtatagtggcacgatctcggctcaccgcaacctccaccccccaagttcaagcaactctcctgccttagcctctcgagtagctgggattacaggtgcctgccaccatgcccagctaattttttttgtatttttagtagagacaggatttctccaagttggcgaggctggtcttgaactcctgacctcaggtgatccacctgcctcagcctcccaaagtgctgggattccaggcgtgagccaccacgcccggcctcttttctgtctttctttcctgttttcttacaccctgtctcttccctttttccttctgtctgtctctccctctctgtttctctgtgtctttctccttcctgcccctggcctctgtttctctccagcacctgcctggattggtggtgtcattcccattttacagacgagagacctggggctctgagaagccgatggcttgcctgagaccacccagctgagaggcagagctgggatccgagtctaggtctctgtgactccattctctgtgcttttcccaattccgctcagaagtgtcccaggtagtgccagggaagagagatgggggagggggagctcaggcagctgtggtgacattttcagagggaaatggtctgccctagaggggcccagagggccttttgtgctttctttatacttcctggatctgaactggaaaaaaacatgcaagggctgcttcacacatgattcctgattcacgcagacacaaaagaacgaacccagccaaacaaatcacacagcccaacacacagatggaagcttttccttctgcatttctacctagtccttcataaatcaattaataatgtaccacccttataaagaacataaaatggggattttttttttttttcttgagatggagtctcactctgttaccaggctggagtgcagtggagaaatctcagctcactgcaacctccgcctcccaggtttgagtgattctcctgcctcagcctgccaagtagctgggattacaggcgcgcaccaccacacccggctaatttttgtatttttaatggtgacggggtttcaccatgttggccaggctggtcttgaactcctgacttcaagtgatccgcctgcctcagcctcccaaagtgctgagattacaggcgtgagccaccacacctggcctaaaatggggattttttaaaagcaaaagtacaaacacatgtttgttgagccccgcccctgggccaggcccaggcttgctctaggggacaatgaggagtcaccctgggtgggggactcagggtccactggggagacgacacatgacaggcaatttcaggagccaagatggaatgtgcacagtaagcttcagtgagaggccgggcatggtggctctcacctgtattcccagaactttgggaggctgaggcgggcagatcacttgaggccaggagttcgagaccagcctggccaatatggtgaaaccccatctctactgaaaatacaaaaattagccaggcgtggtggcgggcgcctgtagtcccagctgttcgagaggctgagacatgagaatcacttaaactcgggaggcggaggttgcagtgagccatgatgacaccactgcactccagcctgggtgacagagtgaggctctgtctcaaaaaaaaaagaaaaaaaaattttgaaaaaagcttctgtgggagcacagaaaacagtgcttagctcagcaagttcagtgaaggctgcctggaggaggtggcactggcactgagctgtcttgaggagtgagtaggatataagtagccaggtaaggaagggtggaaaaggccttctaggccgcagaacccacataagcaaaggtacagggacatgaagccgtacagtgtgcagaggaaatagctagaatcgtcacactagagttctgcaggtcactacgtgggggtccttgagtcatccagagatgctgggcagagctgtggcctgagctagtggaaaagcttgattggttggggcagagaaatgtcccacagctctgctcagtgagttgcatctggggacaggggttcttaaggatctcactgtgagtgtggtagaagcaggcactatgctgaggaggccagataaggtggacatcactacctgggcacaccctgcccactctggcccttggcccaggggcaccttaaagtgagggagaggcccttgggttgtacttgagggcaagcattcctaagacgtcatcaagggccaagagccacttgatgacactttacaggggtacctgcaaggtctgataaggaggacttggagctcaggaggtggagaacttggtcttcctcagcttgggggccaaggtgctgcaatttggcagggtgacagagctctgggcagggggtgggtccctaggagggactgaaggcctccaaggatgaggcctcgggaagccccctcatggcatcttcccctcagcccgatggaggcctcagacagcagccagccaggccggctgtgcctggatgctggtctgggttagggccactctcttccctgtatttctgtagtttgtggacttctctgtttcctaggaccaagtcctttgtaaaaacatcgggcctgccttgggtgagtgaagtgggtggttaggaaggtcgcaggccctggccggctgcctggttcaagccctggctccgcccacttcagcctggagcaagtctccgacctcagcattcctcggtctcctcgagtggggccgtaacagatctactttttgggtgattggaagatggaatgagtccctttgtgtaaagcacctggcatagtatctggcatggattaatagcaagtgttcaataaatgccaaccgtcattatcatcatcatcatcatccttcttatcatgacaaggtcctttctttactttcagtcaggctggggcaggtgtcagggtgtccctgagccaggcttgatggtggcagcaggtggcctatgccaaggagagctcccacagccagagcagaaggaggtgaaggccaagacagagctggggcctccagatgccatgtggcgtcatgtgggactgtctgtctttccccgtgtggctgggaggcagatggagccgtttctcccgctgccacactccccagcccggtccaggcagccagctctcccctgcctattgcaagatgagaccatgattataccagccccatcttgctctacgggaagcctcagcaccatgttcccgcctgcctcgtcattgcctgtgccagagcccagggccaagggagtgccttgtctcacatcccagcccatttcatgccagccctttacaagagatcacaaagaagaggcactccctgggagtgggcaagccaatgccaggaagctgatgcctgggcaggaaagaggctaaggaaacgtggggctcatggtataaacaaacaccaggaaaggtttcctggacttcccccacctcaacccagtacttggggaagaggaacacagcagctgggcctgttttgcatcactgccttgaagtggaggctggagggagctgcctgagggctctggccaggctcccagcccctctctgctccatctctgctccagggcaggtactgagcacccatggtgacatggatgtggaatatgccatcagcccagggcatagcagccatgtggtttggggaaacagaagaggaccctgttattcacatgcccagtggtaggtagggagtgaggggccaaagagtgagagctcttggaggaacaaatgatgacttatttgtccctacttcagagcctggcccagggaaggcactcaggaaatgttggatggagagatgatggatgcatggatggatggatagatggatgggtggatggagggatggatggataatagatggatggatgcatggatggatgggtgatggatgtatgggtggatggagggatgcgtggataatggatggatgcatggatggatggatagtggatggatagatggttgggtaggtgggtggatggagggatggagggatggatggataatagatggatgcatagatggatgcatgcatggatggatggatagatgggtgagcagatggaaggatgaatgctttgatggatgggtgatgcagagaggcaggaacagcctcgggcctcattctgggctcccattctctttcagcactttcattcaccctactattctttataacttatttttgttaaagtataattaacatacaataaagtgtgtacaccttaagtgtacagttggatgaatttttacataagtatacacccttgcaaccaccaccaagattaagacacaaaacagttccaacttcccagaaggcaccccactttgagcggcatcatcacctcccataaatacctgcccaccgtgctcccagtgtgacttaatagcaagcacccatacactcagcctctacacactcagcatccacacactcagccaccctggggcctctgtccccatccaagccctgtctactctccctcacttgggtcctccattcctcctctcctgccctgttgtctcagcctggactggtgcagtggccttcaggcgccctgccctccagctgctccctggtaattctctgccactgttaccacctctgcctcttagaagatggcatggtcattccgtgattcttggaaatttgcagggagtagctgttggcccagctggtccctgtgtctcttggaggctgggtgccagtcagctcgaaacctgttggctgattgcgtgcaccctgaggaccccacagcccttcctggggcccagaaggatgagaatggtgagggaaacagtgtgctgtgaggaaatggccccaggagtcccagaaacattcccccataaagagaggatatgaccagtggagaagagaagcgagaggaagaagcccaaacaaagggcgggaaatgccattctgagtgggtagctcctgagaaggagctgttggacaaaggacacatgtgaaagtggaaacaatttagggcctccctcctacagaggaacatccttcttggcccccagggcagaacagaaatgcaggctctcaggccagctgtgaagagacagtttgcagttaacatttgccaatgctttctctattacttagaaaaagttagtgagtgaccctccagggctctcagctggctcatttttattctttcatcacctctgatcctagttgccccttgtcgtagctcaagctgctattttaaaaaacaactatagactaggtggcttgaacaacagaaatttagttctcacagttctagagattgggaagtccaacatcaaggtgccagtagttttgattcactggtggggactctcttcctggcttacagatggccgccttcttgctgagtccgcatgtggtggagagagcgagagctctggtttctctttttcttataagagcacttcacatcctgaccctcactcatgacctcatctcaatcttattacctcccaaagaccccactttcaaattccaacaattgaggattaggttcaacatacaaaatttgagggtacatattgagtccataacaccctgcctccagaaaatgttccctgaaccatgccaataagctgggttgggtgcccctgctctgtgctgtgacatcctgtactatgactacctgattactcatctagactgtgaaccccatgggggcaggaaccatgtcacattcaccactgtatccctggttcagggcctgacacatacttagcaggtgttcaataaacctttgatcaatggtgggatgaatgagcaaatgcctgagcagggagagagccttcttatagccgccctaatgtcctattctagattccttaggtcccctcctctcacctcctgcctttgttgtggaggaggaagaagacagggagaaggaagaggaggaggaggaagaagaagaagagggaaggatgtgtttgagttgctttatgccttcacttaaggctcactgtccttaggggaacctgagctgttcactagggacagacacattagtggcttgggcaagtggtgctttgggattttatttttggaaggaggggggatggaggaggatcaaaccactttttttttttttaaccagcaggagagcaaagggagaaagctctaggctaaaggccagaagacctagccctgccaataaaatcaacctcattttgtgaatgcctgttgtgtgccaaggaccctgctaagtgctttgcttgtacgtaatcctcagaacaaccctctaaaggaggcatgatgagtacttttatcatcaccctccccattttacagataagcacactaaggcacagaacagttaaaattcctgccaggaaagactcaagtcagacctttctgatccccaaaccactctgcctgctaggccccgggctgcggcttcaggatgggggcttgtattctctgtgactctgctacacctagatgctcccactcccacagtcaccctggtcatttctagaaggcaacagcagcaggatttgacacatgccccacattaggctaagaggtctcaggagaaatgggggcctttggcacaaagactattggcagataatccagggctgggaggaacttattggcaggaaatagcctgcactgcacctgcaggaggagtgaatcttcagtgttggttaaggaaatgcaggctggccgggcacagtgatgtgcacctatagtcccagctagtcaggagactgagacagaagaatcacttgaggccaggagttcaataccagtctgggcaacatagcaagaccccatctctaaaaacggacaatcaaactaagaaactatgtttccattaaagcatattatttagttacataacagtaactaccaaaagaagcagcccaaactattcccgtgattgtttctggggagtagatttgggggccaatgagctgtgatggaggacacttacttttcatgacttttccaatggtattagtactttaaaccaaaattttacttttttaaaaagcaagtatgtcaaggcaaaggatccttctcacttataaatgtgtataaaagaaatttctttttcctccccctccactccttctatttctgccctatttttttccaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgctgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaattgtgtactcttcggaatatcgtgatgaaatctcacaccatcctgctccatcctacctaggacgtgaatcctccctttgtccagggtacccgtgctgtctacaccacccgcctgccagtcacccagcaggtgatcagatcgactgtcatggtattgcagtgcttatattcaagaacctcttatgtgactcagtaatgtcctcaaagtgcaagagcagagatgctggcaatttggatatgccaaaaagaggccataaagggcttcctttaagtgaaaaggtgaaagtctttttttttgtttgtttgtttttgcagttgcaagatttaatagagtgaaaactgagctcccatacaaagggaggggacccaaagagggtagccattgctggctcgaatgcctgggtttatatcccgatcattgtccctcctgctgtgctctcaggcgatagatgattggctatttctttacctcctgtttttgcctaattagcattttagtgagctctctgattggtcgggtgtgagctaagttgcaagccctgtgtttaaaggtggatgtggtcaccttcccagctaggcttagggattcttagttggcctaggaaatccagctagtcctgtctctcagtaccccctctcaacaggaaaacccaagtgctgttggggaggttggctgacaactgctctaactgcttcctgctgaattggggcgtagtaggggttgtgcagttgagatttcctcgggaggggtgccttcgatgtcatcaacatcggagcatgggctagcaggccggtccaggggtccatggtagatcttagtcatggactgcatctggggctccatttgaagaactatttgtagttttacagctttgattctggaagagacaaacttaacaaggaggttaaagataaagggattgaaatgtatgggctgcagtgcaggggattatttctttggcacacttcacaggccttgactatctgcttgatagttttgaaaaggcctggtctagtaaataataatttgaccatctgatgggtgctattaatgcctaagagaaagatatggtgaagggttttaagtaatttccattggttagctgcaggcataagtatttttccttcttcggtggctggccattctgaggggaggaaactatgtcctcgtgaggttccccattctatttcttctgagtactggggcttggtttcctggaggggattaccctatactagggctccttctataagcatttctaatggagggtcctgccttgtggctcttttggcttcaatatccgcttggtggttcctttctatttccctttcctttcctttctggtgaccccggcagtgtaagactgccacctctttaggtttctgtacagccaataataatctcctaatggcttcctgatgtttgataggtgttccctcggaagttaggaattcccttcctctccatattgctgcacgggcatggaggactaggtaagcatactgtatatatatttacccgaaaaggtgaaagttcttgacttaataaagaacaagttcatatattgaggctactaagctctatggtaagaatgaattttctatccatgaaattgagaaggaggctgggcatggtggctcatgcctataagtattcccagcactttgggaggccgaggagggcagatcacttgagctcaggagtttaagactggcctgggcaacatggcaaaaccccgtctctaccaaaaatagaaaaaattagccgggcgtggtagtgggcgtctataatccagctactcgggagactgaggtgggagaatcgcttgaaactgggagatggaggttgcagtaagcccagattgcgccactgcactccagcctgggtgacagagcgagtctctgtctcaaaacaaaaaagaaaaaaaaaagaattgagaaggaaaaagagatatgtgctagttttgttgtcaaacctcaagctgcaaaagttctggccacaatgtgtggtaagtgatcagttaagatggaaaaggcattacatgtgtgggtggaagacgtgaacagaaacgtgttccaactgacagcagtcgagttcagtactatccactggggatcttggaacatactccacgtggatgagggggtactgttatcattagggcatagtcaggcagccgtgcatggtggctcacacctgtgatctcaacactttgggaggccaaggcaggaggatcccttgagcccagaagtttgagaccagcttggacaacatagtgaaatcccatctctacaaaaaaagtttttaaaatttgccaggcatggtggtatgctccggtagtcccagctactcatggggctaaggtgggaggatcactggagcctgggagttcgaggctgcagtgagctgtgatcacaccactgcactccagcatgggtgacagagcaagagctagtctcaaaaaaggaaaaaaagaaaatggtaaaatgtgcaaatgtggaatatatatttacaaagttcttgggttttacagaagatttactcctaccaccaccaaaatatttatacctttgaaatgcttttttttccaaacagcattttgtttactaaggcaaaagaacagcattttgtttactaaggcaaaaggtcctttgaagagcctaacatttatcaccattgctgcccctcacctcacccctaacactattccacctcctctctgtctgctcccctgcaccccctgagcccagaccctttaacctcttgcataggagggcagcctcaccctgtgggtgggtcaggcctctccagtgctcaggcggctcagagtcctcctgaacaactccagtcacttgcccttatctctttcacaagctcccactgcacagtgcccaacaacattagaaactgagtcactgaccgtgtcccattacactcttacaatatcctgtgctggttgcactgctgagtgacggctgactcacccagatcaggggagtccagcttcgcagccatggccccaaatgtttgttgaacctgcttaattttcattcatttccttaaacaggtctagtttcattctttaaggagcaacagttgtgagaatagaacacagagggtagaaatgaaccccgcattgtacacacagcagttaagcgtgaggatgtagcacagtggttctgggactgacttcagttctccctatgcaggggcatgatgcagccctgggcggaagttgctggggctggggctctccaggtctccctttgtcattctaggggagttcccacaggcaggggctgtgctcagtgctggtgcggcagcagggctgacacctccagcatcctgagaactcagccacatggggatctgcggcatctcacggctcagtgaagccacctcagctctgcagcctccctgaccacatgtcctccaattaggatttttgtccctgatttgggactgcagagttccatgtagcgagggcctctgattgagattgtaccccgacgtttctgcaatcttgatggctagaagagagaagccctcaccatggtaaagctgccagcacgcttctgactcatgttttgggggaagacacaaatgggtctttggttttgcagtagtaacagcagggttctcttctggcatggaggagtctgaggcataaccatgtaatgggttgtcttcactgtgggcagaaattcatggggagaggatttcagttgtttggtaaagaggctgacaccaggttgagcccagagaaagctgagaataagggtcctagactcagtgacacatccaaacccctgaccccgctacagggagaggcaggcctgtggtccaacatcaggggctctgatgcaagggagaagaccccttagcagggcccagcccaaggaccacaggagctctgcattccaggatccagttttgatgcttgtccattccactgtaggattcctgctcagacctttagtagttttgctcagctttcctcttttatcctagccttgactgtgctttgaggaagcacctgtatccatggggtggccatggtgagtgtggctgcagcctgcagaagctagttacagggagataggagatgacatgcagggaatgatggggtgatttaaggcgagatatgggcctggtgccaaccagaatggatttgtgggacataggagcatcactgggcatttccaagaacattgaggggaggtaatcctggtgaacagtgcataggatgctccatggataacaagggcaggctggagaccttggcaccttgaggggagaatgagccacacagaccctgcaggagatggatcaaagacaagtgagccagctaagcaggtcagggctccttagtcccctggaggtcctctggcccctccgtcactcagcagggaaaggcattcctctgaggttgttccttgcccctcattgcacgggctttgctgaccaccagccccgacttggtccagcccactgcattctgctacatcctgcccactccctgtggcttccactggctgcacgatgaggtctaactcagattcgaaaaaccacttcctctaggcaaggtggagaggaggatgtggcttaccagcaattcacataaactcaatgtgtgtcagcaataagatttctcaccagaagtaaagaagcagagaggaaaatgggcctgttctccatggggcaggtcagacagacttgctctcacttcacattccaggcatcgcatttgaagaagtggattttgtttagaggaaggtacagaggggtgggtgcttaaaacctcttaagtttagggctggatgtggtggcttatgcctgtaatcctggggaggccaaggcaggtggatcacttgaggccaggagtttgagaccagcctggccaacatggtgaaaccctcttctctactaaaaatacgaaaattagctggctgtggtggcacacgcctgtaatcccagctacttgggaggctgaggcaggagaattggttgaacttgagaagcagaggttgcaatgagccaagactgtgccactgcactccagcctgggtgacagagcaaggctctgtttcaaaacaaaacaaaaaacctgttaagttgaggtggcttgaagagctgcctgtcagagactggccagatactcaccaattctgcctctctttcctgcatccataggaaaactacctttcccagcctcccttgcagttaggttgaggccacatgcctgggatctgaccaatggaatgtaagtagcagggatatccgccatttccacacttggccaaaaacccctgtgagattctctttttgctgcatccccttacctgtgtgggtgaaaagggaagaccccaagatgatggactctggtgatgggaggatcctgaatcactgccatcactttgggaaagacttgccagaaagcagcctctcgttggactttgcatgaaattttctgcccgaccctgaaattagtcatcttgagtagtagtgagttgtcattggtggtgtttgtttgtagacagactggactatcgtttttggggaatgcagaggggagacttcatggagagggaactgaatattatgacctctctggtatatgccagcactaatatctaacatgtaatttagcagtattcttctgaaagttgttgaattaaagcaaatgggattgaaatcccaacatttccccagagtactgggcaccattataacctcaggattaaggccatctgtcttagcccattttctatggctataacagaataccacggactaggttatttataaagaacagacatttctttggcttatgggtctagagactgggaagtccaagagcatggtgccagcatctggcagggtcatctcctggcagaaagcagaaaagcaagcaagttctgaagagaggaaaaaagggggctgaactcccccaataacaaactctctcccaccataacagcattaacccatgacctaatacctcttaaaggtcccacctcttcgcatagttacaatggcaattaaatttcagcatgcgttttggaggggacattcaaatcatagtatcatcagagactactgtcttgccagatgaattccagggatggaggcttcaggatcaccagctacaagaagtggctttttcagaaaagcaacgagccaagagggtcagagtttggctctcttttggttggaccagccagaggaaagcagcagatggggatgtatttcgtgccgaaaatttctcccactcttgtctggccaacccacagaccagtgtgtgtaacaggaagatgagccctgtgtgtaaacaggaagatgagccctcatctgactaaacaactctggtgaataagaaataaatcctaatggcttctgtcaccttccaaaccagatggactttttcttccacccatcctctcaggagagaaaggagtcataatccccaatattgtccttacttaatctgtttagaagaaggatctactcttctggaacactccaggactctaggagcctgacccagagagggattaagtgaccaagatcaaatttacattttaatatgatgcagttaatcctcagtgataaacatggcatatgccactgttgagaagatgctccagcctaaagaggcaggtcagcaaatgtgggcctctccaaacaaagccccgtcactgaggacagccccacagagatgaatgcaacaggcccttcttctctagtgaggagggggtggtctgatggagccctccctcactgtggggagcagctacccagcaggtacaaggggttatgtggccaaggacagagtgggtgatattctccaaaccacatgactgggctctgtcctcaaaagggagttagccaagttaaaccacagagcgaatttgcaacaccacactgaagaactgggtggcacttcatgaatctcaagtggagggagagaaggctctacttcactcaagggctgtgtctttcttgaccatttgctgggtaatcaagtgcaaatcccctaatcgctctgcttgagtttgccctgagaaggtcaacctctgccctttcctgactcctttggttcttcaagggccctcaagaccccctggtgttgaagactcccttaccccataaggactgcagcatactcccaaggtgtccagttactttgctttatttgcagactgaagtgggctacataaatccattacagagtcaacacatgtagacttggcaaaaaggacaatacaaaaatacaactcttgacagtaaatgagactgccctcagctcatcccagtctgtatcagtgggaagccagtgtttaaggtcaacataggaggaagtgctgtggaatgaggaggcatgaaggcttccaccaatgtcactgacccagtaaaatcctggactgagttgcatgggctcttcttggctgtgtggccatttctgccgccttcaaacttggtcacttcctcctctaggaaggggaagagaacctccccaagtcatcggacaccctccacaaggatctgagcaggggctgtgcagtcaaagccaagtgtagccctgggaccactgtgagcacccttccctggggcacctccagcctgggctgttgcctctgggcatccccgatgaaagggctaagagacacagcacaaaggatcaacctcttcaaggctggggggaagaggggaagggagactgaggaaggggttctgcctgggcctccctttggtagattccagaaatgtttgctgatgccaacttctgcttctagcccctggtcccttcttggaggaagcccagttagcctcttggttctgaagaactcgagtcccaggccatggaaggcatccttagtcagagctggtcccagttcactgaccagaaggtctgaagggctagcatttctgtggaggtgggcaggtcttctggagcagcaggcggctctcccagttcttatggctggagctaggatcctcctctgcctataactccctcaattctcccaacccaacaccccctaccttccttctttcctcctcccttccttctccccttcctcctttccttcccccctctttctttccttccccctctttcttccttccccctcctgccttccttccccctccagtcttcccttcccaccctgttgtgggcgggctgcagtgctgatcccaccgggacgtttggacaggcattgtctgtgacaacggtggcattggaaggccctggcagctgaacgcccagcctcccaccctccatgtcctcacactccccatgcacaaactctgcaggaagcaggccagggaacgcagttcactgtcttcccccgaccagcagccccagcctggccacatcgcagccgcggcagaggacacggcttattcccacgagccaaccggggcttattcccaccctcggcggtcccagcgggctcagcaagcgagagcaggcttccggagttacaggggcttccctgcctccgcagcgagggaagcaggaggcggcaggccctgaggcccgtgggctgaaggctcaggcctcacgtggagccacccgcggaggacccaggctaggccaacctgcccgtggggaacccgcccgaccctggcgagttaggggtctggaaggccgggtggagcttggtcaacagctcgggctcctcaccctgggccccgcttttcccggaggcctcgggggcacccagcgggtaggcctccctggcccggccggtcctggagcaggtgaggaaggccaggcaggccccgcggaggcgggccaggtcccggtgggtggtctcgctgacgaagcagtagagcacggggtcggcgacgcagttgaagctggtgagcaggagggagaagtggtaggcgttgaaaacgcccttggcgaagtcgcagctggcctcccagacgctgcgcaccagcagcaacacgtggtagggcaggaagcaggccaggaagatgaccacggtgctgagcaccagccgctggatctggtccttgcggctcttctgggtgccgtggctccggcgcacggcgcgcaggatgccctggtaggacgccagcagcaggcagatggggaagaggaagcccaccaggaagcggtagtagttgatggcgcgctgccatgcctggatggggtagtgctcaaagcacacgcggtgctggttctcgtcctcgatgacctcctcgtgcatcaggaagtagatgctggtcagcagctccttggcccagatgaccacgctgacgccgacggccgccttcagggtccggaactggtggaagcggaagggatgggccacagccaggtagcggtccacggagatgcagcagaggaagcccacgctgatgtagatgttctcgtacaggaggatgccgcacacctggcaggacaggtcgccgtgagaccagttgtcgtgctgcagcacgtactgcagccagaagggcagcgagcagatgtagaagaggtcggccaccgtcaggttgcacaggtacacgcccagctcgttccgggccttgatctgcaggtagccgaagtagagggacaggcagttggccgggaagcccaccaccagcacggtaacatagaccaccggggccagcgtctggtggatggtatggtcgatggtacagctcatcgaggagttgtctgcagtgatgttccccatctttgggcctgaaggggccacactcctcatgggctcagggactgggcctgtctctccaccgccatcctgtttatagaaggtggttcaagctctaccaagggctgggcatcgctggtggtgggcaagaccctgaaagtcagaggcaggaaaggtttataatagtagctaacatgaatgtagcacctactgtgtgtcaggcaccattctaaatcctttactcatttaatttagaaggtgtactagcccaccaactccaattcaactagaatatctgaacggctggacatgatggcttacacctg

SEQ ID NO: 1042 - DNA, 24201 bp, Homo sapiens
attttctttagttctttgaacatatttaaaacagctgatttaaagtcttgttctagccgggcgcggtggctcacgcctgtaatcccagcactttgggaggccaaggcgggtggatcacgaggtcaggagatccagaccatcctggctaacacagtgaaaccccgtctgtactaaaaatacaaaaaattagccgggcgtggtggcgggcgcctgtagtcctggttactccggaggctgaggcaggagaatggcgtgaacccaggaggcagaggttgcagtgagccgagatcacgccactgcactccagcctgggcaacagagcgagactctgtctcaaaaataaataaataaataaataaataaagtcttgttctagtaagtccaatgtctggactttctcagggacagattctgttggctgattttttttcccctgtgtatgggccatacttttttgttttgtttctttgcatgactcataattttgttgacaactggatttttttttttttttgagatggagtcttgctctgtcactcaggctggagtgcagtggtatgatcttggctcactgtagcctcaaactccctgacttcctggcttaagcaatcctcccacccacctcagcctcccaagtagctagctggactaaaggcatgcaccaccactcctggctaatttttgtatttttttgtaaagatgtggtttcaccacgttggccaggcttgtcttgaacttctggactcaagcagtccgcctgcctcagcctcccaaagtgctgggattacaagcatgagccactgcacccagcatggatattttaaacaatataatgaggcagctgtaacaatcagatccaccccaaccctgccaggatttgttattgtttttgtttagtcacttttctaaactatttgtttaaattttgtattctttatcatgtgtggccactaaagcctctgctcagtggtcttagtggtcaactaatgattggacagagatttccttaaatgcctggaacccataagtttcacagcccctactgaggggctctgtgtgttgggtcatgccttcaacactcagccaggcagtttagaattccacttcactttctgttttgccagagcctcaaggttagccataggtggcagcttacaggcttctcaagtctatcctcggcacatgcacagtgctacacgtgtgtggacttttggatgcctaagaatgtcatcagagatttgcaaagtcccctgtgatgtctcattccccaattttcccaattaaacttttggccagcttgttattgcaccaaatgttaccaccacctcaggcagctgtaacatttaacaattgctgctgattgttttcagtaaatgctgtcagggaaaaaggtggtttacactgtatgagttctgagtcaggtcaaagcaagacaagccttgatttgagtaggattctccagggaactgccagacaggttaatggatgacagttatctgagaatggagttttggaggagctccaaccccattctgccctgtccagaggctgctgggctgttggttttcactgtgattgtgggaaattgatttttaaagctaccgtagggctagggggaaggggcagggactaaggcaagttaaagcttcctgagattcaaccatttttcttgaacaaatactccctagattgttgcaaacctttaattaatgttcagagttctggaaaagatttttgaccatttttcccagtgatctctgttcctttatggaggagagtgttcagaggtccttacctcaccattcttactggcatcactcctctttactaatcattttaagctcactttaaatcagtcctctcataagtagcttggctgcctactctactaagaaattttatgccacctacgtttatcttaataattaacatttatgtggcatatcggcattttcacatatttcatttaatcataaatactagaaccaccaactaggtgttagtcttaacaagtgagcaattttcattttttcaggattgcttattagataaaattttatatttatattgtcttttttttttttgagatggagtctccctctgttgcccaggctggagtgcagcggcatgattttggcacactgcaacctctgcctcctgggttcaagtgattctcctgcctccgcctcccaagtagctgggcttacaggcacgcaccacctcgcccagttaatttttgtatgtttagtagagataggctttcaccgtgttggccaggctggtcttgaactcctgacctcaagtgatccgccctcattagcctcccaaagttctgggattacaggcatgagccattgtgcccagcctatatttacattgtcttatgtcattttttaatctctaatagtgctgacaaacttctatcatgttgagtcctgtaaccatagaacttagcccaaagaccattaagatcctctccagctaggtaataagccatacagaagttcaaactgctcccttggccttactgctgcttcttgatgaggttaaatgaaatttatgatttaagctgtgtttacattttaggttatcacaaactgctgactaagagtgtggccgagactccagtgcataagcagatctccaaaaggctgctgcacagacaaatcaagggcaggtgagtgacatccccatccgggcttcttcatacacccacaccacctcaaagcggccttgtgggccactacttcgcttctcttgaccttcatgacttaaatcttaactatgttgcttaaaaccaaagagcattctataagctctccatgggagcaggagaaccatataaaatatacacttgtctggcctcaattattttgagattcatccatgttgttgcatgcaatagttcatcctgttttattgctgagaagtattccatggaatagatactccacggtttttaaatccattcatctgtgaacatagagaaggtggaagtctgggatcccaactcagcctttgctgacagaggtgtgggtggggctgcagttttttctgcagcgattggttggagtagggctgttattgtctgaaagttttctgtcttgcttggctgaccctttcctagttctttggcttgagagctctccttccttggggcatctgtagtttgctcctggtatacctgggttgtcagcttttctggcacccagtctaggggtgtaggcagcaaacagaaaacccagggagctagctcactgccctcctcaggtcccaaagtccccagccaggctgccttcttctctctgcctttcagaattgtctcctgctcattgtatagataatgtcatgggtttttagcttgatttcaagggtaatagaagcacacctccttctattttgtcagaaacccatctcgacattattcgtatatggattttacacacttgtgaagtttataggttaaattgcgaaaagtgaaattggtgggtcagaggcatatatatttttaattaaattttttataacatccttgacacattggcagaaattaaggctcttaaacagaaacttgaatgttgctgctcattactgtgatagtctgatagtttggtataattttttaatatattaatggggtttataattctgatgttgtaaaattgctttccaaaaaataaaagcaaaacaaaaccacattctaaccatctcactctttttctgagtaggaatctcactctgtcactcaggctggagtgcagtggcacaatcccagctcactgcaacctctgcctcccaggttcaagtgattctcctacctcagcctccagagtagctgaactacaggtgtgtgccactgcacccagctatctttttttttttttttttttttgagacagagtctagctctgtcgccaggctggagtgcagtggcgcgatcctggctcactgcaacgtctgcctcccgggttcaagcgattctcttgcctcagcctcccaagtagctgggactacaggcgcatgccaccacgcccagctaatttttgtatttttaatagagtcggggtttcaccatattggccagactggtctcgaactcctgacctcaagtgatccgcccgccttagcctcctaaggtgctgggattacaggcgtgagacactgtggccagcctccctcttgacaataatcacgtatgagagccctttaccagcactggtgttatcagaccctgtgatctttgtgatcttgttaagtgagaagctgcctgtctccttaataagtgttaattacaagtggtatggagtaatccttgtgcatgtggttcctcgaggtcctctgatcctggtcctgatattggtgttgttgaagagtcccctgaaaaaggagatggtgagtgttatctctttttgtttttaatgcaatctacccagcttctatgaaaacctttctgtatgtattgttacttggcatatcctaagatattttacagaaattgtgatggctctgagtccacaatgcagctcagtaaatatttataagtgaatgttcttctgcatagaaggtactgagagaattctggaaaagaaatatttttgcacaacagatatgaaattcaggatgagggctaaactgtgttatacaaagtgctatgacttattttaaaagtatatataactttgttggagcttttcactacatattttttcaagaaggcagggaaattttttattggggagtgtcttttctgagacattatctttgctgctgccccttatgtatctgtgtattccgtgcccccaacacacagtgcctggcacatagcaggtgatcagtaagcacatgttgaatgagggtgagcagcaggtgtggtggttcacgcctgtaatcccagcactttgggaagccaagtggggaggatcactggccaggagtttgacaccatcttaggcaacacagtgaggtgctgtgtctataaaaaatttaaaaaatcagctggtcatgttggcatactcctatggtcccagctactcgggaggctgaggtgagaggatctcttgagctctggagttcaaggctgcagtgagctatgatcgtgcctctgcactccagcctagcgacagagcaagaccatgtctctaaaaaataaaataataaaagtatacatgatgaaggaggggttttaaaaaactaacttctaagttgctcaagtaattcacatttattgtggaaaaaacaggaaacatgaagccaaaaattttaaagcacttggtaattccacaactcagaaatactctaacattttagcatatactcttactgctattatttctatataaatgcatgtaacatatacatacgaaacctaacataaatacttgttttcgccctacaccattcttctttttttttttttttttttggtgagacagactcttgctctgtcgcccaggctggagtgcactggcatgctctccgctcactgcaacctccacctcccaggttcaagcgattctcctgccacagcctcccaagtagctggggttataggcacccaccaccatacctggctaatttttgtatttttagtagagacagggtttcaccttgttggtcaggctggctacaccattcttaaggtggcagtaaataagacttctgaaggtaatagtctagtgggtcagtgtttttttaataccttgttgggaccatgtatcaaacccctcttagtttgttaagagacacttcagaagtctcttaaagctaatagcttgctgaatttccatcttatatgtggtactatgtaaattttgcccggttttggacaacatgagaaaatgtcaagcttgtagttgtctttggttacttactgtggttctgattttacagaaataagtctgagacgaagtcctcgaatcaagcagttgtcatttagcaggacacattctgcctccttctattctgtgtctcagccgaagtctcgaagtgtgcaaagagtccactctttccagcaagataagtcaggtaacatacgggcccctctgccttcacaagtccgtgctgacttggtgagaagtgtttttgggaaaagaagcaagaaatttgacattttctttcttgacattggagaagtagaataggtatgtctagttgaggttcagggtgatggctagatggacagtccatgactttgtaatcagtcatccctaggactcctacaactggtcatccatgctatcattataggtagctcattcattcaagaggaagctacccataatttcccataaggacagaacctacacatcattatcttaggtggaaggtgatatctgtgtttacgttcttcattcttctatccatggttagcttgctaatagatttgtgtttcttattttatctttttttgagacaaggtctcactctgtcacccaggctggagtgcagtggcacgaacacagctcactgtagcctcaacctcccaggctcaggtgatcctcccaccttagcctcccagggaggtgggactacaggcatgcaccaccacgcccagctgattttttgtttttagtaaagactgggtttcaccatgttgcccaggctggtcttgaactgctgggctcaagtgatccatctgcctcggcctcccaaagtgctgggattacaagtgtgagccaccacacccagccagatatgtgtttttatatttacaaattaaagtagttcagttgtctacattttctaacataggagctggggttaatatgccgtcttactaaaattaaaaaaggcagcagttgttgtagttgctgacataaataggtgggattttcccgagttgctctcaaaaattgttgccttctttcttttatgaactggctgggtttttcttatgttttgtttgtttgtttgtttgttttttgagatggagtctcactctgttgcccaggctggagtgcagtggcgcaatcttggctcactgcaagctctgcctcccgggttcatgccattctcctgcctcagcctcctgagtagctgggactacaggcgcccgccaccacgcccagctaaattttttgtatttttagtagagacaggtttcactgtgttagccaggatagtctcgatctccgacttagtgatctgcccgcctcagcctcccaaagtgctgggattacaggcgtgagccactgcgcccggccttgtttgtttgtttttgagatggagttgtgctcttgttgcccaggctggagtgcaatggtgcaatgtcgtctcactgcaacctccacctcctgggttcaagcaattcttctgcctcagcctcctgagtagctgggattacaggcccctgccaccacgcccagctaattttttgtattttcagtagagatggtgtttcgctatgttggccaggctggtctcgaactcctgacctcagaccatccacctgtctcggcctcccaaagtgctgggattacaggcgtgagccaccatgcgtggctggctgttttaatagtattggaagaacaggaattgagaaagaattaaatattgttgctgtttttgacttgcagaccaaagagaaaattctccagtccaaagtattcggtctcccaagagtcttctttttggggcaatgtctgagatgatcagcccctcagaaaagggttcagctcgaatgaaaaagcgttcaagaaacactttggattcggaggtacctgcagcttaccaggtataatgtttctgtaatgtttgaaataatataatctcctggaacacagagacatggccaaggaactcagagtccattagggaagagaaagcaggtgacctctagataatactagagattggaggtgactgggtggagccacatgaatgattattagacacgtgggaacttcaagcagcaggtttgactgaagccacggtgggggcggtggaggaggagatagagaggatctcatctgttctcttggctttgtctactgtttatattatatactgcacagatacctttctggagtgtgtgacactcatcttttccgtttgattgcccactccatccagtcaccaacattagaaacctgggagtcatccttttccctctccccaggcatagccaatcagtcgagtcctgcccattttatttacaaactgactctttttttttttttttttttttggagacagagtcttactattttgcacaggctggagtgcagtggcacgatctcagctcactgcaacctctgcctcccagttcaagcgattctcctgcctcagcctcctaagtagctaggattacaggcacccaccacaacgcccaactaatttttgtgcttttagtagagatggggtttcaccatgttggccaggctggtctcgaactcctgacctcaagtgatccacctgcctcagccttccaaagtgctgggattacaggcatgagccactgcgcccggcctacaaactgactcttgtacccaccccctcttctcccctactgcaattcctaccctagttcaggtctacctggaacacttcaacaggcttttccctctcaaagggaaatcctccacccagaggtcagagtgatctttctgaaacattcctctcagtttgcttaaaatgttcactttgcttaaagctctatagactccccgtccgctaaagcaaggctttaagttttcctaagtggaactcttgggttcaaaaataatcacctttgtttggaaactcagtaaattgcttggaggttgggaaagacatagagctctggagaagggtctgaaaaccatagatctacacaaccaagatcagtctcctcccccaggcaggcagggtcttccgtggtctgttccctctggcctcacccctccccgctccacctccccagcaacatcaggctgggtgccatcctgcacagccactgcttttcacttccaggcctttgctagtattgttttctatgcctacaggccgccaccaccccacccacttttcctgtgtttgccttcccctgccgacacccaagcttgaagacctgatccaggctgggttaggcagcccttctttgtgttctgtgatgcccctcgcatgtccctgtcactgcaccaatcacattgtattttcacctgcgtatgccccactgaacaggaaatgccagctagactgagagtcccctgacgggatgaaggaaggctgtaggaaagataagcattgatttccttacctgttggagcttttcactacgtatttttgcaagaaggcagggaaattttttattggggagtgtcttttctgagacattatctttgctgctgcaccttatatatctgtgtattccatgcccccaacacacagtgcctggcacatagcaggtgatcagtaagcacatgttgaatgagggtgagcagcagatgaggtggctcctggaggctgctttaggcaaagatcagaaatagctgccttatctgaaaagaaggaagagctagagagtagctgcagtggtagaatgattccattagaggcaaaaagcatggtttagcaatatgtagattattaaaattatttgttctaggacaaactaaacttggatagtgtttggtcctagaaaaagtagacaagtaaaatctgagtcatgttttggagagggaaacgggtcactatttgagatttccatctttagatcattcctttggctgactataaatctcccatttggtcttagagattactaaaacacttcagagatcatgagttataatattcaaggactgaaataagcatttctcttttcagactcccaagaagagtcaccagaaatctctgagcttttctaaaactacaccaagaaggatctctcatacaccacaaactccgttgtatactccagaaaggctgcagaagtcccctgcaaaaatgacccctacaaagcaggcagcttttaaggagtccttaaaagactcctcctcacccggccatgactcaccattggattcaaaaatcactcctcaaaaacgacatacccaggcaggagaaggtacctctcttgaaacgaagacaccaagaactcctaagaggcaaggtactcagccgcctgggtttttgccaaactgtacttggccacattcagtgaattccagtccagaaagcccctcctgtccagcccctccaacttcatcgactgcccagcccaggagagagtgtctcactcccatcagagaccctctcagaacacctccgagagcagcagccttcatgggcacgcctcagaatcaaacacaccaacagccccatgtcctcagagctgctcgggcagaggaaccagcccagaaactaaaggataaagctatcaaaactccaaaaagaccagggaattcaactgtgacttcttccccacctgttacgccaaagaaactgtttacctctcctttatgtgatgtctccaagaagagtccatttaggaaatctaaaatagagtgtccttccccaggagaactggatcagaaagagccccagatgtcacccagcgtagctgcatctctctcctgccctgttccctcaactccccctgaactctcacagagagctacattggacaccgtccctcctccacccccttctaaagttgggaaacggtgtagaaagacctctgatcccagaaggagcatcgtggagtgtcagcctgatgcctccgctactcctggggttggcacagctgacagcccagctgcccccacagactctagagatgaccagaagggactgagcctctctcctcagtctcctcctgaaagacggggctacccaggccctggtctcaggagtgattggcatgcatcctctcctctgctcattacaagtgacacagagcatgtcactctcctcagtgaagccgaacaccatggcattggtgacttgaaaagtaacgtcttatcagtggaagagggtgaggggctaaggacagcagatgctgagaagtcttctctgtctcaccctgggattcccccatctcctccttcctgtgggcctggctctcctctgatgccttcccgtgacgtgcactgtaccacagatgggagacagtgccaggcttcggcacaactagacaacctgccagcatcagcttggcattccacagactctgccagcccacagacctatgaggttgagctggagatgcaagcttctggccttcccaaacttcgaattaagaagatagaccccagctcttcattagaggctgagcccctcagcaaggaggagagctctctgggagaagagagcttcctccctgctctcagcatgcccagggccagcaggtccttaagcaaacctgaacccacctatgtgtcacccccctgcccccgcctctcccacagcacacctggcaagagcagggggcaaacctacatctgccaggcctgtacccccacccacggcccttctagtaccccctctccatttcaaacagatggggttccttggacaccatcccccaagcacagtgggaagacaactccagacataattaaagactggcccaggaggaagagggcggtgggctgtggcgccggctcctcttccgggaggggcgaggtcggtgcagaccttcctgggagcctgtcactgcttgagtcagagggcaaggaccacggccttgaactcagcatccacaggacgcccatcttggaggattttgagctcgagggagtgtgccagctcccagaccagtcgcctcccaggaacagcatgcctaaggccgaggaagcctcttcctggggacagtttgggttgagttccaggaagagagtcctgttggccaaggaagaagctgaccgtggagccaaaaggatctgtgacctgagagaagattcagaagttagtaagagtaaagaggggtctccaagttggagtgcatggcagctaccctccacgggagacgaagaggtgtttgtttccggtgagttcgtttttgaaacccagtttcctcatggtttcttttggtcagagtgcttgacaaggaggcacttgggagttgcttcttgggaggcctgggcttcccggttgggggtctggggacgctgctcttactatgtgggatctctttaggctccaccccacctcccagctgtgccgtgcggagctgcctctctgccagtgccctccaggctctgacccagtctccgctgctgttccaggggaaaacaccttcctctcagagcaaagaccccagaggtaatgtttgttgaaggtctaggaccctttcctgtgacagactgtctgaattcaccagggttgccaggcagctcgattctagaggagccccagggagtgccaagtgtgggataggtgacttcgcgcctacagcgtcatgtgtgcccttcccagagaaactccacattagaacttgtgtgcatgtgaacagaagcccctcaaaatcctgctaaaattcctcggtcctcctgaaaatgttgacagtcgtgggcttgccgcaacatgctgctcatctgcagtctaagaatctgaacaggaaggcgttctgagcagcacgagtgataggcctgtttagagctagttccccacagcgggtttatccgcatgttctgtatattcggtgggacacagtactgactgtagttataatcagcctgcaggctctaggattccccttccccttccaaatcctattcccaaaagacaaggatttggcctgttaactgccctggttagcaatgttgccttctgctgctagaatcaaagggggagtgcaggaggagggggcctttggtggttcagttccctcaagaccatgatataaatcatgcaaaacagcataaccccagagatctgagacctagaaagaatacaggatattaacctgagggaattcaaaccacaggtactttgcattttcagagctgcttcttgctgccagcacggtgcatagctgttaagggcagggtccttctaaaaagtgtaggtaccatttctgtaggataagcgaacctccaagcagtgctgattttcttaaagtctgtttttgtgtgtaaccctctgcaatttaagccaatttttttcagttcggtcctctgtgactcctgcatgctaagcctttctaccttcttctagatgaggatgtggatgttcttccctccactgtagaagactctcctttcagtcgcgctttctccaggaggcgccccatcagcagaacttatacacggaagaagctcatgggaacctggctggaggacttatagccacaaacattactgagcccaaaagatcaaggagtcagccaggaccctgtggacataaagaagttggatgcctggtcccaagcctcttttgccatggtcagtgttcagattgccattagaatgccttagggttttctaattccccttatggatccaatccatctcctggccctgccccttgttggggaagttgcaggaggagaggtggatggcaatgtgattggtgctataactcaggcagcctgggagtcaggaacccagacaaggaatcccattccagcctcaccccaaccatgaccttggcaagtcagggggccactctgcctcatttatgcaaatggagaaaggcgccctccctggggtcccttgagctgctgtaaggctgggctgctgcgacacaggcagcgctttgtaaactgtgaagccatatacgtgaaactgaagagtgcattgggcagtggaagctattttttgccttccctgtgtaacagtaaaatcatctctagtgactgagcactcagtacatttttgtttaatgttgggcctgaggttaactgtgaccatggtccagcttgagtggcttctggagcagccacattttcaaggactgtccaagagccagccagttcagggctcaggcctcacccattgcccactcctggggagaccatcacctggctcatcgtttccaccaagagtgccccacaggagtgccccacagacccgctggaccagcctgctgcgggtcctggccaggggtctggctaacggtgagggctgactctgaactgtctctcagtctccagaaagtgttcaagcctgttgtgttcccaaatctgattcctcctattgtcttgtaaatcaaactctaagtgaaaacttcccatttgtcccttcaaagatttttttttattaaatggttttttaagatcctaaagtctcccagtttcccctatatacataagaccatttaaaccacaacctggttaccaccgaccctttcgtgatgattcttggccaaacccctgaactacaagcacatccatttacgcctgaaaccagaattgtcctgagattcgagcaagacacaaggcggcaattgggtaccacagcttcatggaagtaagtggtgggaatttgcatattattttgttaaatgagggtccagttcttttgggccatggcccaaatttgttgatcccagtgagggtacagatgagggcctggatttagggtgtgcggtaaggactgcccttcacagaagcaaaacaggcagctgcccctttcagcaggctcggagtctccctccaaggcagggtctgccccgagggcttacagggggtttttccggacatcaatcatccccgggctggctcgtcgcagttcccgccggggcttggacaaaggcccaaagttccagggcaggcctgcctcacccacaggaagcacccgccccaccaggggctcagccgcctcccgctgcctcagttcctcgggggacccctgctcctcaccacacaggctcgagcgtttccaggtcaagggtaacggagcgtggaccaagtcccgcgtctcctcccgggtgcggggggccccctcagtgaggggggacagccagagaagctcgggtgccaggtggagctcatcttcatttccaggagcctgtctgccctccgagcacaggctcctcttctccccacctgtcatggagagtaacgtgtcctcatcagaaacaggtggcaacaccttcccgaagccctagctccccagtgccccagcacaataagcaacctgtgaattgagccaataaaggctcgagggagagtggtctctaagctttccccaaagaaagggaacaggtctgacttcagagcgcgacgaggagttacccctgctgtggcctacagcgttcacaccgccgagcttctgtttcagttcctggtttatccacatgtaacggcccagttccttctccagagcttgaatccgggcctcatactgcctcctgctgtctgctaacccttcaccgaggtggtctagagtggaaaggtcgaggagagggtggtgagggctgcaggcggggcaggcggccagggctgtgggggtgggggctgtgggctgggtgggggccggggttgtgagcggtgggccgggccaccagggctgtaggtgcaggggctgtgagtggcaggggcggtggggggagggaggggggtgcagggcggggaagatgggggtgggggggatggagggggccggggttgtgagccatgggccgggctgctcacctcgactctgctgcaggagcagctgcatgttctgctcgtgctccttctgctgcagggtcagctggcggtccatctccaggcgctgccgctccagggccacctccagccagtacaccagcctctgctgctcctccagctgcatctccagttccgagaaggcaatctgctgctggtgctgctcctctcggagcgtcaccacctgtcccaagacccagccaggctcagccctcatcatgacccctcttcatccagctaatcctcaatcacagacacagtattggcacacttgccaccacggcactaagaaatcaccagggtcttccctgctgagccaagactcagcctcagacacctcagcagtgctctagttatcttccaacgatcagagctggctctcaccttatctgctatctctgccacaaaccctttcctagccacacactatggagctgggcagagcgtcaagttgtgggatttcatctagaccaacctcagcactatggacatctgggaccagataattcttggttgtgggggcctgtcctgtgtgttataggatgtttagtaacatccctggcctccacccccaccactgtgacaaccaaaagtatctccagccatggccaaatgtcacaaaagggcaaaaacttcccctactgagagctactattgtggccatggaccaccctgaggttagccaatcagagcagaagtggggggcgggtaggaaactgggtcttagtttcacaagtaaaataggctttaaggtcaggcggccctgcagatgagttggtcctgattctgtcccccagtctgggaggaaacgggatatccgctggagcagctgccatgagacacctccccacacgtgccgctgaggaggagctggggggccatgggctgctggcccaccttgtcaaaatacttgcagaggagggctctggtctctgaggatgagaggtagctgagcttggccatgaggttcatctcgcactgggacagcaacgaggctgaggcccgaagcacccgctggcggcatgtgatggcctcattcttatactcaatggcagcatccagggcctcgatggcctcatccaactggaacagcgtccgctcctcctgcagagacgggcacgcgtggaggaacagcacccactgcctgaatgctgaagtcctgggcagacatgcaacagccaacacgtagccacaactgggccttaagggtcccctcgtcccaagggccaagtcagcccatcgagagaggtgccccctgctcactgtcacagccccaaccccagggtgagctgggggcactgctcagaggtggcctgctcaactgcaagcctctgtgaatgatctacattcaggaagttcagagcaccctaaccaaacaaaaggcatggttgggacagccacggaggcaccacggtgtctgctgggtaagcttctacagatggggatacgttctaagaaatgcatcattaggcgttttcgacgtcgtgcaaacatcagaatatactcacacaaacctagatggtatagcccaccacacacctaggctacaagcctggacagcatgtgactgtactgaatactgtaggcagttgttaaccatggtgagtatttgtgtatctaaacatagaaaacgcacagtaaaaatgcggtgttataattttctgggagcaccattgttgtatgagctgtcattcactgaaatgtcacacagcacatgactatagtcacataggctttctctctgctcagggaacacagatgtgtgggcatgaggtgcactgagtatgcgcctgacactccacacacgaagccgagacgtgtgggcaggtactcgaatgcagcacagaacaggagtccaggctccagccagaagagagctgagaggtcagcacagcctggcccctgtgtcccagccaatgaggccaaagcaggggcagaagggccaggccagccctccccagcccccacctccacctaacagtgaaaacttgggtctgccgacagcaaggcccagcacccgcagagggctggagcaagggctgaggagagcagacagacaggcatacaatggcaccaaggggctgagccatggggccgcagggtacctcgggggacagcagactcccctgcctcagcttgccgtcgatctccaggcgctgcttgagcagcgagtccttctcctggcgcaggctgtcgatctccccgcggatctgctgctggctctgggcgctgccctgccgcagctgcccgctcttctcggacagctccttctccaggtgctccagccggctggacactcgcacgatgtcctcgttgagggcctgggggcagaatcaccagggattagagaaggaacaggcactgtcctcacaggggggacagaaagggccggatgttaaggaggacttgcgtccttccctcaagaaaccaacactccaaatgttctgctcagcagggagaccagacttagttcacagagactccaggaggcggggctaaagggaccagagcatttgcagaggggcactcagagatggcgagaggaggataaggaccagagggacgtggccctcctggcaagaacaggcaatgggtaggggtgggaggaatgatctgtcactgagatgaccggactggacagtgataggaattggccaagccctaaaggcctttctgggagccagatgcgggaggaagtgagggctctcctggcggagggaagttacggatcattccagtaggaccctggatcctcctggacatcagagtgatgcgtgctggcaggagcaaggctcctggcctctgcgggcctaggacactgggcgtgtggcccaagcccctgtactggaacaggccctgcatcaatgacggccatccccctccagccatcatggtaacattatgatcccatctgacagaagacaacgctgtggctcagaagctgaccttcctattctagatggagtaatgatgccaggcggagaagtctctttctatttggctataccaccttcctatacctgcgcctcctcattcttcctgcacaggccctgaggagggggttaatgagtgaaatgaattggaggatggacacttaagagaggttcttctatgcatacatctgtaactgtgtcataaatatcttgaagccctacagctcatggggatgcacaggatagaacccagtaggacagagcttcctctgtctggaacttacctggcagagataccacctagaagaaactctcctgtctagacctcgcctggcagggacatcacctggcaggtttatcacttggaaggacctcactttgctagacctcacctggcagaaacttacttggcaggagctcacctggcaagatctgtcctggctggacctcacttcactggacctcacctggcaggatctctcctggcagggcctcacctggctggatctcaggcgcttgctctccagccccgtcttctcctgcatcagggcctccttcttggccaggatggcctcccgcttgtggagctcctcccccagctcctccagcgcccgccgctgctgtagcaccttctccatctcctggtccagccacttcttctgctcctcaatcttctaaggaaaagtagggagggagggagggaactcagggcccacctctggctgtgtcagccgccactcgaggttcactggggagaaaggtgcacccaccagccagcccccaggggagccctgggtgcggacacagcctggccccacctgctgctgttccaggctgaccacagagccgttgctgccactgcgcctcttcctctggaatgccgcgatctcttccgtcttaatcttcaggatcttctgctgttgctcatgcttcagctccagctcctgggtgaggagctcagtgggcagggctgtttatggtgccagcatcttaccagagcctgccaccgatcccaaagcccccaggagtgcctgcccactcccaagagggccctgcgaagtgtcccccagacccatcccacacaaatctccctggagaccggcaaatagacgcaaacacttagaaataagccccacaagatgccagtcacctcatatacctcatctcactgaagtctcaccctggccttgagtttcctataacattccacattttcagatgaaaaaacagactcaggctaagtgacctgctttctaaggtcacgtggctgtgggttgcaaaccctgcctgggctcccctggctgggccgccagctcagcctattggcctggacagaaggtccccaccctgccgtgagcctgaccttgacgcggtgctgccgcttgctcatttctgcctccaggcgccgcttctgctccgtctcctcgcgaagccgcctctgcagctgtccctgctgctgccgcatgagctgcacgttccgctcgagctcctgcagtcgcttctcactctgggccgacagtgacaccagccgctccgtagcctgcttcttctccttcagcacctgggacccacacagtcttcactgggccatgcacggggctaccgcgagcctgccatagtgctgggcactcaacaagggcaggcagatagagggcaaatgggtaggtgggtgatagaccaataataataacagaggccgggtgcggtggctcacgtctgtaatcccagcactttgagaggctgaggcgggcggattacttgaggtcaggagtttgagaccaacctggccaacatagtgaaatcctgtctctactaaaaatacaaaaattagctgggtttggtggtgggtgcctctaatcccagctactcaggaggctgaggcaggagaatcacttgaacccgggaggcagaggttgcagtgagccgggatcgtgccactgcactccagcttgggcaacacagcaagactctgactcaaaaaataataacaggacacaggagccaagatggccgaataggaacagctccagtctacagctcccagcgtgagtgacgcagaagacgggtgatttctgcatttccatctgaggtactgggttcatctcactagggagtgccagacagtgggcgcaggtcagtgggtgcgcgcaccgtgcgcgagccgaagcagggcgaggcattgcctcactcgggaagtgcaaggggtcagggagttccctttcctagtcaaacgaaggggtgacagatggcacctggaaaatcgggtcactcccaccagaatactgcgcttttccgatgggcttaaaaaaggcacaccaggagattatatcccgcacatggctcagagggtcctacgcccacagagtctggctgattgctagcacagcagtcggagatcaaactgcaaggtggcagcgaggctgggggaggggtgcccaccattgcccaggcttgcttaggtaaacaaagcagctgggaagctcgatctgggtggagcccaccacagctcaaggaggcctgcctgcctctgtaggctccacctctgggggcagggcacagacaaacaaaaagacagcagtaacctctgcagacttaaatgtccctgtctgacagctttgaagagagcaggggttctcccagcacgcagctggagacctgagaacaggcagactgcctcctcaagtgggttcctgacccctgacctccgagcagcctaactgggaggcaccccccagcaggggcagactgacacctcacacggccgggtactccaacagacctgcagctgagggtcctgtatgttagaaggaaaactaacaaacagaaaggacatccacaccaaaaacccatctgtacatcaccatcatcaaagaccaaaagtagataaaaccacaaagatggggaaaaaacagagcagaaaaaatggaaactctaaaaagcggagcgcctctcctcctttaaaggaacgcagttcctcaccagcaacggaacaaagctggatggagaatgactttgacgagctgagagaagaaggcttcagatgatcaaattattccgagctatgggaggaaattcaaaccaaaggcaaagaagttaaaaactttgaaaaaagtttagaagaatgtataactagaataaccaatacagaggagtgcttaaaggagctgatggagctgaaaaccaaggctcgagaactacgtgaagaatgcagaagcctcaggagctgatgcgatcaactggaagaaagggtatcagtgatggaatatgaagtgaatgaaatgaagcgagaagggaagtttagagaaaaaagaataaaaagaaatgagcaaagcctccaagaaatatgggactatgtgaaaagaccaaatctacatttgactggtgtacctgaaagtgacggggagaatggaaccaagttggaaaacactctgcaggatattatccaggagaacttccccaatctagcaaggcaggccaacattcagattcaggaaataacagagaacgccacaaagatactcctcaagaagagcaactccaagacacataattgtcagattcaccaaagttgaaatgaaggaaaaaatgttaagggcagccagagagaaaggtcgggttacccacaaagggaagcccatcagactaacagcggatctctcggcagaaactctacaagccagaagagagtgggggtcaatattcaacattcttaaagaaaagaattttcaacccagaatttcatatccagccaaactaagcttcataagtgaaggagaaataaaatactttacagacaagcaaatgttgagagattttgtcacacccaggcctgccctaaaagagctcctgaaggaagcgctaaacatggaaaggaacaaccggtaccagccgctgcaaaatcatgccaaaatgtaaagaccatcgagactaggaagaaactgcatgaactaacgagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggagcaattcaacaagaagagctaactatcctaaatatacatgcacccaatacaggagcacccagattcataaagcaagtcctgagtgacctacaaagagacttagactcccacacattaataatgggagactttaacaccccaatgtcaacattagacagatcaacaagacagaaagtcaacaaggatacccaggaattgaactcagctctgcaccaagcggacctaatagacacctacagaactctccaccccaaatcaacagaatatatatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaactaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccactagcaagaaaaaaagagagaagaatcaaatagatgcaataaaaaatgataaaggggatatcaccaccgatcccacagaaatacagactaccatcagagaatactacaaacacctctacacaaataaactagaaaatctagaagaaatggataaattcctcgacacatacactctcccaagactaaaccaggaagaagttgaatctctgaatagaccaataacaggagctgaaattgtggcaataatcaatagcttaccaaccaaaaaaagtccaggaccaaatggattcacagccgaattctaccagaggtacaaggaggaactggtactattccttctgaaactattccaatcaatagaaaaagagggaatcctccctaactcattttatgaggccagcatcatcctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatac

SEQ ID NO: 1043 - DNA, 48285 bp, Homo sapiens
tggaatacagtggcacaatcttggctcactgcaacctccgcctcctgggttcaagtgattctcctgcctcagcctcccgagtagctgggactacaggcgtgtaccaccatgtccagctaatttatttgtatttttagtagagacgggttttcaccatgttggccaggctggtctcaaactcctgacctctgctgatctgcccaccttggcctccccaaatactggattacaggcattagccaccacactcggcctcctccttttcttataaagccacctggggtccctatcctgatgacctcatctaatcctaattacttcccaaaggcctcctccacaccaggcctcctccttttcttataaagccacctgggggccctatcctgatgacctcatctaatcctaattacttcccaaaggcctcacctccaaataccaacaatatatgaatttggggattaagtttccaacactagaaatttggagggcatgttcaaaccatactaaaagccagcttttagtataagcaaaccaaaatgtagtatgatatttgagcaaatggtacaggattttgaccattctctttcaaatgttcgagttcagcaatgaaagattacatttctttttccaaagactcaatcattatatagttgtatatattgttaaaaatagtagtatttttgcctgggtgcagtggctcatgcctgtagtcccagcactttgggaggctgaggtgggcagatcacctgaggtcaggagttcgagaccagcatggccaacatggcaaaaccccgtctctactaaaaatacaaaaattagccgggcgtgttggcagatgcctgtaatcccagctactcaggaggctgaagcaggagaattgcttgaacccaggaggcggaggttgcagtgagctgagattgtgccattgcactccaacctgggcgacaagagtgaaaactccatctcaaaaacaaacaaacaaacaaataaaaataatagtattttaaacactatatccaagatcaaggtaccagctaaaaagaaaaaaaggaaaaaaaatttttttattgcttttttttaaaaaggtgtggtcttgttatgttgcccaggctagtcttgagctcctgggctcaagtaattctcctgcctcagcctttcaagtagttgagactataggtgcatgccactgtgcctggctttagttttcaaattttagaattaatcgttacacaagtcactgaatttatacttatggaatgtaaatgtcctaaaccataacaatgtgtattagttagtgttctccagagaaagagaatatatatattccaaatatacatatatatattccaaatatacatatatatatatattccaaagaaatagaatatatatatatgtccaccatgtatacacacatgctggacaccccagaaaagcctgcatttcagtgtaggtctaaaggcagggaaacaaactgatgtctgaattcaaaggctgtcaggcagccagaattctcttttttgcgggggaaggtcagcctttttgttccattcaggcctttgttctattcagctgattggatgaggcccactcacattaggaagggtcatctgctttactcagttcactgataaatgataaatcatccaaaaacatcctcacaaacacacccagaatagtgtttgaccaaacacctgggcacaccctgtggcccagtcaagttgacacatgaaattagtcatcacacaatgtaatggcaggtagggaggagggaggagagaaggggagggcagtataaggatccacatctccccattttatacagtggggagacactagaacttcctagccctgatggattaaaaaatgtaattcaatggatattataaaaagttatgcaagtaaatactagaagaatgaaaaatataacaaaaattgagaggtatggaggaaaagaaagtgagaggcagatcaatgcactaaattcctcatcttcttcttcttattattattatttttgagacagtcttactttgtcacccaggcaggagtgcagtggcacaatgttgactcactgcaatctctgtctcctgggttcaagcaattctcctgcatcagcctcctgggtagctgggattacaggcgtgcactaccacacccagctaatttttgtatttttagtagatatggggtttcaccatgttggccaggctgggcttgaactccggacctcaggtgatccgcccgcctcagcctcccaaattgctgggcatacaggcatgagccactgcgcctggccatttcttatagcaggtgtgttagtccgttcttgtgctgctataaagatatccccgaggctaggtgatttataaataaaagaggtttaattggctagcagttctgcaggctgtacaggaagcgtggtgccagtgaagaggagctgacgtctcacttggcaagagttggaacgaaagagagagtggggaggaggtgccacaagcagatctcaggagcgctcactcactatcgggaggacagcacccagggaatggctctaaaccattcatgagaaatttgcctccatgatccagtcacctccaaccaggccccacctccaatattggggattacaattcaacatgagatttggaggggataacatccaaactatatcctcaggaaataacagatacttctgaagctgataaaacaagataagtatatgagagttatgctgtgaccatcagggccaaaaccagaaattggtaacaatggtttcttctgggtcgtgccactgagtattgttggggaagaaggagagattttttttttcacttgctatttttccatactattgaaattctttaacatgcatgcatttctttcataattacaatatagtgtgattttattttgtaatttttgactccttggagtttgataactagctggtctggggagccattgagctagacagtctctggaaatgtttcggagtttaaaactcctgtgaccccagcagagtcacaggcaggggcgaagtgcctactggtagttctgtgggttttgatgtaaaaacaagtctttagatttttttttttttgcttaaatgtttgcttaaatgatcttctaagacagctaaatgcaattaaaagaacaatgttttgagattgcttaatgagttttttaaaatacaagtcttgactgggtgcagtggctcatgcctgtaatcccagcactttgggaggctgaggcgggtggatcacctgagattgggagtttgagaccagcctgaccaacatggtgaaaccccatctctactaaaaatagaaaattagccaggcgtggtggtgcctgcctgtaatcccagctactcgggaggctgtggcaggagaatcgcttgaaccagggaggcggaggttgcggtgagccgagatggcgccattgctctccagcctgggcgacaagagcgaaactctgtttcaaaaaaaataaaaacaaaaacaaaaacaaaccaagtttttatttccaataaaagtgaatttaacttatttaattttatttacaaattattcccaggtctagctttgactttaaaaagtgaattttaaatgttaaacatatgaattattctaatttgtattataaacttaaattttcctctgaaaatcaaatcaaaagcagggaaaagcatgccagtaatgaaaagaaaccaaaacaggtacagctttgcatcctttcttcaatttaatgtttaaagatgtaaccgcccaaagggttcaccttgcctgctgcctagacagaaccgatttgtcaagacagtggaattgcaatgaagaaagagtaatttcactcagagctggctgtgagggagacgggagttttattattacttaaatcagtttcctcaagcatttggggatcagagtttttaaagatagtttggtgctgggtgtggtggctcacgcttgtaatcccggcactttgggaggctgaggcaggcggatcacctgaggtcaggagttcaagaccagcctggccaacatggcgaaaccccatctgtactaaaaatacaaaaaattagctgggcgtggtggcacttgcctgtaaacccaggtactcgggagattgaggctggagactcacttgaacccaggaggcggaggttgcagtgagctgagattgtgccactgcactccagcctgggcaacagagtgagactccatcacaaacaaacaaacataatttggcaggtagggtctcaggaagcagagtgctgattggtcaaggttggagatggaatcctaggggggtcgaactgaggttttcttgctgttttctactcctagatgggatggcagaactgattggcccagattaccggtctggatggtgtcagctgatccatccagtataggatctacaaaatatctcaaacactgatcttaggttttacaatagtgatgctatccccaaaagcaatttggggcggttcagactcttggagccagaggctgcatgacccctaaaccgtaatttctaatcttgtagctaacttgttagtcctgcaaaggcagactggtccccaggcaagaagggagtcttttcgggaaagcgctattattaattttgtttcagagtcaaactatgaactgaattccttcccaaatgcccagcaatgaacaaggacagcttaaaggttagaagcaagatggagtcggttaggtctgatctctttcactgttataatttcttcagttataatttttgcaaaggcagttgaaactgtgtctttgaaaagacacagcagaaacatctgttacataaacaacagaaatgaggaagaaagtatctgactcagtagcaaaggaaatccacagaaagaatgttctgagaacggaagcaatgatcagaccaggtagggatatgatagaaagaaaattctcatctaattcaaattctggccagtccttttggtgatttccatactaatactaggcactttaaaatgtgagttctggtaacacatggaacctcaaagtagaaatgtctgttgttcatttttaaaagactatttgcagagttttgatgtttatcaatgaaaagagtttttttttaaaatttatgaagaatagggaatcctatatgggcatggggcaaataatcaaactgttttaatgcagaaaaaaatgtgcaacagaaagagatagctcatggagggataaagactttattctggaccctctagattctgtggggcctgcagtagcttcaagatgccccagcatgtcctgcgcccacacccctgtcaagatcactgtggtcagggcgtcttgcccatggccagtgtattagtctgcttgggttgccacaacaaaataccacagactgaggttgaaaacatttattttctcacagttttggaggctagaagtcctagatcaaggtgccagcagcgttgcttcctctgaggcagctcttcttggcctgtaggtggcgccttcttgctgtgtcttcacatgggcggcccctcagtctgtgtgtctaggtcctaatcttctcttataaacacaccagtcatactggattagggtccatcattttaccttaacggcctatttaaaggccttatctccaaatacagatgcattttgaaatactaagggttagtacctcaacatctgaattctggggggacacacttcaacccataacatgcaggcagacctcaatgctgcttgcagacccaaggcgaactgcacaacaatcaagcctggctcttaggacaaaaacatctgccagagtcaaccaaactgaattctctgggaaggacgagatgcctggtgtcataaaaagaccatagtcttttttaagtgtgatgcatgcgcacacaggcacgcatacacacacgcgcacacacgcgcacacactgcactgctgccctgtccttggcagacattcctgtggggtcatgttcgaaatatgcacttctgtggagtagcttgggttttcttggaagtctctttttctaaacttgtacctaagctgatggcctgtgcctgcttgggcatgaggggtcggagtggggatgggtcaagactgactcctgttcactgtgaagtagaggaaggcagtgatagccagacagggacgtgtgtttagggaagtcctctgtgttttcagttctgtttttgttttgtttttatgatgggagagatgagcaaatataaaggctgcttctaggagcaggagtgaggagaggttgcctatatgagagaaacgggatggtcaatactgtaggtttttttgagaaggtgaaatatggaattcattttttaaattttttaaatttttttttttttgagacagagtctcgctctgtcacccaggctggagtgcagtgatgtgatctctgctcattgcaacttctgcctcctgtttatataaacaggccaaaccctgtatgtatgtatgtatttatttatttttgagatggagtttcgctcttgttccacttgttgcccaggctggagtgcaatggcacgatcttggctcactgcaacctgcaactcccgggttcaagcgattctcctgcctcagcctcccaagtagctgggattaccagcactcaccaccacagccggctaatttttttgtatttttagtagagacggggtttcaccatgttggccaggctggtctcgaactcttgacctcaggtgatccacctgcctcagcttcccaaagtgctaggattacaggcatgagccactgcacccagccgaaagatggaattcaaagaagtgctggtaagtcactgtggtatttgtgaaaaaataaaaataaagagggtttgggctaggcgcggtggctcatgcctgtaatctcagcactttgggaggccaaggggggtggatcacctgaggttgggagttcgagaccagcctgaccaacatggagaaaccctgtctctactgaaaatacaaaattagccgggtgtggtggcgcatgcctgtaatcccagctactcgggaggctgaggcaggagaatcacttgaaccgagaggtagaggttgcagtgagccaagattgtgccactgcactccagcctgggcaacaagaggaacaagagcaaaactccatcaaataaataaataaataaataaataaaaacagggtttggccttgggcaggatggaccgttttctagaaggacagccgtggtgcgctgcacaactggtatgaagcccagtttccatctgaagtcctcgatgttcatggaaataggggcgagacagtctgaggagtgtgaagaaggcctgaaaatatccttgcagagaacaggagagacaatgactgggacagccaggcagggctgagggcccatttgaatttcccgcagtgccctctgtcctgttgtgtgacccctccagcagtaggtactgggaaagcaggtggctgagttcatccaggactgaggctctgccagacaagaacagtgcagcaaggatgttgaaggtaatggcaaaaaataactggaatgcagagaaatgaaatcaaagctgatgaggagggaagggaagagaggagagggcagatagacttgggtagagaggacagaacaatgacagggcaaactggtgatgttgaggaagagtcacagggagcagctaaacaagccagctgcagggatggcactgtgtggctggagagcagggttctggagttatcggtttttccatgtgtgacatgggcctgggtgggtgaggctgagtgtagaagtcttacatttccagtcttgtcactcctctgatgagtttcagaccaatatatccatctgcctagatgtcatttctccttggattcacatgctccaaaccaaactcctgggctcagacatcaaagccactcaaaaatagctctctgagaaatagaactaccatatgatccagtaatccaacttttgggtatagacccaaaagaattaaaaacagaatattgaacagatatttgcatagctttattcacaacagccaaaggtgggaacaacccacatgcccatcaacagacgaatggataaacaaaatgtgctatatacataaaatggaatctttttcggccttaatgaaggaaggaaatcctgacacatgctacatggatgaaccttgaggatattttgctaagcaaaagaagccagacactaatggacaaatactataaaatccacttatatgagatacttagagtagtcaaatttagggacagaatcagatttgcaagataaaaagtttctggaaacgtatttcacaataatgtgaatatgcctgatactactgaacacctcaaaaagggttaacacggggccgggcgcggtggctcatgcctgtaatctcatcactgtgggaggccaaggtgggcagatcacctgaggttaggagttggagaccagcctggccaacatggtgaaacccggtctctgctaaaaatacacacaaaaaaattagctgggcatggtggcaggtgcctgtaatcccagctacttgggaggctgatgcgggagaatcgcttgaacccgggaggtggaggttgcagtgaaccgagacagggccattgcactccagcctgggcaacaagaacgaaattccgtctcaaaataaaataaaataaacaataaaaataaagggttaacatgggggctgagcacggtcagcgagagaatcacttgaggccaggagtctgagaccagcctgggcaacagagaacgctgtctctacaaagcataataataaaaaaatgagccaggtgtggtggcatgcacccgtggtcccagctacttgtgaggctgagatgggaggttgagactgcagtgagccgtgttcgcatcactgctctccagcctgggcacagagacactctgtctctgaaacaaacaaaaaaagaggggctaacatggtaaatttcatgtttcttatcaagtaaaaaggcttgctgacccacaatctatattaggtttccctgttactagcaaggagtgaaggatgtgctatcccaaaatatgtccaaaaattggtatattattttgagctaaaaacaccggagaaattgtagtttcagaaagggctagatgacctgtcgtttcctacagggaataagcagtaaagattcctctgggagtggcaccctctctgtacccgggtcagaaaatagcccttatcaccagagactgggagttggggctgcaatggacctgaataaatgaacttcccaagtaacacttaccttccactaattttacaccctccccaatatttctcctagtgactctcttagaaatgtatcgccccagccagatgccttttgtgctttcttctcaaatgcatcattctttgtctaaaaagtataaaagcatcttgctgtggccacttcttcagacctcactctcttttgaaggtccccatgaaaaactaataaagtgtgtatgcttttcttttgtttatctgcctcttgtcaattcggtttctggctccagcggaagagcccgcagaagcgctgaggggactggagacggtctctggcgcccctacacctgctcagtgagccttcagccccttctccctgacgaagctcccagaggctggaactctggcgcgggaggcacttgggaaatcctcccgaaagcaaggaggagcctttcctagaccgggagcggtcccacgcgggggtacaggttggggcaggggcgaccgagccgggcacaggaactcgcagcagggtagggttggcggctacgccgccctcggtccgcggggaaccacgcgggcttccgggtcacgccgccgcgttccgaccgccctcggggagaggggaggagcctccagcgccgggcggggcgtggttaaggccggtgggccccaccgcagccagacgctgcccgtttaagcgcagagggccgcgggtcacgtggtgggcggggtgggggcgtggcaccaggaagcggcgtccgcgccgggcccagagccgcagccgcagccgccgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtccggcgcgcccgcgcttcctcccccgcgcggccctgccggggtcgtgggcgcgccaaggccggtcccgcgcgaccaggcccgagcgtcccctcctgtcctgtcccgtcccgtcccagcgcgggaggcggcgcgcgctccttccttgttgggtgggctcagccgcggccaggtgtcctcgcaggtgacctcggggctggacccccgagccagctgcgcggatgcagtggccccgtggccagtgtctcaattgttggcgcgcccgtcttatctaggcttcttttgttgtgtttgtcattagttacactcgtagtcaagggtttagacgtcgagattttcattttccttgaaattttgtaaagggggaaaagactgtacttcaggcgtatcagcggcgccgatgcgcgaaccggtgttagaacttggagcctcgggaacccgacccggtgtcacggtggcatccttttcgctctctgctcttggtttttaaaattcacctgagcagccaaacatctgtaccttgatatgtgccgtgttactttagttgaacccagggtggtgtataacagaaataatcgcttgcgggttggcttctgagtttagatcctttcagagttcaggctgttaaccttgctgcttttccctctcaggtttttgctgttcgatctggtggagctactggcgtggtagttaaaggcccagatgataggaatcccatctcatttaggtaatggtatagacactttcagatcattttgtcatgtaaacagaatgatgtttttctaattcaaatggttttttataattttgtcatttggtctgccctaagaggcctgaagtctgtgtgcgcacatggaattcctgtctgtagggagggtcttcgtggcacttactagcacctcttgtcagagtggaatatctggagcagttgatttgggagccaaatacttcaaaagtggggcagccacttcctagcactggaaattaacaagtcagcgtgatgatgtgcccatttctggtttgttcacagaggagggcgttcatttctttagcccaggtctttccagagtggcaggtggaggagattcattgtttctcatgtaataatacaagaaaatcatggcttccactatacttaaggtgactgcatagtcccagttcgcactgttgaacaggtttaatgatcaacagcagggcctttcactttcagaagtgtctcgatttggatgataagctatctggccactgtaacactggtgcttacagaaggtgaaagtataatgtaggccctcaattcagtagtgacttaaaaaattttactgttggtctgtgttaatgagaaactgtccttttttgagagggagcctccctctgttccccagggtggagtgcagtggtgcgatcttggctgactgcaacctccgcctcccaggttcaagtgattctcctgcttcagcttcccaagtagctgggattagaggcgcccaccaccacgcccggctaattttttttgtatttttagtagagatggggtttcaccgtgttggccaggctggtttcgaactcctgacctcaaaacgatccgcccgcctcagactcccacagtgctaggattacaggcatgagccgctgcacccggcctgagcaaggttttaaagtatggatggggttcgagcatggtgttttggggaactctgggtctgtgtaactgaaggttacatagggtgtctccacagggaaggggaaatggtggtggtgtggccactggcaggggccagcttgaaccttacatattctcctatgaaattagagctttatcttcttattgaaacttatcaggtggggtgtgggatgatcatgtcagtgtttggcaagatcatgctgttcacagcacggaggctggcttagttgggagcctgtcagagttagggatgctatggagagtagcaatcagcgagccatgtgtggtgaagagcagcgctctggtggtgtagagtggcattgcataggcaatcaagggatacttaggaagatgggtctctcgtaagacccgggggtcggttgggtgtggaaaacgagtgagcccgtgataatctagattgggggctctaagaagtttgtgggtggggggaaggtactgaatttaacttaaaaagagtttttagactgggcgcggtggctcatgcctgtaatcccagcactttgggaggccgaggcgggtggatcacttgagatcaggagttcgagaccagcctggccagcatggtgaaaccctgtctctactaaaaatacaaaaattagccaggtgtggtggcacgtgcctgtaatcccagctactcggaacgctgaggcaggagaatcacgtgaacccgagaggcagaggttgcagtgagccgagatcatgccactgcactgtagcctgggcaacagagcaagactccgtctcaaaaaaaaaaaaaaaaagatttttaaaagcagctttattgaggcatagttgacacataataaactgtacacacttaatattatgcaatatgtgagttttgacatgtatacacccatgaaaccatcaccacaatcaaggcaatgaacatgttcagaccccgaaaagtttccttgggcccttctgtaatccatcccttgagttttttttttttaaatgaatttttaatttaaaaaatgtatgtattggaatagagacggggtctcactgtgttgctgaggctggtctcgaattcctgtgatcctcctgcttcatcctctcacagtgctgggattacaggtgtaggccgctgtgcccagctgagttcactttttaacatctgtctgaggcggtcatgagacactgtagtggagccatctgggttgcataatgaatgtgctgtgagatgcacaagtagatagttctttccagaagctttgctgtgagagagaaacagcagttacggagaaggctcctgagcgggtctatagttatttatgttggaacaattctcaggtgatatgtgtgtgtgatctgaattcttcaatcacttgttacccataatactgtaagtttcccagcaagttctttccagttggatttggtagtttgaaaagaggtcctactgatggcttccgaaacataattttaattttagactagaatttgctgcctcctgaatatagattgtgtcttttgccttttcaataaatggtagtagctagaattcggttatttaactactaacacaatctttcttcttaaagaatggatgacaaaggagaagtgaagtgcattaagttttccttagaaaataagatattggctgttcagaggacctcaaagactgtggtaagacttatctttaaaatacagcattaaagggcattagaaatacatttggaagagaaggaatcgcaaattttcagtgttaaaggaaacttttattatcttactgttgtgaaaggtatagttatgttgcattgtattagagccttcaaaaacgaaaaagacatttgagtgggttaaaaaaatgaccttagtttgatttttaaattaaattaaaaatttttttttgagccagtcttcctttgttgcccaggctggagtgcagtgatgtgatctcggctcactgcagcctcgatctctcaggctcaagtgattctctcgcctcagtctcccttaaaaattgttaaaaaataatttggaacttcatgtgtcttttgtattgcttgatagcagcatagaatatgtgaggtatttttggctactttgtgaattagccttttcatctctcatttctgagtgctagatctgataggagcagatattccaagttgaagcagcctacaggcactttagcccgtgtaaatgttcaccattgccgtttgtagagtagagggaaggctgttagaaacaggcagaatcctctgttagtttcttccatcagttttaagtgttaaagtcttggggaagcctcttagtgcagcaacacatttctctgacatcagctgcttgaggaatgaatttttgaaaggagttactaaactgtaactgaatatttgtattaacttaaaaaaaattgaatcgtaagcctgctgctgttgagacagatgatccgaattggtctttttatctttcctgtgttttggttgtcttcagttattttctggtcactttttaagttaatatttatttttcttgtcttgtagtatgccaacgtaggttggcagtatgctgcctaatccaaatttgtgtgtgtctgtgtgtttttcctttcaggatttttgtaattttatccctgataattcccagctggaatacacacaggagtgcaaggtatgaccccaggccctttctcagctgctggtgtcagtggtgttgagctgggttatgtagtggagagcggggcattggggtcgcagggagcacagacttgaagtcagactgtccctcatgttgattcccaaactggagtcaggcggggtgtttgctttgtgacactgaacagttttctaagtttgaaagcttgttcctttggagggggagggttcaatggatgatgcgtggtgaacacccagtagtgctagcccttggggctgtcgtctgtcttgccctttttctcctcactgggctgacagcacatctgggtctgggccctgggatgcctcacagccacctggagtggaggtttctggtgaggagtttctttttctgtttcctgaagtttcctttcctcaatttgttgtctttgtcttgtccttactctttctttcttctcctaggtgttgattctaatccacattaatgagatttgctgggtgtagtaaactaggctagagggagctgagctaaaattggcagtgtggcaccttgggcgctgacagaagctgctagtggttggggtagggctttctgcatttttgtgactgttttgctcaatggagttcagggcggactctttggtgaggagaggtgcatccccaccactgtcctgcctgccctgcagtggccccgtgtgaagagaccctcagcccggcccttctcaaacctgtctgccctcaagcgagtcgggtgtgtgtctcagggtcctcaacccattttagtcaacactcactaaagacccttaggcctttgtacatttttaataaccatttttataacgtgggtgactaagaatgttggcagtatggtgattcctgcaggtagaagctgctgtctgtgagctctggtcagttacttttctacaaaacacagacttctcctgttctgtttagtagaaggaattaggattcaggttcttgaatgaagagttatgggcaaaaatcagggaacattgtatttaaaagaaaatttgttttgttaattagtaaacattccggggaacgttcattaaagaatgacaaactgcagagtttgtgaagcttttgaagagagttatatgtgttttttcttattaattaaaaatatttttaaaaaatttttcttagactaagaatgccaacattctaggattctgctggactagttcaactgaaattgtcttcataacagatcaaggaatcgaattttaccaggtattatgtttatcatttatgtttgttggttaaagttcagtgatagcattctggcagccttttgaattcagtactgaatatatatatatatattttaaacattttctagagatggagtcttgctctgttgcccaggctgcagtgcagtggcaccatcatggctcactgtaatctcaaactcctgggctcaagcaatcctcctgcctcagtctcctgagtaggtgggactacaggcatgtaccaccatgcctggctaatttttctttttattattttattttattttattttatttttgagacggagtttcgctcttgttgcccaggctggtggagtgcaatggcgcgatctcggctcaccgcaacctccgcctcccaggttcaagcgattctcctgtctcagcctcgtgagtagatgggattacaggcatgcatcaccatgcccgggtaattttgtatttttagtagagacgggatttctccatgttgagactggtctcgaactcccgacctcaggtgatccacccgcctcggcctcccaaagtgctgggattacaggcgtgagccactgcgcccggccctggctaatttttaaacttttttgtagagacgaagtcttgctatgttgcccaggctggtgtcaaactcctaacctcaactcctgccttggccactcagctttagtctcttgctggggattttattctttttttttttttttataattgcaagtaataaattaaaaaaaaaaaaaagaaaagaaaaagggcttggtggcccatgcctgtaattccagctctttggaaggccaaggtgggtggatggcttgagtccaggagtctgagaccagccaggccaacatgatgaaatcccatctctataaaaaatacaaaatgttagtcaggcatggtggtgtgcgcctgtagtcccagctacttgggaggctgaagtgggaggattgcttgagcctgggaggcaggaggttgcagtgagccaagatcacagcactgcactccagcctggatgacagtgagaccccatctcaaaaaaaaaaacaaaaacacaacaacattaaaaagtgggcaaaggccaggtacagtggctcacacctgtaatcccagcactttgggagaccgaggtgggcagatcacctgaggtcaggagttcgagaccagcatggccaacatgacgaaaccctgtctctattaaaaatacaaaaattagccaggttggtggcaggcacctgtaatcccagctactagggaggctgaggccagggaattgcttgaacctggaaggcggagcttgtagtgagctgagatggtgccactgcactccagcctgggcaacagagcgagactccgtctcaaaaaaaaaaaagtgggcaaaggacatgagcagacactttttaaaagaagacacacatgcgaccaacaaacataaaagagctcaacatcactgatcattagagaaatgcaaatcaaaaccacaatgagaaactatctcacactagtcagcatagccattataaaaaagtcaaagaataacagatactggcaaggttgtggagaaaagggaacccttatgcactattgctgggagtgtaaattagttcaacctttgtggaaaacagtatggcgattcctcagagagctaaaagcagaactactgtttgacctagcagccccattactgggtgtaatatgcagaggaatataaattattctaccataaaggcacatgcacgtgaatgttcattgcagcactgttcacaatggcaaagacatggaatcatcctaaatgcccatcagtgacagattggataaagaaaatgtggtacatatataccatggaatactatgcagccataaaaatgaacaagatcatgtcttttgtgggaacatggatggagctggaggccatcatccttagcaaactaacacaggaacagaaaaccaaataccacatgatctcacttctaagtgggagctaaatgtaagttatgaatgcaaagaaggaaacaacagacacggggggctacttgagcaggggagggtgggaggagggagaggagcagaaaagataactattgggtactggacttaatacctgggtgatgaaataatctgtaccacaaaccccgtgacatgagtttacgtatgtaacaaaccttcacatctatccctgaacctaaaagttaaaacaaaaaacattcaaacattgcaagatatgtaatatggaaagcaaatgttccctataatcccgataaataattattatgaacagtttggtgcatattcctctatttttaaaaataaatacaaacttctttttaacaaaaaggggaatgttgtatataaacttttgcagctagctttttttttttttgtccaaagtgtatcttggacatctttctatattttattctgactgggtagtattccactgtatggatggactgcagtttaaaaattttcttgttattggacattggctggttttccatttttttgtgattacaaataacccttcagtaacatgcttgtacacacttctttatattagagggagagttgcagtataggtacgaacatctgaaaagctgaaccagtatcgccaaatttcttctagacatgtgtattttcactagcaatataggaacttctgcttttcatacctttaggaggactggatattatcagtctatagacatttgccaacctgagaggtagaaagacttttttttttttttttttttctgagacagagtctcactccgtcgcccaggctggagtgcaatggtgcgatctcggctcacggcaacctccacctcctgggttcaagcaattctcctgcctcagcctcccaagtagctgggtctacaggcgcccagcaccacgcctggctaatttttgtatttttagaagaggtggggtttcaccatgttggccaggctggtcttgaacccctggcctcaaataatccacctatctcggccccctaaagtgctgggattacaggcgtgagccaccatgcctggccgaaagacattttaatttgcattttacattactagggaagtaagcatcttttcatttgtatattgtccatttgtattttgttaacttcctcttaaaatttttttattttgtaataattattttgagacaggatctctgtcacccaggctggagtacagtggcacaatcacggctcactgcagcctcgacctcctagcctcacgtagtcctcccacctcagcttcctgagtagctggaactacaggtgtgtgccagcacgcccaacttaatttttttttcctttttttttttttgtagagatgaggtcttgctgtgttgcctagactggtcttgaactcctaggttcaagccattcttctgccttggcctcccagagtgctgggatttatgggcatgagccactgtgtgtggtcaaaaatattttttttactgtggtaaaaaaacatacaacatttattatcttaactgtttttaagtgttcagttcagtagtgttaagtatattcattcacattgttatgaaatagctccagaacttttttcatcttgtgaaaccaaaactatccagtaaacaactccccttatcccttccctgcagccccagcaatctctattttactttctgtttctatgaatttgactcctttttttttaagatggagtcttgctctgttgcccaggctggagtgcagtggcgtgatctcagctcactgcaacctctgtctcctgggttcaggcgattctcctgtctcagcttcctgaatagctgggattacaggtgtgcgccaccacgcctggctaatttttgtatttttggtagagatgggatttcaccatgttggccaagctggtcttgaactcctgacttcaggtgatccactcacctcagcctcccaaagtgctgggattacaggcgtgagccactgtgtccggccgaatttgattaccttttatacttcatataagtgaaattatacagtatttgtccctttgtgactggcttatttcatctaccataatttcctacaggttcccccatgccatagcatgtgatagggtttcctttttaagactgataataccgcactgagcgtatacaccacattttgcttatccattcatctgttgagggacatttgggttgcttctgcctcttggccattgtgaatagtgctgctgtcaatacaggtatgcagataccgcttcaagatcccgttttcagttcttttagatttatacccagagtgagattgctggagcagatggtagttctgtttctgaatattttagggaaccgctatactgttttccatagcagttacaccattttgcaatccctccaagtgtacaagggtcccagtttctccatatcctcaccaacacttgctgttttgttttgttttgtttttgatactagccatcttaattgtggttttgatttgcgctctttgttgattagtgatgttgagcacttttgtgtgtgtgttttggccactttgtgtatcatctttggagaaatgactaattcgggtcattgtgcctatttttaaaatcaaattactattatttgttgaattgtagttctttatatattctgatattaacaccttcttagagatacaatttgcaagtattttctccgaatccggaggttgcctttccactctgtggattgtgtcctttgatgtacctgcctgtttcttttcatctgttccagcttcctgacctattaagcatgcttctgagatctctaaggggaactaatttagagggtgttaagagttctttcaggttttaattttgttgacctaatgaaagtcatataatttagaatgtatggttagagaaaatacacctgtgtgttaatgccatggtgctttgctgtaaggccatcatcgaaatcttagtaatgactggctgggcacggtggctcatgcctgtaatcctagcactttgggaggccgaggtgggcgatcatctgaggtcaggagttcgagaccagcctggccgccatggcgaaaccccgtctctattaaactccatctttactaagtgccgtctctactgtctcaaaataaaaatacaaaaattagctgggtgtggtggtgggcgcctataatcccagttacttgggaggctgaggcagaagaatcccttgaacgtgggaggtggaggttgcggtgagccgagattgtgccactgcactccagcctgggcaacaagagtgaaactccgtctcaaaaaaaaaaaaaatttgtaatgaccaataggagaactttaaacaaactttagacaaattccatacacacagaaatagaattttgtacatgtgattgcatgggaaggatggcttgctttctgggggagttccctatggtaatcatttaaaagtctgtctttctgttctctgcagtgggaaagtataccttaaggttacctagatggcttcagatcttcaagaaaaaagttaaaaagaaagaagactctagcacatcctaattattatagttcttaagaagcttacggctcctgcccctgacttgcgcagcagttcttcagtgcagtgtaccatgagcattaatgtcttgggggctctgtacagtgttctgtaatatcggaatatttagggtacattgaaaatgtgcctggattataaagtactgcatttgtatggagtcttatgaacacatctgctagaagaagggagctcctcccaggcccagtgtagactggagtcgaggtggaggccaagcagaaggcagatctgccatggtctgggaggtggccgagttaacacatggggtcctggaggtgtcagtttcttttggccgtttcctggatgaggagaaatttgttgtaaattgctcttaggtgtatccatgtgctccacatgcccaggcatgtggaggcacagataaggattttggagggaaacagcctacccaggctataattgctttgttaaggggcaggttccctaatccactcttggagccttgtttctcatctggctaatagggccagtgatgcctgcctctcagtcgtggcaaagagtaaatgagttaggaggctctgtaaagcaccaagcatagggctggttaagtagtagctgtaataagtacaagtgagaatgttcatttcacttagtgggtttcttctgctttttattctcagagcgcactgtaaggatcttctgacagtttgctgttattgatttatttattaattgagactgaatctcgctctgtcactcacgctggagtgtgatggtgcaatcttgactcactgcaacctctgcctcctgggttcattcaagcaattcttgtgcctcagccttctgagtagctggaattacaggcatgtgccaccacgcctggctaatttttgtatttttagtagagatggggttttaccattttgtccaggctggtctcgaactcctgacctcaggtgatccgcccaccttagcctcccaaagtgctgggattagtttgccgttttttaaatgaagatcctgtttcttaaactctgcttcaggtattaccagagaaacggagtctgaaactcttgaagagccacaatctcaatgtgaattggtacatgtactgccccgagagcgccgtgatcttgctgtctaccacggtcctggagaatgtcctgcagccttttcactttagggtaagaggaagcctcccctgaaaaaaacacctttccccagttgtcccctgttcctgtagcatcctaatgtgtcaggcacgttagggacaggttcctctagccgtaacgtcaccgctctgaccactagagggcactctgtatacccgtcagctcctggagccattcattctatgctgggcagacaggctgtgagaggacatgggggacggtggaaaggatccaaagacgaagtctgtgtttatccttgttggttttacacagggaatgatgaaacattgaaggggtttaataagcttttcctaaaacattttccccctaaacaggctggcactatgtcgaagctgcccaaatttgagattgaattaccagctgcgcctaagtcaactaaacccagcctttccgaaagagacatcgcaatggctaccatgtatgtccgtgtcagagagaattccatcctgtgattgctttcagtaatataaataatagaaggagtgtgttacaagcaccacgtgatgccctgacccctagaacacataaggaggactccccttgttctgggtattcagtgtataggtcctgtgaacatagaaaacctgcagtgtttttggcattcctttttgatttttatcagctttgtgatgctaaggaattcctttacctttctagcctgataaaacaagaacattgaaccaatttatttcttagtatctttgttttagaatttcttcttctttttttttttttttcgagacagagtcttgttctgtcccctaggctggagtgcagtggtgcagtgtcggctcactgcagcctccacctcccaggctcaaacgattcttctgcttcagcctcccaagtagctgggattacaagtgtgcgtcacctcgcccggctagtctttgtatttttggtagagacagggcttcaccatgttggccaggctggtctcgaactcctgacctcaagtgatccacctgccttggcttcccaaagtgctgggattacaggcatgagccactgtgcctggccaagtttattttttttaaaagctcagttaaataataattgttctaaataagaaaatagattaagattttatgtaacagacatggaactaaattacgtatatatagaggtatattttcttttactttttttttttgtttgtttttgtgatggagtcttgctctgttgccaggctggagtacagtggcacgatcttggctcactgcaacctccgcctcccaggttcaagcgattctcctgcctcagcctcccgagtagctgggactacaggtgcgtgccaccatgcccaactaatttttgtatttttagtagagacagggtttcaccatgttggccagggtggtctcggtctcttgacctcttgatctgccctcctcagcctcccaaagtgttgggattacaggcgtgagccaccacgcctggcagtacggaggtatattttcatttgaaaaagtggatatctcagtttttaaatttgtaatgaaaattttaaacacacaatagagactaataaaaaagaacccctgtatgcctgtatctgattcgacaatagtcaaaattttgcttctaagttacttctgattcttctgtggcctaaaacagtggcccaaactttcaaactttatggtagttagtataatgttctttcatttcttcttcctttttttttaaacgtactcttctgtggcattcctgtttatttttaaattttttttggagagtgtcgctctgttgcccaggctggagtgcagtgttacaatctcagctcaccacaacctccgccttctaggttcaagtgattttcctgccacagtctcccaagtagctgggactacaggcgcatgccaccacatctggataatttttgtattttctgaagagatggagtttcaccatgttgcccaggctggtcttgaactcctgggctcgggtgatcctcccgcctcatcctcccaaagtgctgggtttataggcatgagccgccgtgcccagccagcattcctgtttagacaatagataaagtgagagcagtcctggctgaagtggaggtggggacctgttccctcccaccttggtctcctccttgtccctgggcaggcccagcacagagtttaccactggactagaatatgcattcaggaactgttcacagcaacatttattagatggcacttaaatagaaaaggctgagcatggtggcacacacctgtaataccagtgactggggaggccaaggcagggggatcgccttgaggccaggagttcaagaccagcccgggcaacatagtgagaccctgtttctacaaaaaaatttaaaaattagccaggcacggtggcacgtgcatgtagtcctagctactggggaggctgaggtgagggaagatcgccaaagcctaggaggtggaggttgcagtgagctgtggttgcaccactgcattccagcctgggtgacagagggagaccctgtctctgaaaaatgaaaaaaaaaaatagtgattatattttcctgttattaaggaatatacattcattatacaaaacttggaaaacagagaagaaaatgaacttagcatatcactcaagtataactattacatgtgtttctttccaatcattttagactctatgcttaggtttggggttttcttttaaaatattatgatcaagctgtgtttagtgtgtgttctcttttccacttaactttataataggctttgagtaactgcatgtttctttgtaaacacttgttggcagcaaaatactccattaagtgaatatcttataatttacttaaccgtgatgccatttagaacaaaggaattttgaatggccagatgtgatttatgtctgtttgttccctaattagatacgggcagctgtatgttctcttcttgaggcatcattctcggacctccaacagcacaggagcggaggtggtcctctatcatctaccacggtagatttcatgctttgttttccctctctctctgattttaaaatgtgaactgcagcttgttgatctgttttttgctttctatcctacagagaaggtgcctgtaaaaagatgcacatattgaagttaaataggacgggaaagtttgccctgaacgtggtggacaacctggtagtcgtgcatcatcaggatacagaggtacaagctgtctgcgtttctaccaaagttaaggttgcttaaaagccttgtgaaaattggtggctgggcacggtggatcacgcctgtaatcccagcactttgggaggccaaggcggacagattgcttgagcccaggagttcgagaccagcctgagcagcatggcaaaaccccacctatataaaaaatacaaaaattagccgggcgtggtagtgcacgcctatagtcccagctacttgtggggctaaggctggaggatggcttgagcccaggaggtcggggcttcagtgagtggagatcgcgccactgcactccagcctgggtgatggagcaagatcctgtctccgaaaaaaaaaaaaaattggcaaaatgtctgaataagactagaaagtgcatttttatgctaagagttttggtcttccagatggaaatgggtttggtagtctcaagtagtttagaaaaaagtgattgtgtcagttgattaaagataattcaaaactatttcagaaactaacgcttgagatttgaccttggaagaaggtgggaatccgctccattccacgagtacttgaactctctgttgcaattgtgagcatggatgacagtgctgggggataatggttttgaggccgtgtggaccaggacaactagaatgggtcctgtgggctgggcctctgatataaagaagctgcttacctcctctaccctcccagagggtggtgacgctaactctgtgacacgtgaggatgtttccagttgaaatgacagagatctgcttaggtcactttgagtgagctcatcaaaggaagcatgtcataaatgcaggaaatacttgtgagaggagataaaaatattaaaagagagttgtgatgttaatgacaaattccttctcaagtaagagctagcctgtagggaggaaatgcaaacacaggcttttaaactgatttaaacagcaagatgggatggaatgaaagcaactgggcaaaccatgattgattttggcctcagtcttgtctttttcccccccagacatcggtaatattcgatatcaagttacggggagagtttgacggctccgttaccttccaccaccccgtgcttcccgctcgatcgatccagccctatcagatccccatcacaggtaacacgggttctgtagaggagtctgtgctgccctttcaccatgtggctgtgttctcaccatgatctttgggagtcacgttaaaagtggagtgaggaataaacagagattcccagatctgtctgattttgccaggggccatttgttccagttttgttgttgttttgagacagtctcactgagtcacccaggctggtaggtagtgtcgtgatcttggctcactacagtctccacctcctgggttcaagtgattatcctgcctcagcctcccaagtagtggggattacaggtgtgtgccaccgtgcccagctaatttttatatttttttaaatttatttttttgacagagcctcactttgttgcccaggctggagtgcagtggcatgatctcggctcactgcaacctccacctgtctgtcacaaggttcaagcttgtgaggtattcaagcaattgaaccaagtattcaatcgcttaaatacttgtgagaggagataaggttcaagtgattctcctgcctcagcctcccaagtagctgggattacaggcgtgcaccaccacgcccagctaatttttttgtatttttagtagagatggggtttcaccatgttggccaggctggtcttgaacttctggcctcaagtgatctgcccaccttggcctctcaaagtggtgggattacaggcatgagccaccacgcctggcccaaatttttatatttttggtagagatggggtttcaccatgttggccagactggtcttgaactcctgacctcaggtgatccgcctgcctcgctctcccaaagtgctaggattacaagtgtgagccaccatgcccagcctgttctagttttttaaaaaatgcaactactactgatcctataagctaaaattatgttgtgaaaaaagcattttctaagatagatgaatctcccttgggaggaaatagaataatttatcttccctgagctttagaatggatagttttgattagccgttgatggtgaaatatgttttaatattgaatacacccgtaacgttttctgtttgccttagctctgtaacgctgaaattaactttggctgtaggtttgttactgtaacctgggatcacttttctctttctcacattccgtgtgacagtgatgatgaatattgcattctttgggactgacagtcacagtaagtgcttcggctgtggctcttaggcttacccaaatcagtcctccttctgtctggagaggtggggttgggaagtcagaagagtggaggtcaggaattcaggaaaagggaaagaagtcatttatttgcttcgttttgcctttttccagtgtaattgattttaagatagaactgaaagaatattcaacacacactctctctcttttttttttttccttaaacagaactttattttctcacagttctggaggctagaagttcaagatcaagatgtctgcaggtttgctttcttctgaggcctccctcctggcaggcctctttgcagatggccaccttctcactgtgttctcacagggtctttcttctgtgcctgtccctcgcagcagtctctcccggctctcttttgaaggagattggagtgcagaattggctagtctgaggtttcagtgtgcaagacgtagtcagatggctcacatttggaaccctagtagtaatgttttattctttgtccgatggcattgggcgggttgacccagcctgcagtcaggatttccttgtaccgttcacccgggagttcagaatcgcactctggctgaaagttcagcaagagcaccattgtcagcctgactgccctgtcttgctggaccagccaaaagcttagttactttctggcacagttggaggaaggagctggttcttaacagacgttcaattaggtcttttggctttctgtgttctttcaagcttcttccttttcctttgtaaataatgttagtattgaaagaatagattttgccaagtgattgtcttgtgtctgctgcccacttggcatgaaggtaactgctggtgaattgggggaaaaaaactaaacatttagaacaagcctgtccaacccacggtctgtgggccacatgtggcccaggacagctttgaatgcagcccaacacaaattcttaaactttcttaaaacattatgagatttttttaatgatattttttaagctcatcagctattgttagtgttagtgtattttatgtgtggcccaagaccattcttcttcttcctcttaaggcccagggaagccaaaacattggacacccctggcttagaaccttcagctctgttccggtggtacaggaccagttaggaggcatcaggttctaaccatctggtcataagggaacagatgcgaggcctggtcacagtaacagcccgtgcagagatcaataggaggaaatcaggaatccactgagggtctggggatctaggtagtgtgggctgcaaagcattttcagaggttagtgactctccttttgtttcctgctgggctgtgagccctggcggcttgatgcatccgtgtgtcttgcccactgtgctgccactgggtgggcgtgctcaggaattgaatgggcctgttgagaaagatataaccagcacttttgggaagagtcagccaccctttttctttttgttttgggcctgttagaacagtgggtctcaatctgactacatattaggatcatctggggggccttaaaaatgaaagctctcacctgacagtgtgtaggtcagccacccaaaggtgagggctgtgcactcggcgcagaccttgacacttaggtccaaagcgcgagtgctcttcgccaaagcttgtctgcctgggctctttcctacctttgggtggtctgttcacaatgaccctttctctgaccagctgattgaaacctgccttctgattgtacctgggtaattggaacagaaccaggagtcatggttagcttgtagggctgcctgcatggctcatgagcagtataactggttgttaacggtccctgtcatgtgaggttttgggggtctgcttcccagacgagctcactgtgcttggacctactctatgcaatggataatcgaactaattatttagataattaagtggctgggcacagtggctcatgcctgtaatcgcagcatgttgggaggctgaggtgggcagatcacttaagcccaggagttggagaccagcctaggtaacatagaccttgtcttcacaaaaaaaaaaaaaaaaaaaaaaaaaagaaaaaaagttagggcatggtcacatgcctgtagtcctagctactctgaaggctgaggcaggaggaccacttgagccaaggagttcgtggttatagtgggctatgatcaactactgcactcaagcctggacagcagagcaacaccctctcttaaagaaaaaaaaagataattaagctacaagccacatttatttgaaacattctccgtggatgatctgggtatttgattttgaatccttcaagtaaatttctcagttccttaacgtgcatatgtaaacgatcatgagtcatctttggttattaaaaataacccaaaccacagtgattgaagccttgacatgctttctttttcttggtgagattttcctggattgttagctccttcccccttcctccccgtacgtgctttcagtgagacggaacagttcatttcttccttgactacaattgaataaacatttcgtaatgacattaaaaagtattgacttttgtgtcataagtaccagcatttgcagcattttctgactgcatcgttgcacttatgttttctcaatttgtaggtcctgctgccgtgaccagccagtctcctgttccatgtaaactctgtatcctttactaaggtgtggcaccgtgcacaacagggcaagtggtcaccctcagagagtggtcctgaagtcctcctccgggcagctgtgaataacactccgagagccaccccgcaggcagcttccctgactgtccaggggcctcgcgtttagcgtggactcagtacatggtgggcaggggcgagtgctagcggaaactgggtttgctttttgttttcatcttttcctggtttagaatttcctataacatgtggattcttcatcttggattgtctttcaacctgacatcattatcagcgcaagccaaggtaggtcagcggggacagttgtcgtgttacaacatggtgcttgttgactttggatcccagttgtagccagggacgttttcaaggtgaatctcttagaaatgacccctcctttcaagcgtgggaatgggatttttttttttcactttatacgttttttactatatgtgcattttatcaagaacatatactacttttaataattaaagcaacaactaagaatgccattctcctgcttaagcccattctggaaaagccagactccaccccagggtggatggaaagccggactccaccccagggtgtctccctcatttctcccatcgaccttcccaccggtgtccgtgcccttttctgttctgcatgagcccgggaggtgtgctcctctttctggccttgctgaggaagcctcctcagtctgttaattgtctcttcctgggtaatctctttattagagaaatcttttttttttttttttttttttttgagacggagttttgctcgttgcccaggctggagtgcaatggcgtgatcttggctcactgcaacctccgcctcccgggttcaagcgattctcctgcctcagcctcctgaatagctgggattacaggcatgtgccaccacgcccagctaattttgtatttttagtagagacgaggtttttccatgttggtcaggctggtctcaaactcccaacctcaggtgatccgcctgcctcggcctcccaaagtgctgggattacaggcatgagccactgtgcccggcctaaagaaatcttatttttttaaggcagggtcttgctccgtcacccagcctggagtgcagtagtgctatctcagcttactgcagccttgagctcctgggctcaggcgatcctcctgcttcagcctcccaagtagctgggcctacaggcgcacatcaccacgcccagttaatttattataataataataataattattttgagacggaatctcgctttgtcaccaggctggagtgcagtggtgccatctcggctcactgcaacctccaactcctgggtttaagcgattctcctgcctcagcctccccagtagctgggattacaggcatgcgccaccacacccagctaatttttgtatttttagtagatacggggtttcaccatgttggccaggatggtctcgatctcctgacctcgtgatctgcccacctcagcctcccaaagtgctgggattacaggtgtgagccaccacagccggcctataattttttttttgtagagacagggtcttgccatgttgcccctgtgtctctaatacctcgccaggctggttattagagaatctcctatgttactctttaatcctctgtgtattttcctgcctttcctctggaattcctaagaactcttgaggagagaattagccctgatgctgtaggcatccactgtatgtaatgcattgttgtgccttgtctgtaacccatagcctcatgtgacatccactgtatgtatgtaatgaagtcatttctctcctgtgcatctcgctggtgttttcctgtacagctgctctgtacctgccttgggccaactgaaaagggggtcacccagatgattttttatgtggcacttcattctcctgtggcatcccaattgggaaaggccacaccagatgctggcagtgtgggtgatcagtacatttatgggtcgatgaatggatgagttatgatgttccattgagagcctctggagttaccttttaaactaatgagctgttgtaggagaaaccaaagcacaggactgaagttgatgccacgtgttgacatctttttctattttaaacgttaaaagaggggctaggtctagggaagtccccgtttggaatgaaggactaggagctacacctttgatgtgcccctgaatgcagaggttacttggaaaagagtcagccaggtgtgcggtggttgggctgtcatcctcctgtggtagacacgctcctgaattgctcctgaatggctcagctctgctttggttaggaaggaaaagctacactgactgtactttgcggctttttatcaccacctgccacccgccccgcagatgtttaggggaaccacttttgggcttttgttacggtttgcatcatactgttttatttgctgcctcttaaaatccaggttacctctggaacctccaagtgaaacttgagcccatagtaaatctcttaccagacaaaggaagactcatggactttctcctccagagaaaggaatgcaagatggtcatcctgtctgtctgttcacagagtaagttgaatccttcccccttgctctgattccagtgtgaggcctgtgctgcccaacactttttatcgggatgtgggctacattgttgtgtcttgtctgtgacccacagcctcattctttatgtgaggggtggctatgtgaccccctaggaaaggctgctaaatggaaagatgatttgtagagatactggtagaaaagaacaataaatgggatggttctgaatgaaagtgggcacacaggaggggagtgggccaccacccctggccttcacacacacctctttcaaaatccaagccactcactgcatatgtgtcttctttaagaatcccctactgaggccaggcatggtggctcatgcttataatcccagcactctgggaggctgaagcaggaggattgcctgagcctaggagttcgagaccagcctggacgacaacatggcaaaaccctgtctctacaaaaaaaaaaaaaaaaaaaaaaaaaattagctgagtttggtggtatacacctgtggccccagctactccagaggctgccgagggaggattccttgagcccgggaggacgaggctgcagcgagccgtttgtgtcagtgtacctccagcctgggcgacagagcaagaccctgtatccaaaaaaaaataataataataatcccctaccaatatgtgctgttggtgtttgtttttgttttggtatagatggggtcttgccttgttgcccaggctggtctcaaactcccagcgttaagtgatccttctgcctcggcctacccaaagtgctgggattataggcatgtgccactgagcctggcctgctatagcttttttttttttttttttttttaaccgtaaccagaaaggggttgcgaatgacatctagctgtcaggtctttaaagtagagtgtcctttaaaggtacttttgcattggtaaccttttgagattagtttttatcatagcaacgtgtggaaattctgaagctgacatgaagttggtttgatccgtgtgtgaacattgtgcctttccagtgttaagtgagtcagacagagcatcgctgcccgtgatagccactgtttttgataaactcaaccatgagtataaaaagtacctggatgccgagcagagttatgcgatggtgagttacatggagtatgacaaagggtcctcctcccccaccccctcccgggtattttctaagtaattatgatgcaaaattgtttcctatatattagaataaggtcgctgagatttgccgcctgccatagggcaaggtggcagtagtgggggatagtggaggagtagtaaattcagggtccctgcatcccacgagctggcggctgcatctcacttcataccttcactgtttttgtttttcccatctgtgtttgatcttgcctgtagatccttggtctactgttatagatgagaaaaatcagtctctgctttgcaatattttgtatatttttctgttatgccagagtgaggacttagaaaattaaattagaaatatttatatttgccacacctttcttcccttttgggaaagaatcctgttgagatagtgacgattcagtgttagcacttagcaggcgtgtttgtagtcaaggtaataaccatggcttatcgccaccaattcccgctgtattacttgtacatcatatcttctgaagccagaagaaaagtttaggacaaggagaatgaattatttcaattccaggatctgattagtcctaggctgaaaatggttttaaaccaacaaaagccccagaactccactcccctttagctgttcatggaagggtaagaggtctgagacaggcactgaagagggccagttgctgggacagtgtccattcctacgctgccagacgtgagggatggctgagtccttttggactctattgctgtgggtgttctgggctgtgggaatcagtaggtctgatcccaaatggcagtttctgtgccgtcccacacggtctgctgggctccataaaccgtcatgactcagcagtgtgggccactgaccagccacatgagcagcatctggagtttcttggaaatgcaagttctcaggctacaccccacagctattgcataatctgcacggatctgaactgcttttttttttttgagacggagttttgttcttattgcccaggctggagtgcaatggtgagatcttggctcaccgcaacctctgcctcctgggttcaagggattctcctgcctcagcctcctgagtagctgggattacaggcatgcgcacaggaaaaagttgtatctaagtagagaaagtgttttccgctcatatcctgggtccacatcgaagaattcagtccttgtggatgaactgtaaacagcacccttcctctaagatgccgaagatcatagtttgtggtttttttctttcaggcggtggaagcagggcagagccgaagcagcccgctcctcaagaggccggtgcggacccaggcggtgctggaccagtcagatgtgtacacccatgtcctgtcagcctttgtggaaaagaaggtgggctgcagctttccgcctcttctggactgagaatgctcaaaacaaggaagttgctgaaaacgaggagacttcatgtgattagagtcacttgaagtgattagaatcactggagtttccttgggtgaggccctagagctggtagtttggcttctaatgctgaggcctaaagcataattgttgacgggtggttctggagcgatgtgtgcaaaaccagtgaaagatgaacactgggccattttaagatggaaacaaggtgggggttggatagagagttatatgcagcctcttttgcacctcgttggtatttgtaagaccacatttttttctccctaggagatgcctcataaatttgtgatagccgtgctgatggaatacattcgttctcttaaccagtttcagattgcagtacaggtaccttcaaatcatctgggcccaagttaaaacagaaggaatttaaaaaaaaaacacagtcactgtcttagaagatgactcatatgctaagacaggtctgcctccctgactcagaatgctgagtgactcctgacattattagttggaatgggaagtgtaaggtcaagttggggtctttacctgcatgacgaaaccacttcttgtaatgacagacttttactgtgttggttagaatagccagtccttggggagcctctagtctgttgtagctgaatgatttggaagtgttctttcactttttacttttgtcctcagcattacctacatgaacttgttatcaaaacccttgtccagcacaacctcttttatatgctgcatcagttcctgcagtaccacgtcctcagcgactccaaacctttggtatgcattgccagatttttacttccattgtggttaaaaatggaaaattttaaccgttatctttccaactgaagtgggtctaaaaatgtctttcaggcttgtctgctgttatccctagagagtttctatcctcctgctcatcagctatctctggacatgctgaaggtaactctgatgtgtgaggttttagactatggaaactaactctgttcctgttgtttgcactgacctggacttctctcccttactgctagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggtgagaatgcaatgaaaagacttggggtaaccatagcctcaaagagtagcagagggcactggcagctggtgggcgaggaccctgggttagcatttttgtaaacaacacaatttgataacagcccacctagcccttggcccattatttgtagtagagtgaattcagtatactgacagaatctgaattatgctctggaactcaccgaggaggtgtgttttgagtcaagacacatttaggacccagatcaggcacagcccatctcttatagcagatcttggaatatctcttaaagccaggaataagacggcaaatggtggctaagggttttaaagggtctggggcttattaaggtttcagttttatgaagtatacattggttgatcattctcattttttttttgagacagagtctcgctccgttgcccaggctggagtgcagtggtgtgatctcggttcactgcaacctccgctgggttcaagcgattcttctgcctcagcctcctgagtagttgggactacaggtgcgtgccaccacacccggctgatttttgtatttttagtagagatggggttttactatattgtccaggctggtctcaaactcctgacctcatgatccgcctgcctcagcctcccaaagtgctgggattacaggtttgagccaccgcacctggccctggttgatcattctcatctccaaatagttatacaacctaagacatcatctttaggatagggaaggatcagggctgtctaatgaaacttctaggtctatttctagctcaatgtaagacggcatttagttaccataaggacaggttagatagaatctcttccatttagcttttgtatttgtctctcaaagcagatagggtaaccccaaaacttaggaaaacaatgtattttattaaagaaaaataagttaaaacccagtagacacacctacgagatgctttctttgtccctcatttcatgccacatctaactggcaattaaatctcttcctttctaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaaactataaaatgttataaagtgtatctacaacctcaactgtcactaaaaatatggtatagaacttgtgggatggcttactcctaaaaggagagacagacagtgcattgattggcctttacagagtgtcagtgagcggatcacattcacagccatctagtgtcacctcctgcttgccaaagaatgaggtttctttcctgaagaggctgggagaagtttagtgtcctgtggttgcctccagatctagtaatactgcttcccaagtcaactgtgcattcctgagttcacaggcgctacgttcaaagctgctgccaaacaaccgatggttggcaccatccggtgttcaacttggccttgccgatgcagcacccgtccagtggtaaaccgaccgacccttagacacagttcagtcaggatgccctgcgagagggctagaaatttagaagccgttcgcgctctgttcctttgtatcgctcttcagtggcacaacttttggctttatttactgatggccctatgagagagagagactttttcttatttctgcaggagaaagggagctagttggctgggcatagtggctcacgcctgtaatcccactttggaagactgaggcaggagaattgcttgagaccagcctggacaacagagtgagaccacatctctctccctctcttttggagatgggctctttgctttcttcctcaggctgcagtgcagtggtatgaacacgactcactgcatcctaagcccacccttctgggctcaagcaagcttcctgcctcagcctaacaagtaggtgggactgcagacgcacaccacttcacctggctaattttatttttgtagagatggaggcctcactatgttgcctaggctggtctcaaacgattctcctgtctcagccttccaaagtgctcatctctttttttttttttttttcttaaaaggaactagtatattagattgtaatagaactactttctatcccccggagatgataaaaagcccctcattttcttaatcttctacttcagtgcttcaatttagtgacaaagctataaatgaagcaaatcagtattgttctttcaaccgtgggtcatttttgtgcaaggtgaagtggccatagaagtaaaaggatcaaggacagtctcgagatgaagaaaggcagcaagcactttgctaagaaacgggaaatccatgagggacataaaaagctgttctgcagcactgctggtgtgagagctggctgccagatggactccttcatctcagtggcagggaggagctgccctgcctgctgacactcagatccattcaaggactggctccaggcctttgtgaagcagacagatcaggcctccagaaaaaacatcgacaacttcctaataaagtagtctgcaccatcatgaatcccctggatgggttttttcttttagaagaaatttttttactcagtatcatttatcattatcaaatgaccattagtatgagttcaaatacttgaaaagaatgcctcaggatagaattccctttcagtaatgtccttctattgtgccacccttttaagatgagaactcttacctatgtaactgagtaagacagggagaaatattaatccgtgagtggctcccagtaagaccatggccaaatacatcctgaagtagaatatctggaaaatttgagatttggcaaaagccaacaccacaatccctccaaattttgtaagtgtgattccactgaacacctaaaagaagagatactgtgttagaaaccacttttaccaacctgtaattgaacaaaaacacttccttacaaggatttctcccaggttcaagtgattctcctgccccagcctcctgagtagctgggattaaacaggtgcacgccaccatgcctggctaatttttgtgtttttagtagagatggggtttcaccatgttggccatggtctcgaacccctggccgcaagtggtccgccagccttggcctcccaaagtgctggggttataggcatgagccaccgtggccagcccttatggggatttcttaatattcaaggttcaaagcaatgggaactgaacccaggtagcatcatctactacctaacactatttgctgccttatgatcctgggggagaggtatgaccaagttaaaagctgtgtattctgcacagacactgcatcgtgtctcccaattgattatctttctttatattctcaggtgaaaacttaaatatttaaaagtgttacgaaacaaagttttagtttttactctttaccaggtattttctacagtggtaaagagataggctaagccagggtgtagagttgaaccaagacgactctccaggcaccaaccgcacatcacacgctgggttctggcccgggctcccctgcattttaaatgggaaagactgccagctgtctcatgtttaacttgtctgttattttcctgcttcagcacactgccacctaaaaaggagccgtaccaacaggtacagttccacagaacgtccgttctgtccacgatgtggcagctaattcatgaattgcctgaaagcttgcaatccttagaagctgctttgtaagtacaggatccagactcttcagtcactgaggaggattactttgtggtgcgactctgccggcgtggccctgctcagggtactcacggagctgcccatgtgggcaagtgcctcttccgcgcgctccacgcggctgcctttcatgctcaccgtgaacgctctggttatgtggctgcagaactccacggagatgccacagctctgaaataaagcacttcctttaggatggctctcttcctgttgaagaccctaggcagccaccccgttctgaggatgggtgctaattacccagggcaccctgggtgctagaggaggccaagcatcccattggacttacaaggcctccatcacaccaatcttactgtaccaggaactttttggggccctctctacacacagccaaaagcctggttttctgtggcacgtttgtgttgaccaggagaaattgctggaacccgttaaggtcaccccacccgcaccgagctggcgcattgtcacaacttcttttcttggacctcagtgctcccctatctgaagcagggctcatatctgagagtacggatacactgttctattttccatgaataccttctcaagtgctctcatctttaatgattaaaagtacctgataaccacataggaggcaaaaggcactggtcggagagctcctggggcggggtgcaattttctaagtaaaaagtgaacatcctgctgtcatcaggctacaggcttgtgcaatctctaaagaataacaaattacaggcagactagcccagaactaggccaggaaatcacatttccatggtcagaggcaccatcaggtatactagtatagccgcaaggaatgggacaagagaaaaaattgaacagaaattgcctgtaatgtgcctatgctcccagatgtccaactcaatgctcgctccctctatgccctgtcccaccaccatccagcactcctccagcactcatcctgcctctccatgtgtgccaagagcaagcgccagacttggtatcttactccatctttagggtttacatggaatctaagacagccaattcccccaagtgaaacaggagctagggacaaactgagactgtatgaggactcaccatcaccaggttgaccaaggatacagcgttcagactgatgccccagagccacataactccaaacatgttgaccaagaccatggcgatggtggcacacatgatgactgcagaccagagctcacagcccaggaggaccatggtcaccagaaatatcgcgcccagggacacaccgaggttgaagatagtgtcgtcaatgatggtcaggtactgttcgtagaagacataaaacacactggaggggagaggggaggcctcattaaagctcgctctcactcccgaacactgcgtgttcatcctgtcaccactgccaagtggtcagactcctttgggaaacatcccttgcagaaaaccttgctggctgtctacaagactcaccgaaagcaactcacttgacctctcatggccactgaccacccagagaagggcccagcagtgatgcaaaatgtatatttttgataaagtttctgtttataagcccaatctatgctattttatagacatttacagagagcattccacagcattctgaaaaaacacaaaaaaacaaagaatcctgatctatcctgagacactacctcaggctcagcggggtccgtgcaaggcctgaggaaaacatgctttcatttattttctgccagagctaaccggctcttaacttcttccaaacaaatccaggccttcctgctttaagcgagatcatggggaggcaggaaaaataaatcacttgtttctcctacctttctacagtttctaaattcagtagttcatacataatacttttcttcctgggaaaaaaaacccctaacaatataaaaagtctacatacaggcagcatcccaaataaccagcagttagggattctggttcattgttggccaagaatgtgggccgggccctgctctgagccgcctgctctccaagcgccccctgccttaagccattttccagtgtgtgtctcttgcagctgtgcagtggcgcagagatcaagttttgcgtctctagccctcaggccttcacagagactttagattctgaactcctttgcccagcacccatttcctttgatatactgccctgtgctcagaatggagcaggggccagaacccaacctgaaaatcagcatcttgccaagggaaccctccccactcccacccagtgtaggccctttgctgggtaaaccccattgaaaaagggcaggctttacctgtaaggaaatactcggtaggcactgccgttaatgcccatggtttcggtgacattactggctataagtcgggctttcttcagagcgtcaataaagtcagcagaggtctgcagcacggtgtggtaggtcatgaagtacgtggctccgaccctggtgccatggccaaggaggatgttaactgcagaactataggcagcatgtcccctgaggaaagaatcctgggtgtcaagagagtccaggtcttgcaaaatatcagcagaatctgagcacttgaggctaagcaaaatcacctgaccctggactcagaggtcagacccagctgtacatttcagggatgaagaaggcccccagataagggaacaccaaaggtttagcttgttctctcccagactggcttctttttttttttattttgagacagagtcttgctctgtagcccaggctggagtgcagtggcgtgatctcggctcactgcaacctccacctcccgggttcaagcaattctccctgcctcagcctcccgaatagctgggattacaggcacctgccaccacgctcaactaacttttgtatttttttagtagagacagggttttgccatgttggcctggctagtcttgaactcctgaggtgatctcaggtgatccgcccacctcggcctccaaaagtactgggattacaggtgtgagccacttcgcctggccagatgggcttttctcgattgctctgggttctttggtacatagctgctgtttctccacctggtttcatgtataatcaaaggtacagggtttactcagtcctgttgtgtaataggaagcaggaaagggcaagggccctgggaacaacctcagccctgccacttactggtcatgtaaccccgagcaaaatgaccacctctgagccccagtctcctcttctgtaaatgggtataccaccacctactcataggctgcgtgatgagaaatggaataatgtcagggagtgcctggcatgacgctggcaccctggaggctccccaggaacggtggctactgccttcagaaaaactgaatctacttcaacttattttacgtaggccaaagcatccagtcagtgagtaaatcaagctgcaagattcatttctacttaacttttaggaggagtcatcccatgatacctcgaataggtctcaaagcacatgcatgatataaatgattcactgatatgactctggtcagatgtatgttcttatgaaaaacctaagttcagggtttacctaacatacatggggatactcatcttccacctcccaaagcttccaaatcaaggccagagacttccggtcatcatcactatttttgggccatatatctggcttccgtgggtaactggctgcctggctggatgggggagtgagatagcccataaccctatacatggatgggctggcaaggagcatgacgaggctaaaagaatcgcaaccttaatgtgggataatgttactaaagctaagatcacgccccagctgccatcagtacaagtgaacaggccaagttccttcaggcctggattaccagcaggccgtcctctccctcagccccgcttggaatgtgcacaggaatctgcgttcattctcatgcccagggggccaggacacagagagagcatgagatgtgaatgcccacgctaagacagaatcagttgaacactatgaggcattttcttaaaaaggtgttttcggttttcctgcttccaccaaaggaccaggacagggtggggcggagaagagacgttcccatgcaactgtcttagcccagtcctctcctagttttctactgcaaattaaagttgcagtggatgcttatctgcaatggcagcagcacttaccctttgccacacttggggttagggttatccgaaaggaacatgggcaggaatctcatgaagtctcccccctgaggcctctgtttgccttccggagtcagaggcctgcagcgaacgcaggcagggtcaaccactggcggagacatgcagggaggactgttagaagaataggtctccagattttttgtaaaacattttaaaatactgacagtgaggggcattactttcttctctatcgattactttccttactagtgagggataatctttccccttatctaaaagcttcagccacatgtcactttcacagtttaatgaatctgaaataccattttcatcttaggcatactatgcatcattttctgccctgaagtagatctcctccttcaagtatggccttgactggtcagagcccggggcttctatgtttttattaagaaaattccagggcaacctcgacgctcctacaaaaccacagggtaaagtgataaagaaaagccctcctctgagaagctaaggccagataccaatcctgagaggcaatcgctggagttagaacaggatgagaaaccttatgtggaaaccacactccgaacatgtggaccttgttcagcttgcagccccgagggtggctgtctgagccaggaacaacatgacaatttcagaatgaatgactgaggaaaggaatgatgacacagggagacccagctttgatatacaaataggtataaactgaggcacgatgcaaatgatttttaaatgataatttgaaaatttttcagcaaaacaggaaagatttggtaaaggagaaggtacctgaagcattgcagaactggtcagtgatattgtccactcgacagcaagacgactgtggcttcacccagtcgaaataatcgtcgatccaggacgagggggcgaagcctattcgggtactagagaggacagacagggttactgacctgctccacagggaggaagtctttagtttcagtactttttcttaaaacctaacttccttttctacgttttatactgctaacagtcaaaagaaaaactacatgagcacttaatgaaaaaagccttcaaagtattaggtggtaaattagtcctttcaaaggttttttaaggtaaagccagatttaacatacattttgcataaaaacaacttttccaagaaagtctattttcagtgagacatttcaggcctgagctgactgcctggctgagagcctcctccgctgcttctgaagtacaagacaaggtggtactgactagttgtccagctgcgccgcgttaaatatctgctgcaccagggaatcattgttgcagcccatgccgccgcacaccatgttctgccccttggaagaagtgtagtcgtgcccttcctccaggacaaagtacacaggcggacccgcatgcaggtactgactgatggatttgaaataatccaccatgtaggagtcctgaaagaaagataaaagaataggagagagtgtgaacactctgatagtaactaagcaaggcgaggatcatggagaataagagggtgccaggaggttcctggctgagatgcctccagctggactcatgattcctaacaccaccagtcttccccccagggccccagggtgctcctcctgctagccccacaatcaggagagcatctcataaagtaacctcataagactagttattcgtgttctgcagctgtgcccagaggggctcagtcagaatgccagacagcccacaccagcagtgcactgcgacagttctcctaaccctggaaaccctgtcaccatttgcagttagaagcaggcacttgcttgaaacacctacgtgcatgttttgaaaaatgtattcatcatcagctaaagaagttaaaaaaaaaaaaaaaaggaagtcatcttacatctggcatcgaaagagactgatccaatccaatatctactttgttcaggactgcgatgctgaatgacagaacacccacaaatattgctatctggaacaacaaatgaatcataagacagagactgcttagtaaataagcttacgaccagaaataaaatcttaagcacacacaaaaagcaggattttttaaaatggaaaagcttaaatgacaggctaatagggagtacagggcagtgggtgagaccacagcaccaggagtccaaattcctgggtgcaaatcctgactctgccacttacgggctgagtgacttggggcaaaccacttcacctctcttggcttctatttcctcattattaagaggaaaaataaaagtttctttgcaactttctgtgaatctgaaactatttcaaaataaaaaacttaaaactcttgtttatatggactgataaaagctcacaggaaaaacattttatctactgttccacatttgcttttgctttttttttagatacattttaacagctttaagaatctccttcccaggctgtctggcttcttagaaggcatgtgataatctgtttcagtgagaggaaagagaaaaaccacagataagcgcataccacaattggtctcatccagtcctttagcagaagtggagaataggagtttttgaagaagcgaaacaaacagctctctgaggcctggacgcttgttccatcttcagcacctctgacacagcaaaagatgtctagccgatttttctgaggggacagagggaaacaaaggttatacccgctagctgcttcctctagattctagactcaaattaaatagactataatcctggcaccaacttacctcttgacgtttaatgtctaaccccaagagactcacgaaacaggtaatctgcagaagaaagtcaatgaagactgccaatcccgcaaagagagagaaggtgtgcacggctggcatcacggacaatgctcctgtcggggagagaagggctctgcgtcacttctgtttacagccgggggctctctgcaggtcttatgttcatgtgcatgtacagatacaaggagccagcacaggccaaacgcatgagaaggcatgctgcggctggacattacaccagaagtgggacaggaggtgataagccagtgcttttcaaagcacactcagcaccagaccatttgggaagccccatcctagttatgacaggaattcaaccccaattctactatactcaggttcacagcaaattcacacacattaaaatttgagaaccactaatacaggccatttcttatagtactttctgtgcttcactgtaagaaa

SEQ ID NO: 1044 - DNA, 25213 bp, Homo sapiens
ttttctgtcgacattccatagaattccacagggatgaatttatttttaattccactgggatgcatgcccaggagagcagttgctgggttgtttggtattgtatgtttaattttttaataaactgcccaattcttttccaaagtggctgtaccatgttacattcctgctagagtgatccagtttctccacatcattacaaacatttggcattggcagtatcttttgttctagctgttctcatagatctgtagtgaaatttcatcatgaccttatttgcatttccctaatggctggtcatgtgcctttatccatgtgtcttctttatatctttagcccatattctatttgaattgtttgattttcttactgtcaagtttttaatatattctttacaaattctagttacgagcccttttgtcagatctgcagttttcaaatgttttcttccagtctatagcttgtctttccaccctcttcatggtgtcttttgcagggctaggtttcattttaatgaggtcctctttgttgatgtttttcttttatagatcacaccttgctatcattttaaattacttttcaccaagccgtaggtcccgaagatattctcttatgttatcttgtaaaagttttatttaaatgtaaaggggtatttcatttaaatataaaagcttcatttaaatgtaaagggggtataaaccctttacattttaatctgtgatccactttgagttagcttttgtattaagcgtaaggtttaggtcaaggtacatttttttgcttttggatatccaactgacccagcactatttgttgacaagactatcattctttcattggactgctttgcacctctgtcaaaaatctgttgaccacacctgtgtggggctatttctgggctctctattctgttctattgataaatgtgtctctccctctaccagtagcacagagtcttgagtaatgtacctacgtattaagtatcggagtctgataaactgataggtctgattatattttttatcttcagaattgttttagccattctagttcctttgctttcctatatagattttagaataatcttatttatgttcacaaaaaatcttactgaaattgtgatagtaatcgtgataagcctgtttaccaatttggaagaattgacacctttattatgttgagtattccaatccatgaacatggtatgtctgtctttatttttatttttgatttttcttttcagctttgtctttttcagcatacaaatcctgtaagtgttttgttggatttacacctgataattttattttgtgttactgattgtatgagatattgtatttttaatttcagtttccatatgttcattgtgagtatataaaaataccattgggttggtcttatatcttgcaactttgcttattagttctaggaggtttttattcatgtgcttgtttgttttgccttgtgttattttgttttgtttttgtagatgccttgagatttttcatgcagattatcatgtcatctgcaatagggacactttgtatctttcttttagatctacatgccttcattttcttttattttcttattgtgctggctagaacttccagtgctatgttgaatagaagtagagagaggggacatcttgtttttttcccagatctcaaaggaatgcattcagtctttcaccattaactatgatgatagctgttgctttttgcagatgctgtttatcacattgaggaaggtcctttctatttctaatttcctgagagttttatcataaatgggccttgaattttgtcaaatttttttgtataaattgatataatcacataatttttctcattaagcctattagtattgtagactatagggcttgatttttaaaattttaacccagccttttatctttggaataaacccaacttgatcatagtacataattatttttgtatattgtagaattatatttgctgtattttcttaagaatgtttgtgtctatatttttgaggaatactggtctgtatcatgttttggtactgtctttggttttggagtaagtatcctacttacctcataaaatgagttaggaagcatctctacttattctgttttctggatgagattgtgtagaatggttatgaaattttttatatgtttggtagccttttttagtgacacaatttgggccttgagtttcttttatgagagtttataaattctattttcttaatagttaatagggctattcaaattgcttatttcatattgcgagaactgtggtagctgtgcttttcaatgaattggttcatttcatctacgtcataaaatgtatgtgtgttgaattgtttactgtattcctttagtatccttctgatgtctgtggggtgtgtagcgatagcctctgttcactccttatattggtaatctctgccttctctctctctctttttttgtcagtcttgctagaatgtgccaatttattgatcttttcaaagatgtaccttttgtttcgttgatttttttctgttttaatttaatttctgcttttatctttcttgtgtccttccctgcttgcttgacatccattttgctagctttttctagtttcttgaggtgagagcttagattatggagacatgttctctcttaaacctcagatttagtttttttttttaattaagaggtaaggttttgcatggtttcaattcaactaatatggaaaaaaaacttttcactcatgtgtatattgtgtaaagttgtagaatcctactattcttttaaatgccccaatatttaacattgtactgatcgctagagtgtaccattttcagataaggacaaacccaaaggttaaatagtttctttattaaccaagagttatggtgaaagcaagacaagaagcaagccctctcccctctccccacccccacactgctcttcccacggcagcatccagcctgtaatggctgtcctcaaggtctgcagctggggctgtccaaaaggaatctgggtgggctccatccagtctcacccaaaccagcccatggtactccagatttgagagtagatgtggggagtggcaagactgagggtctgtgatggcatctgtcctccccactctgtccttgggctccagccagaccccctggctctctgcaggcaccctgggtggtggtcatccacaaaaaaagtcagcccagtgtctttcaggagttgcaacctccaaagggttaaaatgcatcaacaaacttcacctggacaaggcaccccagccatctttacagtatccagggtcaattcagagctctgccacctaccagccatgtgactctgagcaaatgtacaaagtttctctgtaccttggttttctcatcgaacaatgggatgatattggtattggtctcacagggttgctatgaggagtaagtttgtctctgtgtatagagctctctgaacagtgcccagcatggcataagcactagatcagcagtactggctggcatttgcccttattgccccatcaaaactccttcagtcctctctgcttaaaatccactggctttgatgtcagaagaataaggaaattggcaattaccctttatattcatttccaccctctctctccattcctaccataaagtaaaccttttggtagccaagaagaagaaaagttattccacaacattgtcgacacttgttcaaagagccaggggcaggggaggaatacgccgaaccagtctatgcagaatgcaaacaggtttgtgcataaccaccccatccactgcatgccattgaatgaacgattcaaacacaactgggcacttttgttgacttacagtttacagtgtgtataaacagtttgtaagtgaagagcactcctccagcaagccagcccccaccacaccccctaggtgtggtatccacaaagacaagaaagttttttggactaatttgactcagagcatcaagactgctaaagatggcactgcccgtttgtggaattcagatgcaggcttcactatgagtctccagtaagcctcagtcaaaacagtagagagggaatcaagagtgcctcccccagcagtgtgtcttctaacctttctcctggctctcagaatgtacaggctcttaacaaaaacacatgtgcaagaacatattagaccctcatcacctctgccagctgagttcttatttccctgtctgctcccactgcatctgaaaaccctacatcctgcccagtgtaagtccgattcctcatgccagaataatttgttaatttttttccagatcctaaagtgatgcttcaggtagcaaactctgagtttgatgtatgttctccgagaatgcactgtagataacaatgctcaattcatagtgatagggcatctctgagcaaatgtctcccgccagctgtttgctgcaataatttggatatttgctcctgtgcctttcacgttgtggttaaacagcatgtttaccatcaatatcactggcaagaggttgggaacagaatggagagaggagacagggtgtggttctataagaatcaatggctctcctccttatgggttgtgtagacttgaatgaggtcccctctccaagcctttatttactcattgctgcaatgacagcaacctctctgcttcataaaagggtatatgaagcaaccctagcatggtctccaataagctcagtgggcattccttctctgtccccaccatatccatatggcctttctacaactatttctatgtttaaaagagctaaacctgcctgttatcccatttattataattctttcatttcgtatgtctaactgcacttgagtcctcacaattcagatggatagagtgaaggcttttcagaccctcaactgattaggtgaggcccacccacactcaatggggccacctgctttcatcacatggatatgctgaagacagattgttgaaatattctttgtttttaatttaaacttgtttcatcatactggttcttttgaggtgattttcatctcactttcaggtcgtttgagagtttcatcttactatataatggttgaaaaaggaaaggaagtcatcacttgcccaaggtggtggtgaattcccattctgttaccagccaagggaagggattaggggaaaatatttcacccagaaaagtgctgtgttgtttgagttcgccttttggttattaagggtactaatatatttttcatcaacaatgacttaaggcccctagaagttcatgaacctggtgtgggtgtgtgtttcccactcagatgtgctgtgtaacttgcacctgagggtaacacgaactctccctgggcaagatgtaaccagggaaagaaaggagaaggcagagctcagagcaagcagaaagccaagcaggagaccaaaagaggcctcagaggccatgtttgcatcttccacagagggacagacacattctctgcctctccagtaaacacaaacatgcaaacatgcacacacagagacatgcacacacacggaccatacacaccacaccacacacacacacacacaactacttatgtttctgaatattacaaacatcattacaaaatatgaaatgtacaaagaacaattcccggtggctcatgcttgtaatcccagaactttgggaagccgaggcaggtagatcacccgaggtcaggagttcaagactagcctgatcaacatggtgaaaccccgtctctattaaaaaatacaaaaattagccaggcacagtggtgggcgcctgtaatcccagctactcaggaggctgaggcaggagaattgcttgaacccaggaggcggaggttgcagtgagctgagattacaccattgcactccagcctgggcaacagagcaagcctccgtcttaaaaaaaaaaaaaaggaacaattcctgaagcttctgatgatttctggctgaccatgaggttggaagtgggaacacattaagggcttaatgatgggacacagtgatgtaaccactgtggagccacaattgaagtgctgagattcagcattggaagacatctctgtcaccaaatgaacacgcctccctaaagagctctggcagtgagtcaaaggcttcatttgggtcaagacagagttattatacaaaaagccaagtttcattctacaaatccacatcggggtcaatattttaaagtgatttcccccaagttctgtgtagagcaagctgacagagaagaaatggctctgagatatctggcaaggtgcagatggactgaccacaagccgcttatccccactgtagctccgggctcccttctgccacagtggccatatctgtgaggttctgccctttccctggggccactgcatcagtcagggctctccagagaaacggaatccacaggaggtatacctatagcatacacaaaggctttattataaggaattggcccatgcaattatggaagctgacacatccaatgtctataggtccaaggtcccagttccagtcctaagaggattctcctagttagagacttctctctaactagggagagtgttggctttttgtcttcaataacagtctactcaggccctcaactaattgggtgaggctcacccacactaggaagggccatctgctctcctcagtctactgactcacttgtcaatctcatccagaaaccccctcacagacacattcagaataatgtttgaccacatatctgggcaccccatgccccagtcaagttcacacatacaattaaccatcataactatctgttagaccccaccttgcagggggcagtcctcctctggaaaccttcaggacttgaagtgtcaagctcatgtgtgcaaactgtgaccaacacacattttcctgagaagaggcctcagacaaacaaaaaaatatcatgcatgcacatttactcagataatgactgtctgttgcagcctttacgctaaacagagctaagagtagagatagtgcagattaactcagacccagaaacttggggaggcaccctgggatcctggaagcagatgctgggagggcagaggggaccgagaaaggaggtgcatttactcagctcttctgagacaattctgctctcctgcggtgcactcgttctgctggagaaagggctcactttgagtttgaatcttaaaactgcatgtcctttaaccacactgtacctgctcaccaggctgtggacactaaattgttgggaaagtgaatatatttcatttttttaattaaaaaagcatgtaaggttatattacataattgtgatatataatacatttattcaaatcatatttaagtttggggccacatgattttcaaaagtatacagatataactcatagtatctttcaattttattcccataagcctagatttgatttaaagtctaagcgcaaaggtagagaaattttttagttgtttagtacctgccattttatttttctccaactttttattatggaaaaagttcaaagatacaaagaaggagaacagattgtacaaccccttccctaaatccaccacgtagaaccaataatcaccaaccttttgtcatatcagcttatgtgcacgtactgtgctgaacaatttaaaataagttttagacatgaagacattttaccctttaatacttcagcagcacctcctaaaattaaagccattctcctaaacaaacattatgccattatcacacctaaaaacattaacaataattctatactatcagtcaatatcccctccaatttgtaatttcctccaaaatgtttttgtgtgcgtgtgtgtgtgctgatttgtccagctgggagtcaatccggatttgtacttattgttatacttcttcttttcagctgttcttataccagaagaatccttcacccctttttcttgacattgattttttttggaagagctcaggactgcagaatgcccacactctggtagtccagtttttcccatggtgtcatttaactcatggctcaaactcttccatttcctgtaaacttgcagtaaagtctagaggctttgcaattgattcaattgaagcatctttggcaagcacacagcaacaatgatgttgtgtgtttcttttgcatcacataatgccaggttgagccagtattagtgacactgagtttgatcttcctgtaaggtacagccagatgtctccataaaaaaatggaaaatggaaaacctttttcttttttttttccaattagcacccgttcgcctgcacactttcacctaagggtttgacacccactagtgcacactgcctgatttaattatttcattaagggttacagaatggggatttcctcattctcgcatttctacgtttatgagctggcattcttctgttaaactgctttcacttgtgaaacaggatgcagaggaggagacttattcaacagaattgtagggagggctgtttctctcaaaaggagtggtgagagaagatggtctctaccggggcatggagggctccttgtcagagtctagtgtctgagctttaaggcccaggaagagggcagcagatgggggtggggcagtgggtgagtgagaggcccgtgtgtggggagacccactgaggacagggatctttaggcaaacggagcctcactgaaagaggaatttcagtgatgccatgggtcagatcctgggtctctcttagggaaacctgccataaagcatgagagccacattactcctcagggcttctgggctccgattccgcagactagttttggaggcatcaccacgcctcaaggttgctctgttatatcagggtaactgactttctctaggaacggagacttgggtgccccttaaaacaaccctcagccagtatcctagcagtaaatttttcatcacgggaagcaactaattgaacagaggtgtgatgaacctactgaccactttggtaatatagacacagtggccacagtatgctgtattgttatcctggttgtgaccaatgccaaaggagcatgtttccttcttttcttgacttgatgctgtaggagtccaacaaagggaagcacattcaggcccacatgaaacttgggacagaagtggcttctcagagccgtgcaccaggcactttgaacaagttggaaggctacagtgccggaagactccacagtagcacaggcgaagtggcttaggcgaaaacgctgggaagtaccccagctcccgggggccagagcctctagggctggcagcctcagcaggcagagtcacttgcctccttcagctcaattgctgagggcttgcgtttctctgcagggaacaggagtgccgccgacttccactcttggtgcccttcaccgctcaaactgcaccccaaataagcgtatgcaccctgctccaagagaaggatgcgctgggctgatcctctggaggcaagagggcaaaagacagaaagtaacgagcggcctttgcacaaactcaactctctgcagcggcccctgcggcccaatcctgccggcccaggaatgcacggtcggataacaggcctctccttgctttttcgtcttcttcctcccgcttctctcctctctccttttcctcctcctcctttttctttaattttctcctttctccccaagcttctacagttgtttctgtgttcgctcaatcatggcctttggcattgattgaaaatttggcagttccttctctcggaattctgtttgaagccttcatatggatttattattattattattatttttgccacacaaaaggggcaaatccgcgtgaggaagggggtcgcatgggggtcggctgagatctgctggctgccggtctaggaggggcgctgctctgtgccggagtgggctctggtgcaccagcagaggctgggggagagtgctgcccccgcctggagcccaagtctctgcgtgcctgggggtagagcgcggagagggaccaggcaggcgccggaggggacccgcgcggaaaaggaagaagcccaaacaaaaacgctgtccggcgccaggcgcccacctgcaagcccaagccggtgctcggccagttacaaaagaaatggtcaggatctggacaacgataatgatagtattaatcctcctattaagaatcggcccaaacaaaccctcgctgtcagggcgacaggcgcccgcccaagcccagacctcggacctggttccaagcctgttcccgctgggtctctgggcgcccggtttctgcacctggagctcgcccgatgaggacaaggtctggaggccggcctgggaacaggggccgaagggcgagccggaccctaggggattggtagggtcggggagaaggggtccaggctaggggcgggcggggcgcacggagaccaggcggcttgagcgggaggtggggagctggaggagtgccgggttcgcgggcgggggacggggagaggggggcggggagaggggcgggagtcgggggcggcgaggggaggggcggagcgcgggtcccgccccggcgggccgctggaaaagtttagtctctgactcgctcgggcagaggccgaggaagccggttccggggacgggcaacagggactcagggaccagaaggcggctgcaggacgcgaccgagcaggaccccaggcccgggaacgacgtcgcgagcgctgagactgccgggcctcccagcccatctggcattcgagcgcaggaccgggcgccccggcaccgccgcgcgccacccgctaggatgccggtggccccagcgccctcagccgacggaggtgagaggcgggcccgggcggggcgcggaaccagggtggggggctgggggccgaaggacccacctttccaacaaaatccccaccgatcccgggcgcgacggggacttgggcgcgccacggcggccggagcgctccacatcagcacccctcccccagagccgctgcaggaacagggaggaggccttttccaccgcacccggagcgtttacaacgggctggagctgaatacctggatgaaagtggagaggctgttcgtggagaagttccatcagtcgttttccttggacaattaacaagttaggcttccacagtgccagggcctggggatgctggacgtgggagagggttgtggtcgttagcctgggaaaatcattcttttaaacaatattcgccggaaaattagttttttcctaacatttctcaaacaaggcaattagggccgtcagaatcggtgctggaagacgaagtccccacagtgcaataatgaggttcccacggaaaatcagtacgttgtgttcgtaactgagataacagctagagaaggggctttgggctttttgagtctcccaatagtcagtctctctctctctctctctctctctcttcctctgactttctggctttggacactcccaatggtatatttctttgtggtgtttttatatttggatataagagaggaacttcttgttggatttttaagggaacacacttcgttttgacccttccaataaggaaaggggagctacaggaacagagagctctttagaaggttacttttaaatggaggcccccccattcatggtacccactcccacttggacctctgagacctccagaattaggcatcattctaaaatctggacattagaagtcacagactttgtatataaccacatattcataatttatcttttcaatgttttttattcatagatgaaaatcttgcaggcatagttaagaaaaatataattcctagaaagtacaagggaaggattatgctctgcagatacatgactaacaaggatagctggccatgcccagggctggtgttggttgaggaggtggtgatggtgcggggcatgtgtgtgtgtgtgtgtgtgtgcgcttgaggagttgtggaagtgttcatatctgtaaagtattatttcatggatgcagaccttaatgctaggttgaataactttgttgccatagaagaagaaccgcacgtcaggcttttttcattagcaaaccagtaagcactcactttgggcctctgaaatcacttccatcacctaacaccagagatacaaactgaagctagcccttaagagcctccccctaagatttagagagaatgatttctcaaccagttttcatctttgaaagtgccatttctccctttatcattgtgatttttattcaaatgcatgagtctctgattttctaccatatacaaagggtagagactacagtttcctatagaagaaacttcacatagtggccgaaggatcttatttctcaaaattcaggaactggtttcctctttctggaaattatgacattaacttgatttcatggtatctctttcatcttcctcaatgcctgtgctgtatgtatatttttattatatactgtaggtatatttttattaccaaaaaaaggagaatttgagcatgccacaatcttgaaaaatctgaggttgccctgctgtagaaccctttaactgccaggactttgtactgtttcccaagtgttaccagagccaggccgccagccttatgcagtctgtttaccttagctggaaccagggtgctgtgctgtgggttctatgaaactttctgtttcttcatatttggctttgtaattcctttcttatcagttttggaggcatttcctattattcctctgccatatgttttctgccaaattaattgccttaagattttccttaagcttttggaaatgtataatgtttgagaaaaaagaaaaagaatagactgagtggaatcgtatctagtttcagttaataacatgtttcagttgatgttactgttatagctactgggcataaagtctccttcccttttttgaatcctatttttgaggcattgaagctgtgtctgtaagagacaataggccagttgggttaaatcagtgacgagattgtccagtgcagattggtgcccagtgagtggatcttcactgctcacaggccggactggggtcagctcacacagcgaggtgacggtccgctcctcaagcagtggatggtgctcttcggccttgcagatgccgctccattttcctggcttcaaaattttccagatatttcagtgcccccagaatgacatgctaacattctgctggcatgggagcatgaggcagtttgtctctaaaacatgccagagaatctcttgtcactacctaggcaaagaaccagtggcaaggtggcagcctcccaaagagctcatccctaatgtgacatcctggaatcagatggcacggacaccggcccagccccttcccagctctgtgactaaggacaagtgacaccccccctcccccagcctcggtctcctcctgtgtacattcagaaggcagatgctgccatgaggccatgtgtgctatgtccatggtgcaaggtggcacgcatgccgagtcaccaggtgagactgccgctttgggaagggataggaaggatctccggtagccttcgtgggcaggatgcctcttatttgaatgtgcctttagccacctcacagagcctatttccacatccctgtggattcatccctgtggaaatcttgagaatcatttatcctatgctgtcatgaagcagcagcagaatggagaaggtttaaaaagactcatggacaggcaaagcggtcaaacacctcctggctcagacgcacttgccttcccacacacaagtctggaagctcaggatggtgttcacggaggcagatgctcggggccggggcctgagtttcctggggcacagcctccatatctggggttccctggactatgcccagatagctcataatgtcccagccttatttgtgatggagaaggacttggggaaaagccaccgggaagcagtaagtctaaccagggaagtgcactgacttgcatgctttgaagaagagaagggagaaaagatacaaaaccctcacctggtttgtctgtaacagttgttatttctcaggggagctgcattaatgggccaagcctgtgcagctgggtgtgtgaagcatgcattttgcaatggactgtctccaaaagcagagcgaggtcacccaagaaatctagagcaagggaaaatactcattagcaaaggaattttgctggagccttgtaacggccgactcattatttcctttccaagttattttaaatgaaattttaaaaaacatcttgctttccaagaaattttgcttgttggcatatgtttggtgttttgattcagtttggaggatgaactagttaatttccctgggagtacatgcctattaaaaatatagcatcctgcatctgaccaagatgctatcttactatcttattgtgcctatcttttatgcggagagagaaaggggggtgttgggaaggagaccagactgtggaaacattttctttattttttctctttttcttccttttatagtttgtttatttttcaacttgacatgggtagagaaagcgaatcgctagtatagaaagcacatctggaatccatccggcctcctctctctggctcaccctcctcccagcaatgtttctccttggaagttgggggaaggtaggcacctctgaccttggcagggtctaacttggggtcatccactgcatactcatcttccagaaggcgtcttattcctcctcgacaaaaaaaaaatgtgttggtattaaaatgctttgaggtaggctggatgaacccagcttagtgaggatgacatgaaaacccttagctaatggggtctttattgagtagaactcaggtaagttcagatgtaagcagtgtctctcagtaaacatgaaaagactgaagatgcagacaatcaaatacttaagtctcttgaagagctgggtggtgggcgggggtcttcccaggtggtcagggagatgtgttagtgtagcacttggaagagagtggaacgaccaggcaaggatgtgccgtggaggtgggcagtgggagcagcccagtgtcagcatctgtattggttagaagaccaccgctaatgaggaggagcgtctctaccctgcagctgtctgtactcctgtgtcttccgtaatgtgccaagctctctgaatatatgcaaaactagtctgcaaaaagccatatgtctcagcatctggctttatttctaagtgttcaggtggaatttaagccgcgatcaaatttacaatgtcactgccagctctggacacttacttttggaataaagcaaagagtgaacactaatactgcatcagtcttgccctctgttaggggccgccccttctccccacaccagttttgcaagatgggctggctggggtctgagaaacccagtgcctccgagtcatggttaaagcccatctcagacaccaacacaccgctcacaaatcaacatcgacctgcgaaaacatggacatgtgttcgccaagagaacatcctcaatcaatcccagcagtgctacttgatgataatcaacacatgggccatggaagaaattaccccatgtccataaacaagaatgaatagagggtagtgtatctacccacaccatgagagcaagaatattcagcatgcaggtgcatctatgtgcatgactcgtacaagcatcatggggagaggaaagcaatggacacaattgtatcctgtagggtttcattcacgtgaaggtcagaagcaggctaaactcacctaggggagagtcctatcccaggtagtggtcatgcttggggacaggtggtgactaggaggggcacaaggaaggctgcagggtccggcccatcttgttgctggcctgggtgctggtctcactgatctctgtgtggtggggcaggtcagcctcccaggcctgctggtgcctgcagtgcccagcactcctgccgtgcctggcagtgttagtaccaatccgccagagtgactgactcccctcttgccctgagtagggcttgctgactccaggagcctcagggcggggtgggctttgagctttcttctagcaaacttgaggtctgtggctggtacccctcaggagcggaggggaactcttgtccatgagatgcttttaaccgtgcgcaataatgtgtagacgcatccaaaatcaatctggcctttagcccagcacttaactcttgggatgaggcctgctttgtaaatgttgataatccagagaaaatgagcttttagattccaaagacagccagatatcttccacttatgcaaaatgcagagaatcatatttaacaaaagatgttctggacaaatatgcttcttgagggatgaatatttaattataagggaaatgataaatcaaacattaatgggaaaatatgtttgccctcaagattcatgattttgatgggtctctggcaaatcttatactatgtttattggggttattttattgctggttattagtttttaattgtttgcttgttttctgctctgatcaatttttgtataagccgtgggtctattcaccctcttctctccattcccgggagcaagtccacatctggctgttggatgcatggcaaaagcaaaggtgtggagaaggttcagaggagacaggacatgtataaaatggtagggtcaggttgtcatgggggaaactgaggcacaggaggcaagctgagttagtacaagaacagtctgaatcataacgacatgccagtattacctaaaaggatgaggaacatggagctgtacttgaatccctacgtgagctggggaaaaggggcctcaggaatcactgacattggaaccaaggtttgtctgcagcttgtcggtttctgggacagaaacccaacatactggagtgggtatcccagcaatctgtaggataaaccaggacactgtggtgtcatggatagctggctgtctgccaggtgatggcccctctggttgcaatgtgagccgggcaggtcatccatttggcagcatggtgagggctctggccccagttgctatgggagggaggatgctggcacagggcactgttcacagactgcctttgctccatgccttttccatgagcatgagtggctgttcgtgtgggaaacggcagagccctcgcggtccccatcagcactgtgcagtggtaccggaggtggcaggagacagcctgatggcccaggttgtcttcatacccggcttcatgccagggtgcatgccgggcatagcacatgtgtccctgagaggcccctgatcaggggtggaaacccagcaaagtgaaaatcagaaatagtgattctccagttcctgttcacagataaagaaagaaagaaataataagcaatactaggcctggtgtggtagttcacacctgtaatcccagcactttgggaggccaaggcaggcaatcacttgaggtcaggagttcaagaccagcctggccaacatggtgaaaccccgtctctactaaaaatacaaatattagccgggcatggtggcgggcgcctgtagtcccagctactcaggaggctgaggcagaagaatcgcttgaaccggggaggcggagggtgtggtgagccgggatcgcaccgctgcactccagcctgggtgacagaatgagactccatcccaaaaacaaaacaaaacaaaacaaaaaacaaacaaaaacaactaaaaggacagtatctttttagcacccatcagtgtacaggatgctggggagggtactgtgaacttacccatggtgaaagtccctgtgttaatggataagctcaatgctcagaaaatgctgctgactgtggtattgccccatttaaagagacagtttgcagtacgttttcagaagtggcatgcagcctcagagaaaagtcaccaggggctggcatgattccagaaaatgttacagagcaagtggaatttgacttgaggcttgaaggatgggcaagatttaaataaaattcagaaacggtagagagggaggggctggggggaaggctgcccactggactgtcctgtttgcctccaggagaacctacaggcaagacatggtctcttctcaggtgaatgggaagccaagtagggctggcatgggtgagccacagctcgaggaggcaggccccgggccctgcgctgcctgtcatggctcatgagtgatgggagagatctgggcaggcaacctcctctcatcctgcatcatcagcctggacttggaacttggctgctttttctttctgcagttagcagagggccttggccaacacataagcctttctgccagcacttggcattccagctgacctcgacccaaggcctctgtgacttcaggaggcggcagctgggaagggtcagggcagttccaggcagagcacagacgtcagctcagacatcctaccccccgccaaccccccgcccccggggtttccagagcaaccaacaccaccaagctccaggacactggaaaaaaaatctttgcaaagaagcaaggggccatctcagaaaatccaggtcccccaaattgatgtagggagaggagggctttgacagcattcagcactccagagggtcacgaggatacagaaaccatttggagccacctctgcttctcagccccacccaggcaagccctggatcttcaagggactgatttgtacctgggaataaactcatgcatggatgagattcagagtcaatcacaccctaaaatgcagagcccatagtattggtgagttgttcatgtgtctctgaagcaaatttagggctgtggttcaaacatcgtaaaagttaaaaaaaattcactggatacacacagtaggctcttttaaattagcctcatttgaacttaattacatatttaaatactcaaataataaatgatggctgggtgcggtgtctcatgcctgtaatcccagcactttgggaggctgaggcaggctgatcacttgaggtcaggagttcgagcccagcctggccaacatggtgaaaccccgtctctactaaaaatacaaaaattagccatgcatggtggcgggtgcctgtaatcccagctacttgggaggctgaggcagcagaagcacttgaacccaggaggcagtggttgcaatgagccgagatcgcaccactgcattccagcctgggtgacagagcaacactgtgtctcaaaagaaaattttttttaataaaaataaaaaataaaataaaataagtgagtccactgaaagcggtttctaccttgatagttgggtgtgtggcgtcatcaacatcacagaaggctgatcgatattaccaggtgtggttgagtgcaagtgtttgaggtctcgtgggggaagagtttggaattcagaatccattgaggccttcactcaccactttccctctctcgctgtgttcccaaatgtgccacttttctgttggctcacatgcacccatgctctatttgatattcagggctctgaatttcaagccagactcagtcagtgtgattgtcactgctttcctgtccttcctttatcatctgtagacttgggtcccgtttttgcaggttgatgttctgtcttcgctgggctctggactcactgctcacgagtgcggtgtctgcatgggcactgcccagacatgcactgttggtccctcgatggctgcatggtcaggcctcagggctctctgccaggccgacctacagcccatacagacctgatttctgggcctggatccaggggatgccatctgggaagtgcgggatcttcccacgatgtcactgtaaaactcaccagggaggttttagaaattgaaccggcatcattcagattccatcctgctttttggtcctgagaaaatcctgcttttccctgagtaactgggataatgggtcaccagctcccatgccctagatgaggactagttagcattttctagtgcctggagatttccagatggaagctgtacttgggtctgtgtatctttgttacaggattcaataattcatgcactgaatttcccttcccggcaactccagacaccaaatcgcttcccatggtgtcccccaatcacttaggaatttagcctgtgtctaaagaccctctctgcagcctgacgtggctagccatcccagtacttccacgtttttcatgcctttctccaacagcgttgccgtggccccttaggcggcgatcgttttatcaatggtcgctccctctttttatctgttggcaggagccctttttcaacgccctcgctggagtctggcctgcacgccttgctgaatgaagccggaacctcagccccgcttccctttgaaatgaatgttcctggggcgccctctcgtggattttggagctaatcgtctgtgaatgccaagtgatggcaactgccctcccgccgcgtctccagccggtgcgggggaacgagaccctgcgggagcattaccagtacgtggggaagttggcgggcaggctgaaggaggcctccgagggcagcacgctcaccaccgtgctcttcttggtcatctgcagcttcatcgtcttggagaacctgatggttttgattgccatctggaaaaacaataaatttcacaaccgcatgtactttttcattggcaacctggctctctgcgacctgctggccggcatcgcttacaaggtcaacattctgatgtctggcaagaagacgttcagcctgtctcccacggtctggttcctcagggagggcagtatgttcgtggcccttggggcgtccacctgcagcttactggccatcgccatcgagcggcacttgacaatgatcaaaatgaggccttacgacgccaacaagaggcaccgcgtcttcctcctgatcgggatgtgctggctcattgccttcacgctgggcgccctgcccattctgggctggaactgcctgcacaatctccctgactgctctaccatcctgcccctctactccaagaagtacattgccttctgcatcagcatcttcacggccatcctggtgaccatcgtgatcctctacgcacgcatctacttcctggtgaagtccagcagccgtaaggtggccaaccacaacaactcggagcggtccatggcactgctgcggaccgtggtgattgtggtgagcgtgttcatcgcctgctggtccccactcttcatcctcttcctcattgatgtggcctgcagggtgcaggcgtgccccatcctcttcaaggctcagtggttcatcgtgttggctgtgctcaactccgccatgaacccggtcatctacacgctggccagcaaggagatgcggcgggccttcttccgtctggtctgcaactgcctggtcaggggacggggggcccgcgcctcacccatccagcctgcgctcgacccaagcagaagtaaatcaagcagcagcaacaatagcagccactctccgaaggtcaaggaagacctgccccacacagccccctcatcctgcatcatggacaagaacgcagcacttcagaatgggatcttctgcaactgatcgtctccatgcgccctgctctgcggctgtgttcttatttattgcatgcgtcgcttccacaggggcccctcaagagctgtgactcgggagagctaccttactttgaccaacagcctgcccagtgtggatgtctcttacagagggggcccaaggaatcaccaccccgcttcagtgtaaacaacgtgccttgtccactttgggctccagagtctttcagatgtactaagctgctgacatcatccactgccttctgctgcatcctagacaccctccctgttgttcacagagagggaaggtcgtgggccacacaatgctgtgtgaccctctccgtgtgcctctgaatggtgttttgatgattttacactacatttcctgtgcgtagaatggatgcttgtatattcgtacatctctatgttacacagaatttgtgttgcaggtgtttgccatgtggtacctacatagaatctccatacaacacacaggtaacaggttatacaagtggattcagactgaacccccagtacaaggacattgttttgaactaggtggacatgccatccctggtctccttagactgacatgattctcatgttaaccaagttttaaaagttcaaattccccaaaaaggcttgtccaaggctggccccagatgtgtgggtctgacccacaccagccctgtgtcctgtcctttcagtcatttgtccctgcgtaattttaatcgtattccaaagcccaattatgtgatggttttcaggtttctgcaaattacagaagagccagccaagatcacccaggagcttgtgcccccagatgggccaaagaaagagcctatgaaggagaagcagaagcagacggctggcctggctcaccttcccacgccagtggggcaggggtctgcttcaggaaatggaagctgtccaggaaatgagcagagattcacaagacagcactttgattctatgttgagtttgtttctatattagaaaagcagcaagtcagtaatcccccgtggcatcacagctaagtagctgtggccaccggcagtttcacagcatcctgaaagctggcactgatcgtgactatcagtgaaagaagtttaattttcaggttagaaaatgtgatctggcagtttatgcattcttcagagtaatgtaataatacctatgtgatgctgtaattttacttttcaacataagttgaacccgtagcagtctgtttaccttgtaaagggattacttagaagacatttttgtacatgctcttccccaaggattgtacgtattatacaaatagatggaaagaaaagtgaacacgtttgtagaactttcataagcacacagttgctgtgttgagttctctttaaaaacaaggacaaaaccaaccagcgttcaaaggaacctcccatcagagtcccctaaagtattttaggttcagtgagcatttgcctgaataaaacctaaaagagtagtcttaacacattactaactttttctaagagaaattgattcctgttttgtcatctgatgcaatttgctcttataaagagacattttcataggttcagagtaactcacctccatgggctgaccaaaggcttttctaatttttgttactgatgagatgaaacctatttgtaaggagatcttccccaggagcatttctgttgccttcttgacatcaatgaaaagtagcatattctcttatgaaatagcatgagaaaacacagggcatttctaggacagtaaaacgttaaagtactggattaagaaaacaacaacaggctgggcgcagtggctcacacctgtaatcccagcactttgggaggctgaggcgggtggatcacctgaggtcaggagtttgtgaccagcctggccaacatagtgaaatcctgtttctactaaaaatacaaaaattagctggatgcgatagcacgtgcctgtagtcccagctactcgggaggctgaggctggagagttgctcaaacccgggaggcggagattgcagtgagccaagatcgcaccgctgcactccagcctgggtgacagagcgaccctctgtctcaaaaaataataataataataaataaaacaacaacaaaatgcatcagagagccaaaacattcagtattgcattttcacataggtgatgaaatgactttggaactttatctgtgttatagttatgagttgctttgggagacttggagctctctgtagctattgttcataacactttgctccataaccctgatgtccgcagtatctaagtatctcagccttcatccattaactctactagggagcccacagccaccatttccactaggaggtatcaatatttgtggtatgacataaggctcccttgaaataacaagacttttgagcaatctgaattaaaaatacatcaaaaaagtaatagcgctcatttgctaaatgcaaaaaataatcacctttgataccaatgtgcaccaatatgcctaactagctagccagctggagataatttaccagggaatgtttcaaagccctaaccttgaagtttggaaacaggtggtcttctatgctgcagagaaactatgcattaggtctcttttcaattagaaacctttactatttccaatgtatgtttgttaaaaataataataataaaaccaaaagcctttgtggaaacccactcttcgtagtccatgtgatgggattgttttatcgttttcaccgggtgccctccccactgcaggggtgcgcactgttgttgcaggcttgctacccacctgtgtttcttagcatttcaggaattaaaccacattcagaaccccaaataacctttcccctttcttcttacccactatcataggtggtattttaatgaagcgtctgtgccttgggtgctatttacaccaattttggtaggtcatactattttgagaatggtcttttgatagggagaaatttctaagacccatggtaataaaagtgcagctcaaagacatgggacctcttgtcctgccccatttgctgttgtttatgcagcaggagagaataggtcagaaccaacctttgcacactagctttctcccacacaaacggtccattttagcctctctgtcccacttgctatgtaaagaggaggccagtgctcggcataactgttctggtagcgatgcttgttacaactcatgatgaaatgtcccaacgcaagtgaggacgcagctgcccgccccagagctagaaggtaaggtgagttctctaggagtacatctgcccggatgcattttcattccgcagccttgatgaatgggacgaggctttgttgtgactgttttttaagcagtcccccagggaatcactgaaaatacctacttcttagagaaaagtttcaagctcccctcctctcttttgtgaggcaatacaaaatccatcatccaaatgaaagatacttttcacaacagcctttattgcctgcagacttacatgtatagtcctttaaacaattaactgtttagaaaatggttgtttctctcaacccttgagccagttattccacgctggtaagaccctttcacagaaatgtaacaaggtgcattttatagaaaacatctaattaaatcaccagtttcatgcttttaagttgtatctacaagtgcaaaactgcaacacccaaatgtttttagtatctaagtcagatatccaaaagttagctccataatcagaaatgcgcacaccactgttctgataataaaggcacattttccaataaccaattataacaagaagtgcagcattacctaaattgggtgtgtcatc

SEQ ID NO: 1045 - DNA, 50978 bp, Homo sapiens
cctggaccggctcctggatgggtccccgctgccgcagggtgagtccctgcagctgatgggggcggcccaggggctggggtgcaacagcggcccagccctgacctgccccctgcgctgcagaggtggtgatgagcctgtccaagtgctactcctccctgctggactcgatgaacgctgagatccgcatccgctggctgcagattgtggtccgcaacgactactatcctgacctccacagggtgcggcgcttcctggagagccaggtgcggtcacctgcccagggggccagcctggaacggcctagccgtgcggactgggagtcccacccgactccctagtctgagcccttggggcaggccaggcacattctggagaatggggcggggaagacgtaggggtctgttgggagtgggggcatgcaccgggtgcaggtaccagagggcagcctggactccaccagttcttggagaaactgtggaagggaccagctgggagcaggagtttagggtccaggccaccacagcctgctgggccctgggccttcagcgtcctggtctgggcagaggggacgtcccagctcctcagagggaggccagagccctcaggcccgtgggccctggctgccctgctccctgtatgtgctccctccagcccaggttccctggagatggggcctccatggttggcctggaagggcagggtggaggtgggaggctaatggtaggcctcctggccaccggagtccaggccacagccctaatgatgaagctgggaagccaggggcaggagggccgcctggccgggctggcagggtgggctggctcgaggggcctggggagcccaccagtgtgaccgagtgcccctcctgcagatgtcacgcatgtacaccatcccgctgtacgaggacctctgcaccggtgccctcaagtccttcgcgctggaggtcttctaccagacgcagggccggctgcaccccaacctgcgcagagccatccagcagatcctgtcccagggcctgggctccagcacagagcccgcctcagagcccagcacggagctgggcaaggctgaagcagacacagactcggacgcacaggccctgctgcttggggacgaggcccccagcagtgccatctctctcagggacgtcaatgtgtctgcctagccctgttggcgggctgaccctcgacctcccagacaccacaattgtgccttctgtgggccaggcctgccatgactgcgtctcggctctggccatgagctctgcccaggcccacaagcccctcccctgggctctcccaggcagggagaatggggagagggacctccttgtgtctggcagagacctgtggacctggcctccccactcccagctctcttgcactgcaggccctggggccagcccgcacacaccatgcctcctgtctcaacactgacagctgtgcctagccccggatgccagcacctgccaggtgccgccccggggcaagggccccagcagccctatggtgaccgccacactgtgccttaatgtctgccgggggcccaggctgtgctgtccctgcagcacgcctccttgcagggatctgagccaccctccccgcacagccctgcaccccgcccctggggttggcagcctcagttggcccctggcagaggaacaaggacacagacattccctcagtgtggggggcaggggacacagggagaggatggttgtccctggggagggccctctggccccaggcaaccttagcccctcagaacagggagtcccaggacccagggagagtgtggggacaggacagcctgtctcttgtagcttcctggggtgggaggcacaggggcaaagcaataccccagggaaagtgggaggtggtgctggtgctctctccaggcccaccatgctgggagaggcggccagagcctggggcctccagcctgggactgctgtgatggggtatcacggtgatggtcccattaaacttccactctgcaaacctgatctcctgcgctctttctcgcgactcttgtcctctgcatcttcctggctgtgtagggtgggctggcctgccgggacttggggcctggagctggtcaggagctgggtgtggccccctcctctgatacataagcccgagagcaggctccccgaatcctgcccagccccttggctggaccccctgggcctgagtagcctctggatgtcacaggaaagccatgtgtcaccttcactctgggccttcacctgtggcttaagccaaatcccggcctcagtggtgatcctttcccaagatgggtacaaggtgacaggcatgttttgttttggagaactgagatttccattttcccaggcgataggtgtcgctgcccttcacagtccccaaggatgtggcgccaccatctcagtgccacgcacacctggccaacatgccgtggcccagaagcagcacgtctcttctcccaacccgctggccaggcccagtcacagccccactccacacatggcagccaggaagtggggagggcaggaggtgctgggcaaataaccctgataccatcactgtccagtccccagtcaccaaatgtcccactcaccctccttcctgttctggatgccccgcccctcccctcccctcccaaggacatatgagtcccctccagtggcggtggcaactctggtctagggtctggggccgtctctacatgtgttgcttcatgtaccttcttcacatcaggtctgggggaggcgccaccccatccagagacctaggaactagaagactgccactgcccctcacacccagggataggatgactgcagtaacccctgtgaaagcgggtatggagggcacctggcagcccctgctgcatggccatctaaagtcttgccaggcaggcacagctagggcccctgcctgggagtggacaccccactcccccaagtcatgttctctgtggcctggggctccagccttgggaggacccctttcctgtttcttaaccatgcttgatggtgtcctcaaaggagccctgctcagtggcagaactgctttctcagcctcttccccgccaaggttgttttcaagtcccagcagtcacagactttcatcctgggctcttctttcttttgcaattcagctctcgaaatgactctgtggtctgcgggtgactccactccacgtgcctacagccacgcccacagcgccacctccggacgctgctgagctgcgcacctgtgcctgacacctggctttgggaaactcagcagcagtgcccagcgtcatgaccctgggggcaggagggcatctggatccaggatggcaccctcaccacaatctgtcttggctctgtgcccgcccgtggggtacacaggagggctctttcagccctaagtccttgtgttcctgacctttgttcctcttccacccagcttgcaagtgcagaatttttttttagctcgtcgcttccctgcagtcccttgtccaatgcagcctccggccgatactcaggccagtgttgtttcccaacctctccactagatacgcacacttagctcacggtctgcctcatgagtcatcccagttgagctttaccaaatgttttgccccacctaacagcctgcccacattccaaatcctggcaggtcgcacgttttattagcacagcacccctctcctagcggccagcttctctattaggccacgttatgctccagccacacaactatgaagcgcagacgtctcacacaacaaagctttctcatgctgcaggcccacctcaggctggcaggggaaggggggattctcttcaatgtgaccactctcggacccgtaccgatgaacagagatctcaaatgtttccaggcaccttgccagggataagagagctgttgaggggctcacactggcagtggaagttctaaggggcctacaaccacaggggctgcaaccccaccatatgcacaaaagcgggggcagatggcaaacagcactaatgacaacgacggagctgaggccagaatgtgagagagatctgcattttggggattagggcctagtcaggcaggtaggagatgatgttcaaaaagggaaaagaagcgtgatgaaagactggtttctacagagatagattagaaagctgaagcctgaaaaaacagtgaaggagacccatgcaaatttctaggccctggaggtccaaataaggttttctaagtccctcaggccatgacaggttcagtccagacttgtctcccagagtgtttctctgccatccctactctaactgggacttattggtggtgtttctctcctaaggccagatgctttgcacagaacattaggaaactccagatgtaaaggtaaggcacaactgagaatcacctgcccagggcagcaacacagtgtgaaggaaaacaggccactcaacccaaacttacacctgagacagaggcaacagaaaaatcagaaaaggactttagaacacatataatcaaaatctcagacctaaagacgacttttgaaataaaccataacatatgaagaggcacttatgaaacaagaacaggtagtttataaaaaagaaccagtcagagaccctggaaattttttaaaaagcaattactaaaataaaaaatgaaaactcagtcaacagtgctctggtttggatgttccctccaaaattcatgttgaaatttaattgccattgtgatggtattaagaggtggaaccattaagaagcgattaggccatgagggttctgccttgatgaatgcattaatgtcattatcagagtgggttcgttatcatgagcatgtgttgtaaaaatgaatttagctgtctcttgctgtgtgtcctcttgctcttccatcttcccccatggaatggtgtggcaagaaggcctttaccagatgccagcccctcgcccttggacttcccagcctccagaactataagaaatacatttattttcattataaattacccagtccgtggtattgttataggaacagaaaatgcacttggggatattaggtcgtggagagtaaaaaaaaaaaaaaaataagttccagtcaatcaaggcatcctcattctcaacattgcctgcattctaccctccaggggtcccctccatggcccttcatctgcccccaccccgcaactcagcctcatttcttcagccattttctcccccacatctctcttcccttcccatcagaccttcacatcctgcaagctaagccacctcaactagccatgccctcagggctcttactcaagcacccaccaagatgtttttcctaacaaagactgtccttttactaagaggaatctgatgtcagctgttagtctccgctcccccccaccccccatctctcggaataatcacctggtcagagagaagcccaagagcacggacatgccagctaaaggtggagcttggcaagggtgtccacagagtggccaggcccagcacagatccgaggggcttttaacaggcacaggcagagtgctaaggagatcactaccacccacccacccatccagccaggcccagataaacctctccttgttccaaatgaatgagcaaacagaaaaattccagtgtggagggaatacaacacccacaatgcagaaaatagcccacatccaaaatatgctcccctcagataactagtcaactgtgcaaactatctgcataatcctcacaataaagttgaagaacacaaaaccacttcatacaaagagttaggaaaaaaattcctataaggaggagcatgtaccatatttattcccactctgtttactaagcatgtattataatgagaaaaaaagctcaatctaaaatattgccaacaaagaatccattcctcacgttgcagtaaatgaagcgggctgaggtcagcctccttttatgctggctgccccaactctaaggagttgatgcgtcctactgttaacagcggaggatgtccaggttcttggcgtcttaaataaagaattggacaaaacacacacagagagcaaagaaggaatgaagggatttattgaaaatgaaagtacactccacagtgtgggggtgagcctgagcataggagcacaaaagccctgttacagaacttcagagagtttaaataccctctaggtgattccattggttacttggggcacacgttatgtagatggagagcctgttacagaacttctgagagtttaaacaccctctaggtgattccattggttacttggggcacacgttatgcagatggagaggatgaagttacaaagtcatttgcttggcctatgtcctatggagaaggtatttcctatcataactgaagtgtgaatcagcctatgttccctgcactcagaccctattttcctgcctcctacctacagctgtgtggtcctgagctgtcacctcttccctttgaagctcaggttcctcatcggtaaaatgaggcagaaatactcactgctgagatgtgtggggatcgcacaaactcagtgtctcaacatgttgtacgtgtgttttggccctctgagcccttgagggctgccccaggtggaaccctcttcacttttcttggagaactgaccatgggttgcagcaaagcctaaaatggttcctgtttcagccctgcctgggaagattcagctggaacctttaggctaggaaaaggttcgagaaggaccctacccccactgtgcccgacctgagacaaatccacagaaaagcaatccttgctaactctgggcagtatgtggacaagatactaatttttaatctctgcatctccatgagaatgcaaggaccagcacagtgaagtgcccaatgattgccccctgaacaaacggagatgtcaagttcagaaaaaatcctggctgaggaagacagggaacattcccttgaaaaacaagggcagtcatccagacagagcaagaggagtggcaggataagaggaggcagacagggttgattccacagggctcctcctcaacacccatgaacctgagaagtggtcagatgcgtttcaggccactggccagcagtggggtcatggcgggaactagtcccacctgaaggactctcatctccctacaatccccaaacgctgaggcatggggatgctcttccctccttgaagtgagggccccgaggctctcatactttaattacagtacttcagaccaagagcctgcagttgaggaggccagggtcatgaatcagctgccccccaaactccttatctcaccaacccaagctgcttacaacccctccagatatcccaggagccggggggaatgtcattcttcagggctgagggaacatctttgcaccctggggtagcagatgggaccacagggcatgtggaatgtcttagtctgtttcacactgctatacctgaggttgggtttgttttatttatttatttatttatttagagacggagtctcgctctgtcgcccaggctggagtgcagtggtgcgatctgggctcactgcaagctccgcctcccgggttcacaccattctcctgcctcaatcagcctcccgagtgaggggctgggactacaggtgcccgccaccacacctggctaatttttttgtttctttttttttttcagtagagatggggtttcaccgtgttagccaagatggtctcgatctgacctcgtgatccgcccgcctcggcctcccaaagtgctgggattacaggcgtgagccactgcgcccagccaaggtgggggaatttatttttttaaaaaagcaaaacaggtttatttggctcaaaattctggtggaaatttcaagattgggcagctgcacctggtgagggcctcatgctacttcaactcaaggcagcaagtagaaggggagaggcatgcacaaagagattacgtggccatatggcgagagaggaagcaagagacaaccgcaggaaggctgactctctaaccagctctcatgggaactcacccctccacaaaggacactaacctatccatgagggatccacccctattacccaaactcctcctactaggcaccacctcctaacactgcctcattgaggctcaaatttcaataccattttgggcaggggcagaccacatgcaaatcacagcatggggtaatagtgggggcaggttgacacagggctgctgcctacccagcaccagctgtctcttggccccttccagatcctggcaatctggctacaggcatgggcccagccttggacacagatgtggccacaggaagctgttagctctccagatctgatcagcctgggagagcggcacaacaaaggctcccaaaggagagtcgggatcctcagctagcctcagctctgctacccacccatatgtgcccagaacaggaaagatacgtgtttcttactcctccgggactcctaggtgaagctgagaccaggctcttcttgagtcctctcagctatggtgcaaccaccagcctagcaaggaatcagaaacatcttccggaagagtcagcaccatagagggtgctgaatgggcaatgaagcatcccggagatgaaacatctgggcagtgaggcatcccacaggtgttgggctatgcagtcactccctttctcagaccgaggcaagtacataagcactctgggcccctaatcaggggcctggggccaggtgggatgaaaacagcagtgtcctgccacctgaacaactgctactcacgcaggccccacctggcctctcagagggaggaacctgggactcctgaaccagattcagtttctccttcaacagccgggacttttcgctcctgactgcagaaaaacagcttcaatgtgaccatccttgatagtccgaggctgagtaaaatggcctgaggaggcaaaatctgaaaagctctattaggtggcaaactgctgtcactagaagagttgaggcccccttctcctcccctgcctgaccgccttcattcctgggaatggaacaggttcttggggcaagggtgaatcctcgagcaggtcccaggatcactatcctcacctccccgcggcactgaatggctatagctgtaaatgtgcgtccacggggtcactgtccagccaccaggaccaggtgcctggccatctggggaatcggaaaacgctcagcgggatgctctggccacctcccctgcccccagttaagatgtagagcgttcaacctaaaatgcctagaaacaaagcccaggcccgggaaggtcgaacgagtgcgacgccgctccctcaagctcttccctcggagccgtctcatttcccaaaactcccaaacacatcacagagagaggtgttgagccaggtggtcactcccttttccagaaccacagcaagaagttgagcctgctgggctcctaacgaaggccctggggcccggtgggatgaaaagccctattaggtagcaaacagctgtcactagaggggttgaggcccccttctcccctgcctgacgacgacggcggcaggaactcgaccggcgccggacagctcgcaacttgccttaccaagcgtaaatctcggttcctcccaactacccgcggccacggcctccgcagcagagcgccggaagcagagacgcgtttcgggaggaaggtgcatgctgggagcggcggcgcatgctgggagctgtagtctgcgacgcaactcggccgaggtggctccctggtccctgaagctcccagagcccgcgtgttcaggcggtcccgacaccccggcccgagcctcaccggctggaggactgaacgcctgccggccctccgggtatgagcggaggccgggatagccctgggctccgccgcccccggaaggaaaaaatacagtgcggtccgccgcccgaccacgaaagagcggagctcgggagccccgccccctgggcctccgacgtccgtggcgctttccgtcgcgcgagtgcgattgggccgcctgtcacgtgacccgagaccccacgcccggttggctgccgcctggttaccaatgggagactagcgggccggcgtactggcctggtccagcacctgcggggccctcgggcttggagggctgggccgggcggggaacgggcggggcgggccggaggcggcggcggctgactcgccttctctccggggctgcgaccccgaggcaaccggctgcagatgggagcccgcggagccgaggatgcgggcgggccggggcgcgacgccggcgagggagctgttccgggacgccgccttccccgccgcggactcctcgctcttctgcgacttgtctacgccgctggcccagttccgcgaggacatcacgtggaggcggccccaggtggggccgtgtggggtgcggtgggcgccgtttctggtttctgagatctccgctcctcgcagggagcggggcggggtgggcggccagggtagctccgaacgcagggtccgccgttgttctcctcagaagtgggcgcccggccccctcttttcgtacctccttcatacccccgcccagaacgagcaggactcggcgctaccctaaggacgctaaactaggtcgtggcctccgcctgcgagagctccaatccaggaggctcagagcgctgcgagaggcgttttaacagagccccaaaccccgccccacctgtttgctttcgccctgaagagcgtttgtgtctgctcctcccgcagagagggccgctcgtgcccctctgaagtggctaggccgagcccacaaagcaaagcgtgatagaatttcagttttggattttgtgcacctgcctttccagttgtaacacctagaaatggcacctccaagggatgccctggccgagtgctgtgttcatatttttagaaatggtttatctgctgaataagactgcccagggagcaaccttgccctaagtggatgcggtcttagcggagacaactgatggccgccagtcttcgaacagagctggaacttctgggctctcgtgactgagatggctttgacaggccacctggtttccttggacaacactgaagggcctgggaggaggcaagggtcagaccatgtagagccttgtcattggaatttgggttttattttgttaaaagattgattttaggtgcagctggaggccactagagggttttggtagaggagtggttctcttggatgtgtgtttttacaagctcactcttgctgctgggtgggaagtgggttgtcggggcaagaatgcaagggtccattgtagtggtcctggagaaagatgaaggggctcagattagcttgacgactgttaggatgtgggtttggagtagattggtttgagacgtaccttgcaggggggatcgagaggccatagtgactgattgaaatagagggtgaggatagtggagggatcaacatgccttctgggtttctggcctgaacaggtgggtggatggtggtcctgggacagagcctgggggtgacctagagttgggctttgctctcacgtcttcaggtggagctgtcctggaggcaggtggatctgtcctggaggcaggtggatacggagcagggataggctagaggcattcttctgggaggcggagcatattagatggtttacagtccacagcctgggagagtgtctcgggggagtatcagtaaagaagaagggggccttggggctgagccttgaggaaccctaacatttcttggggtcaggcaggtgccctgacagatagacttgagaagcagcaggcagtgagggagaggacacccggggagcatgcggcctcacagaagctgagtggggaccacctcaggggcagcagatggctgttctgctgttgtgaatgctgctgagtagttggggaagagagttgggaccaagagaagcccagtgggtttgataacatagaggtgacagcgacattgatcgaggcagtttaggggccatgattggctcagaagctagaggagcctgtgtggagagtgaatgggaagcaggtagtgggcatggcagctctttcaagagctgtaatgaagagaagcctgaaggagactatggtgctgagagataatgtcttaaagaacatgggggtgggattctgcccggggagctggaagggaaggagttgtgagaggagcccaggctctgagggcaggagagagggtcaggtccagaagcaggaggcaaggtcgaagctcagaggggtgggcaagggcagtgtggatgttttgagtagacggggagaaaggggaaggtatatgatagttagggggtgtgggaaatggagcctgctagagaaacagatttccagcaggatggaggacacatttgagatttaccagcatgagtaaaaagtgaaacttttcgaagccaacatttagctgttttgagaaggagcttgctagagtttgggatttttccagtaaggaaggaaggcaccccagaattaagctggacagaggcatttgaagccaggagctgaaggacacccgctgcaggaaaccaccttcctgtccctttttgggtaacactgatgatcggaaaagctccaccccaactcctgtcatctagagccttgggttcttagtttgaagggttccacagcaggcatgatctaactctggacaactttctgtatctcaggagatttgtgccacaccccggctgtttccagatgacccacgggaagggcaggtgaagcaggggctgctgggggattgctggttcctgtgtgcctgcgccgcgctgcagaagagcaggcacctcctggaccaggtgcggggccccttccctgtgtttgtcctggagccggtttctttttgcgtttctccagcctgctgagtaccaggaggccttgcgaaagcagagctgtgccgcagccggatctcctgctgtgttgggggaaggcaggagagttccaaggcagaggctgaggactgcactctgtccctctgctgcaggggggggtgccttggcctcgccagaaggctccatcagggaggttcgccctgctctgtgctctcctgacccccggactccatggagtcagatcaccacgtttagaataaagagacaaatgtgccagctcacaggaggacggggctggctggcagcctctgcctcagatctctcctcagctagctcgctggttttcttacaggttttgaatataagtttgcaaaaagttattaaacctgtttctgtgggtagacagatactctgggaggagaaggccttctcaggttttccttacctgggagtgttcaccgttttatgcttggcttgttgctaagtgttgctgattaatgcagcggcgtcaacagtgtgacctcattcagagtttcactcatgtcccaggccccatggtaagcgtgtcacagtcactggctttcagacacatggtcttaccagctttgactttttttttaaacgagagtgctaaaatcactgccattgtgtttctggccgtaaagtggcagagccaggaccgcaccaggtgcctggtgcccagcctgcactcccccgatgctgggtcagaatgcttacccctgaaggagccctgcggtggacgctgtgggtgcaagcagctggcccagtgtcggggcgccaggctcccagcagcaggaggggctgctgttcctgtggtgacgtgttgcttgcagccagctcggtcaagaactgggtcactcatgcccttgaatgtcacatttgttttggcttcaggtcagatgcttttagtgagggcagcagagtgtgtcccgggatatgtggctccctcggtgtggtcctcaagttttgcaatgagaggtctgttaatttcatgtgggtgatgcagccctgtgcaggcgccgacatccaggtgtgccgaagagttctctgcgacatccaggtgtgccgtagagttctctgcgacatccaggtgtgccgtagagttctctgcgacatccaggtgtgccgtagagttctctgcgacatccaggtgtgcgttagagttctctgcagaccgcggtgcctgtggagcactcagctgtggccacaccgcggccgggacactggagtagcgccgggtggtgcttatatcacgctcgccttttgcttctccctgtgcatggcaggtcattcctccgggacagccgagctgggccgaccaggagtaccggggctccttcacctgtcgcatttggcagtttggacgctgggtggaggtgaccacagatgaccgcctgccgtgccttgcagggagactctgtttctcccgctgccagagggaggatgtgttctggctccccttactggaaaaggtctacgccaagtgcgtgtgctgggggctgaagggcctggcctggggcaagtgggagctgccactaccatgggctgccccaggagggtctctgctcactctgggctgcagagcccccttcagttctgagggtctggcagctcattctgtgagtcaggctgacaggccaggtgcagagattcttcttttgggcctgtggattgcccactccctgctttcccttcccttgttccaaagcccagcgtggagtcgttctccacagagaacatgtgtgccgtcctccttattttatcggccccagcaagaaagatgcttctttatatttgttgtggagtggttgggacaggcagactcattgtgtagtcgttggggaggaatgaggctaccccagcataccaacacttgtgtatcacggtgcttgctggctcaggggaccaggaccctcaccatgagtcataattgaatagccttccctcttagaatgcatttgtcttcttgccaaaggcaactggactgacaggcaggcagggaagctggtgaacatgggaaggctggctggtgacatcagtgcccagtgagcccttccatcccaagggctgttttaggaaaagcagggttggagcttgagagccaagggatgtgggcatccatagcttccacgcctcctgccctgctcctgtgcccacaccggatgccagagagtttctgtgtgtgggcagaggactgcagggcgctcacgcttgctgtgaagtaaggcgtttgaaggtgaggctaagccttgacttggtgaggatgaggaagaaggcagaggggagtaaagaggtgggattgaggcagcggttggacgatttggggtgctacagaccatgggaatcagagagggggccatgctcaatgccagaggctcactcccatggtgattgtgtcccctagggtccatgggtcctacgagcacctgtgggccgggcaggtggcggatgccctggtggacctgaccggcggcctggcagaaagatggaacctgaagggcgtagcaggaagcggaggccagcaggacaggccaggccgctgggagcacaggacttgtcggcagctgctccacctgaaggaccagtgtctgatcagctgctgcgtgctcagccccagagcaggtgaggcacgtggccagcatgggagggctgcagccagcgtgccccccactgccaggcctcaggcacactgtagctttttatgtgactggctacacagccctgtcaggactaagtgggaagaagtaagcttgttctcaagggtggtgtcctcagtttgtgaccttcccctactgtcctcttccagagggacgtggcccttctctcccctgaccagtcctttccactagtgcgaggcaggaagaggtggcaccgagtcaaagcccactgtctgtgccatccctggcccagctggcaacctggcaaaatcaaaacctgttttttattttagtgatagataacattcgttaaaaacagtttgtctccaaaaaatgaaaggggccaggtgtggtggctcacacctgtaatcccagaactttgggaggctgaggtgggagtatcgctggagcccaggagttcaagagacccgcctgggcaacatggcaagatctcatctctacaaaaaatgaaggaaaaaaatcacttagatggaaccacatgtgacttttgagtgcgctctcagttttccatgagcacgcacggtttacgtgttcccttccgcaccgcttctcacactgccacacacgcgctgtcaaatgttcgccccatgagcgggtttgccacagtctcttaatcattcccctgatgttggatattaagatctctctggttttatataattataagcagtatcaatgaacatctttatcatttttttcatacttaggattattttaaaaatatgggttaaagaatatgaatatcacagtaaactgaaacaagttgtcataggccttggtctgggtcccccataagcagaccctgagatgaggttcaggagcacgttgagaggttcagagagcctggagggcgtgtactccccgccagccccgctggggtgccaggaaggacgctggcctcagagcctcccacctgggagtgagggcgctggtctggtgggcattagctcggggagctgttggttttgggtgctccagggtggggtagcgctaagtcctagcacttcaggctttagaggaagcccccaggcagagagagatggcagctggcactgactggaggtgcattggagcctgctgaggtggcaaggggccgcggcgtgggcgagactgaagtccttccaggagaccctcctctctagaccgttgccccgccacagatgtggccttcctctctgtttggctctttcttttctatgcccatctgtctcaaggtctctggccaggtggagctgttgcccccctgggcctccatgcctccagtgggcttctagccagggcactatctgaatgtcctacctctagcaggctttgccaagagaaacactctctagatttctggcagttgcagatgcatctgtgcagcatgtttgagaactggtgctgtgccaggcatcgtgcacagatgggtacggacgatgactgaggcctagagaaggggatgacttacccagcaccagacccggatggcagccgagtcaggccccgtgtgcttgctcctggagatgctcctgagctgatgggtcacagctgctaagaaaggagctctcgtggtccatggggatctggggtctcccgtgtagccatagtggggtgggctggagcatctccagaggaggaggcagaggcctgtgtgtccttgtcagtttgggactccatggtgcccttcctgcctgtgcctgcgccattcctcatgcaggtgcccgggagctgggggagttccatgccttcattgtctcggacctgcgggagctccagggtcaggcgggccagtgcatcctgctgctgcggatccagaacccctggggccggcggtgctggcaggggctctggagagaggggtgagtgctggggcctggaccatgctgctgtcgggaggggggcccagtgccagtctggcctgtgtcctggtcaccttcagctgtcaggactgtacttggctgtctccagcaaggcccctgagtccctgctctcgtgacaccatgcttgtcttggctccaggcaatccttgtgaggcctgggaccaaggtggccattgggcctggggtttcaatagggcagacatcatcacgggctcgggcagcagtcctgggaagacgcatccagaggcgtgaagttcctctgggaaaagagagggctccagggtggccgctgcccagaaggccctgtgctgcagagctgcttcgggtgtgggaggggctgcagagctggggcacggggttgctggcaggaactcagggctctctgggtcccctccaggcttccccccagcctgccggcaagttgacactaccagttctcgggaggggcttctgctgagatgaggtttcttccaggggtgaagggtggagccaggtagatgcagcggtagcatctgagctcctgtcccagctccaggaaggggagttctgggtggaggaggaggagttcctcagggagtttgacgagctcaccgttggctacccggtcacggaggccggccacctgcagagcctctacacaggtagtgccccgaggggctgtgctgggcacgtgctctgcctgccgaagtgaggaggctgggcaggtgcctgggttccccctgcccaggcccagtttggttctcttcagcgtggagagatgattctgtcccaggagccgggaggagggtgatgattctgtcccaggagctgggaggagggtgggcttgtgggaggggctggctctgtctgtggccgtagctgctgcttagaccctgccagggttcatgaggccaccatggcgggaggccagcgaggagccgtgtcccacagctgatgcctggtgttttctcactagagaggctgctctgccatacgcgggcgctgcctggggcctgggtcaagggccagtcagcaggaggctgccggaacaacagcggctttcccagcaaccccaaattctggctgcgggtctcagaaccgagtgaggtgtacattgccgtcctgcagagatccaggctgcacgcggcggactgggcaggccgggcccgggcactggtgggtgacagtcatacttcgtggagcccagcgagcatcccgggcaagcactaccaggctgtgggtctgcacctctggaaggtaactcagccccgtctggctcacgctcggttcagcaggtggtgtggaggcccatggaggtctgggttctaggactggctctgccgggacacatgtgactctgccacgggccccaccagtctcccccctccttgggctgttgcacggggttgacgtctgctggtgctcccagacccggctctgacctgagactgcaggtctttctgccttgccgtgtgcctcattggccaaaggaaagcaacagagtctgcagccagggcaggacccgcaggaggggcctggacccggggggctcctggcagcgccgtgcctttctgaggcaaggaggtagagccagcggctgaggacctgtcagggccagtcccagctctgcagcttgctgtgtgacctggcacacatcctctccctgcctccctcagtctcttcccctgcaagacggggtcctgacacggatctcatgggattgctctgaggcccaggcagtcccaggctcaaccactggttcacaaagtgtgttgtttccaggaagaacagatgggggcgcctgagggcaaagggcctgagtgtgggtcgaggatatgccggctgctcgctcaggggctgggttttcatcttgtgtgtcttgacagggtgtgacacttggcaccacactgttccctgtcccttcatggatgtggcccacatgatgttcctttcctcttgcaaaagaagttgctggaaggcccactgtccagcagcccccaggttgcctgggccacggtgcctttgtgggcccagctacaaggaggacttgcaggctcgtgtctgggacagatactggcgccagggccaagtgaagcccgggattggtgggcatctctagctggtccctgagagagggtggagggtgctgacaggccttggcgctttcatctgtcaactccagaggcccttgtgcttgcagcagggaggtcaaggccagggcgtctgaccccggccgctcctccacactgagcctcctgcacgtgctcacaggtagagaagcggcgggtcaatctgcctagggtcctgtccatgccccccgtggctggcaccgcgtgccatgcatacgaccgggaggtccacctgcgttgtgagctctcaccgggctactacctggctgtccccagcaccttcctgaaggacgcgccaggggagttcctgctccgagtcttctctaccgggcgagtctcccttaggtgagaggaaccgcgcagtgctgctggctctccgaggccacaggcccttccaaggcaggatttgggcactttccctctgtggttggcaggtgtccatgtgggaactgaggccaccgggaacctgctgccagcgccctcccatgtttgtcttcttggcagcgccatcagggcagtggccaagaacaccacccccggggcagccctgcctgcgggggagtgggggaccgtgcagctacggggttcttggagagtcggccagacggcggggggcagcaggaactttgcctcataccccaccaacccctgcttccccttctcggtccccgagggccctggcccccgctgcgtccgcatcactctgcatcagcactgccggcccagtgacaccgagttccaccccatcggcttccatatcttccaggcaagctccttgccccagggagggagggggagcagaaggggccctcagagaatttgcatcttggcctccattgtcccaacagagggctctgggctcagtcacttgggctccccctgcccttcgaggcgctgcctagaacccgcacagggccctctcccatctccaacctctcagaggcaaggccgaagatggcctctggaagggccgggggcctgggaggtgggcagggctgatccaggcagggcaggtttccagaggaggtggtgagtggggaggaagggagaagtttggagaggacaggaggccgaggttgagaccagcgggggtgggtcgagccctggcttgggaacgcagggggctgatggactcaggagtgagaggaggggaggcccaggctggctggccacagcagcccctcgggtgtgaggaagtccacagtcactgagctcagccagcagccccttgtccacttaccctgactcagaatgactgtgtcccaaggttcattctctgcagacatgtgtcccctggaatgcaggggccctgacgaggaaggcactgcaaccctcggttcacagtgggctgcctggggacccttggaccctcgctgtttgccctgggccaccggctcaggtcccctagagctctgaggaaaacacatgccagggccagtgggagcccttggggcgggctgggcagtcacaggtgttaaagcccctgatgatgtgacaggcctccaggcgggggccccactgccggcaccttctggcaagggtggccaggccttggtgaggaggcgagtccagtgtccaggcctggcagcccctcctcagagaaggggctgtatgtgactcaagagggccaagggcatccgagcagatggccctgggctgggctccctaccccaaggctggccccctcagtctgagcctgcgctttcctcaggtcccagagggtggaaggagccaggacgcacccccactgctgctgcaggagccgctgctgagctgcgtgccacatcgctacgcccaggaggtgagccggctctgcctcctgcctgcgggcacctacaaggttgtgccctccacctacctgccggacacagagggggccttcacagtgaccatcgcaaccaggattgacaggtggggctctgggacttgggggcggccagctggaggctggggtgctggagtcttagtgctcgcctgtccccccacgtctcctgcctgcccctcaccctcaagcccctatctgtcctggcagaccagggctgtcctgcctacctggggacccttccttgctggtctgagcctggaaggagagtctagtgggaggtgggccaggagcacacagccacttgtgtgacaagtgcagtctgggagcgctgatctggtgtctctccacaggccatccattcacagccaggagatgctgggccagttcctccaagaggtgtgtatgcagccccgccagcccggctcacctgcctggggctgcctggtggcctagggtctacctgcaacctcaggcaggtggtttctgcctgggacgtgaggtgcccttgactcttcctgtgagagccccgggcggtgccttgaagggcagggggagctgaggctgcgtcccattccctggctgcactcggggtggggtgtgagaaggggcgagtgccaccgctgcccgggccccccatctgtctttgcaggtctccatcatggcagtgatgaaaacctaacagggtggccccctgtgccagctcaggtgactggagcccgagggcctgacaggttcccagcagctgggccggccagccttgcactgtgggggctggtcctgagtcttggcctgcctcccagccctgccaggaggctgcggcctaggggtccacgggaagcctccgtcaggagagacgcagccctgggggccagctggtgctgcaaggaagggtgggaagcttgctggcttctgttgcgccactgagacggcagagaccccaggatcccagagcttcccaggatccctcccagatcctctgctgactccatatggaggcctcacacccagagggtagggcagcagatcttctttataactatttattgttcgaatcacttttaggatgtaactttataaataaacatgagcgctgatgatttgcagatcagtcttgctccaggtagttccaggctgtgcctgctcttgccaagcaggctgtggggagggctgggtgcctgccgagatggtgaggatgaggatggcctctggaggggctgggggcctgggaggtgggcagagccaacccaggcagggcaggtttcagggggagatggtgagtggggaggaggggagaagtttggaggggcgggcccagggcatgccccaggccagggggctgaggttgaggctggccggggcaggtcaagccctggtcttgggggacacagactgatagactggggagtgaggggtggggagagccagcgaaggcactgccaaggctgtggcgaagaaggacatctcggaaacgggtgttagaaccggagttgcgcagagggaggaaccccaggttcacatggactgggagccttggatctggacggctcctctgcctccagccagggttcacctgcgcagtgtcctaggattgtttatttccccaggcctctctccctcgtccctcacaccaaatgctgtgatgagagctgtagtgtcactgaacggtgcagaagacagttccagacatgggtggggagggctgtcactaagcccttttgttttagagacagggtcttgctctgttgctcaggctggagtgcagtggcatgatcatagctcactgcagcctcgaccttctgggctcaggtgatcctccctcttcagcctcccaggtgggtaggaaaacaggcgcacactccatgcctggttagttttttcaagttttgaatgcttaggggtcttagtatgtggttgcctaggctggcctcagtgatcctcctgccttggtctcccaaagcactaagattgcaggcatgaccgccaaccccagctctaatcccttttaaattccattcgcttcctgagtccctttgtgcctggggagaccccgtgtattggtcctttttcacattgctgtaaacaactctgagactggtaatttataaagaaaagaggtttgattgcctcagttccgaagactgtacaggaagcatggctggggaggcctcaggaaacttagaatcatggcggagggaaagcaggcagtctgcaggtgtctggagaaggaggaagagagcgaaggggaggtgctgtgcacttttaaatgaccagatcttaggagaactcactatcaccaaaacagcaagggggatatccgctcccatgatccaatcatctcccaccaggctcctccaacactggggattataattcgacatgagatttgggcaggaacacaaattcaaaccatagcacccagtgagcctgatttgggccttgctgccggatcacgaccatctctggagtcctggtgtctgttcccactgggacctgtgccgctgtccccctctccacgccctggccacgccaagccaccctcctgactcacccacaggaagctgccctggccctggagcctgccccgtgagcccctctgcttgctggttcaatggccctccagcagcagtggctgtggcagctgggttctcggcatcttcagacacggattcttgagcagcaggatggggctccatctccctgcgtgcagagcctgccacagatctccctcatccactggcttctgtgctgacttcggatgaagccagtggtgccgcctattggggtacagcaactcagggcgaacagtgaggggcggctcaccaaagaaataccccgcagggcagtgcccaagccagaggcttgagctgggtcggagctgccctagatccctgggtttgtgggcggacaggtcctgtgcagggcgcctgatggtgcaggttgaggtgggacagttggggtcaaggtatttctcaggcacagtgcctatgaagggaagacagttgcagggactgtgtccatgtcaggatagactggtggggaccccgtgaagagttctggagcaaaccctgcctgcagggccccacctgggctggccaggcccttatgttgagcatcccttcccccaggccctcaggagccactgtccccgaggcaggccctgaaggtggcggccacaccctcctgctgggcagctctgcccaaaggccacagccaggacctgcttcccgcgtcccaggctactgcctgagaggaggcctcgaaagcgcagggttccgtgactttagaggccatggttggcacccatcatcgccccagtgtagattggctccactcgacctggctgctttggccatttggtctaccagctggaaccatgttcctgggtgtggaaaacgctccctccgaagcctgcggagagccctgaggccttgtgcttccttctgatgggaggttccagatgcagttggaggggatgtctggcagggctctaacccccagccaacctaaacatttctggtgcagaaggccccggcctggtgttgtttgtccctggctgcctcctgctctgacaccatcagcatcctgttgccaaggtcatggatcagtgcggtgctcttcagggtgtccggccagctggggtctctgtcctgtattccggcagaggccccaggagaaacagcaaatgcctttgtccattccatacaaatttcatataaatgtgagcagcttctgatcttccgtggcgtattcgtccagttgatggccaaccctgggtacctggacctccaggacctgctgcactgggctgcccctcggctgtgtgtgcactcgccacgtggccctccaggaatcccatcccacggggccacactgaaccaaatggagagagcagggccaccaccctctctccgcatgccacggctgctctgggacccgggcaggaggggacagtcttggccttccagtgtccctcttggccttcccacggccatctctaccccaaggatgcagcagagatatcggtcgctccccaggtgtcaatcccagtcacaggctcagagaccgggacatggccccgggtgggtctgtaggccctgtgggctcatgtgagctggtcctgggcaggactccattattaactgcctgtgatgtgtcccactgtcatggagccctggtgactcttggggaccagcatcagcttggggcctgtgtgctcagtggctcccagatgcctggatattctcttcctggtgcacatagtccccggggaggtccttgtcatgcacacttgctgatgtggggagtgtccttcatcttgcaggcctggccacctcttcagtcagcagatacctgggctgaaaaccgactcgggcagtgtgggcccaactggggctctatcggagtgaccaccctcagccctcctggacccctctgccggctccacctgagcgctgccctcgctggcagccctgccttgctctgctgccattccgtaagccctgcaggcaggccccttggcgcccttcagccgtgttcatgattgtctcctggcctctgctgtttagaggtctaatgccctccgcccccggcgagccaaacccagtgatggtggttcctgccaccagcttcctgtggcaccgctgccactcccgccaggctcctggggcaccgccaccactcccgccaggctcctggggcaccgccggccactcccgccaggctcctggggcaccgccgcccactccctccaggctcctggggcaccgccgccactcccgccaggctcctggggcaccgccgccactcctgccagcctcctgcggcacagctgccactccctattaaccagcatggcacaggtgagcggtgtgaccttggtcttcccagggaaccagtgcttggcagctcacaccacacacgcctacgcctaccctccaccagccacagcagttgtggcatctctaccctgcccagcaaaagtggaagtgttgcctgtgccgctaggaacctccaggtttgctccacctccaggggccttgccagggtgtcaaacctgtgtctcgggacactgctgttaggtctccagcttccctatcaggcgcctcagcacccagtcctaccagtgctcccgcctcccgtccccagctggctgggcctgcagccccctcctgtgccccgagctggccgggcccgcagcccactccctggtcactggatgttgctgacacttcactcggtcagagccctagcacccaaggggggccagggcctgacgggggtggagcgaggggtgggccgcgtctgtgcaggctcagaagcttcctaagaggctggagagtggaaccttcaggcaccacgcactgcctcctccctgcccacggtcctggtttctccagatggggccttggccttggctaggtgttgatcaggagctgggagtgctgcgccccgcccaacttctccaaactccagccagggcacctcagtgaggcctcagccacctgcgccttatttgcttcctccttggaggccctcgtgtctgttcattcatcaaacagcagctggggcccccagcagacccccttccccaactttcccactggacactggaaccagtttcacaactggactggacaggacgaccaccttgtgccaggcgccagctatctcccctgaccagtgatgggtcctcattgcccgtgggccgtgagtgacccagttccaaatcccaaattagtgactctcttctccaatgggggttggattctccagaagcagaggcagacatagaatttgggtgcaaggtatttcggagggaaggtggaagaggtggggttggtgagggagaagcctggagtgtcggtggccggggtgcccccacctggctgaaacgcctggtctttgtgccctgcctggctcagcctccccaggcagactaccccatggcatccctggacaaggctgcccccaagaacgctgcccacagcccagccatgggccttcccttggggctaccgccccggctcacacctgctggccagcgtatttactccttgctggctgcaccctctcagcagtggctgtgtagaccataaccctgggaacacctgcggggagaagcgcccttggcctggcggcttgggggagacacctggggtgtcaggagggaaggaaggcaagcaggggtgaggcactgtgggacttttcctgctttctgggccagtggccacaggccacccagtgacatttctctctcagcgtctgctggggtggactctgcagcggctgcagccagcctggatcggctcctcgcacagctctgcttgagggtgaaggccatctagaaaccctcagtcccctctcagcctcagagctgatagcgctgcctgaccatcagcaagcttgtaatcagcaccacctccagcatgcctgctcctggatctccgtgaggctcccctgcctgtgtcacccaggggcctctaggggtgctctggagctgggagccactgtccagcacttcctgccctctccggcctctcttggctgtctgccaagcagtcactcagtctcctattgaccactcgttttgccgcaaggctgctggtttacgtgaaaatagagaaagccaaagagtttcctcacccctgtaagatttactggctcttctggcattgcacctgcctgagttccttggtggggcccctctttgagttcctttgggctgctgtaacaaagcaccatagcctgggcagctcgtaaacagtggaaatgcgttgctctttgttctggaggctgcaagtccaagattgaggcactggaagacctggtgcctggtgaggacctgcttcctggtccagagacagcaccttctctctgtgtcctgatgtggtggaagggcaaaggaactccctggggcccgttttatgtgggcactcatcccattcgtgacgcctctgccttcatgacctcatcacctaccagaggtccccaccttttcattcctcaccttggggatgaggacttcagtatgtgaatttcggggacataaatgtgtcatctatagaagggcccatctcttacacaaatgctgggtccccagtggcctgtgtcctagcaaatgagagccaccctgaaaaataaaatcctgtctccccaacgccagccctggcaaggcacccagaactctccggaatgcttgaaggcagggcctggcctttccatggggtccagggctgtggggtccctggcggtactgtgggcctgcagagtggggcatgtgggctgaagaccgtctccccaccatggtgggaagggacaaagggtggccctggcagatccggacgggcaggactgggtgtgtcccatgagagcacctccttcctggcctttcctgtggactttgtcccacaccacctgcctgggttccttcctttagtcacttccagctccaggcacagcagttggtgactccttggtgggagccgtgtcccacccggtcctgatactgccgtcttctctttcacagtcctccaggcttgggccagccttgggggcagcagagcttctggggtgagtgtcgagatcctgtgtcctgagagcggtagtcagggagagggctggtcggggcagggctgcccgggcaggacacaggatgcggccggccaggctggggccaaggtgttcagacctggactttgggctcgtgctttcttcatggttgcgccttgctcgctgtcccttggagtcttcatttggttttgctttttttgtttgtttgttttcacctaatttttgccagacttaagctagttttgctgccttttgaaactagtggaagaatcattttattcctggggataatttggggccttttgatcccaacgtgaagccctgcacatggctgcttcatcaggggaagggtcttttctgctttggaggaaaggctttggcaggcaggctgacctgggagtctccggagctctcggctctctgtagcatcctggggagctcagaccatggctgcagggctctggccatagcttgcaggccatctggttagtgctgccccccaaacccggccattcctctctagtccccagcaggtatagccagtgtccacatagacagcactgcctcagatctgggctgggaccacaacactcactcagggatcccagggaacatggcaccaggtttagtaggtttagtcgggcatatgcagtgtcccttacccaggtcaaggctcaggctgggcccatcttagctgcctgggacacccagtccttttatgaatctgccaggggaggagcagccaggcttgggctggggcctggatggacgtgacatcgggcactgtggcattgtgtgcctgtctctgtgttgcagctgacatgggctcattgctccttctccaagccctctgaggacatcaaaagcgtggacgcatcactttccaccatcttgctgcccactgtccctccatcctgaggcctcctaagcacatgtgtggggtggcaggcacactgctgatagctgtggatgcggccgtgacatccttcacccctgcccccatggcatgcatgatccattagggaggaccgtctgcacaaaggtaatccattgactcagacagggggttcatagaagaacaggtgagagtggcagggggggtattccttgaccagctgagggtcagccaagggcaggaaaggggctgggcaccctcagggaattgaaagaagctctctgtgcctgcagtgcggggagtgggcttggagaatatggcaagagctgaggctggagatgtaagcaggggccttaagtgttgtttaaggagcctgagtcttatctcctgggcaattgggagccactacatagtttaaagcagggcctaacatacatatgtttgaaatctttctctggctgaagtctcgaggatgaattggaagtagaggaccaactaaaaagttgttgcagacattaaggtggtgtcctgggttaggtgggaggtgatggagaggagaataggctagtgttgacatatacccaggaagcaaaaccattggggcatggtgcttaatgcttgattggattgatcacatagatgactatgaggaggactgacatatttcaatctatgaacgtggtatacccatccatttacttatttttaattttttaaaaattttttttttttttgagacaggatctcactctgtttgtccaggctgaagtccagtggcaggatttcagctcactgcagcctcaacctcctgggctcaggtgattctcccaccttagcctcccgagtagctgggactacaagcacagatcaccacacctggctaattttttgcatttttgttttttagtagaaacagggtttcgctatgttgcccaggctagtctcaaacgcctggactccaacaatccacccaccttggcctcccggagtgctgggattataggctggggccactgtgctgaaccctgtccatttatttggatcttctttaatttctcccagcaatattttgtaacttcaagcatacgtttcccacttgtgcctaggtactttgttttccaatgcttgtaaatggtattgtatctttagttttattttccaattgttttttgctagtatatagaagtgcattttttggtatattaatcttgtatcctgtaaccttgataatgcatttattagttcatagtgttttttgcttcttttgttcttttctggtaaatgccttaggattttctttttctcccgactccccgccttcctcctcttctttttcttctgccttaggattttctttttcttctttctcctccttctcttcctcctcctcctcctcctcttctttcttctttcttcttcttcttctcttttttgtttttaaattgagacaggggctcactctgttgcccaggctggagtacagtgatgcaatcttaactcactgtagtctcaaactcctgggctcaagtgatcctcccacctcagcttcccaagtagccaggactacaggtgtgcaccatcatgcctggctaatttttatatgttttgtagagattgggtcttgctatgttgctcgggctggtcttgaactcctatcttcaagcgatcttctcacttcagcctccccacatgttgggattacaggcctgagctactgtgccaagctgaattttctacatgcatgattatgtcacatgtgaccataggtaattttacttcttccttttctatctgcttttttcccttgccttatttcctctggctgggacctccaataccgtttttaatagaaatgtgagagccacttcgtttgtttctgagtatagtgagaaagtttggtcttttaccattgcccagcttgaagtttcctatagtttatctataggtgatctttatcacgttgaggaagttctcttctctttctagtttgccgagagtttctattattcatggatgttgcattttgtcaaatatttttctgcatccattgagataaatatatacattttaccatttattctattaattgatgttctaatgctaaaataaaccttttatttcttgcatactttttcatgatgtgttatttgttttatatattgctggatttgatttgctaatattttattaaggattttatgtctatgtttatgcatgatattggcctgtagttttcttttcttgtaatatctttgtccagttttggtacagggtaaaacttgacttagaaaatgagctggccagtgtttctccttttttctgatgtggttaagattggtattattttattcttaagtgtttgatggaattcatcagtaacaccatctgggtgaggtattttctttgtagaaaggcttcaaattatgaattcaacaactttaatagatataagcttgttacattttatttttcttgtgtaaattttggcaagttgtgactttcagtagatgtttttccatttcatcaagatgtcaaatgtaatttcatgatgttcttactaatattcttgtattattcttctgatgtctgtagggtctgaagggatgtctcatcttttattcctgatattagtaatttgtggattttttttctttgatcaatctagccagagctttctcaatttttttttcttttcaaataaccaatctccattttattgattttcgtttttttctgctagtacatcaaattttcactctttcttatttcttctgcttacttgggtttcatttgttcttggtgttgttgttttctagattctcaaagtggaatcttaggtaatgattttagacctttcttctttcctaacatgaacactgagagctacagattttcctctaagcatcacactaaccttatctcacaaagaccggaaagttgcatttttatcatcacttagttcaaagtattttcttatgtctccttgattacttctttgatccctgagttatttaaatgtgttgcttaattttcaaatatttgggcattctttgtgtgtcttataccttgttgctattgatttctaattaagctctgttgtagttagagaacatattctgtataacttaaatctttttaattttatggaggcttaatttatggcctagcagatggactattttggaaaatgttcaatgtgcacctgaaaagattatatattctgctgttgttgggcatagtgttctataaacatcagtttggataagatgattggtgttgctcagggctatcatattcttactaatttttggtttacttgttctgtgagttactgagatgagggtgtcataataaccgatcacaatcatgaatttgtctgtttatcctttcagttctatcagcttccttcattttttggattctttgtaattaggtacatacacatttagaattgttagatattcttgatgaattgacccttttttcatatgaaatatcctttttttttttttgagatggagtctcgctctgtcaaccaggctagagtgcagtggcgcaatctcagctcactgcaacctccgcctcctgggttcaagtgattctcctgcctcagcctcctgagtagctgggattacaggtgcccaccactgcgcctggctaatttttgtatttttagtagagacggggtttcaccatcttggccaggctggtctcaagctcctgaccttgtggtctgcccacctcagcctcccaaagtgctgggattacaggcgtgagccaacacgctggtccgtgaaatgtccctttttttattttgcaatattccctatactaaagtctactttgatgttaatatttttattcctgctttcttataattaatgcttgcattttataaatttttccattcttttacattgttttcattcttttacttttaacttttgtttatatttaaagtatatatcatatcaggcagacagcatattgtcatttcttgctttcttttcccctaagacgaagagtctcctgtcactcagcctggaatacagtggtaccatcagggctcactgcagcctcaaactcctagattcaagcaatcctcccatctcagcctcccaagtagctaggactacaggcatgtggcaccacacgtggctaagtttttaacttttttttttctttttttgagacagtcttggtctgtcacccaggctggagtgcagtggcatgatctcggctcactgcaacctccacctccctggttcaagtgattctcctgcctcagcctcccaagtagctgggactacaggcgcccgccaccacgcccggctaattttttttttttttagtagagatggggcttcactgtgttagccaggatggtcttgatctcctgacctcgtgatctgcctgtctcggccacccaaagtgctggggttacaggcatgagccactgcacccggcctgtctttttgtttttttgagatgaggtctcactgtgtcacccaggctagtgtgcagtggcatgaactctgctcactacaacctccacttcccaggttcaagtgattctcatgcctcagcctcctgagtagctgggattacaggtgcgtgccactacgcccagctgtgtttttttgtttgtttgtttttgtttttgttttttttcggtagttttagtagagatggggatttccctatgttggttaggctggtctcgaactcctgaccccaaatgatccacccacctcggcctcacaaagttctggggttacaggcatgagacaccgtgcctggccaatagtctttgtcttttaactggattgtttacctcagtcacatttaatgtaatggttgatatggttgggtttgaacctaccatctgctatttgtttcctattcatctcctctgttctttgtactcattttccctcctctttttctgccttcttttggattagttgactattttgtatttcacttatctcttctagactattatacttccttgttttatcatttcattagctgcaatagggtttatgatatgcatatttaacttatttatgattgattggatgtaggaggaatggggggagaaagattccaaaatgacactgacatatgtggcctgggtaacaagaggaaccactctctgagatggagactttgaaggaagattagtttggggagtgatgaaagggctggatgatgtggtcagttttggacaagttgcatttaaagtgcttctgaggcatccaagaggagatacctggtagacatttctttacaaggtccagagctcagggcagtgtccggggctggagctggctctaggggtgaagggcagaggggtgactgttgaatgaatgggaacaaggtagtctgtggatgcagaacgtgcgatgggacaggaagagtccaggaccaaaccctgaggagccccaacattttagggacccaaatgcaggacagtagagatgaaaggagaggccagcgaaggagcaaaacaaggaagcgtgtgtcatggaggccacacgaggaagtggctttgtggttacttctgggacattggcagaaggatgtttcagggcaaagtgcaagggggcctcaaagatcatcttaagttctgttccttcactttcacggtgggtgcattggtgttcatttagatctactcaacatcttattaaaacattttttaaaaaggactagggactgggaggccgaggcgggcggatcatgaggtgaggagatcgagaccgtcctggctagcacagtgaaaccccgtctctactaaaaaaaaaaattagccgggtgtggtggcgggcgcctgtagtctcagctactcgggaggccgaggcaggagaatggcgtgaacccgggaggcggagcttgaagtgagtggagatcacgccactgcactccagcctgggcgacagagcgagactctgtctcaaaaaaaaaaaaaaaaaaaaaaggactagggacttactgacttggccaaaggctgctggtgggtgcgtggaggtgctgcctgtcagctgtgctctgggctctagggacatgggagtccaaagggctctcacctcctcagtgagaggttctggtgggctgaccatggtgggatccagatttcagcaggtggaccccgagggggtgtgaggaaatggactctgtgagtgggaacttctctttcagaggaatttgcaagactggcctgagccgcacacggctcttcagcagggcttggcagccagcggggcctcgggaggaggcaaacagctgatcaaatccgggcttctccagaggaagaaggggaagggcaggtctggggaggtcagagcgtgggtgagaaccgtggccatgggtgggatccacatcccagcctgcagggcctcctggtgatggttctccagaattctgcgattggagctgtgctcacagagtcactgtccccgacctcccaggggcgcggacataacccagcctcagctgcagacagcagagactctgcacaactgcagaagctgagcaatcagcctcatcagtggcaattcctggaactccaacctcaactgtaacatgagctgtggcagaccttcagtaaccccagacaaggagtgaggcagagcctgatagctcagggaccagctgggatgctcagtaaacaagagctccagaagatacgcggaacaggagaaggtgaagtgtggggacagcaggcgctgcaggccacccagaaggaggaggagaggggacaagaaacactgaccaggccttcaagatgaggagtgagcagagaggacagcagaacatgggaaaacctacctggcactatgagggtggagaggggagtgttggagggtgtgcatttgagtgcaagtgtgtaaaagaggccctggacaaggagtgaagaatctcatcagatggttaaagtgagggagcaccaagtaaaccataatgaaccataagtcatgtggaccccaaccctaatgctaatcataaacctaaacctcgtgtggcctggaaccctaacctgaacccaaatcctaaccataaccctaaccataaccataaatcatgtggactccaaccctaatgctaaccataaccctaaaattcaggcagaaccgaacctaactcgaacccaaaccctaacgaaaactctaaccctaaccctaactcaattcaaaccttaaccctaaacctaaccataacactaactccaccctattccgaaccttaaagctaattaacaatgcctcatatggacccgaaccctaaccctaaccgaaaccctaactctaaccctaaccctaactcaacccaaaccttaaccctaaccataacactaactccaactacaaccataaccctaaccaaaactctaaccctaaccctaactcaacccaaaccttacccctaaccataacactaactccaacaaccataaccctaaccgaaactctaaccctaaccctaactcaacccaaaccttaaccctaaccataacaccaactacaaccctaaccctatcccgagccctaaacctaattaacaatgcctcatgtgggccctaacgctaaccctaaccatgcctcatgtggacccgaaccctaacccctaattccaaccctaaccctaagcctaaccctaacactaaccctagccaaaaccctagcactaaccctaactccaacccaaaccctaatcctaagtctcatgttgaccataacctggctcaaaccctaacctgaaccctaaccctaagccttgtattgaccacagcctggctctaaccctaaccctgactctagtcctcactgtaattctacctctagccttaattctaaccctaactccaatcctaaccctaatccaaatgcaccctctgatccaaacaactcttcagccaatgtcagacctcaccttaaccgtcaccttcacgatcaccattccagttctcccttcagacttcccagggacttgagccagcccctggcccccaggccttggtttccccacctgtgcagcatggatttggggctgagggtacaaagactggcacccacctgagccgttggaacaggcctgcccctggtcctgaggaggactctgctctcccggttctccccttgcccatgtggaagggggctcatcccccagcatgggtgcttcctgcctggtgtccatctctgtgtgagttcctttagggagggaccgggtaggcgcagttggcatggcaccgccatgcccctggctcgggcttatgcgggctgacagtcctgtccctccacccagaggcccctccaatgatgtagcttatcagagtgtgtgtgtatgtgcacatgtgcatgtgtgtatgttgtatgtgtatatatctatgtatgtatatgtagtatctatatatatgtgtatgtgtatatatgtatatatgtgtgcatatatatgcatttgtgtgtgcttgtgtgtatgcatgtttatgtgtgtatttgtatatgtatctatgtgtgtttatatgcgagtgtgcatgtgtgtatgcagtgcttgtgtgatgtgtctgtttttatgtgtgtgcatgtgtatagtatatgtgcatgtgtgtatgtttacatgtgtctgtgtgtgtatgtatatgcctgtgcttgtgtgtgtgtgtgtgtacacatacacgtggacaggcgagggagaagctgtattgcaccaccacccaggcccttcgagcccaagtgcagtctccccagggctcacgaggccccagcacgctgccctcctgctcagatggtgcccaaaagccccttgccgagtcctctctaagcctcatgtagacccgtgagtcccttctccgtctgtttcccctgcctgtgatgcttagggatcgttcatttcagggccagtgaggaaaccccatcttctcctgcactgccgtggagttaaaggagaaggccacaacacactcccacgttttctacagactagcagtggggtgtttggccacctttggttttgaccttttattttggaaatgttcagactgaaataagcagaagtgtaataaccccttgtgcccatcaccccacctttggcaagagccaaagagtcacaactgattgtgcttcaccacactccatctatgggctcaaaatgttttgagataagtgccagacatcatatccttctatctacaaaaaatgccacatgaataaaagataaggacttttaaaaacacatgaccacagtaagcattatcacatctagccaagaaatgaacctttccttaattgcaacaaacaggagttaacttttacattttctctacttctacaattttttagagaacagtaaggtagactttattcaacggaggctaccacaatggagttttgcagcagggaagggagatgaggctcaattcccaccttatacgtttttaaaaagagcttatttggttgaattggatctgaggagtctggctgcaggccaaaatcctctgtgtgatcattcaggcccaaccgcagttgttgccagcaggccccacaggagaagcagccctcctgccccagacggcactttccacccttagcctcctccacggttccccaggccagatccttttgtttgagccttctgtttcgcctgcttggtagtgagatcatctccccatctgcctgatgtcatccagggggcaaaaatgggacgtagaggagccggcacctttttccttctgtttgcctcttgcctgcactattgcagtcgtgaatacaggcctgagggtgaccttccattgggctcgtggtcccaacctcgacagcagtggctccacaggatgcatacgaggtccccgcggtcccggccgacatacctgttgggttcttagttggcagcttcctcctccgtctctctattcccctcctaggtctcttgccctgtgcagcttcctgcagactggacttgcaaagtccagcctgtatggctggagttcccatgcctgccaatctcctgtcgactgcgagtcagctccgatacttcaccagattcaggtgagagttttggttttttgacaagcccacttcatcagcagggcatgcatttctgccagggggctcatgatatctggtggtctctttgtgaggccagcagccaccaatgatcacgaatgtggcaggaagctgccaagagaccccccagtgggtgattcctgcctcctgctgtcatgcaattccctcctgaagggtggctggacttactcacttataacaaacaatacagtaaaaaaaaaaaaaaaaaaaaaagtgatgtgttgtctcttccgtgattaggttgaaagagaccatggcatctgtcttggatgcatactctctctcgctggctctggggtagccagatgccatgctgtgtgctgccctgtgaagaggcatggccagtaaggaactgagggcaggaaccagggaagatttggggtcctcaggccagctgcccattgggaatgaaactctaccaacagccacctgggggagctggaagtgaatctcatcttagctgagccttctgatgagactgcagccccagctgacacctggattgcagactcatgaaagacctgaaactctaccaacagccacctgggggagctggaagtgaatctcctcgtagctgagccttctgatgagactgcagccccggctgacacctggattgcagactcatgaaagacctgaaactctaccaacagccacctgggggagctggaagtgaatctcctcgtagctgagccttctgatgagactgcagccccggctgacacctggattgcagactcatgaaagaccctgagcagaggacccagtttggcagagcccgaattcctgacccacaggaactgggagataaaactctgtggttttaatcttctcattttagaggtaatttttttgtgtagcaataggtagctgacaatgcacagctaaaataatagataattaaccctaatgctagtttcattcatccatcagggtttgcaaagtagtgatattctacttctgtcttccttcattatttattagcagaaatgtatctataaaaagaagtgttccttcattaactctttggtcatgttgaggtacagtttgcataggaaaggcagggcaaatgcttgattctttcccttcctttcctcatttataaaataatgaactgttttcctggcatctttcaacaatgactaatgagtttttaaagtataattacaagttcatgagtttaaacattttttgatgttcccattaacattattatccttattgatattcagatcttcctgtctttgtccagtgccagcctatttgatttaactcctgagcccctttggcactgccctaataatctttgacagctactttgttctctggcataagaagacattccagaattacattagacatttcctaacccagattggacagcatacacttctctccaagagcccctcttcctcttcaagagaaatggtacttagagaccacagtctgggtgttaggtgtgcttgtggttactggatttgtcgtcatttttaggccttgtcagtggacagaactaaggcttttttttttgaaagacacattatgagtacaaatggatactttctatttaaattcggatttacatagtttttacttaatcttattgataatatatctgcatctcctttctcccacaccaaaaatctcaaacaatacccaacatagttattcatttgttttatcctgtaacacacacaatattttcaaaatgactttaccaacactaccatcaacagtatataaccactgaaaatagtttaaaattatttttagatacttttaaagtccttgggttgtgtcgacgtacagacaaaacagtgttttaaaattatttggaaaatgattacttaaaataatgaaaacttcttttgccattctttcttgttgtcaggctatatggatatacatccaaatgactggattttaaaatcacttggaagagtttggtaggttcatattgtcaacccataatgcaagtcagttagtttcattttgctttcaattttaagaattccttttacaagttaatttaattaaattaagtaattacacaaacatttgacatgagtctaaatccaaatctagaaaccaagatatggtcacagaagtccgtccctatccccatcccatttccacctgtttcctacaggtaacagtttaatttaaagcaaattttgtagcttatctttccatttgtaaaacatacagctgatggctccatctaaaaacacatcaattgtctatatgtacataaacatgctttttttcatttacaaatacattctggagatgaccatatgacagtgtgtagaaatatttctccctcctctttgcaagtgctcagtgtcctgtggtgtgaacacgcttcattcaacctgggcccttgggagagatgctgagtggttcccgggctgtccccactccacaccgtggcagtgaagagctgctgaagtacatgcttcatagtccttgcgtctctctgtgagtacattcctagaagtggggttattgggtcaaagagtaaatgcatctctaatttggctaaagatattgccaaatccacctgcctgggggtttgtgccaccttagagatcagtgatcaatgggtgatatccgaggacgtctttctattgtggtcagactcttggattttgacctgactaatggaggagaaatggtgttgcagtgaacttttgatttgtgtttctctttttatgatcgttttgagcttaatttgtgtttctctttttatgatcgttttgagcatcgtttcgtatctttaaggagcaatttacatctcctctgtgagcgtctactcccatctctatcagcaggcgtcttgcctggctccggaggaagtgtctctgaaggctggtggtcccaggatagggcaaaagaacgggagtgagaactctccacacagtgcttcttctggggttaaggaccctctgcctcagtggctcctgggcgtgattaaacttgccatttcctgggcccatcctagacaggctgctgcaagccagccaggccgggatcctgctgccccggggaggacgtggggaaaatccctgctggagggactgccccttccttgtccagccactgggtgtttatggttcagtttagggcggggatgacagcacacgacacacactccgctctcaagagttactcctccctccccgccagactcccccaaccggaggtctccccagagtggaggaccttccagcggctggcaggcggcctcaggcaggcagtggggagcctctgcaggttcccgagccaggaagtggcacttaggagtgaggatcttaggagcggggctcttggacaggagggcgagtgagttgggagggcctcaagcgggggcccgatggctctctctgctgagaagggagggccctagggatggggacagagagctggcagttgaagggccaaggagcaggcagcttcccagtcacagagccttgtgcagaggaaggggaaggagtccgagagggtggccctgctgtccagggccaagaaaagggaaagccgctggaaatagcagaaacctggctggggcagcacccaaggcccaccccgaggccaggtggggaccccagcggggcatctggcagcagtgggtccccaggagcaggcagtgggagccatcagggtgagtgagctggcgggggtggcccaggggctggggtcacctgccctcagcccaaggagcctcttctggcctttggtggccagggctgggatctccctgctggtggccagatgcctcgacaccccataggctgggtgaaggtggggcaggagttccaaggcgtggagacggcccctgagtgcccaggggcctcctgctgcaggtgggcagagctggaggctccactgtgagggtgcctggtgaagggaggcgtgggcacgggggaggcagggaagggccctgggtgcgacttgcagcccctcagaccctctcaggacccctcctgcccccatcgtggtcctctcagggcccctcaggatcccttccagacccctgggaccccgtgtcccctgctcgtcctgcggtggtgcccagctcctgccaagggccctgcacttgggctgtggggaccccctgtggggatggggccatcacaggaggctgagcacagggcggggtcttggctggaggggaccttaggccacaggtgctagtcttctgcagccaccccccaggacccctgcccgctacctcctctgccccacagctgacaggctttgccctcccctgcccctctgtggccacacactcagttctctatacacttttattatggaaaacatcaaatacacacaaaagcagggcatctaggacagagaccctgtgtcctggtccccagcccctcacagtgacaccgccaggctttaggcaagatcagtgggggaggggagtttcccagcaggacgtgcacttccagacctggttctgtgaagaggggaacagaaagtgctgagggtgacagggaaacctcgagaagagggaggtgtactcacatcctctctcggggtccacaactgagcccccacacagaggaccccactggtctgcctgagctgctgggtgggcaagtgaggcactggcctcgggggcacagcgcttgaagggacaccagaaaaacagtcataaagataaaccgtaatgtgttgttttatttcttatttatttatttatttatttttgagatggagtctccctctatcgcccaggctggagtgcagtggcgtgatctcggctcaccacaacctccgcctcccgggttcaagcaattctcttgtctcagcttcccgagtagctgggactacaggcacgcgccaccacgcccagctaatttttgtatttttagtagagatggggtttcaccatgtcggccaggctggtcttgaactcctgacctcgtgatccccctgcctcggcctctcaaagtgctgggattacagatgtgagccactgcacccagccaatgtgttgttttagtaaaccaaaactatgcaaaggacgcatgaggatccaagcgactcatttaggatggcagcttcactgcaaaaggagtctcgattcagacctcaagacatgcttcgtgggtctcactcaggaaggaagtggaggcaagtcagaatgtggtgagaagagagggtttattgaaagttgctccattacagagcagggtgtcgtcagaaagcaagagggggaacaccccagctttaactttttctcatacaggggtctcgtctgtgtaaagactaagctaaactgtgcctaacatgtattattctattgatttaaagaaaactgtctgtcacggggtcttgctctgttgcaaccaggctggagtgcagtagcacgatctcagctcattgcaatctctgcctcccaggctcaggtgctcctcccgccttagcctcctgagtagctgggattacaggcatgcacccccatgcgtggctgattttttttttttttactttttgtaaagatggggtcttgctatgttgcccaggctggtctcaaacttctgggctcaagccaacctcccaccttggcctcccaaagtgctgggattagaggcctgagccaccgcgtccggccaagggtagttgtctggaaagcatatattgttctggataccagggcacttggacactttgctgtcatagaagtgtgtccacgcaggcgtcactggctgctgctttagctgtaaacatcgtatgaccatgggctgtggctggcaggtatgtgcctcattggtctcaaggtggagctgaacgtaaacggcttttctctggctctcccaggctcctgcttccctgacatcgcctcacagacttcccttcaaagcagggctgtccaatcttttggcttccccgggccgcattggaataagaagaattgccttgggccaaacatgaaatacactaacactcacgatagctgatgagcaaaaaaaggtctctgcgtaaatctcataatgttttaagaaagtttacaaatttgtgttgggccacattcaaagcccgcagcccgagtgttggacaagcttgctgcagaggctcccctagatagggctgcaggggtggcgtccggcagctctagctggagaagcaggaggaggggcaggaaggaatcctgttcggagctcctcgcgtcacacatacagcccagcggggtgaagtgggaggggctggcgctgctgcagggggctaaccttgggggtgagggggcagcctcggagaggaagctgcccaggagcagaggctgggggcggagggccccgggcagtgcccccgtgcccacagcaggaccctggctgccagttctccgcagagggccaggtggtctgaagctgcccagcagggagagaacaggcctggcctggactggaaacctgccatctggcctctcgaacctggggactccgggtgtcctcgaagaagggcctgagcagcagcagaggaccccaggcgaccgtgcctgagccgggcgccgacgacgactgagcacctgatatgtccccggcactcgcagccccgcggccggagtcgctgtgggtgagcggtcgtcgagcttcacagaggccgggctctgtgccagggccccgacagggcaggaagcagatagagtcccacaagcacaagcccagtgcgcagaaagggttacttaaaaaataagttctgtgataaaatcaaacagggtgaagggctggaaacaggtcatgagggcgcaaacaggtcgtgagggcgcaaacaggtcgtgagggcgcaaacaggtcgtgagggcgcaaacaggtcgtgagggcgcaaacaggtcgtgagggcgcaaacagatcgtgagggcgcaaacaggtcgtgagggcgcaaacaggtcgtgagggtgcaaacaggtcgtgagggcgcaaacaggtcgtgagggtgcaaacaggtcgtgagggtgcagctttggggagagaggggccctgggggtgagcggggagctaggagagaaacagcgctctggaggggcccgggcaaggcctgcctgagtgggagggggcagagcacgagggcccaggctccaggctgggtgggactgccctgaagtgcctgcggagacagccaaggggcagatggagagaggtagggggtgggctggggacagcgtttcctgtacacaggtggaacctggtggcaaggggcccttcccagagacagtcagagtctctaaatgtccagtttcttccccaagtccacacagcccagaagaatccgctgggaccatgtggccctgcccagtggggcttcccttccagtgtgtgaggagcacaggtgccaggccacgtcagggaggccaggcctggtggggacggggtgccccaggccactgctggggaggagtgatgcccagcagagggggcacggtggagttcatggctggcctggtggtggggggggtgggggagctctgcagggccctggctctggtgggctgggtaggcctgcttggggcaccatctgatctgccagaggtggaaggagcactcctgggagatgccgtgccctgcacctccagtccctgcttgacggcggccgggcttggactgatcaggtgccgtgccttctgctgaccccagaggccagaccctgtggccagagtgagggatggatgaaatcccaaatctgagcctcctgcccgaggatgaggcccctctccaatgaacatcatggcccatggagactgggcagggaacccaagggcgcacactggggactgggcctggagggacagccggggaagcaggaggaagggcaggaaggacagcaggaggaagcaggaagaaagggacaggaaccaggcccgggatgacagcagagaaggaccaatgcccagccagggcttcctcacgtgcctctgggtagagagccctggtctggctcaggaggcccaggcactggtctcagacctgccaccacctgtgtgacgctgggccaagcgcttcccttccctgggcgtccgtttccaccgctgtaaagtggggaggggtgaaactgaagctctccccagcctatcccagccgttgaggagggagaggctgtggtcaggggctgtggggcccacgttgaggagacgaggctcctgccctcagggtggacagggcccaggaagggggtgctctgcaccatgggggcgcagcctgggcctacgggctcccccaccatgagctcagaaggaagatgtccgctgaggagttgggggccagggagaatattctagaccagataggggtggtctgggtaggcttctgagggggtgggcttggaggaggggccggtggccaagtcggggggaagcaggggaggagccagcctgcctgcgtgtgcctctcacctgtgtgcattggcgtgtgcatgtgtgtgtgcatgtgtgccagcgtgtgtgtgtgtattggaaggcgcccacggagcgtgtctgcatgaaccaggatgagtgtgcgtgctgcaccctgtcttggggctgggcatgaggcgctggggagggcgagctgaccgcagaccctgggagggctgggccctgggaaggtttccgagatgacagggcagaagtgggctggggaggaggaaggctccgtgggcggggctggagcgtctctggttttgctgtctgtctctcacgctgtttccagaacaaatgtgtgccctcagcaaggatgctggctcttcagaggtgtcagcacaggcagccggcaccccacttccctcccagaaatcccccacgccctctagctggggctggtgcaggagcagtggggaactcctgttacccctgacctgctgccgtcagtcagccgcccgcccccccaccttaaggaggggcagagtcagggaccagccctgaggggtggctcaccccagcttcacttcccccagcccttctcagacagccactgtgcaggctttggcagcgggggtcacacactccacccgggaggccaaagctgcctgcaggtcagtgccgcccactgccctaggggcctcccagcggggcaggggcatggtgggggtctcagagtggggtgaggctgtgatggggtctcagagcagggtgaggctatgatggggtctcagagtggggtgaggctgtgacgggggttctcagagcgaggtgaggctgtgacagggtctcagagcggggtgaggctgtgatgggggtctcagagcagggtgaggctgtgatggggtctcagagtggggtgaggctgtgatgggtgtctcagagtggggtgaggctgtgatgggtgtctcagagtggggtgaggctgtgatgggggtctcagagtggggtgaggctctgatggggtctcagagtggggtgaggctgtgatgggttctcagagcagggtgaggctgtgatgggttctcagagcagggtgaggctgtgatggggtctcagagtggggtgaggctgtgatggggtctcagagtggggtgaggctgtgatgggggtctcagagtggggtgaggctgtgacggggtctcagagcggggtgaggctgtgatgggggtctcagagcggggtgaggctgtgatgggggtctcagagcggggtgaggctgtgatggggtctcagagcggggtgaggctgtgacggggtctcagagtggggtgaggctgtgatgggggtctcagagtggggtgaggctgtgatgggggtctcagagcggggtgaggctgtgatggggtctcagagcggggtgaggctgtgacggggtctcagagtggggtgaggctgtgacggggtctcagagtggggtgaggctctgatggggtctcagagtggggtgaggctgtgatggggtctcagagtggggtgaggctgtgatggggagtctcagtgaggtgaggctgtgttggggtctcaggtgggctgaggctgttggggtctcaggggtggctgaggctgatgaagacttggagcctgtgtctgggtagcagcttgttggagtgtgggatgtgacatttaaaaacaagaatgaagaataccccgtgctgtggccccgaggtgagcagctactttggtgaactcgtgtcactcacagccccatcctgggtcctggggtgtggtgtgctgtgtggggcccaggcccagtggggtcacaggtacgggggactctggtgcctgggccacagggatctgcacctcactgcgtgcccccacgtcttcagcagtggttggggcctgtggtctcaatcccaggccagccaggcactctggggtctgggcgggtcccgggtccagacagggggaagggctggggaggggctctggtgtggctggatcgcccgtctatggccaggtttctctcctggatcactcagtgcagaatcaaagggcacttttctgcttttgtgtgcagaagccgagggtgaccttgtcatcagaaggggaagcggggcctcagaggcgtgctgctggctccaatccccaaagcctcctgggcaggaagtggaagggccccatccccacggtccccggcagcgggagctccctgaggctgatggtgctggtgtctgtcgaggaagacaggcctgaggagctgaggcgggaggccagctacggtccacggcctggacacagattcctgtgcgggactggggcagtaggtgggcatctgtgctggccatgttagctcccaggggccccatgccatctgggctaaagcctgggccttgatttcctgaacttttctgggaggcactccacgggcgagacaaggacccatgaacagggcacttcttcgaagcctacgtgcacctcgaaactcttgcaacatttgcatttttctccctaatagttcagtgtttgttttattataaacaggaaaatttaaatgttgtagttagagtttttttcttcttcttagagatggggtttcactctgtctcctaaggctggagtgcagtggtgggatcatagctcacttcagcctcaacctcctgggctcaagccgtcttcctgcctcagcctcccgagtagcacgcatcaccagcccagctaattttctgtctttttttttttttttttttttttttttgtagagacggggtctccctgtgatgcccaggttgttcttaaacttctggc

SEQ ID NO: 1046 - DNA, 39384 bp, Homo sapiens
agagactgaggtttggggatataaaaaagacttactctttattataattttttccctgttgaattttatactaaaagtgtagatcattttttaattaactaaaataactatattttagtaatccatatatttaatttttatgtttgtttgtttgttttttgacgaagtctcgctctgttgcccaggctggagtacagtggcacgatctcagctcaatgcaacctctgcctcccgggttcaagtgattctcctgcctcagcctcccaagtagctgggactacaggtgcgtgccaccatgcccagctaatttttgtatttttagtagagacagggtttcactatgttggccaggctggtctcgaactcctgacctcatgatccacctgccttggcctcccaaaatgctgggattacaggcgtgagccaccatgcccggcacatacattaatactttttcagatactgtcttcttcttcttttttttaaagacaggatcttgccttgtcacccaggctggggtgtagtggcacagtcgtagttttctgcaacctcgaactcttgggctcagacaatcctcccccatcagcctcccaaagagctaggattacaggcaggcaacactgcacctggctaattttttaatgtttttttgtgtgtagagacagggtctcactatgttgcccaggctgtcagatactgtctttaattgttatttaattatttcatatgcatctcttatctctctacccatatcagaaaatcctggagaccacagtcaaatatgttacctctcctggatagatgcccttagaagttagcacagggctatgtacaatgtagttacaaacaaatgctccatggtgaaatcaggtcccagtgacaggatggtacccctcgctggtcccacacacagttgtgcacattacagtcagacccagactcactttggctgtagttccccaagctggaggagcagtgtgggaaaggggtgatatacgtgggtttattttcaccaatttacagattagtaaccgaagctcagaaaggttaagtaacttgcccaaggtcacactgctagtaagtggtagaaatgagatttgaaaaccagggttggccaaaacacatgtgcttaaactgcacggcctcctgtttgctagtatttacaggcatatccatgtgggactctgctgtcactatctgtagacatttctaacaaacacaatgctctttttgttgttgttgcttagcaacaactacactcaatttctcaaattccagaaggtttttgtggcttaatgccgagtatctgagctagactgactgcctcaaccccattgttcactcagttcttgtttagcgagctttgtacaatattaaaactagttgatggggtaagtgcatgtatttatccttacatactggaggatttattattttttgaaagcatttccatctagaaaatatcaatgttgctcacctatgtcatgataaaccatttatccaccttccttacacattttggagaagctgtgactaaggcaatttctgaaggggaaaacacacccagctgaattaaaaggtcaaggttctgagtttccttctaactaaagaaatcgtgtactttctctgagcttgtttcctctgtaaaatgaaagtgataatcaggcagcccaaatgattgttaataaggatcaaatgagatcgtgtatgtgggtccaatcaattgattctacacaaaggtatgtatctattgtcactgatatctttttagaagtcaccagcagtgtgttgtatgcttattcagtttaaactgatctattttttagttgtcttaatcagatgataaaaggtaagccttccaatacagagcttgcaatcttcatttccttatcctgccttatatgtcaataaccttaatttaccttctgatcatctccttggctgcccgtgctgtctgaaaatcagccttttcttaaaatggcaaatagtggggaaaagtagcatctaaccactcctccagagaagggcagaataatgattcagaatgcctctagtgttttgttaaattatcatttgagagcagcccaagagagcatttagagtgggatggtgtagtgcttaagagccaggattctgggttcagaccatgggttcaaatcctgaccccacccttaattagctacccacatacctcaagtttcttacctcatctataaaatggacataatcacagtaactacctcttagtatagcatacgtattttaaatcacttaatttgtgtaaagtatttaacacagtgaggagtatgcacaaaacattctacacatgttgatactataaagcactcccagattcagaaacacaaaaatcacagaaatacaaagccacagagacaagcacacagtgggaggcaataagcttgacttctcccttgttctccttgcccttccacttcccttcaccgtcaaccacccaaatgagctgggaagagtgggcaaggagaagtcattccatctccagtagggtttgtcaaaggcaggcaagtagaaagtggatgacaattgaattaagtgatgcattcctgttttgctaaggatattaagttgacgaagaaataaaggaaagcaaaacctttgggaagcaatttggccatatgcattcgggacaataaaaactttcctattgcttgtctcttgataatgacatttcttaaaattcatcctgaggaaataatccaaaacaaaaggaaaactatacataagatgtttattgcattagtttttaaacagttttcttaaggtgtgaaaggaaaataaatcttgggatcccaaacttactaagccagagggaaaagtcaagctgggaactgggtcatgcaaacctgcctcccattttggtttctttggttttttgttgtgttttgtttttgtttttgtttttgtgttttgagaccaagtctcactctgtcacccaggctggagtgcagtggcacaatctcggctcactgcaacctctgtctcccgggttcaagcaattctcctgcctcagcctcccgagtagctgggattacaggcacgcgccactacaccggctaatttttataattttagtagagatggggtttcatcacattagccaggctggtctcaaactcctgacctcgtgatcctgatctgcccacctcggcctcccaaagtgctgggattacaggcatgagccactgcacccagccccattttggtttccgaataagatggctacaaagatgaaaagctacacacctccctcacactttgcctacaaggaaattctttatggtaaccaagatctttaccctaaagcatttcagctaaggttcaccatggcaatgtaaattgatagcttatcttcacaggtgggggaacacaggacagaaatgaaagtcatccctctgcccactgagacaaatgcatatctgattgtttcctctgccctattatctacattatcttatgtaaaaatgcagattcactgagccagacaaaggcattaaatattgaagccaccaaaatcatctttaaaaaaaggcatagacttgtctcccgggtgcccttccttaactttggcaaatctcctaaaataattgagacttgcctcagtcattttccttgattgacaaaggtataattcatccttttaaagtgtacaatgcagtggggttttttaaagaattattcagagttgtgcaagcatcaccattatataattttagaaattttcaccaccccaatatgaaactcatttgcagttactctccatttcttcctctgcctccccacccctagcaaattctaatctactttctgtctcttgtattattattattattattattattattattatattaatttttgagacagggtctggaatgcagacaggctggaatgcaatggcatgatcacggctcactgaagcctcgacctccatgactcaagcaatccacccacctcagcctcctgtgtacctggaactataggcgtgtgccgccacctccagctaatttttgtatttttttgtggcatgatcacagctcactgcagcctcaacctccagggctcaagcggtcctcccacttcagcctcctgagtagctggaactataggcgtgcgccaccatacccagctaatttttgtatttttttttttttggagagacatggtttcgtcatgttgcccaggctggtctcaaactcctgtgctcaagcaatccgcccacctcagcctcccaaagtgttgggattacaggcatgagccactgcgcccagcctgcattattattattattattttttaattattttattttttgagacagagtttcactcttgttgcccaggctggagtgcaatggcgcaacctcggttcaccacaaccttcgcctcccgggtcccagttcaagcaattctcctgcctcagccgcccgagtagctgggattacaggcacacacctccatgcccagctcctttttgtatttttagtagagatggggtttcatcatgttggccaggctggtctcgaactcctgacctcgcgatagtccgcctcggcctcccaaagtactgggattacaggcgtgagccaccgcgcccggcaacctgcattattttaatggccaaaaatattgagtgaaataggctcagtgttattgagcaacgtatcatgagggtatattaatcaaattatggcatatcgattcaatgaaatattacatggctgtttgaaattactacaataaggtctttatcagggtgaaatatatacaatataaagtataaaactttttaaagatacaaagtggttagtatattctggtttgcatgtggacagtctggaagaaatatataaacgttttaaatggccgtgttaggataatgagaagatagacaatttttttttctttagcttttaaatattgtcatgttttttcttttaacaaatgcaatttttaaaaattgattttacattactggaattgagaatgtatgaacgggcacagccagccaccagtctagcctctccagttgggatccagttcttgtctatcgtactctccttccggcaaccaagagacttaagctacaaaggtccgcctctcccagactctccccttacacctcaggcccataccttttggccccgtgcctcttagcctacaccttcccattcccacaactcactccttaacaaaccccctttcctatcacacacaccaatgacccttggccaatttccttctattcatatgttaactgtagactgcagtcctgattccagctgtactttccccttatgagcagaacagtgaggaaattggctgaaacagaacaacaatcagcccccctcactcctgtgcctactttgcatagagacacacctcatttagactcccacagccttcctgttaatgtctccttcctctctctgctatcgatctggggctctgggacagagaatcttcaatatcccaccagtgcccacacttattaccactacagacacagttattctcattcccatactctctctctctctctctcacacacacacacacacacacaccctctcctatgcttccccaccccagctgtccctggggagcctggattggatttgtgcccacggtctgcagcttccctcggtctgtctgctggtcaccctctgaaggaacggggcccagttttgttcaccctctggctcaaggaccaagtatgcttctactcactctctacctccaagcacctaccctactccgacttaactgcctgacccacaactaaaaagaacagctctttgatcttcacaggtgtggtgaggcctggtgagaggggagccttctagttagtgacctaccacgtttcaggaaccatgttagtttccaggattcagagatgattaaaactaatcacgcaccttgagaaactcacagtggaaggaaaatcagtaagcagaaaaatgctacataaccaggtaaatgctgggacaaatttaggaaggaacgatgtggatacactggagcaggctccaaagcagcatcacctcggaggaggatcttgaagactcaagagttaactgggtcaagaaatatacacactaacacttctgacaggtctgcagaatacagggagtccataaaaatagcacttgggtaatggaagcaggacacaccattccatgcccacagcattactttctgtgtgcagtgcactgtgtgatgatctacagagattaaataagccgaggtctccgcttccagtcacttgggagagacgcacaaggtaaattacccaaatagaaggcaaactgcccagggctgtaattaacatacaatatgcgccgagagggaaaggttaatgctaactccggtcctaagtacaaagatcattgggagtcaggggtgcactctcattagggtacagcatgggtgggtggagagagtaaaaaccagaacaaatcaaggttcagcagttggaagtcagccttagggagaaaaggggcggagactgactgggccagaacagggattgggacagaaaaagagggtggggccagtgggctccacctacccgctccggcccttcccaccaccccccaccccatctactttctacagtctgtggagacaggtgagcgacgaacttctgagacaggtgtgggtgcgagggtcgggagggtcatgggattgggaccgaggtgtgaggagggaatctgcaattccttgctacacagagcgctggcaacttctgacaggctgtttctggggtatgggctgcctcgggttgttgctgttacaaggaaagaaaagagttcccctgcccaccgcctcccagccactgggctacctcctggcaggaaatttgcaaactgagtttaacaagttaggatcagcagagggtagaggagggccctggcagatgtggggtctagaagaggacaggagttatcagggcctccggccattgtgctgggcctttgcctgtacaattgtttctcaagcagttgtgtccctgtggctttggtgcgcctgtgtgcactttctccctccacctggagcatgggctaacaccggaggaaaggaaaagacagagtcagacagggtaagtggggctccctcccctcttctctctaacggggctggattgagggcctctggctggggaggtgggggtggagatccagtaggagcaataacagaggaagggcagggcctgccccatcacctgaattccagagatgccagtgtgcactgaagccccaggcagggcgtgcccaggaccggatcctggatggtggtaagggacaaagctggaagggagactacagggaaggagaaaggaaagaaggcagagccatgacacagtcaacttacagaatggctgggagtcaaagctcctgggctggtttcctggctattccacacactccaagacatagagagaatttcggaactggaggggactctacagatgatttatttgagattgaagaacctagaaaccaaacaaagaaatatcatatggttactttggtatctgacacagccatgacaccaattgctagtgtagacacaatagctgtgtgtctttttgcaggagcctggggaggggccatggtgccaatgcacttactggggagactggagaagccgcttctcctcctgtgctgcgcctccttcctactggggctggctttgctgggcataaagacggacatcacccccgttgcttatttctttctcacattgggtggcttcttcttgtttgcctatctcctggtccggtttctggaatgggggcttcggtcccagctccaatcaatgcagactgagagcccagggccctcaggcaatgcacggtgagttaagggtgggcatcgtaagaggaatacaccttgggcccatcctccctctctccctgtagtctctgaggcagagagtctctggtttcctgtcattggcatcagcgggaggaggggtcagaggccaacagaggatcttttgcccacagcagacaaaaaaaagggaaaaagggcttctttcatggaagccaccaatggccttatttctcttccctcagggacaatgaagcctttgaagtgccagtctatgaagaggccgtggtgggactagaatcccagtgccgcccccaagagttggaccaaccacccccctacagcactgttgtgatacccccagcacctgaggaggaacaacctagccatccagaggggtccaggagagccaaactggaacagaggcgaatggcctcagaggggtccatggcccaggaaggaagccctggaagagctccaatcaaccttcggcttcggggaccacgggctgtgtccactgctcctgatctgcagagcttggcggcagtccccacattagagcctctgactccaccccctgcctatgatgtctgctttggtcaccctgatgatgatagtgttttttatgaggacaactgggcacccccttaaatgactctcccaagatttctcttctctccacaccagacctcgttcatttgactaacattttccagcgcctactatgtgtcagaaacaagtgtttctgcctggacatcataaatggggacttggaccctgaggagagtcaggccacggtaagcccttcccagctgagatatgggtggcataatttgagtcttctggcaacatttggtgacctaccccatatccaatatttccagcgttagattgaggatgaggtagggaggtgatccagagaaggcggagaaggaagaagtaacctctgagtggcggctattgcttctgttccaggtgctgttcgagctgttagaacccttaggcttgacagctttgtgagttattattgaaaaatgaggattccaagagtcagaggagtttgataatgtgcacgagggcacactgctagtaaataacattaaaataactggaatgaactcctgatcccaaagcctattgtgttttcaacacaaggtaataggaagccaagcaacttgcatgtctcccaatccctgtctagggacagctgctggtgcaggatggaagacttcctataaacagaatgggcgaccaattgtgtctacagagggggtgggctgagcatgggcacgcatgtccccagcctcctggacgagcaaagtcagtcaaagcgctggtgatccctgctccgcgtgcgtagcagtgtctgtgcctctcctgcccaggggctagagagcagtctccagtgcagggtccccatcctatctgaaaacagtggagtcagtgaccccaggtggagggacttccagttttaacaatgggttggtatgaaggccagaaggagtgaaacatgtgaactttctggcgaggagactccctcttgaatcatccatatgtagccccggggtcacttgcgaagagtctctaacagcttctgcctcactcctaagctctgaccgctaggctttcaccccagccgccggtcctgattcctgagatcccaatattgagcaccaggtttcctggaattgtgtgctgcggctgtgatgtaggtttcggtcgctggaagctgctaaaccatagctgacgccccctcctaagccagccttccttccccgcgcgggcatctgtccagggccttgtcgcgctctcagtctccttcgcagcctggccccaaccgttcaacttcaataaagcaaaactccagccacgcccgtctccgtgaagttatcgccataggccggccagggggcgcgagaggcaccggggtgatttccgcgggaatcgataaccaatcggattcccaggccgaacggagcacacccgcccgccctcgctctttccccgccctttgccccgccccgctccttcccctccttttgtctgtccgccgagcaccccacttcaccccattggaccgcgcggccgccgctagagctctgcgcctgcgcacgcaccgggccggggactgggtggcctggtgtgtgggcgcggcagggcgcaggcgcaggcgcagtgtgcgtccgcgtctgaggggagggatgtgggggaagcgacggcccccggtttgtttgggctgtgggcggtgcgcagcggagagcccgggaaaagcgggaaatggcggcgccgagcgcggggtcttggtccaccttccagcacaaggagctgatggccgctgacaggggacgcaggtaagtagggaacggtcttagggctccttaggggagcccagggaaggggagcgtggcccccaggcgtgcggccctgcagccccctcccctcggagccccggaaagcagccgtgtccgcgcttcctgccaagggtgggacgcccgcccgagccgctccgagcctgactccgcgcaagggcccgcgggcggacctcttggccttgtctctcgtgggaaaagactgccccagcctccctttgttcaacccacgagggttctaaaggggaggtctttgcagtcctgcccgctcttgggttctcttgaagattcttcatcctttcctctggctcccttatgagggaaactataaaaagaccatactctgtctccttaaaaatcgacgagaccttctgcagacctcggtgctctgcctgatgtgcatttgatttgtatcgattgtatcatgatctgcatggctttgcatagaatgaccagattttcaaagaagtcaatacagggtttggaaattgagtacttttggcagaacaagggggttcctgtggctccgagtgtccatgcctctgccccggtcattccatttcatggcagtcatcacccaggagaacattgtaatgcctcctgctcgagactgaagattaaggtcttcgcaaagggaacctgcagaaggacacagaattaagacgtaggaactccgtggtgcccttcgcccctcctccccttccagttgtgtcctgaaattctaaatgattggaaacttttataatgttcacgtttaagactctcatactacagagtagaggaaggagcgggtgtgcagagggggtgatgcttcagattaaaactaaagagttgattgaaaattcaagtctggaactcgagagagttaagaactataagtcagtaagttgcaagtatgggtgagattgtctagggaaaggctctttgaaggggcgtccctaatggaatatcaatattaagggcaggccaaaggccctctaaagaaaacaggaactgggtaggcagagagaagactcccaaagaatgctgtcatggaaaccagaggaagagaacgatttaaggagcgaatactactggtaaactaatggaagaaatctgctgcaccactggttagtatcccagctgcagtgttatatgtgatcgttattactgctttgacgtattcgaaagtgattcattcttaaataggtttttttatttgtatagctctttttcttgtagccagtttttcctgaaagtcttgggtaatggaaatattacagtaaaaagaagaaaaaatggagtttcagactcatttttccaaacctcagattcattggctgcttccaacccacttcatctgttttaggatcccacctgctatcttagttctcccagttcttccaggacccagctcttccctcttctaactataaatctctcacccaatagcatctgcaagccaagtgcatccattccatagatgtgtggtatttcactgactctaagatacacattttttccctccctttttttttttttttttttttttggacggagtctttgctgtgtcacccaggctggagtgcagtggaatgatctcagctcactgcaacctccatctccaaggttcaagcgattctcctgtctcagcctcccgagtagctaggactacaggcatgcagcaccacactcggctaattttttgtatttttagtagagacagggtttcaccatgttggccaggctggtcttgaactcctgacctcaggtgatctgcccaccttagcctcccaaagtgcagggattacaggcatgagccaccgtgcccggcctcccctcatgttttaacaccttagaaatcagaatgcattttagagtaggtttttaagttataaatggaagttattgtattttcactgctatcaggtgccacccttcctgctgttacatatgtggaaaatgtgacggggcaggctagagaactctggatttatgtaaactaggcatgtagatgacatattggcaataggattattttagtttataagcagaagctgatctctttgcaagcctgtagcaaaattagctggaggtgacagcacatgcctgtagtcccaactacttgggaggctgaggcaggtggatcgcttgagtccaggagttctgggctatagtgtgctatgccagtcacgtgtccacattaagttcagcatcagtgtggtgatgtcctgggagtcagggtccaccaggttgcctaaggaagggtgaacccgcccaggtcaaaaatggagcaagtcaaaactcctgtgctgctctgtaatgggatcatacctgtgaatagccactgcactccagcctgggtggcacagtgagactcttttaaagtaaatagataaatacctatccactgtgactttctgtcatactttctgcttatccacatcttaacaggattcgccattttgtcactggaacttaaaagttttaaaaaacatgtaattatatgtttatatcactagtgaaagagagttagtgtctgcctcatttattttctgttaaagccattggcttgagtttttaccatagtgttttaaccctcatctaagatcattataaacttacatcactttcaccagcttagataatgtgagatgttttctgaaataattctctttattaaaattggtctatcagagaagtattccttctcataaatatgtgtacttgggggtattgttttgcttaagacagatatttccctcctctagtcagaccattcatctcagatgatctcagctgaacataaaccataaggaattagacattattttcttatgatcaatgtgttcctgcttagtacatctttgctttaaccagatttaagaaatatgcataatcttggttattgtaagtcttattctttttgttcttcctattcatgcctcttccactccactcttctgtgtcaaattgtgacttgacagcctttccttctaccgtttatctgtaggatattgggagtgtgtggcatgcatcctcatcatcaggaaactctaaaaaagaaccgagtggtgctagccaaacagctgttgttgagcgaattgttagaacatcttctggagaaggacatcatcaccttggaaatgagggagctcatccaggtatctggaggcaaaagagagaagataaattgatcatggggtgggaatagagcatgacaaaatatggaaagggtgtcgtatctttcttccttttttttttttttttttttgagacagagtctctgtctcccaggctggagtacaatggcgcgatcttggctcactgcagcctctgcctcccaggttcaagtgattctcctgcctcagcctcccaagtagctgggactacaggcaggtgccaccatgcctggctaattttttggatttttagtagagacagggtttcactgtgttagccaggagggtgtcgatctcctgacctcatgatccacctgcctcggcctcccaaagtgctgggattacaggtgtgagccaccacacccagctggatgttgtacctttctaaagaaatggaaatgcccttctaccgtagagcatttgagagaaatgatatataactcaagaataacagaaaggacttcacccatacatacacttttcctgtaaaaagaattcttggatgaggacactactaggaagctcatgtggagaaatagaattatagctagagaagtaaatatgatttcatgttttattcttgtgtcttaggccaaagtgggcagtttcagccagaatgtggaactcctcaacttgctgcctaagaggggtccccaagcttttgatgccttctgtgaagcactgagggagaccaagcaaggccacctggaggatatgttgctcaccaccctttctgggcttcagcatgtactcccaccggtatgaagctttagtaatatggggtgttgggaagggttagtttgactggaaaggaatttgtaagtcagagtgagggagactagattttgttgtatttggaccggaccacttccctaaggtctgtcatcatgagttttgatttcttacagttgagctgtgactacgacttgagtctcccttttccggtgtgtgagtcctgtcccctttacaagaagctccgcctgtcgacaggtgagaattgatggactaaaaggggtcccaggccaggtgccacggcttacgcctataatcccagcactttgcggggccaaggcgggtggatcacctgaggtcaggagttcgagaccagcctggccaacatggtgaaaccccgtctctactaaaaatataaaaactagctgggcatggtggtgggtgcctgtaatcccagctactcgggaagctggggcaggagaattgctagaacccaggagacggaggttgcagtgagccaacacggtgccaccgcactccagccttgccaacagagtgagactcagtctcaaaaaataaaataaaataaaataaaaaggaggggggtgtcccagattgacttcccctttcttgtctggtatctggctttgtcctaacatgagcccttttttttgtttttttttttttttgttgtgttttttttcagaaatagggtcttgttctgtcacccaggctggaatgcagtgacaccaccatagctcactgcagcgttgaactcctgggttgaagggctcctcctgcctcagcctcccaagtacctgggattacaggtgcatgccaccacacctagctcatttttaaattttttgtagagaaggagtctcactttgttacccaggctggtgtcaaacttctggcctcaaatgatccttccgccttggcctcccaaagtgctgggattataggcgtaagccaccatgcccagctgagacatagtttatattgggaacagttgtcagtaaatttgttaagggctagtaggacagtttatgcaggagtttgtggttttttgttttttttttttcttgtgatggagtcttgctctgtcgtccaggctgtagtgcaatggtgcagtctcggctcactgcaaactctgcctcctgggttcaagtgattctcctgcctcagcctcctgagtagctaggattacaggtgcgtgccaccatacccagctaattttttgtgtttttagtaagagatggggtttcaccatctcctgacctcgtgatctgcctgcctcggcctcccaaagtgttgggattacaggcatgagtcactgcgcccggcccaggcaaggtgttattaatagttggtccatttcccttccaccccagataacagtttttgtgataattgggcctttgagtagcatgtatgggcaggaagttcatgctcaattggcctctaaaaagctgaataagaaaagactacatttggggccaccagcctgctgatggagcatcctagtgattggaacgaggcttttatcagctagcccattcggtcattcagccagttgagcatatgcttcatgcaggctatgtgcagagaatcctttagtgagctaaaactaagagtctctgccctcatgaagcttacaggtttgggtagtgagtgagaccaatatttatcacaacccagttgcaagagatgtctgaagttacaatgacatattaagattgatggttaagttatatactagttttttggttttctgtctataccacagatactgtggaacactccctagacaataaagatggtcctgtctgccttcaggtgaagccttgcactcctgaattttatcaaacacacttccagctggtgagtttttgcataatgacaagaggaagagagttgggaaattagacacccttcctgggaacctgaacttagtttgcatgtacatttcctttctgccttattagtcagaaagttgttactggttaaatgccttctgtgagcatttgtctatttttacctgctggaggttaagaagaaaaatacgatgtctttgttttcttgaaatgtctaatctagccgaggaatcatctgttatcaagacgctcatggtctaactggcctctcctccacaggcatataggttgcagtctcggcctcgtggcctagcactggtgttgagcaatgtgcacttcactggagagaaagaactggaatttcgctctggaggggatgtggaccacagtactctagtcaccctcttcaagcttttgggctatgacgtccatgttctatgtgaccagactgcacaggtacctgaggtgggaaaaattgacatgtaaattagaggactgaacaacactttgggaccagagacatcgtttgttcctgtgcctgctgggatatgtcttaaaagttggtttattctacttacatttttactcactctgttctgcctctcaccttgcattctagtaagaaagaattagggccggccagccattttagtgttgacatctcaggttgtggtttcataaagtaataatagtccacagttggtgtctcacttttttttttttttttaaagacagagtttagctctgtcacccaggctggagtgcaatggcacgatctcggctcactgcaacctctgcctaccaggttcaagcgattctcctgcctcagcttcctgagtagctggaactgcaggcgcatgcaaccatacctggcttattgttgtatttttagtagagacggggttttgccatgttggccaggctggtctcaaactcctgacctcaggtgatccgtccccctcggcctcccaaagtgctgggattataggcatgagctacggcacctggctgggaaagtattcttaacatttgtgtaatcacaagtcatagggtagattgtttgtggaccagatttctagaaattgtaaacattttcattatgggctgttcgtcattaacctcagttactgtactgcacaactgactttgtgacctttagggtttctattttgcaatcaataatggcctatttgtagattcatattcactctttattttgattccagaatagtagaactttcttcaacttgctttgaggttgtcagtggtgaaattaaaattgctaggagattcactttgatctgttgggatagaggatctttgttttccattcagcattgtctgtagtcttcatttctctttcttagctgccctccttctgtgagagtaattatgtatttactatatttttggcaaggccagtttcatccacaggtacctgggtgttgtcctttacatgctatttttgccagcttcccccttgtagcatatgcaatgtagttaaatccacccttgcttcaaagccatggcagcaacagctgcttcagtcatcaagtattcaggtagtttatatgctttcctgagaagtctgctgggcataaaggggcaaagggcagggtaccagccataattcctacagaaggtcacttaacaaaatgtgcagtgtgtgtgttttcttagaggttttggtctagccatgtcttttactagaaatctattatgtcatggtttttcaagttgtatgcagctgataaaggatcttacatgtctaatagttaaagataaaatactgagtcactaagtcaactatatatactgctgttttctcagagactgtcagatttggtgagtttatgagctcacttcataaatagcatttccatttatggtaagcctgatgcatattcagtgacctattggattctaattctttggttgaattgctctgtaactggaattgcagtagagttgaacttcaagcaccttataatgggggactatgtgagctgccacagattttaaagatcagatgagggagttttgacatcagcataaaaggaagtgtgtcctcttatattcctaacgaccaaacaagattagagaaaaaatcttctgtcatagctaagaagaagaagcgcctaggtagatatgatcagaaggataagtggaggaggcagaacttaagctggccttgaaggatagaagttactgaagcagagaggagtggtgaagccaccctaggcagggagaacagtatgtggacaagaaatgtgtgtgttataaaccaggtagttgcaatgggtgtcataatttggtacactgggcatctgcacagaatgctctcttcctggtgggatctccctagagagtcaactcgtttatcatatagctatttggcaagcaaagaaacagaaccaaaaaaaaaaaaaagatccttttttctttccctatcaaatctttcttacttaagagaggaattccatttaaaaacaggaaatagtataattagtcttagagactcctcttcccctgatagtgctgcagtgaacatgggtattctcactgcccagatgttttcacttttctctttgttattaagtttttattgcatctacttcatgaggttactagttctagaattatgatttaccctatgttaggaaacgtactcttcaaagtggaaatttccttttaccatgtggtattgtttttttagcttgcatttgggtcacaaactgctttgaaaatgtaaggacaagctatgggttatccctggaaaatgcagctgcccatataatttagcatataatttcagagggttcacaagttactctcttcacatgtcccccaacccctagccaaaaatacacttaggagttaagaaccctgctatttatagaagtactgtaattttatcaaaaacaaatctgcagatcctattttaagctatgctacttgtagaaaaattcctccaaatgtctaatccccatttattgaatggtttagtcttactaagtttggttacaaagtgcgtgtattctttttttggacattgttttctatttactgacctaatctcactaaattcaaaatgctcgtgattcggtgcccaggtatataatttttgttttctttttttttattttgagatggagtttcacttttgttgcccaggctagagtgcaatggcgcgatctgggctcattgcaacctctgcctcccaggttcaagcaattctcctgtctcagcctcctgagtagctgggattacaggcgcatgccaccacgcccggctaatttttgtatttttagtagagacagggtttcatcacattggtcaggctggtctcaaactcctgacctcaggtgatccacccgcctcggcctcccgaagtgctgggattacaggcgtgagccaccgcgcccggcctttgttttcttctttgagcaaaattaacttctttaactattaaatgttaaattctattagcatcagctccagaggaacattcacagttatgtattctcttgaaattatatattcttgaaagaattttttgattatctgtcattaccttaagatttctattattatggtttgcttctacttagaaaatacagatacttttcaacaacaccagtctctttatttctagttatattgcagactttcaaatattttatgtaattgcatctcaattatctacaaacagaagtattccgaacagatcaattagtagctctcaaactttaacatatcacagtgtcctggagggcttgttaaaacacattttgctggagcccaagatttcacgtttcttccaagttcctgggtgatgctgctgttgctgctttaggggccactctgagaactactgcaatatgttatattatagaagtgtgctttttattttggcagtgtgtgtgattaaatatatgtgtgttttaactcttccacccagataacttacttattttcattacattttattcaagtttataataaaatgaacttgttttctttctgcccatctcagaagacccagacatcgtgaattatagagggaggcataggtttaaacatgtgtgcccaattattatgctctttaggtacacagtataaccttctgatggatggaccaaatgcttaaggtagtgctcttcatgtatcgcaacttagtgcaagataaacaagattctccaggcatggtggcacatgcctatggtcccagctactctagaggctgaggcaagaagattccttgagcccaggagttctaggctgtagtgtgctatgctgatcaggtgtccaaactaagttcatcatcaatatggtaacctcctgggagtggcggaccaccaggttgcctaaggaggggtgtaccagcccaggtcagaaatggagcaggtgaaaactcctgtgctgatcagtagtgatcttacacctgtaaatagtcactgcactcaagcctgggcaatatagcaagatcctgtctaaaaaaaaaaaagataaacaggaaaacagttcttaagttggactacaacattgaccagtaatagatttctttgagaaaaatactctttattcgacatgcacattgtaatggcacattttttgcaatgtgtcccagacacagtgatcggtttttggttttttttttgagacagggtctctctctgtcacccaggctacagtgcagtggtgcagtcacagctcactgcagcctcaacttcctaggctccagtgatccctccaccgtagcctttagagtagctgggactataagcatgcaccaccatgcctggctaatttttttttttaaagatggagtcttgctaggttgtccaggccaagtcctttgtcataatatctcatttttatcttcacaaacttagagaaaatatcctcataatttttttttataaagtgaaaagtgaggtctcaagggtctgagtaagctgttccaactcatgaagccaaggttcaaacctagattaatctgaacccaggacctgtgtatgtaattactgccctgtacagaatcctccttcatagcgtgctctttctgaaacaaagcattttatacagtcatcatcattatctcttggacacttagaatcttagaagacaacatacaagtattgctattctctactatcatgatgctgtcacagaacagtttattttcgtgtagctgaatgtgcatgttacttattcatagctacactttgagtcacccttgtgccatttatatacaagggcagttgctctaatgaaggatctggttatgaacagggaattaatcagagttgaccagctcatgattagcttctttagtaacttgctttaatccaggagctgtttgcctatctcagtgagtctgaatctgtattcagaatattgtgtctgaactcatatgcatttttctggtgagtccatagctttctttagtctctcaaaaggtctcttcttttatcattgaccacaggaatatacataaagcgttttatcttctaatagcttagggtttcaaaaagaaaccaaactttgatgcttatgttggtgctgaccttagtgcacaacactaaacattcctttcttttaggaaatgcaagagaaactgcagaattttgcacagttacctgcacaccgagtcacggactcctgcatcgtggcactcctctcgcatggtgtggagggcgccatctatggtgtggatgggaaactgctccaggtgcggataccctggtggaagccaactgttgaaaccaggctgctttacctcctgcctgctgtctgtcaagtgatggctactgttgcatgtgtaggacttaggaggccccgctgaatgcttaacctctcttcttccttctttctttctggcagctccaagaggtttttcagctctttgacaacgccaactgcccaagcctacagaacaaaccaaaaatgttcttcatccaggcctgccgtggaggtgagtgccctagcagaccagcacctgggtggtggctcctgggcagcctcccaccagctctcactttcctgtttgctcctctcaggtgctattggatcccttgggcacctccttctgttcactgctgccaccgcctctcttgctctgtaagtgtctcccaatgcatggggtgtgctgggacttgggcagcccatggctctcaggctggtcagctctccgtgcaccaccatatcctgttttcaggtctcttatcccgtgtctttgccttcctttctgagaactcttactcttttctgtgcttcattaactctggtgccctttttttggttactcattccagttacggatttttgatctgtctttttcctgtccttcttattttatctcctttctttcactctttgttcttttcacttgttccatatacttccctgtttacctacacttccatgcttgcctcctttcttctttcttcttaccattcttgggtcatgcaggatagcagaacagaatccgtgttggcctttgactcttccttttccgtgagctgctgctgcccctctttctctcatgcagtctgttttactcctttaagagccaggactgcaggacgaggattaaaagacacataggtgtgcttctcatcctggaggaaaataatagtaattaagagccctaactttggagtcaaattctgacttcaccatttactagtaacgtgaagttaaagaagttaaatggcatccctccatctcagtttcctcaatataaaatgaaaatagtccttgtacctacttcataaggtgcttgtgatggttaaatgagattatgcatttaagggcttacatagctcagtacctggctcacagcacatccacaaaatatgccagctgtaactcttaaaacacgatcagtgccgtaaagggcttatagtttgctttaaaggtcactttgtccaaacattcaaataattacttttttaatctctcatgtggccaaatgtaaatagctaatattattgtcatcctgatctagtattaccgcagaatatagtctgctgaggccctgcaacatgactcagactacggcagttactaccgcaaaagcagaaggaaatgtggcctctctaaggagcagaccagttactcaggaaaataaagtaaatatacatgaagtagcttaagactagttcacaggcctcatgtaagcaaaggtgaaattagcaaggtacaaactgtacttaggaaggagtatgcagtaagagtagatcattttaagtgagggtagtttaaagagattttttagataagataaggcttaatttgtacctggagtaatttgatttacatagttatagagtagtatctagagtctgtcgtaggaaagaaacaatacaatatgataagtacactgagaggcagagggcatgttgtgtctcccctcctcccaaacagatgctcggatctgattttaaaatagcatctgtgtgagtatgtgagatgtggctggtcacaatgaagtgggttcacctccttacaaacctttagtcataactgaggttttggacatcagcaggtaaaagtaaggaacagttgggagcttaagtaagaaataatgtgatgaattgtttttccagcaaggttgccatggagggggctgcactaaggaaagaggttatgggtcagcaactttacttttcattccctgctctatccccaggcccagggcactgcctgatgcatggtagcacttataaatgttcaatgaatggatgaaaattaatctgcctgaaaaactgtaggtattatgtaaaaaacaaatatgaggatattgtgacaaaagaaccagtgacatttattgattgatggatctgtgatataaaggtgagagaggaattctcctttctctttagcttggcctgtttcctttaggcgtctttactaacaaaacgacgttaaattgtgattttctcatcctatatccagggatttaatacactattggatctggataaggagtaattgctcttttctggagtaatctggatcttttgctctgtctctctaacttttctgaaattaaatccttcaaggaatgaccagtagccaattgttccattgaaaatttgagttcacctgtcttcctgctgtatttggttaatataattaatgtctagaaaaagctccacccccctgccccagtcagcttctaaactggagtgtaagctccatgacggcaggaattttctcttcactctatccctaggccttaaagtaagacagtgcccaacacatggcagttgcttgacacatttttattaaacctgtgctttggtccttttcccccaattcttgaagcttcccttctttcctaggctccctcgacattgcatggatcaggaagtactgtaaaagagcatactcttacttttgatgtgttgacctgagagtcctccccatctgtcttgcctactgacagcacccctgcccacacccaaaataaaacaacatcatcaaaaataagagtctgtcttgggatacataaggcttgtatcaagagcaaggatctgctcagggtatgttgagaaattactgctaaaattgaataaggatgatctttttaaattttctgggagaaaacagtcaagttctccccactttaagtttttcctcttaaaattttcataaggccaggtgcagtgactcatgcctataatcccaacactttgggaggccgaggcagaaggatcacttgaagccaggagttcaagacaagcctggtcaacgtagcaagaccccatctctattaaaaaaagaaaaaaaaagatttaaaaagttattttaaaaaataaattaaaaattttttttcttaaatcttggatgcttgctataatttatcttatgaaattaataaacatagtgcttcgaagatatcaaaaccaccttggaaacaactgatcatacttagttttattattttttgatacatagttcgaggttgtgatttttatatagcatacatatggtaaccgtatttgttatttattaccttgttttttcttgtttatgtaattaaatatatcaatattttattatgtattgcaataaaaagcactgtgactcccaggcatattgttaattgaacaagtgagttgtggacttagatgattttcagttccatttacaaggagtatttgatttggcattttccctgtcttacacagaatgggaactgctccaaccgcatagatgtgcatgtgcttgagcgtggtgcccggtgtgtatgaggcatcccctgagtaacagatgcatgctgagagagtaataattttttttttttttttttagtttatcagccataggttggaggcaacagctggaaatggctcttccccttcaaggttgtagggaacgtgggcttgcctgtgacaggcccaagagagataggaagaagtaacatcattgtccattctgtctgcctttgttacagatgagactgatcgtggggttgaccaacaagatggaaagaaccacgcaggatcccctgggtgcgaggagagtgatgccggtaaagaaaagttgccgaagatgagactgcccacgcgctcagacatgatatgcggctatgcctgcctcaaaggtactttgagttccaaaagagttgagtcatacctcattttgttgcactttgctttattgtgctttgcaggtacaggttgagtatcccttatctgaagtgttggaaccagaagtgtttcagattttggatttttttgtttttttggattttggaatatttgcgttatacttactagttgagtatcccgtatccaaatattctaaatttaaaacactcccatgagcaccttctttgagcatcatattggcacttggaaagtttcagattttgaagcatttcagattttttggatttgggatgctcagctgctttttacaaattgaaggtttgtggcaatcctttgagcatctgtcagcaccatttttctattggcatgcctctgttagcatttttcagcaataaagtatgttttaattacagcatatgcatgttttagacataatgttgttgcacacttaatagactgtaggatagtaaccataacttccgtatacactgggagacctgaaaatttgtatgacttgctttattgccatattcactttcttaagctggtctggaaacagacctacggtatctccaaagtatgccaataatccaaaagagtaccctcctagacttagattcttcatgctgggttctctgactagggagggtgcaggtgtcatggccgagtctagtttgggaagtgcagctgtgtgatggcattcacactgtgattaatgcccttttggttgcagggactgccgccatgcggaacaccaaacgaggttcctggtacatcgaggctcttgctcaagtgttttctgagcgggcttgtgatatgcacgtggccgacatgctggttaaggtgagccagcgggctccgtgacccctgtgtgtctccacagtgctctactttcctcctctcttgaatgctctttcatagtccgtctccccttcccgtttgctgctctcctgaagcccgagattctcagacttgggcctattggttctgcccctccaggtgaacgcacttatcaaggatcgggaaggttatgctcctggcacagaattccaccggtgcaaggagatgtctgaatactgcagcactctgtgccgccacctctacctgttcccaggacaccctcccacatgatgtcacctccccatcatccacgccaagtggaagccactggaccacaggaggtgtgatagagcctttgatcttcaggatgcacggtttctgttctgccccctcagggatgtgggaatctcccagacttgtttcctgtgcccatcatctctgcctttgagtgtgggactccaggccagctccttttctgtgaagccctttgcctgtagagccagccttggttggacctattgccaggaatgtttcagctgcagttgaagagcctgacaagtgaagttgtaaacacagtgtggttatggggagagggcatataaattccccatatttgtgttcagttccagcttttgtagatggcactttagtgattgcttttattacattagttaagatgtctgagagaccatctcctatcttttatttcattcatatcctccgccctttttgtcctagagtgagagtttggaaggtgtccaaatttaatgtagacattatcttttggctctgaagaagcaaacatgactagagacgcaccttgctgcagtgtccagaagcggcctgtgcgttcccttcagtactgcagcgccacccagtggaaggacactcttggctcgtttgggctcaaggcaccgcagcctgtcagccaacattgccttgcatttgtaccttattgatctttgcccatggaagtctcaaagatctttcgttggttgtttctctgagctttgttactgaaatgagcctcgtggggagcatcagagaaggccaggaagaatggtgtgtttccctagactctgtaaccacctctctgtctttttccttcctgagaaacgtccatctctctcccttactattcccactttcattcaatcaacctgcacttcatatctagatttctagaaaagcttcctagcttatctccctgcttcatatctctcccttctttaccttcatttcatcctgttggctgctgccaccaaatctgtctagaatcctgctttacaggatcatgtaaatgctcaaagatgtaatgtagttctttgttcctgctttctctttcagtattaaactctcctttgatattatgtggcttttatttcagtgccatacatgttattgttttcaacctagaaacctttatccctgcttatctgaaacttcccaacttccctgttctttaagactttttttttttttttttttttttttgagacagagtctcgctctgtcgcccaggctggagggcagtggcacgatctcagctcactgcaagctccaactcccgggttcacgccattctcctgcctcagccttccaagtagctgggactacaggtgcccgccaccgtgcccggctaatttttttgtatttttagtagagacagggtttcaccatgttagccgggatggtcttgatctcctgacctcatgatccacccacctcagcctcccaaagtgttgggattacaggcgtgagccactgcgcccgggcaagacctttttttaaaaaaaaaaaaaaaaaaacttccattctttcttcctccagtctgttctcacataacagagtagttttggtttttaattttttttggttgtttgctgttttttgttttttaaggtgagttctcactatgtttctcagactggtctcgaactcctggcctcaagccatcttcccgcctcagcctctcaaatagctgggcttacaggcatgagccaccacacctggccaggatttggttgtttaaatataaatctgatcacccccctgcttagaacccttctgctttctattacccctcatttaaaatgtaaactcttcaccttggtttatgagaactggttcttgccttccccttgaacctcattaaatggtgatttcttgctaagctccagcccgagtggtctcctctcagcttctaattttgtgctctttcctgcccttttcctgggccttctcagctctccacccccaccactcttgactcaggtggtgtccttcttcctcaagtcttgacaattcccgggcccttcagtccctgagcagtctacttctgtgtctgtcaccacatcttgtcttttcccctcattgcatttattgcagtttatatatatgctacttttacttgttcatttctgtctcccctaccaggctgtaaatgagggcagaaaccttgtttgttttattcaccatcatgtaccaagtgcttggcacatagtgggccttcattaaatgtttgttgaataaaagagggaagaaggcaagccaaccttagctacaatcctaccttttgataaaatgttccttttgacaatatacacggattattatttgtactttgtttttccatgtgttttgcttttatccactggcatttttagctccttgaagacatatcatgtgtgagataacttccttcacatctcccatggtccctagcaaaatgctaggcctgtagtagtcaaggtgctcaataaatatttgtttgggtggtttgtgagccttgctgccaagtcctgcctttgggtcgacatagtatggaagtatttgagagagagaacctttccactcccactgccaggattttgtattgccatcgggtgccaaataaatgctcatatttattactgatgtgtgctcaatatctgtttctgtagatactcagtcctctgaagcccacagatttcgtttccttagccccttacactgcagcattccttaccacctcacaaggcatacccagacctgaaaacccttcttattttgctgctgtgatcctgtaaatatatgcaggtgtgggcccatctcagtttgcgtagtcctgggatttctcacagatgaaatggaagttattagcaaacagtgctggttcttgattatttagactatgagatgtaggctgccataacagattgggctggaatagaaggatgggagagtgaagatagtaaaattccatttcttacctggttgcatttaaggtcttctagagtgggcatagattgtaagagaattctagtgcagcatagaagagatcaaagcaatgaatttgtgtaagttgggatattttgggggtgcattgtatctaaaggatatgcctgagaggtaagtgcaggtgcagatgggccatggaatttggcaagagatggaatgttctgtaggaactttgtacagaagttttggtaggaaacaaaacttttttttttaaatacgggatttcaccatgttggccaggctggtctctaactcctggcctcaagtgatcagcccgcttcggcctcccaaagtgctaggattataggtatgagccacctataacaaaccagaaacaaaacttttttgtttggtaggaaacagctgtgggagctggaaatattgttgagtcatacagagaagggtatggcagtctaggaagagcagaaggggattgaggtgagctgaagcacctcggcagatagagcagaatttggtacagaacactggagacaaaagggcatgaaaaatggactgaaactggttggttgtactgcaagaaaaacaaccatgggatagcctcaagggaaggatacaaaatctaggacaggcgaagaaattatggaaatagtggaagtaagataaatacccattttcaggataggaagcattttcagtggtgtgatatgtttgagaattacagagcagtatctctgaactggattccatgtcctccccgccccccaacccccttgcccttgaataagggtatgaggttgaatttcacagctctgctcccttctgcttacctctgccagaggattctcttctaaaattattcccctcccagagctgggggctgccctctgctgccctcctccatcctgtttcctctaatagggaaaaggaaaacaggaagaaggaaaaactgtaatatcagaccaaagctgatttttttttaatttttaaaattttattctataaaatagagatgaggtctcactatgttgttcacactggtttcaaacatctgggttcaagtgatcctcctacctcggcctcccagagtactgggatcacagacatgagccaccacacccaaccaaagctgtgatattaagaatggtgccagactggccgggcgcagtggctcatgcctgtaatcccagcactttgggaagctgaggcaggtggatcacctgggctcaagagtttgggaccagcctgggcaaaatggcaaaaccccgtctctaaaaaataaagaatgaggccaggcacagtaacacatacgtatagtaccagctactcaagaggctaaggagagaggattgcttgagcccaggagttgaaaaccagcctaggcaacatagtgagacccccatctttaaaaaaaaaaaaaaaaaaacacacacacaacacaagaggaaagacgtctaatctgagaaggaggaagacattaataatagctacaactgtttgagtccttggtatgttgtaggcattgagaggagctttccatttcatcttccccatgcttctgtgaaggagtcattttcccttttgtttttgaaacaattttgctgttgttgcccaggctggagtacaatggcgtgatctcagctcactgcaacgtctgcctcccaggttcaagcgattctcctgtctcagcctcccgagtagctgtgattacaggcacacgccaccacacccagctaatttttgtatttttagtagagatgggatttcaccatgttgcccaggctggtcttgaactcctgagctcaggtgattcacccacctcagcctcccaaagtgctgggattataggcgtgagtgagccaccgcgcctggccacaaatgtagctttaacggtatggactctagaattcagtagatctgattttgaatgccggctctgcctttgaagatattggagaccttgatcaaggtagctaacacagccccaatttcccttatttgaaaatgaggaaaattgtgtctaccttccaatgtccctatgaggattaaatgtgatgatgcatgtaaatcacatggtgttaatgcataaaaaatgcttgataaatgttaactcacagaatgagcttcagtttaatatgagtgaacagttcttactatgaatcaaacactatagcacatttttgttttgttttgagatggggtctcactctgtcgtgaggctggagtgcagtggtgtgatctcggctcactgcaatctccgtctcccgggttcaagtgattctcctacctcagcctcccgagtagctgggattacaggcgcacgccaccacgcccagctaatttttgtattttaagcacagacgggatttcaccatgttggccaggatggtctcaatctcttgacctcgttatccacccaccttggcctcccaaagtgctgagattacaggtgtgagccaccgcacccagcctatagcatgtttttttgcatgtgttattttatcttcttaaccctctagttacttcctttctgaggaaactgaggtcaggatgtgaaaccaaagctgtcagtttgagcgtatgctaacagccttgcttctgtgacttattctggcatgaaggatttttttcttcctttttttgggctgtaagattcctcccattgggctgtgggaatgaaactgagacccaaaccttattccatcttaagtcctaattaggtaggagtttgggggaaaatgtatcatgtttgaaaagccagaagggggagaaggagacctgtcgaatactacagggaaagcctgacgtgcaggggatgggaaaggactaaggatgcttaaagaataaggaggctggctgggcgtggtggctcacgcctgtaatcccagcactttgggagtccgaggcgggcggatcatgaggtcaggagatctagaccatcctgactaacacggtgaaaccccatctctactaaaacatacaaaaaattagctgggcgtggtggcgggcgcctgtagtcccagctactccggaggctgaggcaggagaatggcgtgaacccgggaggcggagcttgcagtgagccgagatcgcgccactgcactccagcctgggcgacagagcgagactccgtctcaaaaaaaaaaaataaaaaagaataaggaggcaagccacaataaagaggagaggagacatgaccgccagtggcatacaatacaaagtgtcttcagaggaagttgtagcttagctgaaatttcagaaagtaggtggccacgggttccatggctgcctggatatgcagagggaaagtgatgactgaaaacacctttaaagaacataagggttttactgcccactatgctggggaggccagactggaagacgtgagagtctgaaaacaagggtgtaacccagaaagaaaattctttcacctatacccaacacaaaacttctcctccatgtatcttgcatggcaactttttacgattttccttcaaatagcaattctataagcctatgggcttttaaactttttgtataatggaccctaggatgatctatttaaaaccccaaaagaggccgggtgcagtggcttacacctgtaatcccaacactttgggaggccaaagcgggcagattacctgaggtcaggagttcaagaccagcctggccaacatggtgagaaacccatctctacaaaaatacaaaaattagccgggcatgaccgtaagtgcctgtaatcccagctactcgggaggctgaggtgacagaatcgctcaaacccgggagacggaggttgcagtgagcagagatcgcgccattgcactccagcctgggtgacagtgagacaccatctcaaaaaataaataaataaaataaataaaacccgaaagaatatatatcatttatgcatgcttatgaatttgcttccacattcaggagccttacaggaatccctagaagcccatctttgtgcctccaaataagaacctaagctactaagcccagcgggatgatggagtgaggagtgggcatggtttacattttcttttcttgttctcttgcagggatttaaacccatgggatttaaactattcctaatttcaaacacaggatatttactctcaaacccttgcccaccagcactggcagtctgtacatgtctttgaccctcctaatttcagaatctggttttaagaatcgcagttggtgctttccttctagaccacacgcttccactcagcttggctggatgtgagcacttccctactccactggtctctgccttcaaatctcagagtccatgactaggctgctctgttttagggccctgtctttctcagaaatagtaagaaagtcataattgtatctcatatcttgctgcttatatttatcaagtttctacagcaactgatcactttcaggaaagctatactcctcaaatgggagaatcttgtttctgaagtcctccaaggaatgcagtgttaccttggcactctatttttttgtgtgtgcaacaatgtcttttattatgtatgcggttttaaaattatttcttgaatctctccatacacaggcaaaaaataagtgtgctacttaacatactggaacttgcctaacttaatcattgcccagagaagggaaaattatcaccaaaatgtgcttaaccaggaggccaatgcatctgccaacctccaagaacatggagatgaacttgacagacagactgtccaccatctgaacctttattcaccaccatttgataacccttattcaggcccaaatcagcagcacatttcttgccaacaatcattaagtgtccaagaagactttcgtcattatcttctgctgcagaaatctgggatatatgttttttcgatatcaacagaaaacgtgttggtgcttgaggggaagtgtcatggaaagcaaggcactggtcatcctcaaaaatgattttggctgggatttccttgcagatgatcttcccgaagacagtgttgccaccaggccgagcgacctgagccttggcgatctcacctgccatctctgcctgtctcccacacagcaggcagggtagaggctcagaaggagggaggaacccacagattctattttctttgttaagaaagtaatcctttctgctcataccaatcccatagatgtctatccttattttctgcctgcagaaaaggtgggtatcatcacagaatgtttagtctctcaattcatcacacatttgtaattttttggagagattataggccttgaggtttgtaggattgttgttagagcaggtgttttgtttttttttttttttagctacattggtgtataattgacaactagaaattatacatatttaattactacttgagaccgtgattacagcagttactactgttaccacttgaaaccatcattatgaccgaacaaagggacgaatgtagaaatgaaaacttaagacaaaagaaactgttttaaggaaaggcaacatgaagaagaagagagctccctgcttctagtgagcaaaggcagctcccctgccgagcttctcagcccttcatatttactgggtaacaagaacaagaaggaggtaacgattggtcagctgctgaattgatcacaggttcatattgttactgacaagcttcaattgtacctaatcataagaaacatttgtgcggcctccaacaatgtacaacttgatgtgttgatatatgtgtacattgtgaatgatcatcacaatcaagccggttaacatatccatcacctcacatagttgctttgggggtgcagggaggtgagaacattcaagatctaccctcttagcaaatttcaagtatgtggtattactacctatagttaccatgcacattagatctccaggactttctcatcttgtataagtgaaccttgtatcctttgaccaaatttccccattctcccaccccctactccagcccagcccctggcaactaccctctactttctgcttctatgagtttgactattttagattccacatacaagtgcaatcatgcagtatttttctttctgtgtctgcaatgtttgacttagcgtaatgtcctccaagttcatccatgttgtcacaagtggcaggattttcttctttgtcagggttgaatagtattccattatatatatttatatacacatgacattattcatctgttagtggacacttaggttgtttccatttctaggctattgtgaataatgctgtaatgaacatgggagtgcagatacctctttgagatactgatttcctttcccttggatgtatgggagttgctgagtcatatggcagttctgtttttaccttttgaggaacttttatactgtttttcataatgactataccagtttacattcccaccaacagtgcacaagggttcccttttctctgcattctcactaacatttatctcatctttttatttaatttttttttgagacataatctcactctgtagaccaggatggattgcagtggtgccttcccagctcactgcagcctccacctcccgggcttcagtgatcctcctgtctcagcctcccaagtagctgggactacaggcgtgcaccaccacacatggctgatttttataatttttatagagacagggtctccccatgttgccaggttggtctcgaactgctgggcttaagcattccacccgccttggtcacccacattgctgggattataagcatgaaccataatatccatagccataataatggctatctcttgcttttttgataatagccatcctaacaggtatgaggcgatattgcattatgattttggtttcctgatgattaatgatgttgaggccctagaaaaagtacttttaatgatattggcttccctcctgctttgggtggttccatttagcctaggtcaaaatcacattgtagaccagatgtttggtgtccctaccctgcagtccctgaacttggactgtcctgggacagaccccacttggtaatgcatcctaaactttactttggctcagttcatatcttttctcctacagtgaagagttcatagggaagacatgtcataggaaaattggttttataacgtgatgccaggaagaaaagtttgtccttggccaaaaaagtatttattgacctgaaaagggaagaatagcagagagcacttccccatcatctttcatgtttgtcgggcttgtcatgagaagccctcacccctttcccacctctcccttccctgtgcctctttctactttcgattctcccctgttatctcccttgttatctatctgatggagccagtgtgggcactccacagtccaaatggaagctcagtccctccgggttggcagtgtggctgacacctaacagtctgggaagtgggagaaattctagaacccaaggctattaccgaccctcgacttcccacttcccataagtgttccacacccagtgagtgataaggatgggatcaggggatgcccccaagctgttattagcagcctctggcagacagaagggcaaagagctagagaagaacgctggacatgggatgggctggcagagctggccagacagaaccctgggtggacacagagttgggaacaagctggccaggagatgtggcagagaggcaccagttactttcccaggtgagttaatgtgccagtgtttccagaacttcgagtcgcttcatctttatccagcacccacccctcaccttccgcatcctgaagaagagagatgggcaactggagggcttccatgcagatccggctctacacataggtttgagagcatactcagcagtttctcatcctggtccaggcgatatttatagagggaccagtgacatggagctggaagcctactactggtgactaagaagggggacaatgccactggctcagcagagggaattccctgtggggctgtccctcaggttctcatcccaacccccacccccacactgcactcacacctgcttcgaccccaagcagatcagatgtggcagtggggggtcatgtgacggagaggggtctataaatagctggaggtgggcatgctgccccagacgccttggggacagcaagagcagaggcttaaggagctacactgggggaaggacaggggcaagcaggccaaggcctggccggggctcggggggagggaatatggagcaatcccggtcacagcagcgtgggggtgaacaaagctggtggggtagtgacccccagtaccagtatatgccctttgaacactgcaccagctacggactgccctctgagaatgggggcctccagcacaggctccggaaggatgcaggcccccgccacaacgtccaccccacacaggtaaagtgctctaaggggagaggggagccatggatgaggggagacagtggtgccagagactggtgaaaatgaggaattgggtgaaaagagggagcagtgttacatttttttaacttaaaaaacaagtacgtggtgatgtgttcaaaatatgaaaatctttgaaagtctgggctcacttaagtatgcacttagagagatatgcatgcactttcatacaacctttaccaacagagtacccaaatcatatggggaaacagcagagcctcacatgcatgaatagctcgtgcttacataacctacgtggagtggattgcgtaggagcccacactgcagtgtgctgggagctgtctcccacaccctcacccacaggtagacactgccagatttctgcctctgggaccctctgcagaatacacacaaacatgaatctttctgcagaaggcagaagaaaggaattgggcaagtgtagaaaacagactgaattgcttatcagtgatcaaagatctaccaacgtcaaaatgagcagagatgtacaagcttttaggtcgcaagatgatcaagtaagaacctattaagtgttaggcacctggaaaagggcagagatgtgatcccagcaacagaagcatgcaggctaattaggagtgtctatggatgagcagcctcccgctgtgggattggtgggatatgaacacctaggaaagggggaatggggatgggcacaactaaaggaaaggttgtgaaattgtcatggaaaaagataggtcatggttaataagtaagtgtgcctctccctccaaagaatgcagagaataacagaggatagaatttgtctagagggcagttggccagaacttttttttttttttttttttttgagatggagtctcgctctgtctcccaggctggagtgcagtggtgctatcttggctcactgcgacctccgcctcccgggttcaagcaattctctttcctcagcctcctgagtagctgggattacaagcacctgccaccatacctggcaaatttttgtactttcagtagagacggggttttgccatgttggccaggctgtctcgaactcctgacctcaggtaattcacccgccttggcctcccaaagtgctggaattacaggtgttaaccactgtgcccagtctggtcagaacttaaaaggcttttttttctttcttttttttttttttaacagggagccttcagttcctttaggtttaaggctgggaagctgaggcatgagctatgcaggggatctcagcactgggggtcaaaaggatctgctctca

SEQ ID NO: 1047 - DNA, 122813 bp, Homo sapiens
ttctttacttaaacctcatgaaccaagctcctagcttcaaaattttctcctgcagcttacttacctttctcagccttcatagaattaaagagagttagggccttgctctggattaggttttggcttaaggtaatgttgtggttggtttgatttatctagaccactaaaactttctgcatatcagcaataaggctgtttcactttcttatcattcatatgtttaccagagtagcacttttaatttccttcaagaacttttcctttgcattcccagtttagctaacgggtgcaagagccctagttccagcctgtcttggcttttgacatggcttcctctctaagcttcatcatttctagcttttgatttcaagtgagagatgtgtggcttttccttccactggagcacttggaggacacagcaggtttattatttggtttaatttcaatatttttgtgtctcagggaataagaaggacaggtggagagatagggaaaggacgagttggaggagcagtcagaacacacacaacatttatcggttaagtttgccatcttatatgggcaagatttatgacaccccccaaaatttacaatcataacatcaaagaccactgatcacagattagtgtaacagatataataataaggaaaaagtttgaaatactgtgtgaattgccaaaatgtgacataaaaacatgaagcgagcacacgctcaataaaatgaaccacagtggtcaggactcaaagtgatttcaatgaactggagtgctaggatatctagctaagataccagcaggttcaagctgggtacagtgatgcatgcctgtagttgcagctactgtagaggttgaggcaggatgatcgctggagccaaggagtttgcacaatgatcacacctacaaatagccactgcactccagccaggacaacttagcaagaccctatctctaaaacaaacaaacaaaaatcccacaaaatttagcaggaaccaattcaagttgtatagggcctgaagcctatagaatttgaaataccctctttaacaacaacaaaatacaacattatgaataacgacaaaaaagaatcaagtacaaaagtaaatatttattagcatgggaaagaaatcaccacagtcttggagttatgtccctttattcagagaagcttactttaaaatatttcttgattataatctagtttttattccccacctagaacactctacaagtcccagaatctctcagcattcacagaggccatacgaatgaaagaccctgaagcttaagctttattagcttcagagtataactacctctggcaaaagttctacatttatgttaaaataattaaattttatttttaaaatagagaatgaagagagcctgactttgagacacttgtgttaaaaaaaagtcaggggaattttcttcaatcacaatcttcctgtacattaatattatgacagtaaataaaagtgggccagcttaggcaaggaatattctaactttaacatatgcattagccaaataacttcggggagttcaaattgaaaaagaaacattggcaaagcacagccatctactaagggaagcagataatatgacgagagagattcttgccatatgaggaaaggactactgaaagaactgaagtgtttggctttgggaagtaaatgctgctgggagagagctgatgagcagccgtgtgccacttcaaactatactacaaggttacagtaaccacactgtatgacactggtacaaaacagacacataaaccaatggaacagaatagagaatgcagaaataagaacacatacctacaaccatctgatctttgaaaaacctgacaaaaacaatggggaaaggattccctatttaataaatggtgctgggagaactggctagacagatgcagaaaattgaaactggaccccttccttacaccttatacaaaaattaactcaagatggattaaatacctaaatgtaaaacccgaaagtatcaaaaccctagaagaaaatctaggcaataccattcaggacataggcacaggcaaagatttcatgacaaaaacgccaaaagcaattgtgacaaaagcaaaaattgacaaatgggatctaactaaatgaaagagcttctgcacagcaaaagaaactatcatcagagtgaacagacaacctacaaaatgggagaaaacttttgcaatctatccatctgacaaaggtctgatatccagaatctacaaagaacttaagcaaatttacaagaaaaaaaaacattaaaaagtgggcaaaggatatgaacagacacttctcaaaagaagatatacatgtggccaacaaacatgaaaaaactcaacatcactatctttagagaaatgccagtcaaaaccacagtgagatactgtctcataccagtcagaaaggcgattattaaaagtcaaaagacaatagatgctggagaggttgtggagaaaaaggaacgcttttacactgttggtgggggtgtaaattagttcaaccattgtggaagacagtgtggcaattcctcaaagattgagaggcagaaatatcatttaacccagcaatcccattactgggtatatacccaaagaaatataaattattctgttataaagatacatgtacacatatgttcattgcagcactatttacaatagcaaagacctggaatcaacctaaatgcccattaatgatagactggatagagaaaatgtggtagatatacaccatggaatattatgcagccataaaaaggaaaaggatcatctcctttgcaggaacctggatggagttggaagccagtatcctcagcaaactaatgcaggaacggaaaaccaaacactgcatgttctcacttataagttggagctgaatggtgagagcacatggacacatggggtggcaggaacaacaagattgggtgggaggagggggagcatcaagaagaacagctgatggatgctgggcttaataccttggtgatggcatgagctgtgcagcaaaccaccatgttacatgtttacttatgtaacaaagccgcacatcctgcacatgtacccttgaacttaaaataaaagttgaaggaaaaaaaagaagacttactcctattgttctagagaaagaaagagtgagagttgcaagcagccgatttcaacccaaggtaagtcaattcaattcaataagtatttatgatgtctagtatttgccagaaatgttttccggcactggagataaagcagtgaccaaaatggacaaaagttctcctctcatcgagtttacattaatgcaagagagataaacaataatacataaatatataatatgtcaagtgttgaggtgatgatgtaccctgagaagaaaaatacagcaaagtaccagcaacagtgaattgagaacaaaattttttaaagatgccaaataaaattgcatcaaaaagcatcaaatatctaagaataaatccagcaaaatatgtgcaagacttctacacagaaaattgtataaagcattagtgagagaaattaaagaatacttaaataaatagaaggctatactgtgtttgcagattggaactctaaatattatcaggatatccattttctccaacaatcgacctatagattcaatgtaattccccaaaattaagggggagtgtgtgtgtgtgtgtgtgtgtgtgtgctgatcagatgattctaaaaatgtatatgaaagtaaatggccatggagaggcaaggtgatcttaaagaagaataaagttagagaacttattgtaccagatttcaagactcatcgtaaagccacaataaataagacagtgtgatatttcggcaaaagaacagacaaacaggctgataggatacaacaaagagtaaagaaacagacccacatgtatactggtactttatttatgacaagggtgacacagagcagtagagaaaggtggatatttttaataaatggtgccaagtcaattggatattcattggaaaaaaatgaaacttcacccatacaaaaatcaattccaggtcgattttagatcttaatgtaaaaggcaaaataataaggcttttaaaagataacattggagaatatattcctgacttgatgtagacaaagttttcttaagcaggactaaaacacactaaccatcaagaaaaagattaataaattggactacactaaaaataagaacttctattcataaaaaggcactattaagagagtaaaaaggcaaatcacagaaatggaaataatgtttgcaatatctatagtcttagtaattaaaggataatttttaaatgttttcaccacaaaaaatgttaagtatctgagatgatgaatatgttaactagctgactttattacacacattgtattagtaaattataaaatcactttgtaccccataatttatataattataaattggcaatttacaatacaaaatctatacttgacaaataacctatgcctaaaatataaaaggaacacttacatattagttttttaaaagagaaataacccaatttttttaaaggaaggagagaaggaaagacaggcttttcattgaagcgactatccaaatagtcaataaacattgaaaaaggtattcagcttcactaatcatcagggaaacacaaattaaaactgcagtgagataccactttacaccagccagagttataaataatgttttttttgtttttttgtttttgtttttttgtttttttgtttttttgtttttgacggagtttcactcttgttgcccaggctggagtgcagcaatggcacgatctcggctcaccacaacctccgcctcctgagtttgagcaattctcctacctcagcctcccgagtagctgtgattacaggcatgcaccaccacacctggctgatttttttgtatttttagtggagacggggtttctccatgttggtcaggctagtctcgaactcctgacctcagatgatccatctgcctcggcctcccgaagtgctgggattacaggcgtgagccaccacgcccggccataaataatcattttttaaaagattataccaagtgttggtaaggaaatggatacgtaagaactctcatttgctactggtggaaatgtaaatgagtatgaccactttggaaaattctttggtaatatcctctaaagctaaacatgcataccttttgacccagtaattctactgccatatattgctcaacagaaatgcaagcacaggcacaccaagaagtagctacaagaatgttgatagcagcattgttcgtaatagcttataactggaagcaaacttgaatgtccatcaagagtaaaatggttcaataaattgtgatagtcatacaacagaatattatatagcaatgaaaaggaaaaaaactactgcaaaatatggttgaatctcacaaacattgttgaaagaagctagaccaaatgattatttaataaatagttctattaatacaaatataaatgatatatagtgttataaatcaggttagtggttactctgtgggtttcacagaatgaaaaaggctatggagggtttctatagtgctattcaagttgtacagatttctaaatgtgtgctatatttcaataaaataagtaaattaaaacaaaaccgaaaataggctggcacctgagtttcttagagtaatccaagacgagttagggctgtgggtgaaagattgagaaaacactacacttatgagacaagagactgggaatccaggaggaaagatagtcaaggagaaattcacagtagctggattgcctaaaggtttttaaagaacagagtatttaatgttcactttaaaattgtgttctattatgcctgtaatcccagcactttgggatgccgaggcgggtggatcacgaagtcaggagatcgagaccatcctggctaacacggtgaaatcccgtctctactaaaaatataaaacattagccgggcgtggtggcgggcacctgtagtcccagctactcaggaggctaaggcaggagaatggcgtgaacccgagaggcagagcttgcagtgagccgagattacgccactgcactccagcctgggcaacagagcaagactccatctcaaaaaaagaaatacaaaaaaatagccgggcatggtggtgcgtgcctgtaatcccagttactcaggaggctgaggcaggataatagcttgaacccaggaggtggaggttgcagtgagccaagattgtgccactgcactccagcctgggccacagagtgagactccatctaaaaaaaaataacaaaacaaaatttaaaaattaaataaaattgttttcgatgctacaatttgctctaaccactctgtgactccatctccaccaccaattttattgttctcaagccatcagtaaagtttacaacaccccaaaaacgcagggtaaggaaacagtgatggagtaagatgaaagaggggctatgtcatttatgagataggaaagccaaaggaatacctctctgaatagagagcaaaagaagggagggatcacaaggttaggagttcgagacaagcctgaccaacatggtgaaaccccatctctactaaaaatacaaaaattaaccaggcatagtggcatgcacctgtaatcccagctactcaggaggctgaggcaggagaatcgcttgaacctgggagtcagaggttgcagttagccgagattgtgtcactgcactccagcctgggtgacagaacaagactcagtctccaaaaaaaaaaaaaaaaagagggagaagagagctccagactgagagaaggaaatgcaaaggtccaacacagggtatgctgggcacatccaaagaccagcaaggaaaccagtatgtgtgaagacaaggaagctggtagagagatcagagacacagccaggacccacatgatgatggccttaatgggccatgaaatttactgaatttcactctgagacaggaatccattacagacatggttttgagcagggaaatgaccgaatccaattttatttttaaatgtgtcattgcagttgctttgggaagaacagcctgtaggaaggcaaggtcagtgcaggaaaaccagataggaggttttctaagagaaagatgatgccagcttggatagggctggtagtggtggaggtaggaaaaagaggttgagtctggatgtattttgaaagtcaatccatcaggacttgtagatgggttggagatagtaagtgaggaaaagagaggcatcagaggtgtctcagtaaagaatttcctaatccaattgaacaagcttcccctgatgtagctcctccagtggaagcatttagtcctttcactggactgtctgaatggtcttttccctacagcttatctgccctatatgttcccaagtggctttctgttcttagcagtcaggggcccaggtgatgtctactcaccaaatattcttgaaccataaggcaatcagattatggttttgtacattatggattttcagactttatggtttcaaaataaatttcctataccaaagatactttttaactgctggggaccctataaacccttttttccccacacatccattttaatactagtccaaagggttaaaaaaatagcaaggggagctgccttaggggaaacagaggccacacgatatggaatttggggatgggaaatgctggaacatgaaaggaaggaggaacagccccaccatcttggccctcggggatgttaggaatagagggtataccaaaagaaggtgtaagggagtaaatgattgaagtgtaaacctcccaaatgttgtctctttcaaaagttaccttagagagaatctgctagtgctctgttaattataccatggtcacagaggtgctgctattgttctgagcttacttggaaccctttttttggatctgtccaaaaggagtgaatgtaacttgctccaaaatctgtgtttctagaggttagatacctgagaagccctgctgtcaagaatcccagattctcctggttggcaggaactttaaagcttctagccacagcgtttgagctcccaaggctgtccttcagcatcttcccaggcagccctgattcattgtggactgaaacctttctgtcattccttctatccactggtcataatagagtatgggcttgtatttccaaaatttaaacatcactggtcctattagttcttttagatctttctttcaagttgctcatttttctcatataagaaaatttaccttaaatggaaaccacatcactttgtcagtggaaaactatgtcaattggaacttaactgcataaggaataataacagatggaagagaaaacaatgatattaaattctacttaggagctgttgcctagcaaaggttctgagtgagaggcaacctctgtctttgttaaaacaggagattagcaagtgttacagaggggtgcaaagacaaatactacaaaaatgatactccttccttgacataatccataggaacaaaagaagtaaaaagggcatatcttttttcaccttgtgatccactgttatctaattgtattgtctgtgtaccacccaataccatgcttccaatctctactggaagatgtacacactgggacacactggtaaagtgatcaagcaccaggactgtaagtcaagctgatcaggttcagctcttggctctgccaactcctagccacccaaccctaaatacctgaaactgtatgcatcagtttcttcgtctttaaaatggaagcaataatagatcttcagagtaatactttcttaaagatagtgcccaaatttggacattatgcccaggtgtaatccgaccagtgaagagcatcagttcagcctaagattgcagcctcattcgggttttgaactgaactcgttcagcctttgggtgttcacaaagctgtgcttgtagccaactaaaataaaatctaaggtattttgataggcaccactactgagccacatcctccattacttacattgctgggtgtttcggcctgagggaggacttcacatttattcctattaaccagattttgcccccttcactggtgctttagcatttgctcagctccttctcctaccctgtatttgagggaaaggaagccaaatgggcagaacttggccataatgaggatgtgtttgacatgctggatttgagtctgtgttccattgaagaaaagaaatggaaactttgttgagtatccattctatacagggcactttccttgactatttcatttaacactccaaggaccccctgaggtagatgttatcgccattttgcagagaagaaatctgcatttttatttgaagttcttaaacatggtaaacgacccaattttctgctttttgcttaacagtattttgcaaacattttatcatgttacttcatgttttcctattttttttttgctttataaataaatacatactccctccttattctaaaaagaatttgaagcacttctgtcttgatgtttatcattttaatggttgtataatgtcccattaagtcaccctaatttattcaacaaatttcctactgttgacagtttggctctgtttgctttttgtggtttttaaaattattttctgtaacaaatgatcctgctaaaaaaaaaatctccgcacgaatattattttgttctggaaatttccgcaagggtggaatactgcattaaaggggataatatttttggtgtttctttatagagcctagcaaattgcccacccaaaggagtatgctttatttgagagtaaaaagccaaaaacaaacaaacacatacaaaaaaactggttttctacaaaagaaattaattttccacttattcataaaatattctagtgctgtgatgggtggcaggcaccgtgccaggggctagggacaaggataagcaaggccaggtccgggcctccaagcagcgcgctgtggagtcgggtagagtagaccaagtgcaacaggcacctggctgcagccaggaaggaccgcacgccctttcgcgcaggagagtggaaggagggagctgtttgccagcaccgaggtcttgcggcacaggcaacgcttgacctgagtcttgcagaatgagtaagagtttgggcacgcgatttgtatttattttactgtgaatctctggccttatatcagaaaaaaaaaaattgtgccaccctcggcacagagaacgttggtggcgtcgtaagcgccctaagcttctttccatcgccaaggagtaggggtcagggaagaggacagcgggaacaggatttgagagccgggaacccctggctcggcacgggagagggcaggagaggacctaagcgcggggctcgccgtctgctggggacccgagccggcctgtggccctcggggaaccgaagacgcgccctcagcgaccctgaagagtcagctaagctctctgcgggctaaggagacggtgaaggaaccgggactaactggggtaggggttagaaggcagcccgcgagtgggctacgaggggagctgggctcggcagttggggaccccgagggggcaagcgggcggggagcaggagaggggcggagctccggggccggggccggggccgcagcggccgcccagagggtctgcgggggctgctgtggccggacccgaaggcgggcgccgggagcgcagcgagccagacgcgcctctccaagaccgtgaccttggcatagggagcggggctgcgcgcagtcctgagatcagaccagagctcatcctcgtggagacccacggccgaggggccggagctgcctctgtgcgagggagccctggccgcggcgcaggtaggaccggggaacccaaggagggcgggaggaaagcgcccctggtgggggaggggccgtggcggggtctgggggccaagggctccgggccgaacgaggggcacacgccggagcagctccagcctgggagcattgggcgtgaacgtgggggaaagtagggaccagattacaggatcaaggctttccccggctcagaactggattgttcagtgcccctagaaggggcagcgggtcgcccacgcgaatgaacgggagcgcgcaccaaaacgcctgctgttggtagtttcttgtgcctctgccttgtttctgcctgtgatatagtcagaaaggactcgcttgccacgtgttaacaaggggacaggtagcttttacagagtgtatgaatatggaggggagggccacagagtcagctctggccccaggggccgtcagtgcccccacaggattcctggtccaagctaccagctgtcttgggaactttgcttcagtggcatcaaattagattgtcagttcccggggcctgagcaccagcctccatgtgtatttcctggggagaaaaaaaaaaggcataccagactgatggagtcttatcattattttaacattatagctttcaatagataacatgcatatgtttctttttttaagtcaaataatacaaacatttatcttctacaggcaatgcgtgcactagcatgtgtgtctattgctgtctcctttctacacccatagcctttcccactctacgtgttctgtcgccgtcttttgattctttatccagaaaatgatgtcaccaccactgcccacatcccttaatctccagtgttcctccttgcaacgcctctcttgtcctcaaatatttttcacaaggtggtcctcagggtagggagcctactaacgagaagacatttcgtttacttgcttcaattatcccagagatttgaagaaaaggcacattggggaagagtccatgtcaagttctaaacacacttatctttccccttaaactggatcttccaagtgcagtttaggtagtctgttactgagagaaataatgcaggctgttttctgaaatgctctggatttccagaacttaacaccacagtagttcctattccttaaaacagaacttcatcagtcacaccttgctgttgcttttcccatctccactccaggattccctaactggcatgcctaggatttttcctctgtaggaacctgggagagcgggtgctttatacctgcctcccaggtgtccaatgaaggggctgagggacaaagctttgtggtggacaaaaggggaggggaagatgtaggagaagttggaggggaagtaggaaggaagaagcaggccaagacccttgagtagagaagactcctcaagcacagagccctgtcatttgggaacagtctccatataatttctaagagaccacacatgcgagttacttcctgccaatacagcacagtcagctctgttccaagacttctatgctagaccaaaacatagtaagtgaaaaaaaaaaatcagcaaatcaaccagtttttgtctctatgataaaacagagtggttgaaattaaattagttaaaaattttcttttttactgaattagcaggttctttaggagctgtgtccattgtttaaaatcacctaataggtactccagtctccacatttttcctttattttgtttatcttttcatattgcataaccttgaactggatcccaaccatgtcagaaagttcaggctgattagaagctgccacttctaagactttttggtggaagagagtggggaggagagggtgagaaaataatgactgatccttgtgatagggtaggggtataatgaagaggaagaagttaactacaagtttgagactggtgaggagttgcatataattcttaagataacacggcaataagtaagtaagaggtaaaaaaatcattcatcattcatcattcaaaatgtttatagagtgcctggctatgtgccagtcactgggaactaactggtatataaaaccaggtgaggtccctgctctcctggagcttacagatgctttggggtggcagctgttaggaaaataaatattgactatatgttattacaaactaagataaactgtctgaaggaaagaaacgaagttctttgagggtgtatacagactgaactgtgagaccagggaagcctttctcaaggagatctcccttgagccaagattcaaagatggagaggaaggttgaggatatatttgttgtttacgtaggaccagaatgtatccactaggaatggtgtttggctgctagtcattaagaagactaactgccatgtgacatttgctgtactacatgagcacatgtgccaacttggcatttttggcactttgggaaagaatgctttgttatcacagtatcagttgcattgtcttcagttggtcatggtttgccattgctgtattcttgctttataattaaatgtttcaattaactttatgcttatccacttattttattgtgtacaataaaatgtgtgcattgcagttcaaatgtgaatcatccatattcccattaataaggtaaatatatatataaccctgataccaaatgtggtttatacactgactgttcaatgttatcactaaatagattctttaggtgaaaataggtgtggcaggtgggctgtaatatcttccttccatccctagccactgctctaattgggaggatgccagaatttttcaattattctaaagctgcatgatccttttcaaagattcatatatagctctttagtaaagaaaaaaaatcaccaattgcactgaagcaacatatttaacattcaaacaaatatttttattcattcgacagtgtttacagtaaaccttgtatgtgctcagagctgtgctagacagtataattaaaactgattactaggacagagtcccaacatttaaggagttcatagaagtctgagagggagtcatgctcatccatgtgcaggtagtattgtgttcattacaattaaagcataatcagggtacgttcatgtataagggaagggagtggtcaattctaccaaaggaggaagggtcagggaaaggttcttggaggaggtaacgcttgagttgaatcttgaaagatgaggagtgacaccaggtagacaaaagaagaaggtataatgggagagagattcatgtgcaaaaacaagcaattaacaacaactaaaccagaggcatgaaacatcatgtcaagttctaggacctgcaagtggttcaaggagctgaagcataaggagccaagaggtagggaggctagcaaagtggctaaagtatgcatgatggggtcacagaaacaaagatttgagtcgtggttctgccactttctagctgtgggacctcagttaagtaatttagccacagtaattaatggtaataaaggtaatactttcctcataggattgctgcaaagattcagataagatatgcacagattatgtactcaggaattgttggctattcattatttattctagggcaaaggaagctgctggagggttttacatagaggagtgactcgtgagcatttttgcaatcactctggctgcatgtggatgctgagttgaagggggctcatttggaacaaagtaaatatttagagacattataaccatttagataatggtaatgatggcctgaaccatggcggtcatggcagcagccatggagaaaactagctaaatgcttgagatatcgtcaaagtagactccaccacagaactaagttactcattagatgtggtcagtgagggagaggatttgaagaggtgaagcctgagattctggtctgttatcctttgactctgtcattcaagtgatcttgggatagaaaagaagaagtgagtatcaaccaggactggggatcaggaatctgggaagtgcttgtatacagagaacttcatgatcggtaccaaaaaaaatgctatctctgattcagaagagcccttgaccatttctgtgtctgaacataaaataggatcagttaatccataccaaatataatatccatcttctctctctctctttttctctctctctatttctgggaggctttcagttcaaagtgggtggacattagacttcacctatttgtcattgccttgaagtgacagatgtaccctcactccatgcctggtactgttggttcaactcttgcctgacaccagcctgattcacttttttctcctttttctcatgtcttctcatatacaataagcactaactgaggtgtccacatggactttattaaagtccatgagaattagaggattcaggtagttcctatttcatcatgcaatgcagtcttggtaaccacagtatccattcataaggcaggaaacaatacagacatgtgtgatagtgtttgttgaaaagctgccgagagctttattactgtttccaccaaaggtggatactaggaagtgctgattaagggtgtgcttttggattcagttgctcaaacaactgtattattactcaaagccacagaaatgaacattataattaggcagagccaaatgagtgagatggtcaaatatgaaatgaggaaaacaagatcagcctctgccgtggacagtctagtttggtggaaggtgggctttctatctctgaccttcagcatgacattaacctagctgagcctcagtttttagtggtggaccttcctttgagatctgtgaagctaaggtaatgtctccttcacagggcggttgtgaagtttaaatgagttaaatgtgctaaacacaatgtgtggcgtatggtgggtgcttaactagctgatatcctttggctcagttaatccccagggtctttcctcacattgaaaaagcaggaagcatgcagatttcttgggttaagtaacctgaattaatttgttttaatgtgtttttcatctatgattgattttttttccctgggaaccagggtggaaacctgttttcctccaccctcagtgaatgcttatcagtgatgatgggggcaaaggtaatatgatacctgcagagaggaaactaattttagccattcttccttcaacaagtctgtcacacacatgcaagtaaaattactaacaaatagaaaaattgagtaatttgacttcttcctcccatattttctgttggtagagttcctattaagcatattttttgtttatcttttgtttttcatgtaggtagaaagaagcaggctcaaagaaattgcagttgtacccctcaataattgtttgtccttaggaacaaagttttgcttttctcctcttaacagaagttgatggttgaaagaattatcatatctttcatatagtttttctaaatattctataatttgacataagcttttagtttagttttgttcaccagttgggtcccaactgcatgtcagatgttgagttggcactgtgtactcagagacgccagctgtggtgcccagatctccagtctggtagcccttgtgagagagactgggtaggaagagaagtggggtggagggtgcaagctgatcttaaacagctgatggtggtgggagtgacactcaggctgaggctctctaccacagcttcaggcttccagtccatccaatcatgcactcctttgggtcaggatctgggtctactcatcccagtgccccaagcccctgccagttagagcccttatgtgctaagtgcttgtcgattaagagattcggggaaaggtagtgaggaggctaggtgatcttctcttttcacactcttaaaaatgaaaatagtccaagtaaagtttatactccatgcaattatcaaccaatttccattcatcctcatcttttgagaggcagtacactgcagtggtaatagcctagggccaggaattagactacccgagcttgtatctcagtttgacagctcactagcttcgtgaccttgggcaggttgtccaacctctctatgccccattttccttatctgtaaactgcagttaattaacactacttacctctttggttgttaaaagacttatatgagctaatacacgttgttaaagctcatcaagcatagacagcgtgtcttattcaacactgaaactccagaatccatcatagtgcctggtacactggaggagctgaatgaatcaatgaatgaatgaatgaatgaacaaatgaatgagtgacttagtgaatgaacaaatctcagtatatagactggtataacagtcagcaattgacaaagcaccctcttaatattaattcatttgattcccagaacatgtcaggagataaataaggcggctgagcagggaaggtattatctccattttacaaattaggaaaccagggtactgaaaggttggcttgccaaagaaagtgcaactataagtaaaagatctggttaacgttgctgattctacttactcctagctctctgctcttctcaagattcagctgcctctccaccttatacagatttcacagaactcaaaggatgtccaccagcaaaaatgaacacacatagcttatttagctttctgaagaaatgagtttcttactgtaaatacactcagtcaagttaaaacttaaagttgcaacttgaagtttggaatgtttttatgttttggagaggggagcagtggatattttgtaagaatgaggaagttctttctaagtataaaagtagcagagaatcatgaaggaaaatattgatagatttcattacataaacatttaaaatacttgggtttttttgttttttgtttcattttgtttttttgagatggagcctcactctgccacccaggctggagtgcaacggtgcgatcttggctcactgcaacttctgccttccgggttcaagcaattctcctgcctcagcctcccaagtagctgggattacaggcgcccaccaccatgcctggctaatttttgtgtttttagtagagacggagttttaccatgttgcccaggctggtcatgaactcctgacctcaggtgatccacccacctcagcctcccaaagtgctgggattacaggcataagccaccatgcctggccaacgtttaaaatacttgtatataaaaggttataattaaattaaaatgaaaataaactcaaaaaaatttgcaacaaataagccaaaaggttcaaatttgtgaatataaagaactcatagaatttaataggaagaacattaagaccatggtttcaaaaaagtagccaaaggttgtaatggttttcaaatgaagacaatcacatgggtggtgaaacatacaaatattttaacttttcttcaataagggaaacatttttacaatgatataccaatttccttatcaggaacattaagatgttgaagataatgctagtggagtggggcacaatggaaactgtcataacaaattacctggaaaacaattgccttaaaactgttcacagcctttgaccaaagaatttcattttggggattgtatcattaagaaattatcagaaatatggttaaagacttatgcccaatgatgttcttcacagtgagaatttgaaactgaaacacaagaaaaagcctatgaatccaataataagggaatggttaaatacagtgtggtggataggaagcagcataggctagcagctaaaagcatgattttgagtcttaccacctggattcaaattctggctctgtcatgtaactgtcatgtaactctgccctgtaactttggaacctctccaggctctacttttttcatctgtacaaaggggacgataagagtatctaacatatagggctgttatgtggcttaaatgggttcatacaggtctacacttccaaaatcttcaaagctctaaacaactaaaggttttatgtaacttaaatagcaacaaaacatcagtgaactgacacagatctactttattccatttactgtgactgtatttggcagatataatcaatgttaatccctttccacagttttacctttcttgcagaatctccaagattctctttatgaattaataacaatcttacacatttgaaaaagactaattttgaagtcaaagctaactagagagcaggtatatgtattttgaactaatctcttggccaagaaactttcccaaatcttccatcccagggctctcaaactttaaggtggggaatattcttaatgcatagattaccaatgtctatcccctagaaaatctgattaagcgggtctggagtgggggccaaatgtatatagttcctgcgagctcccaggcgatgatggtaaggctgatccatggatcacctcttttctctgctcttctcacgatccagctgcctctccagcttatacagatttcatggaactcctgtccaccagcaaaaatgaacacacatagcttatttagctttctgaagaagtgaacttcttactataaatatgctcagtcaagttaaaatttaaagttacaacttgaagtttggaaagtttttaacttttggagaggggagcaggtagcctcactctaatccactccttctttaattttcatcacccctcacattgtatctttttatttgaaccttttcatttctgaaaatcttcgacctttttttttcatattatcattctcctattctttcatttctggttttttttttgtttgtgtttgtttgtttgtttgtttgtttgttttttgagtctcactcactctgtcacccagtctatagtgcagtggggcgatctcagctcactgcaacctccacctcctgggttcaagcaattctcctgcctcagcctcccaagtagctgagattacaggcatgcaccaccatgcccagctgatttttgtatttttgatagagacaggatttcaccatgttggccaggctggtctcaaactcctgacctcaagtgatccatctgtcttagcctcccaaagtgctgggattacaggcatgagccaccatacccggccctatcctctcatttctatggggtgcttttattcctagaaatagtaatgtaataaaattatttatcagtttctgagtacctaccatgtgccagtaacacagttaaaaatggaaagtttcttggccaagagattagttcaaaatacatatacctgctctctagttagctttgacttcaaaattagtcttttcaaatgtgtaagattgttattaattcataaagagaatcttggagattctgcaagaaaggtaaaactatggaaagggattaacattgattatatctgccaaatctagtcacagtaaagtaacacagttactacagttactttacttttttttatccttctgacaaccccgaaaggagggttattggaagggtttttatactttatcctttttatcctggaagggataaaaaccctcccaataaccctcatttaagtgatgagaagactgaggtcctaggcctgagggtttgtaggtggtggaaactagtcatcttggccccaaagcctaagctgttttcattttactgtcctgcccatttcacatggtggtacacatcccgtgctctccagtctacacgccttctcattcctgcctccactacttaattcctgcagagtccccagcttggaaccccctatctccttatcacctattcaggtaccaatctaggccttctataacatgaagtgtccccaaatatactcgcacagcccacactcagctgcatctgttgttcctagttggccttttatcatatatgcatttggtttttttcaccaagggatttttgtcttcctaactggatttagagctccttgaaaacagggccgatctcatgcatctctgggtcccccttggaacagccatggtgaggactgattgcctccttcacccccgcactttctactcttcttccttcctgtccccctacccaccacttgtcccttcctatcttggtgaaatcaagccacaccaacaagaaggcaaaaaaaataggccaggtttcacccttcctaatctccttccctgtgtggtttgttagtgtttgccttgtggttccacaatgtcatgagaaggaagtctttttatgagaaggagcttttctcatcaatgttatgagaaggaacttttcctctacttggcagagaggtactagccatgtcttataacccttggccctcttgagggtttccagaactcccttctttccatgtttattcaaattccattttcattatcgtacttcccagtttcacccaacatccacgttatcacccaagtatatgccaagagtccttgcctgcccattcccagcttatacatctatggagctactttctgcagtgagatctgttgggagcagcatggccaacacattcatttggtccgtacactttagttatattcttccctgccacctcccttcctcttcctcctcctttcttcttcttactttttcctcctcctcctcctacttcctgctcctcctcctcctttttcctcctccctctctttcttcacttccctccatccctcccttctccatctttctgaggttattactcctattattagttgggcagtgttatcaacccactatgacagcactcaacactcaacttacacatcccagagcttgtaatcctccttttgtaattttcccacaacttgtcatttccttgtaacagggctacagagcagctgggcctcccagcaaaagggtgagatttcctatggtgctttcatttcctccccatccatttagttcaaaagtgctggttgtgtttgtgttacaggttcatgtagctacactgctacactgacaccaccactactgcaaaatttcagattgaattaattttcttgttcaaacgggttttttctgacccatatttatgaaccagctttgtggtgttcttgatggtttcctttggtgtgttctgtaatctgaatttcttctctttggtgcctcattccatgcgctattcttggtagttttcatagtggaacactaggggaaaaaattatcccgaggaatatcatttactgtttatttagtgttgacaatgcgttaggcattatgctaaagattttatacattgcttcgtttaatcctatcaaaaattttaggtagttattatcccagtacacatggggaaactgaactttagtcaggttaagtgatttgtatgaggtctcatggccagtaagtggaacaacctagattcaaaatcagttcatatcattccaaagcccatagtcaaaaatgtagtttatggaatcttttaactcatcttttaaaaatgtaatgagtttttcaatagctctttcataccctactgcgagagtataaatgaatacaccctttctggagggcaatttagcaatacatataaaaagctttttaaaatattcttatcctttaatctaacaattcccatgcctgagtttatgctaaggaaataatcgttgatatgttcaaagattttaccctaaggaaattcaggatggccatattcataatatgaaaaatttgaaacaggttctatgcccaataaaagagaattggctaaataaagcatgatacataatcaatgaaataccaagtagtaattataaataatgtggaaaaagactatgtagtgacatagaaatgtgttcatgatataaacacatggtatggtatgataaataacataaatatatagtatggtaaataacatatacaacatatggtatggtaaataacataccataggatttcagattcaatcaatttttaaaaaatagatactacaaaataaactgaaagagaaatgatatcaaactaggacatgaatatgtaacatatatctaaaaatgtgaaaagctgtgagatgaagtaaggtgctggaattaagactaatttttattcttttatcttttttactatgtaataatttttagttgacatttacttttttttaactttttggttttggtttttggggttttttgtttgtttgtttgttttgttttgttttgtttttgaggcaaggtctcgctctgtcacccaggctggagtgcggtggtgaaatcacagctcactgcagccttgacctccccaggctcaagtgatcctcccacctcagcctcccaagtagctgggactacaggcgtgccccaccatgcccagcaattgtttgtattttttgtagagatggggtttcaccatgttgcccaggatggtggttatttttttaataggaaaattgtctgcatgttgtcccctttgctacccccagttttactgaggtataattcacaaataaaattatatatgtttaagatgtataatgtgatgatttgacatatgtaaatattgtgaaatgattactataatcaagctagttaacatatccatcacctcacctcagttaccttttttttgtatgtgtggtcacaacattaaagatctattatctttgccaatttcaagtgtacaatacagtattattaactacaaccaagatgctgtacattagagcaccagaatttattcatcttagagctgaaagtgtgtaccctttgaccaacatctctttggacttccatcttgggcatttcctctgttggtgtttttatgctaactccttggtcatttttttgcccaccaacctggtgggctgagcttgggagctaatcatttggcctggaaatattggcacaaaactgaacttttgtctggtgctgtgtgtccttgtgtggctccagtgggaaattcataacttgtttgagcaaagcaagctaactaactaaatgtcctttccacctccctctactagttttgtgaactccagcagcccttattttttcctctagagtttagtagctatctttctttaccctcactcacattgtgaaggaaatcctgtacttttttaaaaattacaagacctttgaccgatgttcgtatttatcagtgttcccattttatatttataatttcccccataaccaaataagcatttctgtagacacaacattctgtctcctcagtttctttaataactctttttttcttaatttgggttttcatttgtttttcttctcttttgactcagggtgttttgtttgatccagtgtcaggactaggccacttcccaactgccttgtgctgttgattcatattgatctcctaaactcatcacatcgcctccccttctttcaggcttcaagatgtccttgcagagtgccccattccttcttcagcttttctttctgctgtcatcactttgatcatctgcctgccagctttggcttccttcattgaccccctttcattcctcgcctataaagtccacctatcagtctctcatctatttttattcttcattgactgtttcaactgctagtcctgagtctaatcatttaagcctttgatttgggccttccctgaagcattttttcagatcttttaaaaaatgtctcaccactctgacttctcagagctctgcagagctttctgactgatgcttttttctttaggtcataattgattatagaaggaataattaacctcaggagataaaatactgaaacaacatcaattagcattccttctattaaaaaagtttagatgaaaagcaagtcgtctccataaagagcaaattatctgtagccaactcagagaaaaggatttatgacacagaatttccacctctcagaataaatgctgaggagatgatcagacaaatgttaaataagtacttgaaagtaagtaattgaaatgttatttgtagtagtaaaaacttaagaaatatcttaaatgcccaccagtacacaattggctatgtgaattttgactcatgcatactgtgaattactaggagtcattaaatattatgtttttgtgataatatgtatgtatttatgataacaaatatatattttgaataaaagttgcagaccagaatgtataatatgatcccatttctgtaaaaattgtatatgtatgtgtatatataatcactgaaataaggtctcttggtgatgggctttttgagggattttttattttttgtttctttttgtttcttcttcctacttttctacatcattcgtgtattttacagttaggaaatgttgttttttaggcaaataaaacaactactagtttcttagtgaattacatagctaacttcattttttgattgttcattttatatcttcctaacattttactatgaaattactcaaaaaatttttctttttattataaaattgtcattcatactagagataatatgttttatatatacatatatatgagaggatatatatatatatgggggataaagaataattataaaatggacacctgtattcccaaattcagcttaagaaaattaattctttgaaacttctttgtattcctaatcaaatctttcctgctctttcctccagagaagtaatcattcccaaatttgaatttcaaattccctctttttatagatttatgatatttacatattcagttcattatgctactacttgtgttactgtaatgcacattagttcataaacaataagtaaataagggaattgcgtcaatatacatggaagtcacattgcttatacatctttccccatacataaatgatctgtaccaccaaggaactgcagctgcctgcagggtacactaacacagctgaatacagcaagctgtgaatttctgtacatggaactcatccactgcaagttcttcctcttggctcgctttggccttctattcaatctgagaagtgcttattatatagttcttcctgatctttgggcattttatcctaaggtagcttcttcaacccttccttaaaccttctcctaagaaattatcttccttttttctatatgctgaattattgtatttgcagtggtgtttatttaatgtaaatggagaaagtagtatttattgattaagaatgtaatttgccttataattttcccagtgttttattaggatttttattgttttattaaattctggttacaaaattatagaggtttatttctcttttttctgtgtaaaaatagtccataatctgttacttttaatccttagttttgcagaatgtgagggtttaaaaaaacacatatattaccaaaaagaaaagactgatttcgtagaagtaaaaagtagaatagtggttactagagggtaggaaggatgcgggggtgggaggtgataaccagaagttggttaaggtatacaaaattacaactagataggaagagcaagttcaagtgctctacaggactataccgtgactataactaacaacatttattgtatactttcaaatagctagaagagcagttgttttttgtttttttgtttgtttgttttttgttttgtttttgagatgcagtttcgctctcattgcccaggctggagagcaatggtgcaatcttggctcaccacaacctccgcctccccagttcaagcgattctcctgcctcagcctcccaagtagctgggattacaggcatgagccatcacacctggctaattttttgtatttagtagagatggggtttcatcatgttagtcaggctggtctcaaactcctgaccccaggtgatccacctgccttgacctctcaaagtgctgggattacaggcatgagccactacacctggtcgaagagcagattttgaaagctcccaacacaaagaaatgataaagtattgaggtgatggatatgctaattaccctgatttgatcattacacattgtatacatgtattgaaatatcacacagtaccccataaaatgtataattatgtgtcaaataaaaatcataatgaaagcaaaataaatacacacatacatatattaccttataccagaaacagctgtttctggtatattaaacaatatattgtttaatgttgcattgttttgagttttgtacaaatggagtcatgctctttgcactttttcaattttttaaaaaatgtattatattcgtgagagtaatccatgttaatgactatcactgtagtttattcatttttactgctgtttagaatttcagtgtataagtgtgccaaaatttatttatctgttcttctgtcagtggagcagttggtatttgtggtttcctgctgttataaaaaatgttatcaatatttttgtatgattctttggcacatgtacaaaagtctctagggaattatacctaggagtaaaaaacatttatgcttattagacaatgcaaaatggatttccaaagtgattttacccatttaaacttgttcattagtgtaagagagagctcagctaagcacatccttgccaacagttgaatcattgccaaattgttgcggtttcaattcgattaccaatgagtatatgcttcttctctttgtccattcatatttttttctccatgtaatgcttgtgaatatcttttgcccattgcttttcttttttttttattttttttttttttattgatcattcttgggtgtttctcgcagagggggatttggcagggtcataggacaatagtggagggaaggtcagcagataaacaagtgaacaaaggtccctggttttcccaggcagaggaccctgcggccttccgcagtgtttgtgtccctgggtacttgagattagggagtggtgacgactcccaacgagcatgttgccttcaagcatctgtttaacaaagcacatcttgtaccgcccttaatccatttaaccctgagtggacacagcacatgcttcagagagcacagggttgggggtaaggtcatagatcaacaggatcccaaggcagaagaacctttcccagtacagaacaaaatgaaaagtctcccatgtctacctctctccacacagacacagcaaccatccgatttctcaatcttttccccacctttcccccttttctattccacaaaactgccattgtcatcatggcctgctctcaatgagctgttgggtacacctcccagacggggtggtggctgggcagaggggctcctcacttcccagtaggggcagccgggcagaggcactcctcacctcccagacagggcggctggccgggcgggggcgaccccccacctccctcccggacggggcggctggccaggcgggggctgacccccacctccctcccggacggggcggctggcttggtggagacgctcctcacttcccagacggggtggctgccgggcggagggtctcctcacttctcagacggggcagcggggcagaggtgctccccacatctcagacgatgggcggccgggcagagacgctcctcacttcctagatgggatggcggccgggaagaggcgctcctcacttcctagatgggatggcggccgggcagagacgctcctcactttccagactgggcagccaggcagaggggctcctcacatcccagatgatgggcagccaggcagagacgctcctcacttcccagatggggtggcagccgggcagaggctgcaatctcggcactttgggaggccaaggcaggcggctgggaggtggaggttgtagcgagccgagatcacgccactgcactccagcctgggcaccattgagcactgagtgaaccagactccgtctgcaatcccggcacctcgggaggccaaggctggcagatcactcgcagctaggagctggagaccagcccggccaacacagcgaaaccccgtctccaccaaaaaatccgaaaaccagtcaggcgtggtggcgcgcgcctgcaatggcaggcactgggcaggctgaggcaggagaatcaggcagggaggttgcagtgagccgagatggcagcagtacagtccagcttcggctcagcatcagagggagaccgtggaaagagagggagagggagaccgtggaaagagagggagagggagaccatggggagagggagagggagaccgtggggagagggagagggagagggagagaggcccattgtttttcaagtgggaggtttctatttttctttcaataggaatgctatatattctggatactaatcttttgcatttacattgctgtaactatcatcttccaatttgtggcttatttcacttttaggttgtttttatgaacagtgcttcttaatttaatgtaattgaatttatcattttttctttcaccttttgtggtttttttgctaagaaacctttcttaagaatagttataaagacattctcctataatttcttctaaattcttaaaagtttttcctatcacatttaaatcttcaaggcatttgcaattgatttttgtgtatgatttgagtacagattcaaattaattttttccacatggataaccagttgcctcaatactgttatagaatagtctgccctttctcctaccaatacacagtaccatctgtcaattatcaaggtcccgggtatgcatgagtctgcttctgagctctgttctgtactgtttgtcttccctgccattatcaactatctcaattattccagccaagtattaaactttgggagcagatagggtgagcctcccttctgtgttctttttcttctgaggtattgactgtttccagctctttgcttgtccacataacttataagaatcaactagccaagttgtgcatttgcgacacacacatacacctattgagattttttattagaactgcggtgaatttggacagagctgacattccaacaatattgagccttcctatctgtatgaacacaggagagacagtcatgggttgctttacaatggggatatgttctgaaaaatgcgttgttaggtgatttcattattgttcgaacatcacagagtacacctacccaaacctagatggtatagcctacttacacctagctatatgggtatagccaattgctcctaggctacaaacctgtacagcatgtgcctgtattgaattcttgtgggcagttgtaacacagtgataactatttgtctgtctaaacatatagaaacatagaaaaggtacagtaaaaaatggtataaaaggccaaaaaaagggtacatgtgtataataaggtacttaccatgaatgggacttgcaggactggaaattgctctgggtgagtcagtgagcgagtgatgagtgaatgtgaaggcctaggactcactgtgcactactgtagactttataaacactgtacacttaggctatactaaatttatctttaaaaataaagtaattgtactatgatgttgggataggtaagatgtcactatgtgataggaattttttagctccatcataattttatgggaccaccatggtatatgcagtttgtagtgtatgactatatttagattttctttaatgtctttcagcatttgaatttttctccataaagttcttatacatctttagtttattttccgttttttcattttttttaattgatgaataatagacatacatagtttgtggatacctgtgataatttaatacattcatgtatcttgtacagatgaaatcagtgtacttgggatatccatcaccttaaatacttgtcattttttaggctaggaccattccaattcttctcttctagctattttgaaatatacaatagattattgtaaactaaagtcaccctgctgatctatctaaacactgtcttatttattttatcaaaccttgtatttgtacccattaatcaagttctcttcatcccccaagcctctggtgaccactagtctcctctctgttttcatgagatccactttttagcccccatatgtaaatgagaacatgcgatatttgtctttctatgcttggcttattttacttactataatgatctctagttccatccacgttacaataaatgacaggacttcattcttttttatggttgaataatattccattgcggacaggccccatattttcttaatttattcatccgttgatgggcacttcaggttgattccatattttggctattgtgagcagtgctgcaataaacataggagtgcaaatatcttcttgatatattgacttttttagatatctgtccagtagtggaattgttagatcatatggtagttctatttttcattttttgaggaacctccaagctattctccatagtggctgtactaatttacatcctcaccaacagtgtatgaaggttcccctttctcctcattctcactaacatttattattgcctgtcttttttataaaaaccgatttaactgggctaagataatatcatgttatagtatgatttgcatgtctctgatgatacatgatgttgagtattttttcatatacttgtcaaccatttgtatgtcttcttttgagaaatgtctattcagatcttttgcccattttttaattgcattattcatttttttgctattgagttgttttgagttctttatatattctggttattaatcccttgtcagatgggcagtttgtatgtattttctcccattctgtgggttgtctgtccactttgttgattgtttcttttgctgtaaagaagctttttagtttgatgtaatcccatttttctatttttcctttttgttatttgtgcttatgaagtcttacccaaaaaaatccttgcccagaccaatgtcccgaagcatttcctgagtgctttcttctgttaatttcatagtttcgggtcttatatttttaaatcaattttgacttgattttggtgtatggtgagagacaggagtctagtttcattcttctgcatatgggaagttaccagttttcccagcaccacttattgaagagactatgatttccccattgtatgtttgtggcacctttatcaaagctgacttggctgtaaatgcatggatttctatctgggttctctcttctgttccattgttctacatgtctgtttttttatgccattatgctgattttgttactatagctttgtagtaaattttaaagtcaagtagtgtgatgcctctggctttgttctttgctctgtggctattcagggtcttttgtagttccttgtaaattttaggattttattttctatttctgtgaagaatgtcattggtcctttgatagggattgcattgaatctgtaagttgctttgggtactattgtcactttaacaataacaattcttctaatccatgagcatggaatagcttttcattttttgtgtgtgtcctcttcaatttcttttatcagtgttttatagctttccttatatagatttttcacttatttgattaaatttattcctagatattttatattctttgtagctattataaataggatttttttatgatttctttttcagattgttcactggtggtgtatataaatgttactgatttttgagtgttgatttttgtatcctgcagctttactgaattcatttgtcagttctaatagttttttggtggagtctttaggtttttctcattataagatcatgttgtctgtagataaggctaatttgacttcttcctttcctatttggatgttctttatttctttcttttgcctaattattctagccaaggacttccagtgctgcattgaataaaagtggtataaatagtcatccttgttttcttccatattgtaaaggaaagtcctttaatttttctccattcactatgatgttaggtgtggctttgtcatgtatggtctttattgttttagaggtatgatccttctatgcccagtttgatgagggtttttttttttatcataaagatacgttgaattttatcaaatgccctttaaatatctattaaaatcatacagtttttgttgttggttctgttaatgtgatgtttcatggttattgatttgagtatgtggaaccatccttgcatccctgggatgaatcctacttaatcatggtgaatgatttttttaatgtgttgttgcattcattgtgctagtattttgttgagaatttttacatctatgtctatcaggaatagtggcctgtaagttttctttttttgctgtgtcctcatctggttttggtatcaggataacgctgacctcgaacaatgagtttgtaagtattctctcttctttaatttttttgaagtgtttgggtagagttggtattaattcttctttaaacatttgatggaattcatcagtgaagcatcaggtcctgggcttttctttgatgagagacttttattatggcttctatttcattactcaatattggtttattgaggttttgcatttcctcatgtttcaaccttcgtagattgtatgtgtccaggaatttatccatttcttctagattttccagtttgttggcacaatagtcatagcagtctctaatgattctttgtaattcttcagtctcaattgttgtttcctttttttgcttctgatagtatttagttggggcttctctttttttcttatttactctagtcaaaagtttgtgaattttgtttatcttttcaaaaaaacaatttttcattttgtcgacccatttttttaagtctcaatttcatttatatctgctctaattttattatttctttccattaatttggggtttggtttgttcttgcttttgtagttccgtgaggtgcatattagcaaatattaatagctctaaagggagagatagactgcaatacaatggtattgtattgcaaagtcccctacaacaagtagaggactttaacacctcatgctcagtaatgggcagatcagacagaaaatcaacaggaaaacatcagagttaaactacacaacacacctaataggcctaactgacatttatagaacatttcacccaactgctgtagaatacacattattttcatcagcacatgaaacattctccaaatagaccatatcttaggccacaaaacaagtccaaacacattttttaaaaaatagaaattatatcaagtatcttttctgactactatgaaataaaactagaaatcaatgagaagaggaacttcggaaacttcacaaacacatggaaattaaacactatgtttctgaacaccaatgagtcaatgaagaaattaagaaggacattttaaaatgtcttgaaatgaatgaaaatggaaatgcaacgtactaaaatctatgggatacaacaaaagcagtactaagaaggaggttcatagcaataaagatgcttatatcaaaaaagtagaaagacttcaatggttcattttatttttcagaaaattacttttcgttactgttgtaagtagcaactacttgtaataaacttcattcctaagaataaacttctttgctgagaaggaagtaaataaacttccttcctgaaaaggaagttcatagcattaactctgttgtttccctgttgattttctctgtgaatgattggtccgttactgagagtgggtgtgaaagtcccctactattactgtattgcagtctatctctccctttaggtctaataataacaaaatgtgttattattatagcaaaagtagtactaagaagggagttcatagcaataaatgaatatctcaaaaaagtggaaaaacttgaatagttcatgttatttttgagaaactttttattttaagtagtatctacttacaaagtatatatttcacttatcaattattaatggaaatacaaatgattcttttatactttatatcaagcaactttgctaaattctctctttgttttttctttagacgggtctcaccatgctgcttaagctgggctcaagtgattctcccaccttagcctcttgagcagctaggaatacagtcaccacacccagcctaaattttcttattaattctaattatttgtatgtagatgttaagattatcatgttttctgtaattaatgatcttttttttctaaaccttacatgcttgatatatttttgttatactactaagctggctgaaacctctgggaaaatgataaagagaagtgatgatggggcatccttgtcttgctcttgatttttaaaggaaagacttttaagatttttgtcagtaaatgtggtattgggcatagatttttttaatgatcactgtttattacattaatgatatttccttcaactcccagcttgctaaggtcttcccttgaaaggatgttgaattttatcaattttatctttctccccatgggagcagacatctgagactaatgagttggcctctggagacctggaatgtgtggaaagcatgtctggcttctttccctccagcactgaatggctacgtattttggaacatgccttcctcatactgattagaaagagtgaacctgaagtttagccttggagaaaaaggaaagagtgcacgccttagatgtagattatttaggctaacgtagtggaggaaaaagatcttttgtgtagttcactctcagtcactagagttcgacattggggcttggggatctcagctaatattctcagtatataccatttcccctgaaaccttgagggcaggatttctaagtccccagccaaaaaccacctcctaatgcagtagtacttaaactcaagtgtgtatcagagtcacacattgttgggctccaccccagagtttacgtgactcagtaggtctgaaaatttgcctttctaagaagtttccagttgatgctgatgctgctggtcctagagtccacactttgaagaacactgccctaaagcagtctctctgaaacatcctcacactaaaaaaaagcccaggaccagaaggatttacagctgaattctaccagaggtacaaagaggagctggtaccatttcttctgaaactattccaaacaattgaaaaggagggatgtgttagtccgttttcacactgctgataaagatgggcaatttacaaaagaaagaggtttaattggacttacagttccatgtggctggggaagcctcacaatcatggcaaaaggcaaggaggagcaggtcgcatcttatgtggatggtgtcagacaaagagagcttgtgcaggaaaattttgccttatgaagccatcgtatctcatgagacttattcactgtcacaagaatagcatgggaaagacctgcccccatgattcaattatctcccacaaggtccctcccacaacacgtgggaactatgggagtacaattcaagatgagatttgggtggggacacagagccaaaccatatcaagggacttctccctaactcattttatgaggccaacatcatcctgataccaaaacctggcagagatacaacaaaaaaagaaaacttcagtccaatatccctgatgaacatcaatacaaaaattaataaaatactggcaaaccgaagccagcagcacatcaaaaagcttatccaccataatcaagtgggcttcatccccaggatgcaaggctggttcaaattacacaaataaatcaatgtaattcatcatataaacagaactaaagacaaaaaccacatgattatctcaatagacacataaaaggcctttgataaaattcaatatcccttcatgttaaaaactctcgataaactaggtattgatggaacatacctcaaaagaataagagctatttatggcaaacccacagccaatatcatactgaatgggcagaagttggaaacattccccttgaaaattggcacaagacaaggatgccatttctcatcactcctatttaacatagcattggaagttctggccagggcaatcaggcaagagaaagaaataaaatcatccaaataggaagagaggaagtcaaactgtttctgtttgcagatgacatgatcctatatctagaaaaccccattgtcccatcccaaaagctgcttaagctgataagcaacttcagcaaagtctcaggatacaaaaatcaatatgtaaaaatcacagacatttctatacaccggcaatatacaagcagagaaccaaatcatgaatgaactcccattaacaattgctacaagcagaataaaatacctaggaatatagctaacaagggaagtgaaggacctcttcaaggagaactacaaaccactgctcaaggaaatcagagaggacaaaaacaaatataaaaacattccatgctcatgaataggaagaaccaatatcatgaaaatggccttactgcacaaagtaatgtgtagattcaatgctattcccattaaactattgacattcttcacagaattagaaaaaaccactttaaaatttatatggagccaaaaaaaagagcccatatagccaaaataatcctaagcaaaaagaacaaagctggaggcatcatgctacccaacttcaaactgtgctacaagtctacagtagccaaaacaggagggtattggtacaaaaacagacacgtagaccaatggaacagaatagtgtactcagaaataagactgcacatctatgaccatcagatctttgacaaatgtgacaagaacaagcaatggggaaaggattctctgtttaataaatggtgttgggagaatgggctagccatatgcagaaagttgaaactggatcctttccttacaccttatacaaaaattaactcaagatgaattaaatacttaaatttaaaacctaaaactatcaaaaccctagaggaaaatctaggcaataccattcaggacataggcacgggcaaagatttcatgacaaaaatgtcaaaagcaattgcaacacaagcaaaaactgacaaatgggatctaattaaactaaagagcttctgcacagcaaaagaaactatcgtcagagtgaacagacaacttacagaatgggagaaaacttttgcaatctatccatctgacaaaggcctgatatccagaatctacaaggaacttaaacaaatttacaagaaaaaaacaaccccattaaaaagtaggcaaaggggccaggcacaggggctcacacatgtaatcccaacatgttgggaggccaaggcaggtggatcacttgaggccaagagttcaataccagtctggccagcatggcaaaaccctgtctctactaaaaataaaaaaactagctgggcgtggtggcacacccctgtagtcccagctgctcaggaggctgagacacaagaagtgcctgagcctgggaggtggaggttgcagtaagcctagatcgtgccactgccctccagcctgggtaacagagtgagaccttgtcctctgccaccaaaaaataaaaataaataaaaataaagtgggcaaaggacgtgaacagacacttctcaaaagaaaacatttatgcggccaataaacatgaaaaaaagttcaacatcactgatcattagagaaacacgaaaccaacccacaatgagatattatctcatgccagtcggaatggtgattattaaaaagtaaagaaacaacagatgctgatgaggctgtggagaaataggaatgcttttacattgttagtgtaatgcaaattagttcaaccattgtggaagacagtgtggcatccctcaaagacctagaacgataaatagcatttgacccagcaatcccattactgagtatatacccaaaggaatataaatcattctattataaacatacatggacacttatgttcattgcagcaccgtgcacaataacaaagacatagaaccaacccaaatgcccatcaatgttagactagataaagaaaatgtggtacatatacaccatggaatattatgcacccataaaaagaaaccagatcatgtcctttgcagggacatggatggagctggaagccattatcctcagcaaactaactcaggaacagaaacccaaacacggtatgttctcacttataagtgggagctgaacgatgagaacacatggacacagggagaggaataacacacactggggcctgtggaagttggggtcagggagcacatcaggataaatagctaatgcatgctgggcttaatacctaggtgatgggttgataggtgcagcaaaccaccacggcacatgtttacctgtgtaacaaacctgcacatcctgcacatgtataccggaacttaaaataaaattaaataatttttttaaaaaaagaaatcaatgagaattatatccctaggaagagttttgattccagattttctacaatttttttttttttttgagacagagtttccctcttgttgcccaggctgaagtgtaatggcgcgatctcggctcaccacaacctccgcttcccaagttcaagcaattctcctgcctcagcttcccgagtagctgggattacaggcatgtgccaccatgcgtggctaatttttgtatttttagtagagacggggtttctccatgttggtcaggctggtctcaaactcctgacctcaggtgatccgcttgcctcggcctcccaaagtgctagaattacaggcatgagccacagtgcctggccgattttctacaatttttaagcaagttacttcattgttctgggatgcatttactcttgtgagactcaaggtaaaattacctaagcgcccagaaagcaaggtacaatatagttcaagatagttcttagaattgcagattcttctagtgggacatgcagatctcacgtccacacatacccagggccagatgccctcttggcctccctcagagatgatcattcagcctctttttgaatgcttttacaccatcacatgtatttccattgttgcacagtcctcattgttggaagaaggacatttttctcgtgctcttttgaaaacctagtgcattattgtgcagatctcatggttagaaaattcttccttacatcacatcaaaatctgtctccctttaatttgtgcctgcagccgtattgtccgtacccacccaggaaaacactaagacctctttcagcatcctgcagaccccaatcatgtcctgactagagttctccaggcaaactctcagagttagttcccataattgtttcctctttatggcttcattaccaagctttcattgtccagcttggacaaacactggctcgtttgggtcctctctctaagactgaaatatacatacttggcaccataccccatatgaattctgggccaaggctgagtatgatacgtctcttggtcctcctggtccttgttaataacccactttagtagttacctggaccctgtggctcatatattgcctatatataatccagactcttctatagttttgcttactatttgggtacaattactaagccagtgtcaaaaaacctagctgaattactgaaatcaacatcgtttcagtgaccatggcaaagagaaggcaaggatgatctgagatgacttactcatactggctcctgactattgcagctgtggttgctgagagggacagccctccacctgagaataggtttctcatttcttccacatgattgtctcttctaaccaggatctgccattgttctggacccatatcagtgtcttgtctgcccatgtttagctcctcaacacttgaccccgtgtcatgtcctcttcctgaaaactccaaggtgactgctgaaagtgcctgggtttttgttgttgttgcttactatctctttgtctctttgtcctgctaatctctgtgccagatcctgtcattggctcttttaggtttgttgattctactttatggccctgatttctttttttctacatacagtatccgtttgaagattctttaatggagcgtatccatttttctcattaaagactttaatttatgctgtcttgtaaaggaaaaacaaagggcattcttcagaacttcttttaaaatatgccacagtggctatatagtatctcaaggtggcgggggtggggggcagtatagacaaacaattgcagagctgaagaggacccagtcctcctaatccgcagtccagaaccattgaactaactctatgcagactatctcttctatggctcagacaggataatgaagggatgacattgttgttctcttagttcagaaggcgtaaacctcagtgaggaggtgggatggatacagaagcaggcagatcactgagatcatttaatgccacattctgaacatatctaagtcccaactctgatccaacagggaaagatgtactactattcaggtaaactcaattgtcattcattttgtacataaactgtataggtacactttacatcctagactctaatggctagaatttaaccaaataaaatctctcctggctgctaaggagtccttggactgaaagtgactaaaaaaagaccatgtcccctaactggacacgtggcagcagggtagtaaggcaaattccttgtttgaaagcattcatagcacagtattttttcattgactggacaaagggtcacacgaaagcccatgataaatgacttgcttttcttcagtcatttattaaccacagaagtgtggaatgcatcactgagagactaatccatgccacacattcaagggacttaaagcagagttttccagactgctaaggaagcaggtagaagaaggaaggaggtaggtctatccttgcttttgctgccatctcgaacataactgcctctagcatcttgaataacagacggagaaagtctttgcctatgcacttgagaaagctgggccataccatgattacggccctctgcctccatgggtgaactaagggcacagctggacagctgggctttgtatgaggcaaacaatctgctgatttattttaaaccatcatgctggtatgtgcacgaccaaatgaatgtggtccccttttaagtaaagccccttgaaaagctttctgcttatcccatgatgcttccacgtcgctcaagagattcttagggagttgagtgcaggaatgcacaaaaaaagatgacagccatctatctacatccacaactcataattagctactgtaaatattttggcctatttgcttccaacgtttttctttatttaagaaacctctttctattgtttcttattaaagtgaagcacagattattacggagatctcaaatcatgcagaaaagaacacaaatttaaaggtttttttaaaagcacctgaaagttcatcattaatatttggtgaacattattcagggtaggtttctatatatcccactttttggaatatcatcagttttgtcaaagtttccaccttggaaaaaggatttgatttttcaaaataggtcagagttgccaggagccattgaagtccagtgaataaggtaatgattaagccgtgtgacaagattttggtgccaagtcaggtataattggttttcttggacagctcagaaattgccatgagaggcacccatgtcagaagtgaccaacaagacctgccctcagagagactgtatctgaaggacaggtgcatgaggttgcagaagtgttggggatcataaccactagaactgagccaaggctgtttcttgagggctgtggacctcagttaggtccttaccctcacagagcctgtgtttgctcatctttaatggggtgttcataatgtccacttttcacaagctgttatgagactcaaattaggtcagggacatgaaagctcttttgcaaatgattaagccctatacaaatgttaggcattactgcttaagtatatttgtcaaattaatcttgtttcttgatgggtacacctcctacagacagtcagttcacagacagccacatcatcaaatcctaactgggtgagggcttttctttccccttgtactctccttgggctgcacgtttgtcccttcagggctaccttgtccttgatgtgatgtccattttacctgacttttccagtacttgatcatgggcaagggaaatcatagaaggcaggcaggacacagtttgaatcactaccaccattgtttttagcttcctgcaacctgtgtggcaaatgacttcagtctggggtgtctatggaattttagaaggatctggtcagtttccttagttacctggaagttcttttgacatttaacttatcaactcatttttcaccaaacagaggaatctgagatctggaaggtttctcagagttcttatgctgcataaatagggaataaggacaaaaaactatagttatctgtacaaacgagagtaataactataccattctaatagtggttgaaaggactaaacttcaggtatttagtatagccgggcacataaaagtgctcattaaatgttagctattattttgggtgttattattattaatacaaggactagaacttctaggctctgtaagttagaaaggtagtagcttatatgtcatgagtgacttttgacacatgaaagagtgcctcatcaacagtgagatactgttaatcatgcataatttacaaatgtaattttgccatttggaatgtctactttttgatttgtatccattcattcaacatatatttattgagtgcttactatatgccaggcattgtgctgtgcattgaacatacagtggtgaactacacagacctcatccacgtggagctgactgtctaacaaaggagacaaacagtaaacaaataactatagcaatgaatatttgtctagaacttgttttgagtgcagtgaagggaaagtaaaatttttttttttttttgagacaaggtctggctctgtcacccatgcaggagtgcagcgacatgatctcagctcactgcaacctccatctcccgggctcaagccatcttcccactcctgagtagctgggactacaggcacatgccaccatgcccggttaatttttttgtagttttttgtagagacagggtctttctttgttgcccaggctggttcaaactcttgagttcaagcaatctgcctgcctcggcctcccacggtgctgggattacaggtgtgagccaccacgcctggccaggaaaatacaattctatgaggtatgtagctgatggtacccaatcttgtgtgatagatgggaaaggggcaaggaagattcaggatgtttccctaaagtaattgacgtgtgagttgaaatccaatgaacgagtaggaataatgtaacaatgagtgagaagaagcagattcccaagagaaggaacatgtgcaaaggccttgaggctggattttgacattcagcttatcagctcatcttacaccaaacagagaaatctgagatctggaaggtttctcagaagttctcatgctgcacaaaaagggaagaaggactaaaaactatagttatctgtacaaatgaaagtaataaccgtaccattctgatagtggttgaaaggacaaaatttcaggtacttagcatagcctgccacagaaaaaaaaatgttcaataaatgttagctattatttttggtgttattaatacaaggactagaatttctaggctctatacgttagaaagatattggcataggcatagtcacatctaagcagagtgagggggtgtggagcagaaaatgaggttgggggttgtaggagactaaacaaggcaggcatggtctcattgcagaccctgttaagaattgtgctcttgactctaacagcaaagggagtccattgaagtgattcaaacaagatgaacaggtttctgtattcaaagatcctgccactgcaagcagaataatggattggaggggggcccaagtggatgcaggtagttaagtgtaggaggctgtaacagcaggctgtgggagagttgatggtagcttaacacagggccatagtggtagagctgaaaagaatcaaaaattatttacgggccaagcatggtagctcacacctgtaatcccagcactttgggaggctgaggcgggcggatcatgaggtcaggagatcaagaccagcctggccaacatggtgaaaccccgcctctactaaaatacaaaaaattagccaggcggtgtggcaggagcctgtagtcccagctactcgggaggctgaggcaggagaatcgcttgaaccagggaggcagaggttgcagtgagccgagatcatgccactgcactccagcgacagagttctggcaacagagcgagactctgtctcaaaaaaaaaaaaaaaaaaagttatttacaaggtaaaatccacaagatctggtggtgaactggataaaggaggtagaagaagaagaagatgaggagaatccatttattcattcagcaagtatttattgagccccagatgctctgctaggtactgaggattaaactgtgaacaaaacagaaaagtctctgccctcaataggttacagtttggaggggattggaactgaagagttgacaatatgcaagtaaacaaatagtgatgtgtttgcattgcaaattataattacatattacagtgtgggtgattacagataagtactacaacaaaaaaataagggacatgtcagagagagtaactcaggaggaggtgacatttaaggtaagacctaaaggatgagaaagacagccaagagagccagtgaaagagcattctgggtagaggaaacagtaagttcaaagatcttgatgtattccaggaataggtgggaaattagggtggccggaaatagtgagcaaggaggaattgtataaaatggggtggtaggtcatttgtaggtcatactgaagattttggatttttttaaatacagcagctagaataacctgactgatgtttaaaagattactctgttgtgtgaaaaatggggaaaaattaattatttcacaccaagagtaaaagcagggagaacagttagaagccagtcattcaggtgatagaggatgataacttgcactgggactgtgatggtggatcagggaaagagaaacagatatcagagggattttaacaaactggcctcactgaagatccaaatgacccctaaagaagtggtggcatgattccgttgcataagttgacagcctggtgtaacctacctatgattcatctcaccagacccagcccagatcagggttcagggaccaaacccagcaccagagtagctgggatcagggccaggggtcatcaagactggggtcaccaaagtcacatcagggtctgtagcagctcacagtgaagggaggaatctgttgagctgggtttctatcagtgctgtttgcctggggctagaagtggtaaccagttcagaacctgggtgagggtagagctgggtcaacactggaggttaaagtggcaaagctgccagttcaaggttacagggatggagatatgccacctatgacaccattggatgagacatttggtggatgagtcagacattggagatttatttgtggaataccaagcagtgcaatctcagtgttctctagctccttgtgatttagacaagagggatccctgccttgcagatttagtttgatctagagtgtgaggctttttggtagccttaccagtaagatacttgccttcttgatcttgtctatttctctgccatttcaacattattttccacatgaggtaaaatattcaggattctgtgacaagtttcagctcagttgctgctgtgtgggtatgcctgcatgcacatatatgtaagcacatgttgtgtctactgcgatgagcgtgtgtggcagctggagtgtcagtaatggtacattagggcatgttaacctgcagggccacaagcatctccattttttaaaaagagagaagagaagagacacctgatcccaagatagagacaacaaagaaggatgatccattctggtgtcagttacaaaaaacagcagcatacctcttcctgaaacttgtttgtgtctgaccacttcatcctgctcttcctccagtctcaatccccagccaatgctgatttctacccaacaacacctagaagaatttggcaatttatcccaacaataagcgaagagccagtgatatgtctgagagtactaattatttccaaatattgggaatccagctttacacagactgaaaatttctgaagaaatacagagcaacatctctgttgctgtatgtcattaccagcatccttgataacagtttaccacaatgcattaaataaatcatagaacaccaaggatttacagctttttgagcttgatatccagaagaagagaagacagagttaagaaaagtaacgatattatttttgtcttctaaactctctgctttggttgctgggtcctcttcttggtgattcaacaacgtacattaaaatattaaggactttgtgctgggcatggtggcttacacctgtaattccagcactttgcgaggccgaggtggatggatcacatgaggtcaggagtttgaaaccagcctggccaacatggtgaaaccccgtctctactaaaaatacaaaaattagctggctgtggtggcaggcacctgtaatcccagctacttgagaggctgaggcaggaaaatcacttgaacccaggaagcagaggttgcaatgagccgagatcgcgccactgcactccagcctgggcgacagagaaaaccccatctcaaagaaaaacgactttgataaatgtttgtttatgtctgaccacttcatcttgccttcctccagtctcaattcccagccaatgctaatttctacccaacaacacctaaaagttggcagtttatcccaacaataagccaggagccagtgatatgtctgatagtactaattatttccaaatattgggaatccagcatgaggcagagtgtagaaagagacattgagttttatttaactgaatttttccatatatttttgatcaagaacactttgggaaatgctactttaagattaccattcattttcttttcccctcacccccttccttggagaaccatcaatgctcacagttccagctgccatcttagtgctaaagtctctcttgtctcagcgcaagcccctctctaccccagctctaggacacccctgcccatagcacaccttcacctagatggctcacagtggggcagagtaggaatctacagaggttcagaggaagttctgaattcattaattcttcattcaacaaatatgaaaaaatgaaactgatggaatggaagaggctctacttctgcaatttttattaaaccaccttgagaactgaaccccaaactcagtgaatctttggttcctaaaggtgtagaatctttactgatctattgccactagaaagatagtaacaacaacaacacaaatctctagtacaccagtgaacaatgaaatcccagtacacctgggaataatgcaatctaggtttaaataatccccccatcatttattacagcatgacttggacaagttgcttcacctctctgagtctcacaaagttcatcttgtgagtagcgatagtatctgtggcaattattgggaagatttaatgaacaagtatggcaaatgtataataccttttacctattgctcacctccctcttatttctccatttaactcccatcctctcccatttctttttatatccattaagctagcacagtctccataaaaacaactgaatctacacatctattcaaagccttcctgccctagcatattgactataattctacccaaaagagagaactggctgacagctttctgccaatattggagtaggctgatctttttctggaatagcctctaaaagacaatagcattattttttagtagattctacaaaacaagataaaggggactggaagaggccctttgcccttgggagggtccattcctagctgggggtaaaggtaattatctctgacttttggtcttctcatctgctaaataagtcctgagatatccaccacttttaatagcctgtgtactctgggtgtatgcatagagtgcctagcagcttgcctatacctcttcatccatgaaagattcaagaagagggaggatatccgttgagcacactactgcatcatttattagagaaaaaaaaattcctatttgggggttactagtcttatatcacatacaacagactttaaaccaacaacaatctaaaaggtcaataataataataatcctttcttagtagtagtaataataaaggattcaattcaacaagaagtcttaatggagcacccagattcataaaacaagttcttagagatctatgaagagatttagataaccacacgataatagtgggagactccaacaccccactgacaggattagacagatcatcaaggcagtatctaacaaagatattctggacgtaaactcaacacttgaccaattggacctaatagacatctacagaacactacacccaaaaacaacagaatatacattcttctcatctgcacatggcacatactctaaatcaaccacatgcttgcccataaagcaagtctcaacaaattaaaaaaaaaatagaaatcatgccaaccacactattggaccacagagcaataaaaatagaaatcaataccaagaagatctgtcaaaaccatacaattacatggtagtttaacaacctgctcctgaatgacttttgagtaaacaatgaaattaaggcagacatcaaaaaattctttgaaactaataagaccagatatacaacataccagaatctttgggacacaactaaagcagtgttaagaggaaagtttagagtgctaaatgcctacatcaagaagttagaaatatcttaaattaacaacctaacatcacaccaagaagaactagaaaaacaataggaaaccaaccccaaagctagcagaagaaagaaataaccaaagtcatagctgaacttgatgaaattgagatgcgaaaatccagacaaaagctggttcttcaaaaaattaagtgagatggataggccactagctagattaataaagaaaaaagagaagatccaaataaacacaattggaaatgacaaaagtgacattacaaccaaccgcacagacatacaaaaaatccttagcgaatattatcaaaacctctatgcacacaaactagaaaacctagaagaaatggataaaatcctggaaatccaagcctctcaagattgaaacaggaaaaaattgaaaccttgaacagaccaataatgagctccaaaactgtatcagtaagaaaaagccaaccaaccaataaaagcccagagccagatggattcacagccaaattctaccacatgtaaaattattccaatcctactgaaattattccaaaaaattgaggaggaggagattccaccctaactcattctatgaacccagcatcattctgacaccacaacctggcaaagacacaaccaaaaaagaaaacttcagacaatattcctgatgaacatcgatgcaaaaatcttcaacaaaatactaacaaacctaatccagcagcacatcaaaaagttaacccaccacaatcaaataggctttattcctggatgcaaagttggttcaacatacgcaaatcaataaatgcaatttcccacataaacagaattaaaaatgaaaactgcataattatctcaatagatgcagaaaagacttttgataaaattcaacagcccttcatattaaaaaaccctcaccaaattagacatcaaaggaacatacttcaaaatagtaagagccatctgtgacaaacccacagccaacatcatactgaatgggcaaaagctgtaagcattttctcttgagaactggaacaagacaaggatgtccactctcaccactcctattcagcataatactggaaatcctagccagtgcaatcaggcaagagaaagaaataaaaggcatctaaataggaagaaaggaagtcaaggtttctctcttcacaaacaatatgattctatacctagaaacccccaaagactctgcaaaaaggctcagagaactggtaaacaactttagtaaagttttaggatacaaaatcaatgtacaaaattcagtagcattactatataccaataacatttaaactgagagccaaatgaagaacacaattccacgtacaatagccgcaaaaagaagaaaatgcctaggaatacagctaaccaaggaggtaaaagttctcaacaacaaaaattacaaaatactgctgaaagaaatcagagaagacacaaacaaatggagaaacattccgtgctcatggacaggaagcatcaatatcattaaaatgtccacactgcacaaagcaatttacagagttaatgctattcctatcaaaccaccaccattatttctcacagaaccaaaaaagactattctaaaattcacgtagaaccaaaaaagaccctgaatagccaaaataatcctaagcaaaaagaacaaagctggaggcatcacactccctgacttcaaactatactaaaggctacagtaaccaaaacatcattgtgctggtacaaaaacagacacatagaccaatggaacaggatagagaacctagacgtaaagccacacacctccaaccacctgacctttgacaaaatcaacaataccaagcagtggggaaaggactccccatatgatcatctcagaatcatttactattcagtaaatggtgctgggttaactggctcgcataggcagaagattgaaactggatcccttcctttcaccatatacaaaaattatctcaagttggattaaagacttaaatataagacctaaaactataaaaatgttagtagaaaacctaggaaataacattctggacatcagccttgggaaagaatttatgactaagtccccaaaagcaattgcaacaaaaacaaaaattgatgagagagacctaattaagggaagagctgctttctgcacagcaaacaaaactatcaacagagtaaacagacaacctacagaataggacaaaatattcacaaactacccatccaacaaaggtctaatatccagaatttgtaaggaacttaaacaattgaacaggaaaaaaaaagaaaaaaaaacatttaaaaaggacatgaacagacatttctctaaagaagacatacatgtggccaaatgtatggaaaaatgttcatcaccactaatcattagggaaatgcaaatcaaaaccacaataagataccatctcacaccaatcagaatggctattactaaaaagtccaaaaaaaaaaaaaaaaaaacagatgttggggagtttgcagagaaaagggaacacttatgcgctgttggtgagaatgtaaattaatttagccaccgtggaaagtggtgtggagtttcctcaaacaacttaaaatagaactatcatttgacccagcaatcccactactgggtatacacccaaaagaaaataaatcattctaccaaaaggacatatgcactcatatgttcattgcagcagtattcacaagagcaaagacatggagtcaaccaagatgcccatcagtggtggactggataaagaaaatgtggtacatatatgctacagaatactatgcagccataaaaaggaacaaaatcatatcctttgcagcaacatggatgcagctagaggcctttatcctaagcaaactaatgcagaaacagaaaaccaaatacttcatgttctcactgataagcaggagctaaacattgaattcacatgggcacaaagatgggaacaaaagccacttgggcctacattaacggggaagatgggggggtagtgtgtctggaattggtgggctcttggtctcactgaccaagaatgaagccacggaccctcacggtgagtgttacagttcttaaagccggcgtgtctggagtttgttccttctgatgttcggatgtgttcggagtttcttccttctggtgggttcgtggtcttgctggctcaggagtgaagctgcagaccttcgcagtgagtgttacagctcttaaggcagcgtgtctggagttgtttgttcctcccggtgggttcatggtcttgatggcttcaggagtgaagctgcagaccttcgcagtgagtgttacagctcataaaggcagtgtgaacccaaagagtgagcagtagcaagatttattgcaaagagcaaaagaacaaagcttccacagcgtggaaggggacccaagcgggttgccactgctgtctcgggcagcctgcttttattctcttatctggccccacccacatcctgctgattagtccattttgacagggtgctgattggtgctttacaatccctgagctagatgcaaaagttctccatgtccacactagattagctagatacagagtgtcaattggtgtatttacaaatcctgagctagacacagagtgctgattggtgcatttacaaaccttgagctagatacagagtgccaattggtgcattcacaatcccttagctagacataaagattctccaagtccccaccagactaactagatacagagtgcctattggtgcattcacacaccctgagctagacacagggtgctgattggtgtgtccacaatccttgagctagatacagagtgctgactggtgcatttacaatccctcagctagacataaaggttctccaggtgcccaccagactaactagatacagagtgccaattggtgtattcacaaacactgagctagacacagggtgctgattggtgtgtttacaaaccttgagctagacacagagtgctgattggtgtacctacaatcccttagctagacacaaaggttctccaagtctccaccagactcaagagcccagcctcctcacccagtggatcccgcaccgggaccacaggtggagctgcctgccagtccagccatgtgcccacactccccagcccttgggcggttggcgggactgggctccatggagcagggggtggtgctcatcagggaggctcccgccacacaggagcccatggtggggggttggggtggggagggctcaggcatggcgggctgcaggtcccaagccctgccccacggggaggcagctaaggcccgtgagaagtcgagcacagcagctgctggcccaggtgctaagcccctcactgcccggggcttgcgggccagccagctgctccaagtgcagggccgctgagcccacagtcacccagaacttgtgctggcccgcaagcaccgtgtgcagccctggttcccacccacgcctctccctccacacctccctgcgagctgagcgaacaggctctagccttggccagcccagaaaggggctcccacagcgcagcagtgacctgaagggctcctcaagcacggccacagtgggagccaaggccgaggaggcaccgagagtgagtgagggctgcgagggctgccagcacgctgtcacctctcagtaggagcactggggttgaaagctgcctatagtatactatgctcactacctgggtgacaagatcattcatacaccaaacctcagcatcatgcaatttacccgtgtaacaaacctgtatgtgtactccctgaacctaaaatgaaagccaagataaaaactagttaaaaataaataaataaatcaatccctattttctaaggacatctaaatgactgctcatgtcagtatggctacttcaaaataatatgtccttcctgagatgtatatgcctgtgaaggacaccagcagtctgagggaggagcagattcgaatggtccagtggaagaacattgaattggggatctgagaactggttccagctgaagctttgccagttaccagttgtttagtattggacaagtcacttaattccctgactctcaggtagttttgttgctgttgtggtttaagtatcatggggctaacactagtaatcttttcttggtctaatagtgctccatcttttcttcctaggtctagtcatattttgaaaacaaattagtttcactgtacatgctatttcataaatttgttttttaatttatttaaattatcagcatataatgagcattttcctatgtctttaggtagttttatgacatgttcttaaagattacgttgtattctgttatgagactataccatctttgcacaccaagcctcacttgtggaacgtggaaatgcctttatttcctattagaagtagtattaaccaggtgcagacaaaaggaattaatctggacttcttcaattgagattacacctcatgtgtttcagctacatagacccatctgtctctggctggaattaggagcctaaaaagagaaggggctgaaggactgctcacttagaagagtagaaggggctgaacaggacaggaggtgcatatgtttattgatggctgacatgccacacacttacatgtgttagtacaacaaccctgtgaggtaaggcttatcccccattacatttgctgtaagagctgaactgaatccatgctcacagctaccatgttgaaaggggaagctgagaagggcccagaaccaccgctgtgccactacccctgagactccaccatcctctcctccacaccatgacacctgaccctctcctttgcctgtccacacctaccatctcaatgccccactcttctcaaatgcatccctcagatattcactgatttatcctttcaggacttctcaatcatgtatttaccatcttattataaatgatctgatgctcagattcttagggttacaacagttgatttacatagccttgcctatgtgccgttaagtcacttcaagatggaaaactccctgattaaacttaagatgtagtaatcccacaacatgaatactctggactaagtatatattttattgtaaacagtcttaaataaaatatatacattgtttaaatctgctaaacactttttaccaacgtctatacacttcccacccacctccacccaccctcaaaatcaggccactcttcttgtagcaaaattctctactttcctaccagagtgtgtagtgttcatttgcatttctatttaggtgagtttatttcataacagtcatggcagtgggcagagcccacagaagtctatacccttctctgcctctaaacagtcatgaacaaatgaagtgagttagatgacttctaatatcctttccaaatttaaaattctgcataatttggccatatcttaatgttccaataaaatgcatctttccaatgtggtttagtttactgtgttaaaagtttgcacactaaaaattagaagtaagaagcctcagccaagcatggtggctgacacctgtaatcccagcattttgagaggccaaggcaggtggatcacttgaagccagaagttcgagaccagcctggccaacatggtgaaaccccacctctactaaaaatacaaaaattagctgggcatggtggcacacacctgtaatctcagctactcgggaggctgaggcaggagaattgcttgaacctgggaggtggaagccacagtgagccaagattgtgccactgcattctagcctgggtgggcaacagagtgagactctgttttaaataaataaataaaaaaggaagcctcccattcctaaccaagtaaactatgaaataatgagagactgtacatttctgttctactgctaacactgctagtgtgtggcctgtgacttggcaagctgcttcctgtttctgagccacagtttacctatttgtaaaatggaagatttgtactaaacatattctgagatgccttcttggccccggcattacagtattggattctaatcatgtattcattctgctcagaaatgtttctggtgtttctggtcttaagttatcaataacccctggtagagtctgggacattgggacgagatcctgcaagctcagcctaggcttgccggcagctgtttgaaggagtcactcgcatggaccagtaaagcaaaggcagcgatgacgcctcgcggtgagggccagaacccaagtccagggaaaacgctcctttagcgccacgcattacaaaacaacctctcctccttgctgacgctgccgccacatccggggtgaaaatcgagcctagatctttctgctccagcacagcctggcctgcagcggatgcgggcgtgagagggacgcaggagcagcgggggcggggatgctgctgaccgtggagaaagcaacctccttccctgaggggcttcccctctctgcgccaccatcccccaccccctgcaacagggcagcggctgaacccatctctgtaggtgggaggtgggatgggagggaggaggaagaccctctcacctgagcaggacttggaaaggaaccaggaagagagcccacttccaaatccagtctcttccactgaggttccacctgcatagaaggggcttcctgggacccaccaagcccgtgataccacttggtcatcttacaagagaagacaccaaagcccagagaaggaagcagctgtcccaaggaggagcagctaggtggggactagaaccaccatatcctggccccttctacttctctgtcccctccactagacttcttcagccaaagggggtttctctttttttagtttctttgcaaacctgcttccaaatatttgtattgacctatcggattgatacttaaagaatcagggatttgtgcatttgacacctgaaactcatctgtcccctaaggatcttcttgtgtgttctgcttaccatccactcagaatttttgcagctttttgagggtcatcatccacctgcagtcactttagagacatcagaaagtgtcatgatcatgatccccttgtagaagtgagaagtgtgtcctgcagctaatcccatccaccatgcagacaggatgctaaccagtctcagaggacaccattcctctggcccacctgttgggtggcttacctgactttctgccccagtcctgtctcagcatcatacacttgctgtttgaaggtggccatcccacgagtgggctaaactaggcattctaggactggtcaggaggtggcaagtcatcatgctgatcaattcaattagtaaaggcactgtttgggaagagagagggggacactatcaccatcatacgaagagctaatgttttttgagcatttactatgtggtagactttatgctaaattcttacaagtattgttttaatataatccttacagcaaccgtactattgttattcctgtgtggacaatgaggagacagaggcacataaggaaaaggttactaaatggggaataaggaaactcatcttccattctttctctatctctctgtaatctcgtgctagtcacttaaccttgcctttctggtacatgaaacatctgaattggaagaaattatgtgcatatgtgcatttttctggaaagagcagccacaattttcatcagcatctcaaagacacccattacccccctcccactcacaaaaaaaaaaaaaatcaaagaactctcaggactatctcattttatagcctttttcacactaaacaatttaccttgcattctcttctaacattgtaaataccgacgggcttgagcagtaccgataggcagattcagattacagtcacccctgagccaaagacctctctgtgattcaggggtgtgaagggctcctggctgtgcactggcctttccagcacacccgcatgtccagatagccatcgcaggaaggacgacgtggggatgggatcatcagattcaccctccagctacttgcaacacctcagcagttttacttcagcttgttgtattctttccttgcaactggactgtaagtttatattgcaaccccaagaaaagattcacaatcccttttttttattgtactataaaaagaattctagtgatagaacctccacagggcttgaagtgaagcagccattcattaagtgtctgctgtgtcctgagtatgccagcaatgaacaagacagaccaggtccctggctgcataaagagcaagagggactgtggcagggaagtgccacgcagatgcagagagcacgagagtgaggcctggagaaccaggaggggcttccttgagaagtggtgtttgagccactgaaggatccctgaagaatgcctcatccctgatggatgaagagaaatgaattaagcaagaggcacaggtcagaggggtggaagagcattctgagagggatgggaagggcccaaggcaataaagaacttggcccactggaggaactgaagggagggcaggctaggtgccaagagagggagagtggtgtgggagatgcagccggagaggaggcagggccagtgtatgcagggcccaggaatcgccaggtgggatgctaactggctgtgggctgttggcaaggcaggtaacagctcacatgttccatttccttatcttcaaggtgagagtcttcaattagatgatctcgaaagccctttctgactctaccatcctgtgatattgtgacttcaaagaaagtgaagtgattgctgagaaagagaaaagtggcccctgacaacctggatctgggtggtcccataagctaggccttggcgttctcctgttaaacataaacaacttcacagaacatcaacagcaagcaagatgtctctgtgaccatgataaagacaaaaataagaccactccacaatcatgtctgaacacagacaaaaaacgttaacattgtccaaaccatggaactaaccaaacatttccctattctggctcggaggagtgactgctactcctttacccttacagcttcagtctcacttagtcttcctcccttctagacaagatttattaagatatggaatcatagaatttacccctgcttctgacagcatgcaaagctccacttccttaaaccgtccccaaaatcgcctaccacaaaccgcactcctgtaagtcctttctaacaccctgtcggtgagacaccccaccgttctccttctctgctatgtcctgtccaagcacagggtgttcctcatgcaagtgcagggctggccatgagaagcaatgccaccctacactttgctctcctggtgtctctcttgtctcaccagttccagcccagtcctgggggtctttggctggatggagttgacatcagtccccttccctgctcttctctaatctcaccacaggtaccctgctctgggcctcagggtgttggggagtagagctgggaagtagcggaggagaaaatgaggaagagaaatgcaagagggcgacttcacaggggaattttgtccacctgatgatgtgggaacggaattaaaactgtctccagagcgaatgtttcttctctcacttgaagtctgggcttcctccttttatgtctatgccccacccagattacgcatgggctacttgggcggttgtggtatttctgtttcccaaccaaacgccaccacctccccttaaagccatcttcacaggaaggtaaccagctcccggtggaactgacccatttgacagtatctaaggggaacaaaaattgttgctgctgctgattcagattcacagcttggacttcccacccttagctaaaagtttttcactggggggagtccccaccacacaacctactctattcatgtgagccagtggtaaacaaaccagactcctggtgcctcctgagtcagatgataaccaagggaaagaagtgacctctatctctggacacaaaacaaactagaggacccttactcctctgattgagaaagctggtgaagtcagctcctttcaacttggagaagccattgctcacatcaggcgcataactgtttccaaagtcatggaaatgtccagttcatggcaaaagtagggttttctttgtgcttagtttcatgaagaggtcaatcaactttttcagtaaaaggccaaatattaactattccaagctttgtgggccaatctttggcataactactcaaatctacccttgcagcacaaaagcaaccatagatataatgcaagtgattaggcatgactgtatttcagcaaaactttatttataaaaacaagcacaccagatttggcccatggaatgtagttggctggcccctggtgtaatgtaaccaacacgtgggcacagctgaataagaagaggaataataacctttgcccattactttctaaagagcttacttctcattagacagattgagaggtttaaaatcagtttggaaactgctggaggatggaggaaaaagagggagagaagaaagaagaaagcaaacatgagaggatggaattttatttatttcaaatggaatttagttatttcaaataagtaatggaagaatcagagtggaaagagttatttgtaaggcctctgtatagcaggctgaccctagtcatctcttaccctgaccagctggacaggagtcactcactgaggctcaggctatgtggactaatccaacttcaaagtcaggtttatagaaacatgtgtgggcttctttggggaaagtttatctgagacagtgttcctccggaccagcttcgggtgtcattagcaacagagaatcttctcatagagacaactgaatgtagtatgttccaggatttattttttaaatgctggttcctgattcttctgggcaaagccgaagaaggcagagagacactgagagtgcactgcatcagcacagattgtggaatgtttaggaccatttcagttcccaaagaaagagcccctgaagagctcatagaaagggctcgcaggagagtagagaaggaccagggagtgctggacacttctaacagtcacaggtgctgtgacttctaacagttgcaggtaaacagggtcccagaccttcccatctgggactgatggattgattgtgaagaatatatactcattccacaaatttaaaaagggaattaataatgaaagacttaagtgtaaagtagagcacccaagactctgctcggaaaggtagacgcaaatgataaccacataggtaaatcccctgcatgtggctgggaagagagggtgagaagtagtctatctatggttagtggccattttctctagttcacagaccatgcatattgattatagattcagaaagttaccctaactttacagcaatgacttctgaactgtgctttcctggaatactggtttcataagatgttagcagttattttgcaggagaaaggtttcagggaaaccgaagaatgaattgacattgacaggaaactgttgtgtatccattcaaaatacatttttgtttggctgtgttatccttggagaaaagtaatagtatcagaagaatcctgggcaatacagcaaggtcctgtctctacaaaattttttaaaaaatagcctggggtagtggcatgttcctatagttttagttactcaggaatctgaggcaggaggatcacgagcccaggagttctagactgcggtgagctatgatcatggcactgcactccaacctgggcaacatagtgagaccatgtctctaaaaatgataatacataaataaaattacatttaaacaatcatttttaggaaacacaatttttagagctcagaacagaatatgaccctggacagatgcatatgaaagacggtctagcaatggctttcaaacttcttaaaacacaggttgctggtcccacacccagagtttctgattcagtaggttgggatgggattcgtgtttctaacaagttcccaagtgatggtgctgatgctcgtccaaggaccacaatttaagactcacttccctgcacccggccccatgcccaacagataggaggctctttttacagtaacaagaagtttctttctgagggttaccacattaaaagaaatcaattgaatgggtttccaccatgtgtgaggatatattggctgacccagcatcaaagtcagggttagaaacatccatgggcttatttggggaaagtttattccagacagtcttcctccagaacagcttcaggtgtccttagcaatggagaatcttctcatagaggcaactgaatgtagcatgttccaaaattcattctttaaatgctggttcatgattcttccgggcaaagctgaaggggccagctaataaatcaacacatatttcctgacatttcctgacagggagacatgttccttcaaaaatgggaacaaaattcataatgaatttagtggggaggcatagttcttcaaaaataaaattcagtttgaacattttcaatctgagatatttggggattaaaaaaacagatataggttctgaagggactactcaagcaaatgtatattaggaaatcaaggaggccctagaaggccagaatatggacatgagtcagccaaattgtggagttatggacaaaagctaacaaacacatcttgaaatctccagtgggacgcaaattcttttaacctcaggtcagccccaaatcatggtaccaatttctgttaacatgctctaaaaaatgacatgaagaacttagaataggttcttggcatattaacaaatatatctagaaaaatatgaagtagtcctaagcagaaaggtttgaaagaaatttggatagttaagcctgaaaaaaaagtgaaggtgattctatctttaaattaatgaaaatttttgtctctggcctttcattgcagtggtaaattaggcaagaataaatggccttaattttaaaatagatgtgattttagttaactgtgaggtaaaatcttctttaaaatggggtaatgaaacactggaggcttgttattttgggcctggaaatttgtagagatgctaattgtagctaacagtacttatgcttttttttttttttttttgacagagtcttgctctgtcaccaagctggagtgcagtggtgtgatcttggctcactgcaacctccaccacccgggttcaagcgattcttctgcctcagcctcccaagtagctgggattacaggagtgcaccaccacgcccgactaatttttgtatttttagtagacatggagtttcatcatgttggccaggatagtctcaatctcctgacctcatgatccacccacctcagcctcccaccttgggattataggcatgagccaccacacctggccgaagtgtctttaaaattccacagagctcttccttggttcctgcacaatctcaaagccaattgaaagaattgccatactattgaaaaagtccaaatgcccaccaatgggaaaatgaatgaataaattgtgacatattcacgcagtggaatattataccgcagttaaaatcatggattatagtaaagtacaacaatatagatgaattttattaatacgatattaagtgaaagaaactcagaagattacatatagtatgatacccttttatgaagcttaaaacaactaaaattttaaatacattttgggaacataggtagatacaatataatcatataaaaggaagacaagcaatgaccacaatgaaaaagactggcagtaccaagggtggacaaggacatggagtgatagaactctcatagagtgcagtgggaagataaattggtacaacactttggaaaactttttggtagtatctactaaaactaaagatacacaaattctatgatgtagcaactccacttctaggtatatattcaacatacattcacaaaaaggcatgtttaagaaagcttatagctgagggtggagcaagatatctgaacagaagcctccactgatggctcccccctgcaggaacaccacattttaacaactaactacacaaaaaagcaccatcaaaagaagtaaaaatcaggtgaacagtcacagcacccggtgctaatttcatattgctcaaagaggcactgaggagggtaggaaagacagccttgaatcgctgataccacccctcccctatccccccagcagtggccgtgtggtgcaagagaaaatctgtgcattttggggaaggagagcacagcgactgggccacttggcactgaactcagtgctgacctgtcacagcagagagaaaagctgtgctgggctcagctggcattcgctgaggaggagggagcatttggaccagccctagcaagaggggaatcacccacctaagcagtcggaacttgagtttctgcaagcctcaccaccacgtgttaaagtgctctggggtcttacataagcttgaaaagcagtctaggacaaaaggactgtaattcctaactaagcaattcctagtgctgggctaggcttaacactagagccagtggactagagcagcaggtgacctagggagacaccagccagggtggctaagggagtgcttgttctacccatctcccaaccccaggtaacacagctcacagcaactaaagtgactccttccttctgcttaaggagagaagagcaaagagtaaagaagactttgtcttgcaccttggataccagctcagccaaggtaggatagagcaccaggcagagtcataaggcctccattccaggccctagttccttgacaacatttctagacatgccctgggccagaagggaactcactgccttgaaaggaatgagctagtcctgacagaatatatcacctgctgactaaagagctcttgggccctgaataaccaacggtgatacccaggtagtgtgccatgggctttgggtgagactcagacatgctggtttcaggtgtgacttactaccttcccagctggggtggcaatggcaaaagattccttctgcttgagaaaagtaaaggggatattttcttgctggtaccttaggtaccagttcagccacaagggtgtggagcaccaagcgggctcttgggtcccgagcccaggtgtaggctcctagacagcatttctggacctgccatgggccagaggggagcccattgccttgaagggtgagtcccaagcctggcagcattcaccacaacctgaggtgcccctgggctttaaatgaacatctgcagtggccaggcagaactccccctgagctagtggtggtggtggccaccaggaggggctcctctgcctgtggaaaggtgagggaacagtgagaaggactttgtcttgtggtttaagggccagcttagatgcagtagaatagaatgccaggtagatttctaaggttgttggctcaaatcctggctcccaactgtgtctctggacccacccaacgcctgggggaactcactgcccttaagggaagaacacaagcctggttggcttcttcactgctgatggcagagccctagggcactgaggtagaacatagatggtagccaggtagtggttacagcaggcctggggcaagacccagtgctgtgacggcttcaggcctaacccagaacagtcccagtggtagtggccacagggaagcttgtgtcaccgcacctccagctccaggaacctcagcacagaaagaaaggctgtgtttgttttggaggaagtaaggaggagaacaagagtctctgtctggtactatagagaattcttctgggtcttatccaagacccctatttggaaatacacagtcagaggagacaaaagaaaaaagaacaaaaaagaatgaagcacacctagaagatcaagagaatgccctcaaagggacaaatctaagagttactggtcttaaaaaacaggtagagaaatagataggggtagaaagtttattcaaagggataatatcagagaacttcccaagcctagagaaagatatcagcattcaagaacaagaaggtaatagaacatcaagcaaatttaacccaaagaagactacctcaaggcatttactaatcaaactcctgaaagtcaaggataaaaaaggatactaaaagagcaacaggaaagaagcatataacatacaacagagttccaatatgtctggcagcagacttttcagtggaaaccttataagccaggagagagtgccatgacatgtttaaagtgctgaagaaacaagacccaatgatctgttgcctataagaaacacatttcacctataaaggtacacataggctgaaaataaagggatggaaaaagatattccatgccaatggaaaccaaaataatagagcaggactagctatacttatatcacatgaaatgatttcaagacaaaaattgtaagaagagatgaagaaggtcgttatataatgataaagggatcaattcagaaagagggtataacaattttaaatatatatgcagccaacactggagcacccagatatacaaatcaaatattattagagctaaagaaagagaccacagtacaataatagctacagacttcaacaccccactttcagcattggactgatcttccagacagaaagtcagcaaagaaacatcagacttaatctgcagtatgaaacaaatggacctaatagatatttacagaacgtttcatctaacagctacagaatacacattcttctcctcagcatgtggatcattctcaagtataaaccgtatgttgggtcacaaaacaagtcttaaggcattcaaaaaattgaaataatatcaagcattgtctttgaccacaatgaaataaaactagaaatcaataacaagaggaagtttggaaactatacaatcacatggaatttaaacaacatgttcttgaatgaccagtgggtcagtgaaaaaattaagaaggaaatttaaaaatctcttgaagcaaatgataatagaaacataacataccaaaacctatgcaatatagtgaaagcagtactcacaggaaaattgaaagatacaagtgcctacatcaaaaaagaagaaaaacttgcaataaataacctaatgatgcatcttaaagaactagaaaagcaagagcaaaccaaactcaaaattagtagaagaaaagaaataataaagatcagagcagaaataaatgaaattgaaatgaataaaacaataaaaaagatcaattaaatgaaaagcgggtgttttgaaaaaacaaataaaattgacaaacctttagccagactaggaaaaaatgagagaagacccaaataaataaaatcagagatgaaaaaggagacattacaactgataccacagaaattcaaaggaacattagaggctactgtgagcaaatatatgccaataaattggaaaacttataagaaatagataaattaattgaaacatacaacctaccaagagtgaaccaacaggaaatccagaacctgaacagaccaataaaaagtaatgaaaacaaagtcacaataaaaagtctcctagtaaacactgggacccaatggctttactgctgaattctaccaaacatttaaagaagaatgaataccaatcctactcaaactattccaaaaaacagaggaggaaggaatacttccaaactcattgtatgaggccagtagtaccctgataccaaaaccagacaaagacacacacacaaaaaaaagaaaactacaggccaacatctctgatgaatattgatgcaaaaatcctttaaaaaatactgacaaaccaaattcaacaatacattaaaaatatcattcatcatgaccaagtgggatctatcctgtggacgcaaggatagttcaacatacacaaatcaatcagtgtgatacatcataacaacagaacgaaggacaaaaatcatataatcgttttcaattgacactgaaaaagcattggataaagttcaacatcactttatgataaaagccctcaaaaacctgggcatacatggacgtaattcaacataataaaagccatataaaacaaacccacagctagtatcatacagattgtgaaaaaaatctggaagcctttcctctaagatctggaagaggacaaggatgcccactttcaccactgttattaacatagtaccggagttcctagctagagcaatcagacaagagaaagaaagaaaggtcatccacattagaaagaaagaagccaaattatccttgtttgcagaagatatgatcttatatttagaaaaacctatagactccaccaaaaaaactattagaatcaataaacaaattcagtaaagttgcaggatacaaaatcaacatacaaaaactagtagcatttctatatgccaacagtgaacaacttaaaaaataaatcaaaaaagtagtcccacgtataatagtcacaagtaaaattaaatacttaggaattaatcaaagaagtgaaagatctctacaatgaaaactataaaacactgatgaaagaaattgcagaggacacaaaaaaggaaatatattccatattcatggattggaagaatcagtattgttaaaatgttcatactgcccaaagcaataaaagatttaaggcaactcctatcaaaataccaataacattcttcacagaaatagaaaaaacaatcctaaaatttatatggaaccacaaaagacccagaatagccaaagctatgcttagcaaaaagaataaaccagaggaatcacattatcgactttcatattatgctacagaagtatggcaaccaaaacagcgtggtactggaataacaacagacacatagctcagtggaacagaatagagaacccagaagcaaatccacacacctacagtgaacttgtttttgacaaaggtgccaagaacatgcattggagaaaagactgtctcttcaataaatggtgctgagaaaattggatatccaaatgcagaagaatgaaactagacctctgtctctcaccatatacaaaaatcaaatcaaaatggattagatacttaaatataagacctcaaactatgaaactactaaacaaaaacactggggaagctctccagaacattgtagtgggcaaaaatttcttgagtaacactccagaagcacaggcagccaaagcaaaactggataaatgggaccacatccagttaaaaaccttctgcacagcaaaagaaacaatcaacaaagtgaagagacaacccacagaatgtgagaaaatattcgcaaactagccatctgacaagggattaataaccagaatattacaagctctaacagctctataggaaaaacatctaataatccgatttaaaatgggtaaaagatctgaatagacctttctcaaaagaagacatatgagtatgaaacaggaatatgaaaaggtgctcaacatcactgatcatcaaagtaatgcaaatcaaaactacagtgagatatcatctcaccccagttaaaatggcttttatccaaaagacgggcaataatgaatgctggcaaggatgtgaagaaaagggaactctcatacgctgttggtgggaataaaaatcactacaaccactatgcagaactgtttggaggcccctcaaaaaactaaaaatagagctaccatacaatccagtaatcccactgctaggtatatataccccaaagaaaggaaatcagtatatcaaagggatatctgcactttcatgtttgttgcagcagtattcacaaaagccaagatttggatgcaacctaagtgtccatcgaaagatgaatggatacaaaaaatgtgttacataaacacaatggagtactattccatcataaaaaaaaaaatgagatcctgtcatttgcagcaacatgaatggaactggagatcattatgttaagtgaagtaagccacgaagatggactttgcatgttctaacttatttgtgagagctaaaaattaaaacaattgaactcatgaacattgagagtagaaagatggttaccagaggctggagagggtagtcggggagtggggaggaagcaggggtggttaatgggtacaaaaagtagttagaaagaatgaataagacctagtatttgatagtataatgggatgactatagtcaataataatttaattatacatttttaaataactaaaagaaaataattggattgtttgtaacacaaaagataaatgcttgaggggatggataccccatttaccatgatgtaactattacaaattacatgcctttatcaaaatatctcaggtaccccagaaatatatatacctgctgtgtacccacaaaaattaaaaattaataaaagaaagttcatagcagcactgttcattaaaaccccaaagcgttcattagcaggagaatggataggtaacgtgtggtagaatcataggaaaatactatacaataatgagaaaaaacaaactatggttacatacaatatagatgaatcttgcaagtatgttggacaaaagaagccagatactacataattctacttatataaagttcaaaaacaggaaaatcccatctttgatggtagaagtcagagtactggccatctttggggaaggtaatgactctagggaggcatgagtgggggctccggagttctggttctgttttttgatttggatgctggttacatgaatgtttacattgtggaaattcttgtatgatttgtgcatatctgatgtctatcatgcttcaattaaaattttattttaagagtgagagaaagataagggagataaagataagggagtaaaaatagataataacaaataggatggaagataagaagtatcaataagcatagttttcaaaatatatttcaaaggatatacagtatgaataggtggtaaaatctaagtaaaatcttttttgcaatgtttttcatgtttaacgtttatgtcccttcatatagccattgttttaataacattctaccacatattttctggtttaaaagtaatgtacttgtctgtgtgtatctatggaggattggttcaggaccccctcagataccaaaatctgcagatgctcaagtctcttatataaaatggcatagtatttgcctataacttatccgcatcctcctgtatattttaaattatctctagattacttacaatatctaatataacgtgaatgctccataaatacttgttatactctattgtctagggactaatgacaagaaaagaagtctgtacatgttcagtacggatacagccattcatcttttccaaatattttcaatctgaagttgactgaatccatggctgcagaacccacatgtatggaggaccaagtgtacatgtttattttattaaatttcagaaacaaaaaataaaacagggaagaaaccagaattccatcaatgagatctaatcatccttaacatttcggtgtgtatcctaccagtctttctgtcttatgatttatgaagtttttaaaaggatggggtgaggagagaagcaaggaatgataggcatgtggttgaggataatggcttctttagtgccaacatggcacatgtatacatgtgtaacaaacctgcacgttgtgccaatgtaccctagaacttaaagtataataataaaaaaaaaagaggcacaagaacaggatgtaatacaggaacccaccggtaggttactatgggtgttttttgttttaggtggtagattaattattaaaaataacttaggaaataaaagtcggccaggtctggaccaataatgaggatgtatcaccaacaaaggattatgattaatccaattttgtgcacctgcggtccaattaaaactaaaagaattctcataataaatagattctgtgctgtaattgaaagtaagtttagtcctctgaagtcctaaactgacattttaaagacaaactgtgcactgacaaatcggggggaaaaaattacttcccttttcagtaagaagaagcttgccctttgattactaaacctcacatagttttacaatgatttgtgaattccagctcctgttcatgataacattggccataatgattcaaacgttcatgtgtcagaacgtttcagtgtaaaccagataaacttcccaggtcccttctatctctaaaattctgtattttagattaatgacctgatgtgtctacccactcaattaataaagcaagaatgacttttccagaccctttcctgttaattacacagagagtttcaactggggacagttcttattgctcacagcaaaaatccagatttattggtttgttttcgtgtttatatccctgttgctgttaataaaaatgaaaggtttaatgtgttgaggaaatcagggtaaaatatgtgcaagaatttaaaataatgcacacgtaatgttagaacactaaaatgcatgcttttggtttctattttagctacagcggagccacaaacttggcttacagcttcctaacactcaaagaaggaaacaggagaagagagaagatttgtaatgcctataaaataattttggccaggttttccaaagaaaaccagaatttccatgtgcttagaaagatgtccccacgatgtgctagaacaggcttctatcggcgcttgagagccgatggttaaatattcagattttttacaaatatgttgttaaaccattggtagcttgaaactgaccatggtgggaatatttagcatacaccacaagtcaggtcttgtttttcttttagaagccagactacaagcacaccaccacatgtccccagtggtcctcagacaaagacactgtgtgaggtcaggagagttgcaagtggatggggaaaggctcagtgtacaactttctatgtacaatagaaacccatccctcaggagtagcggagaacagaaacatatgcctgaccagagaatgacttcaaagttacatcagcagtcacccaccccacctgagtccttctttccaataataccctttggaatttcatacctgggattacaaaaactgctatgcccattgaggggcagacatatctccccattcaaagatacacctaaacaaatgcgagaatctcagattacagactttatgctttccactcagtcagcccttccaagcccatgtttcacggcatcatgaaaagtgtccttcagggaagaaaaaaagtgtcccataccaaaataagcaataatctttattgcaggacttctcagagcctttaaggaggcatatgtgctcctgtggcagagtgtacattagttcccaaacttgttttaccccagaacacttcctggtgacacatcttgggacatcatactgaaaaatgccaccctgggtagtcagggttccttatgatttggagaggcaacgccaggatgttattccacagaaatgtttcttttatgtaggacttgaggctctggcatttttctttataaaaacatgagttgcatatcttcgcttttcaaatgaaccatttcattaactctgttggtgttcatacatccgtcagcagagctgacttaaggcataaaggaaacagttcaggacaagaagtttcttaacttcctgtgggctatgtcgccagcaactcactcagtcctatgtggacacagagtttgttatgttgccggcagtacacacaagtatgcacccactcaaccatcatcatggagcccctccatgttccaggccgcggatgggacagacctggccctgtcttcaaggagctcaggatgcagcattaatgaatgtcagcttcctctatttacagcctttctttgctttgtctaggcttctgtttccccactttgctctgtgccctgtgctgctcctcaccactcttgttcatccttttccctcccttccctgatagctttttccaatgactcacaagaacccacccagctcagctgcttttcattacgctcctgtctttgcatttttccaactcaattaagccattaccagaactaaatgaggcatggactccccaaaagtcacacctgttgtcagggagatggagggcaagaccatgtgcagctggcaggcagacagcagaagccgggcttgggcttgcgggaggcagccaagggtgaccgggcaatttgtgtttcccccagtgccgaaagagggccctcattttaaaacaacatgtgccttgctttggtacagaaggaatgaagtctgatatagaactagggatggccgtattggtgatggcaggtaagagtccctaattctttggcaaatgtgcaccagctgtgtatagaaacccatattgtggatgtctcttcagcaagaggtaaaggaagctgcaactacagccaggcacgtgagtttggtgattattgattaaactttttcaggtttatttttcctgttcaccctcattaaaacatacacatttcacctttctgcaatagtggcttcagaccctactgttagtatctttatgatcattgtgacgaaagagagtaaagattacagtacaataaaccagagacatagcagtgtactcacgttatggagataaattctattggaaatcaaatttggtcttataattctcttttttctaggcaacctagaattttttttttttttttgccatctaggaattcaaaaatagtagcttttgagcttgctgtgcctttaatttactgagtgattttatgttcagaaggtctgcgcctgggttttctctatttgaaatgtgagcaaaatcattttgctctagagattcacaatttccagaaatgttgaggccaagaggtgagagtaggggtggtttttatttggaagaaaattgaaatgtggcagtgttcactcctgacgttgttttgctatcctctgttaacttgttttgactccggaacttggattagccacgtagctactctttggacaacaagttcaacagacatttttagagcatccatttagtaccaggttctttgtttgatgctgaggatgcagctatgatcatggagaagcctctgcctacaggaaccatcagtctcgtggggtgaccccttccttgtcctgtccaggaattgcccaaccagcctctggtctttactgtgtacacttcatacatttgttcaacgaatatttgtgaatcatttgtgccaggtgctgtgctgggtgctaggcaacaatggtgaagaaaagagacaggccttggcctcatgaagtttctggtccccaccttgacttaattctctttcccagcaatcaccagagaatatcactatttgctctgtgctccctcaacacttaaaccatgcctctttataacatttagatcaccgtccttataatgcgcctttctgtctctttttaaaccttgagcaccttgaaggcaaaaatttcaactttctttccctagtgtcttgcactccctggtatctagcacatagagagctcaataaatgttttttgaatgagtaaatcattgcacgaatttataacttcatgaacccatggaacccattgactggtctgccctcatctccgatccttggctgaaaagcctaacaagccattatctgtccgtactgaaacactcctcctgatgtcaagaaccttctaaacataaaaccacctggtgcacggatcatttcttcttccaagatgtatctgccattgagagaaagaacaaatactagcttcagctttgtttgtaacactcatttgcaggaaggcaaacatgattatatatgatttaaatggaataaatgtatagtaaggagaacaaatgagtttatttgtgattctttgctagatactgttggagataactacagtaagaaaaaatatatataataacagtggtttaaaccagccagaagccttttttctctgtcaggcaaaagtccaggaatagttcaatattaaggttctgctctatgaaaagcttagctcatggcaccatcatttcctaggttgtagctccttgttcaagatggtctctagctgtcatatccacctccgtgcagcagaatagaggaagcggggagaagggataaggggcaaccaggagtcaagtacaaagaaaataaagcttttacaacatggaaggtggaaggtgatgggagctggacgaaggcactggccacaggagtgtgtaggagaaggcagagtgggaagcaatggcagaatcacaggaccaggagactggatgttggaggacagggagatggaggatctagaatgaccctcagctttggaagcaaattcgaccctgacaactgaactcaaaagggtggtttgaagaatatgttagactgagagagttaactgctacaaattgaccccaaatctctccttcctctattccttattgccattaattttctgttgaatgaactaattaagttaataaactccaagtagttaatatttcacaggaaaaatttaacaggtctcagtgactaaccctagccagttataatgttctctctcccatctaattcagtccatgggactccttaaaattctgagttcttaaggcattcttaagacaagtgccaaaactgctcactcgagtaagctgaatatacaaagaatctatttccctatctagaaagtggacttggtattaccctcattacaaaattgttgtgaagttcaaaatacatggaatgtttaagggatctggcacaatgcctggatcaataaatgctagtttctgtctccttccaaagtactttcttttttaatgcttttattcgataaacatttattcagcatttactatttcagacactgtacgaagtaagtgctgcaggacaaagttgaatttagagaaaaagttacttttttttttccacttctgagtgttaaggtaaattctgatcatttagcccagcatgtctaccccctggactgagagctcctgaggatataaacatgcatgtgtttgtcacctttatattcccagcacatgtacttattaaatgtatgagtgaacatatgaccagggtccaaggaatgaggccaaaaatctaaaagcaggactagggtcagaaaactgggatggtcatggatgttcagacattacaggaggagactccatgaaaattgagcgtctgctggggtcatccttccacctgaggctcagcacactctgctaggaatgctgttggaggagaaggtggaattcctaaggagcaagaggcaccatatgacaatgattaagagattgagctctggaatcagacgtttatgaacataactgtaataaagtgtgatgaaccttccaagagggaagctccaagatccaagacataagagactatgttcttacaggtggacctcccctcacctaagggttcagggaagtcctccttcaaaagccttgcaaattgcttactgcacaactgaggggttaatgtgggctgaaatccaatctgtgttccactaaagctgtgcacgttgactcaaagccgtgtgctccccagaaggagctcttttcctcattcacccgaaggcctacagttcacccagacatgccctgcaattaaggacatctgaaagctcaaagataagtagatgttttccaggccaagtttaggccacagggaccaaggaggggaacagcaagtgtgagatctgagcattttaaaagcctgatgtacttgaggaactgaaagaagttcagcaaggttggagtgtgacatacaaagagaagactaacaagagtggaagggtattcattaaagccagtattttctatgagtttactagttacattgtgctaatggctctccatgcattattttgtttagatcacagacattaagtgacttgcccaaagtcatattagaaagtagtggaactatgattcaaagccaggtgtgaatccagagcctgtgctccaaagcacttgtcctgtggcatccaaagatttgcaaattgcaaaagagcaaaactggagatgagaatgccagttaagaaatagttgcagaaatccaggttaaaaatgatggcagggccaggcatggtggctcacacctgcaaccctagcattttgagaggccaaggtgggaggatcacttgagcctaggagttcaaggccagctgtggacaacagagtgagacccatctctataaaaaaatacatttaaaattagccaggtgtgggtagcatgtgtttgtagtcccagccactcaagaggcagaggtgagaggactgcttgagtctgggaggttgaggttgtagtgagctgtgatggcgccactgcattccaggctgggcgacagagccagattctgtcagaaagaaagagaaaaaggaagagagaaagaaagagagagaaagaaagaagaaagaaagaaagaaagaaggaaggaaggaaggaaggaaggaaggaaggaaggaaggaaggaaaaagaaagaaagaaagaaagaaagaaagaaagaaagaaaaaaaagaaaagaaagaaaagaaaagaagggagggagggaaggaaggaagggaaagagagagagagaaagaaagaaggcggggaggggaggggagagggacaaagaaaaagaaaaagaaataaatgatggtggactaaaaataatcttggaaatggcgaggagtaaatggattccagagagaattaagaagtagaatctacagggcttagggattgtgtaaatatgaaggacaatgatgagaacagaaaggaggaaaagatggctccttattttgtgtctctgtggatggcatgtaatcttctaagatagaaaacagtgagggagaaacaagtccagtagggaggtaagtttagggcctgttaaattcaaagaatctgtggaacattcatgtggcagtgtccagttggcagtccagtgcttggccctgagcctcaagacaggctggatatttagccccatcaacctgtaattggtaattgactcacagggtgagtgagatagggtgcggagtgagaagagcagagttcctactctactaatcatagtatagcaggagggctttctcctatatccagctgttgatctttgtaaaacacaatctaatccatgatttctctgaatttcgtataagaactgttcttaaaaggcttacagggtgtcatattacaaactgaaaccagagacctgcacaaaaaaaggagactatcataaaaaataaagaataagtggtcttttccaacatttttgtttggttcaaagtcagatttaagcttaaatatgactcattctctattttctttctttttttctgagacagagtttcactcttgttgcccagtctggagtgcaatggcacgatctcggctcactgcaacctccacctcccagattcaagcaattctcctgccgcagcctcccaagtagctgggattacaggcgtatgccaccacatccagctaattttgtatttttttagtacagacagggtttcaccatgttggtcaagctgatcttgaactcctgacctcaggttatccacctgcctcagctccccatagtgctaggattacaggcgtgagccattgcacccagcttcattctatattttctataagaacttacatgctgaataaaatatctctaatattattataacaaaaggagcttctgctactaataggccaaatttatgcctcattcacacaggaaaatgaatggattaaaatccagcatcagcaccagcagaggtcttaggttatcaagggcctctttaaaatttgacctctcataacctaacatagttcttccccaatatgggcaattgacgtttcctgtattttacatgaagtgctataaaaatgtgactccaagccaggccttttcagtctgccacccctaggcccctctaaatggaaattctgagccaccttagttgcagtggtcatcacaagatgggattgaggtttagctgaatccattttgtctttcttttcttttagaaggcatcacaggaggcctctgcatgatgtggcttccaaagactcaaggaccacccacattacaagtctggattgaggaaggcagaaatggagattcaaacaccacgtcttctattattttattaatcaatctgtagacatgtgtccccactgcagggagtgaactgctccaagggagaaacttctgggagcctccaaactcctagctgtctcatcccttgccctggagagacggcagaaccatggcattttatagctgctgctgggtcctcttggcactcacctggcacacctctgcctacgggccagaccagcgagcccaaaagaagggggacattatccttggggggctctttcctattcattttggagtagcagctaaagatcaagatctcaaatcaaggccggagtctgtggaatgtatcaggtaagaagaggggcctaatctgccaatctcttctcttctgagtggttggagaaaagctgcaccaaacgcaaaataattttttcaaactttgtcctatcttttcaagaatagtgattgattggtaatcatgctgaagcttattgcccccacaacctgccttttttttcctgaagacttctttttaaataaaatgtcaatgatattaagtagaaaatccatgcatggcctgttaaagcacctggtggtcatttggtgaccaagttatcatcgttcacctggcagcagtgttgcttaatggaagactaagtacctagaaggaaatttattgcaggtcttgcaaacctgagtagtaaaatcccccattgaccttacatgctccaatggatagtaatacctgagtgctggctgcctcactctttttcttttttttctttcttttttttaaggcatttaagttgaaagaaaccacagtagtcagcatgacccaggcatcttcaaactgtaaaatgtagtccatagcattttggaactactgccatcaaaaagtcttttgcataggaaggttatccccccttgccaccctccccaccccccatccaccctgccaagaatgcatctcactctctcaatagattctctctgtggccacttgaagagagctaatatgtctcatcaaatattttcttctccaagccacatagtctgttttatcatcattttctccatgatatgctttccagacccgtcatcatcctggttgtcctccatctgatgccccctaatttactgcgacccttttagaatatagtctccagggtgaggcacatctctttaaatgggatctgacttctgcagaatatggttgggactgtttatcacctcccctaatctacactggagactgactgtgctccaaatcttgacccatcttctagagagacttgcaacttccagaagggatccagcacttttccttgctcttcccaatagctggaaaatgaaaatgaaaactaggattgttccaataaaactggatttctgttcatgttctaatgagagctagtaaattgataatattttcacatttttcttatgaatgcaggaaatctaagtgcagaatcgcactgatgctgatgatatccttcacataacccatgtggacaaatactctgttgtaccctgctgcacagagctgtacatgtgccatgtgtatacagacctaagatcaagcaagaggcttgccctaaaataatatatatttttaaattatgttaaagataataaaattagcttagcagcaaagatgtttaatgtaaaaaaaatctgtaatatttcataataactttgtagatttaaaacaaatagttaaacaaatacatgaaggaaacttaaagaaaatggtaacagaaaacatcacattaaaagttagaccaagagcttagggaacctaacaatacaatggagtataaaagattgtatatctcacctcctgtcactgtcactgagttcaagtagtgaaacccacaatataaagaacctggtgagttgttttttcctctagacacaaatacactgattcagcacatttactgagccctgactctgagcaaagtgctagggaagtgaaaactatgtcactgaccctatttctcttgttaacttgtttgatttttatttaaaatgttcttctttgaaaagcaatgcatgttcattttttagatataaagtataaataagccaaaagcacataattttaaaactcagcattccacctcccagaaataaccactgttgtacaccccagactgtctgtgtatggccttcataggtttgttatttgtttacaaaaatgagatcattcacgtccctttccccttgaccttcaggaatgtcatagtctaaacatatgactctgcaaatctgatctgaggttatttttaggcacccacatattaatatcctaatgtatttatgttttcctggtccttttcttgtacatctacatattgcttttatttaagtacctcatatcagctacttcaaattcattactgcagaagacagatacaaattattcaatgaattacaaatagcaatcttttattcttctttttatttttattattgtcattattgctctctgtctctgtgtgaggcaccatgctgaagattttgcataattagctcatgtcatgatcttcacagtcaccctatgaggcaagtgtcatcctccttttatttttatttattcatttatttttgagatggagtctcacgctatcacccaggctggagtgcagtggcacaatctcagctcactgcaacttccatctcccagattcaagcaattctcctgcctcagcctcccctgtagctgggattacagacacctgccaccacacctggctaatttttgtatttttaatagagacggggtttcgccatgtttttggccaggctggttttgaactctggacctcaagtgatccacccgcctcggcctcccgaagtgctgagattacaggcgtgagccaccacgcccggccatgtcatccccattttaacagagagggctctgtacagagcatgccatgaagccagagagtagtaacagttcgatgattcaaacccagctttgccaggtctttactctaaagtcgttgactagaaagcttcccattttcttccacttcttctttcttccaggtataatttccgtgggtttcgctggttacaggctatgatatttgccatagaggagataaacagcagcccagcccttcttcccaacttgacgctgggatacaggatatttgacacttgcaacaccgtttctaaggccttggaagccaccctgagttttgttgctcaaaacaaaattgattctttgaaccttgatgagttctgcaactgctcagagcacattccctctacgattgctgtggtgggagcaactggctcaggcgtctccacggcagtggcaaatctgctggggctcttctacattccccaggtactcaagccttctcaggcggggcactgggagcaggatcagaagaagcaggcttgggggtgccatgcccaatagccatacggtttaccatattcccatctctggcacaaaagacctatgatttagttgatatgctgtatcatgaccatttgggatttctgaaactccagtgtccacaatatcaatgataccttcactatgcttccaaaattcttttaaatgtaccttgcataaaactgtgtctttttttaaaaagaggcattcagttatttatttcccactctattcctttagtaaattttttttccttctacttttactaaaaggaatcagagcatatgaggtaaatcccacctctcaaatccaaaatatctgtcccgaattccatttcctgaaaagtctcgctgctccactgtctcattgaaactttagctcagagggaagcagagcatattttctcacaaaacaggaacttaatcattgtgttgcacattccagaaacggagaaaattctatttcattcaaaaaatatttattgagcatatatgtataagcggtctccactttgcgggaacttagcctaggtggagagatggttgcgtttccatttactaacagtttattgaagcaagtgctttaataaacattcagtggtgcatttttttcaccaaaaaaagataacaaatgtgaagtgccattttataacctgacattttccttcttaacgctatagagcaaagcatttttcagtttaatatttataaatctatgacatcattttataatagtgaaaaaatggaaacaacctaaatgtctgtgggtgggagaatcagctcaattgtgatgcatccttacatcaagtttgaaattaaactataaactataccttaaatttattttttgaatgtttaatatttaaaatttgtaagagtacctttgataaatttacatttctatgttgggagggctccttttttttttttttttttttggtgattgccattatctctttatatacatgagacaagagatagttttgtcatcattgacggaatccttacttcagggaattaaaggtgtttcccatggggaagccctggctttgtaacttttgtgccaaagtgatctgacaaagcctgtatcagtaaatgtgctgcgtatattcaaacttagatacacgttaaagtaagttattgttaccccatggccaacaggctaagatgtcaagtaaagaaagaacatgaaaaggggaggggcgtgttaattctttgtgttttggatgaaagataaggttaagttgagtttgaattataaaagtgctttgattatcaatcaaaccaatataagtctatctacagtaggggttctctgccatgtctgccatggctacctattggaatcacttagagagctttaaaaatactggtgcctaagtcccactccgcaaagatcaaggtttaattgagctgagatgcagcctaggtgtcgggaggttttaacactctggaagtgattctaatgtgcagctgggctgggaaccactgccctgccgggtgaggtcatggacccaggggtatttcgtatgccagccacgccaccaagtggatggaacaagcagaccagctagacaaattgcggttggaacagttttctgaatcattcttgaaattctcccctcttacaataaaaaaaagttttgtgtgtttctgaggggttttttggggggttggggcacaaaatggtatttaccccactttagagttgctttttaaaaacttggtaaacattataaatacgttccttaagagaacatatccatgaggaatattattgtttttgatttttattccattgaagcccttttgacctatttttgaaaaactcaagaagcaagcaataatggatggattttttaaaatggtaggttttgtgtttgcaaaaatctgatttagaggcctattgtttgggtctgctaacagaattctctgaaaaacaataacatctaaacaaattacttaatttaaccacctgcctcataagttctgtggtatttcgagaataccttattctgataagggaaaaaattatcaattttatactataacttctaaaataaaagctcttgtcagaaaacagtcatacttactttttagtcaagttggcctaatttttttacagaccaacgccttttatgtttctaatgtagaaactatccatcaataagaagaaacacattggaaatttttttttttttttttttgagatggagtctggctctgtcacccaggctggagtgcagtggcaggatctcagctcactgcaagctctgcctcccgggttcacgccattctcctgcctcagcctcccgagtagctgggactacaggcgcccgccaccacgcccggctaattttttgtatttttagtcgagacggggtttcaccgtgttagccaggatggtctggaaatttttacttaaaaatattggacatggaaaattaattgttttaaatggtgaaagatattaaaaaggcattctcccaaatacctttgacttgttttcttaagaagtttaaaatctctctggaaaaactagagaacacaagatattaagctacttcatttcctagaagaaattccatttgtgtaaaaatgtttcgttcttcagaaaaaatggtcccataacttggaacttcctaagtggtgagccatgatgacacagagtgctgcaaatgagctgaagccggcctcatcaaagatgtggatctcctcaagtgttggggtgaccaggtggggcctgagtggtcagagcactcccaccagggttgatcagcttcctctgtttgctccatgtgttgccataatgtgaaaagaagtgggaaagctctgcactaactaatgctttacatggtatttggctacttcttcaagcaacgatctcttaacatcaagggcaagactttcttcccttggtagtccacacccttgctcagatgcagaagtggctatgtcttagagagtgcaaacatgtcaagacagcttctccagggttcctgttcagcctcttaagattttcaagacccatatcaaaagcctgtcaagcaggctcagccatcacctataactgaataaaggaaagggctctggaaggtgcttcccaatggaagattcttcacaatgcgaccttcaaaagtgggtctgctaacaatgagttaatgggtgcagcacaccaacatggcacatgtatacatatgtaacaaacctgcacgttgtgcacaagtaccctagaacttaaagtataataaaaaaaaaaaaaaagtgggtctggccataaaatcaatccaacaatagtgggatggagaggaagggaggtttttctgatgatatttaattacatacgtcattgttattgtgatacagggggattgagcctagtggtcttagtggtctaattgagcctaaaagaaacagttctcagaaatgactgcaattaagcttagttttttctaaagtactggggtgcggggaggagagggaggaggaggaataaccagaggaggggaagagagaaattaggcagaataagaaaagggaattcccggggactcctctgaagagccttaagtttataatccatggggaacccgattccttccacaggcaaattatgaacaaagtgtttattgcagtaaagggaagttaaactcttcagatcagaagctgagcccaacaagccaaagttgtgtacatggatatattataaccaatgaggcagcacagaggaggttagagaagacatgaaacggtgcataaagactcttcttgaaaggctaagtacatcccactattgttgggttgattttatggccagacccagttttgaagttagcattgtgaagaatcatccattgggaattgggatgctccctcaaagactgaaaggtgcttaagtgctcactctggagtggaacagatgctgcttttccttaccctttctttcatcctgtatacagtgaacagcatagttgataaatgagaccaaggcatgctcagaaagccacctccacaacagcctggaggctcactcagcacctcttcactcactcactcactcattcaccatgttcttggttctctccaggtcagttatgcctcctccagcagactcctcagcaacaagaatcaattcaagtctttcctccgaaccatccccaatgatgagcaccaggccactgccatggcagacatcatcgagtatttccgctggaactgggtgggcacaattgcagctgatgacgactatgggcggccggggattgagaaattccgagaggaagctgaggaaagggatatctgcatcgacttcagtgaactcatctcccagtactctgatgaggaagagatccagcatgtggtagaggtgattcaaaattccacggccaaagtcatcgtggttttctccagtggcccagatcttgagcccctcatcaaggagattgtccggcgcaatatcacgggcaagatctggctggccagcgaggcctgggccagctcctccctgatcgccatgcctcagtacttccacgtggttggcggcaccattggattcgctctgaaggctgggcagatcccaggcttccgggaattcctgaagaaggtccatcccaggaagtctgtccacaatggttttgccaaggagttttgggaagaaacatttaactgccacctccaagaaggtgcaaaaggacctttacctgtggacacctttctgagaggtcacgaagaaagtggcgacaggtttagcaacagctcgacagccttccgacccctctgtacaggggatgagaacatcagcagtgtcgagaccccttacatagattacacgcatttacggatatcctacaatgtgtacttagcagtctactccattgcccacgccttgcaagatatatatacctgcttacctgggagagggctcttcaccaatggctcctgtgcagacatcaagaaagttgaggcgtggcaggtgcgtccttcacttatatagcaatttgctgtataataaagcagagttgggctgcaactccaggcaagaaaaatagtggtcatttgaaaagggcaatatttaaatgaagccactaaatggagctttggattcaaagtaccttttttaaatcttgagcaactgatttgaacaaaattgatagtaatttgattatctatttaaagccttgagtcaactgttctttagtccagtgattcagaataactgaagtatggtccccaaaagttttcaaatatcccagaacagatttagtaatgagtggggtatttttctaatgtctaaattatcaatattgttcccttgtgagtaagaagtattttttgagtacctattacattccatatactaagtggcataaagctagtattattgtgtttagccaccacttttgccattacattactgacagcctataccaagccacccagcaggtcagctaagcacagcttaggacaaaagcaaatcaaagacacagaaaacaaaaactctttgtaaaaagatttgatattgagtgtttcaaaaagaagcactgaagtggttatcatagaaaaaatcagaacttaagaggagttcccacacttgtttagccttgttttgtatttttgaattacacacaggagagacatcataatctttttcatttcaagagcttatatcctaaatagctgttcgggtcttgcatatgtgccttatttttttcaatcagaccatgtttcacactccttttgtattttccttagttccaaactgacctatcagagagattgcatgacagtggagagggcgggaattcctgaatttgaatggaatgtgccagcctccagctcccccatttcctagctgtgtgatcttaggcaaaccatggctgtaagtcacagtgtctccatctgtgacacagacttaatgtctagcttactttccactcaatgttcttttgacttaggttcatgacattaaatgacatgatatatgtaaaagcaatttgtaaactttcaagctctaaacagatgtgtgattattatagtaggatttcagtacagctctaattaatccatgaattaggtaaaaatgataactagaacacctttgtatacagaacccaaccaccacaaaccctttgggaaggataccaagaagcaaaaagcacacaacttgtatcagtcactgtagagattctcatgaaagacaaggagtgactgtctaagttggtcaaataggccagaatcttcaagttctcagcccttcttatatgggaacctcttacccaaccatcactgttggctaaagtttctaacttctgtggggtactcagagcttctttcttcacacggaacccctaccttgccaagatagaggtgctgtaataaaggtcaggcactctaaagtcttcaggagtgatgatgctaaggtatggggttttaagtaggaggagtaagggagcaatcttctaggtggttgttactattgtcttttctttcttacctctcacgtccaatgcaaggaggacctcagttcttgaaaaaactgcaagacaagagtagggttgaaggaaaaacaggcttcaagggggaaacttggcagttctactcttcaatggctcctcttccagataaggaaataaaatacagatggtcaagaccagaccttggacctgtgagaaaaaaaaaaaagccatgacaggctacagtcacaactgggacttttagttgtgtaatagaaagccctaaccaaattggcataaacaaaaaaagaggaaatgtagtgagtgggtcatgtcactaaaaatctcagaagtgttccaggtacagctaggtattttcatctcatctttctgttcttcattccccagggttagcaattttcagcttctgtagcagcttgaagctaggatctccttacttcccaagatatcctgtaaaagttccagaaaccacatttattgaccattcctaagtcatggatccatccctgatgctagcagtcctccagactacatagacttagagtaaggggggagtgaatctccagtgggaagtcaggatgccattaccaaaaggaggaagaaatagaagcaaagcagccaacattcaaaatgtccactacacagacacttcacccaaccatggcccaggtaaagatatgttctcctgactcttacatggtctggaaaaatctccccaggagacagcacagataggaaaatgggatcagaactctagggaggaatgacatgggaaattggccaaaatgtcctgagtgcttggtgtgagtctcctttgagcctcaggaacccaggctgttggatgggcgttccagaatttgaggtcttggccaggagatgaactagcaattattcattctcattattaagacctatatcttcatcaggaaatcaactagcaattattcattcattctcaatattaagatctatatggaaacttatcacctataatctaatccaagtctccagctggaactccatgtctgccttctctcagttcttcccctataagccaacctgcatgacacctcctcacaaatcactcattagtttttggcacagcatctttgcataggccatagcccacaccagaagggccatcaatttttatctctgctgtcattttccaccaggaacatttaaattgttttcaaaatccactttcccctggaagtcttttcaaatcgtattcccacaacacattttctgatcattctcgcttcctcatttttgatgtttatatacccagcttaagcttccacagctctttaattgactgaaatagacacttattagttaaaattctggttataagggtcaatcacaatttttttcctttctttctccccaaaaaaatatttatcagtcaactcatatgcctcaaaagtagcactagcaggtgatttatgagcatacaactcacaattgcctcctgacctcttcttggagacccccaagccctcctcacatcccttcccagctctctcttcactactcctttgctgtactctaagcttcataagatccagaaccatgcctgtattgttcagtactatgttcagaatgcctgtcgctggaatattcattgaatgaatgaatgagtgaatagcagtctagttgatttgacctgtcaacactacctataggcctttgcagggaaccgtttgagccaacaacccattcttgaatcaatcactgtggccaaggtattctaggctctgtttggacaagctttggtcacgtgcccactatcaagtttgagtggaacatcatgtaagtatgaaatcaccttctttcttctctcaggatgatcatgcacaaggtgtgcttcctactctcctgcacctcacaccaacactcactagtcagaaaacaggcgtgcagccatggtgaagatggaagtcagatggagctgatctttctaggaattcctggtactgctggaagttggggaatgggggataaattgtgaggacagccagagaagatggaagggagataagaaaacatggctggcgttagagaagggaattgggcctggatcttccccatgctcttaccacaggaactgggcaagataatgaacttcattatcttgttcattatctgtgtgacctggccctcattatctgtataagagctggaagtcctagaccagagtgggggggtttctagtctctaatgttcagtttaattcaattgacgctactaagaatgtgtgccaagaggtgatttccatttatgcttataatgagcaaccgtttgactttaaaatcttttaggggaaataccctaaaagaccacaagatgggaatattatggcataaaagagtatgttagcttctaagtgcatgcatgtcctgtatttgcccctcttttagatctatgtgtctttcttggtggtgttttctttgtgagcctgtaagtctctttgtgtctgtatgttatgttctatgttcagatctttttgtttgtttgtgttttgtttttttgaggcagagtcttgctctgtcacccaggctggaatgcagcggcccgatcttggctcactgcaaactccgcctcccaggttcaagcagtactcctatgtttggatctttctactagctttttttgtttctcttccccttcgtttattctttttcctcatattactccccaaataaaataaataatttggaagcatataatattggataataatctcaagtaaaattttatatttcattttaaaaggaactgtcagttcctttttaaaagcaaaagaagccaggggcagtggctcacacctatagtctcaacactttgggaggccacagtgggtggatcatgaggtcagaagttcgagaccagcctgggtaacgtggtgaaaccctgtctctactaaaaatacaaaaaattagccgggtgtggtggcaggcacctgtagtcccagctgctcaggaggctgaggcaggagaattgcttgaacctagaaagcataaattgcagtgagccaagatcgcaccactgcactccagcctgggcaacagagcgagactccgtctcaaaataaataaataaataataaaaagagtgttctctctcgggcagatatctaaattatcttctaacttatgttgctttttttgtggatcaatcattatcaatttaaagattccctgtcattgctcttaggagtgaaatggttttcatctccatcttccctgttatgtgaattaaaggcaagatattatgcagaaaataaaacgcccaaatgcaaaacttgcaagtcagcctgccaaaagaaatattaaagatgtttaaagaggtgacttagagatatgacttggtaagcataataatttattgattataagtggataacgtacaaattttgagtagaaaatattccacactcatgtgattttatttatatacctgctgtgaggacatagtacaatacaattcaggttaggatttgaagtaaggaaaaaaaaatatcatttgagacgagtcttgaagggtagataaaatttgtggatacggagaaggatctactccttggaggaaaggtcacaaaatgtcctgctaagcaaaagaatactgactaaaaaaaaatagtacatagtgtatgatttcatttatgcgatactctgtctctactgacagaaagaaagcagatcagtggtggcctaaggctgcaagtgggtagaggttgactttcagggacaccacagaaccttttgggaaggtggcagtggtagttaccaagcatatacatttgcccaaattcagaactatacacttaaaatgagtgtatataaattatacctcaaaaaagttgataaaaaaaataacggaaagtccccaggtggggaagtcctggctactcatggagatcaggatgtcattcaggttagaccattttcccacttatggcccctcatgttgccacaagcattacacatctctaccatttcatttttaaaatatgtccattttctcaacctacattttataccagttaacctgttgtaactagagataggcaacttaatagatgtctaatttcactcctgcatgtgagtaggtagtatagtgtaatggttaacagtttggaatctcaagccagactgagttggtttaaattttaattgccacctaattgccttatgaccttgggcagtcacttagtgtccttgtgcctcacttttctctctcacctgagaaatagagatcatgaaacttgttaagtttattatgaggataccattacttaatatgcacagagtgcttaggatagtgcctatatactatgtgcagtaaatattagtcttgagtattattcttttgtaggtgaggagggtaagacccagagaagtcagaatgattttcctaaagtaatatatctagctagtaaaaaagctacatctgctccaggtgatctgttccccaaagaggccaaaggagttgctaaaagaatgacttttgccctctgggcaccacatgccttctagctcctgagaggctgccagatcagccagtggtttccaagtgaagacactggtccactgccttgaaccctgggtgttcaacaattgtcctgacacctcggtccttacacaaagagaaagtatagtgtgcaaataattgagagtgcacacagccaaccaggttggagtctattagacatctctgtccatcttgaatattactgtatttcttctttctaaaacagtgcctgcttggccagtagtggtccctcaataaatacttgttgaataaacaaatgaataaagaaagaaaatgggacaaaaataactcctgagaggacagtggaggacagtaacacagtacctagatacaggcacagataagggaggtcagtgatctcagagaagtggtcagaaaactctcacacaagaaaccacagtaatgctgacttcataaactggggctggaacttagctctgcattgttaacaaagtaaattacatgaaggaaagcatgttttggtaaggattttaagagtataaacagggttattgaggcataaagatccagaaaccattaaattttaaattattcttgtatttttaactgatgtaggcctcctaagaatctttatcaggaacaatttattagcctaatttgtactaataaatatgcctaaaagaagaaaagaagcaactttaaaaaaattattttggcctttttatttgtttgcttgtttttgtttatttcagtttagaatttagatcatattttcaatcttactcggcctgattcagcccaattgaactggttagaactcccagtataatcttgtatagatatagtgaggacagacattactgtctgcatctgatcagggggaaagcattcagtcttttaccactgagtatgatgttaactttcatagatgccctttatagagttgagaaagttcccttttattcctatattgccgagagcttttatcaggaatggaggttggatgtcatcagtgctttttctgtatctattcagaaaatcatgtggtttttcttttgtagtatgttattgtagttgaccatcaaaccaacctttcgttcctgggattaatcctacttggtcataatgtatattcctttttgtacatgtatttgtgtgtttgatttactaaaatttggttaagaaattttgcttctatgttcatgaggactattggtctaaagttttattttcttgtaatgtctttgtctggttttggtgtctgggtaatgatgacctcagaatgagtttggcagtattgacttcttttttgatgttctgtaagacttttgtagaattggtattaattcttccttaaatctttggcagcactcatcagtgaagccacctttagttggttttctttgtgggattgttttgttttgttttgagatggagtcttgctctgtcacccaggatggagtaaagtggcatgatcttggctcactgcaacctccgcctcccaggttcaagagattcttctgcctcagcctcccgagtagctgggattacaggcatgcaccaccaccaccagctaatttttgtatgtttagtagagatggggtttcaccatgtcgaccaggctcgtctctaactcctggcctcaagtgatccacccacctcggcttcccaaagtgctgggattacaggcatgaaccactgtccatggcctgtgggaaaattttgaactgaaaattcaatttatttaatggatagaatgctatttaggtatatatgagtcagctttgatagtttgtctttcaaagactttgtccacatcgtctaatttgccaaatttactggcataagtttatttataatattgtttacaatgttctcagactataattataatgtctgcagcatctgtagtgttgtcacttctcgaatttatcatattgtaaatatgcatcttctcccttttttctgatcagtctggctagagatccatcaactttattaatcttctcaaagaatcagcttttggctttagtgatttttctctatatttttgttgtctgtttcatttatttctattctgatctttgtcatctcctgtcttctgatttatttcagtttaatttgctcttctttttgtagttacttatttggaaactgaagtcattgatttaaaaacctttcttttcttataatatagacatttactgctataaatttcactataaatattttattagctgcatccctcaaattttgatatgctgtgttttcattttaattcaatttaaaatacgttccaactttccttttgatttcttctttggctctcaggtttagaagtgtgttatttggtttccaagtttccagtgatttttccaaacatttttctgttatttgtttttaatttaattccattggagtcaacatattttgtttgattttaatatttttaaatttattgaaacttgctttataatccagaatatggtttatctttataaatattttgtgttcttgaaaataatgtatattctgttgttgggatgactgttctgtaaatatcaattagatcaagttggttgatagtactgtccaagtcttttaagtcttttatatttgtattgattttctgcctacttctttcagctaatacgaatgccctattgaccttatttttctcatttatcctcagactgataaaaacctcatcatgggcatgacttgtccacatagtcatgctggacacctacaggtttaatatctattctattaattatgcactcaaaagacaaggtttgagtatccactaaaatctaggccctctacaaaccactggagatacagaaggaaataaggcagttcctgctttagagaagtttggtctaatgaagtgtgggtacaacattcctagccacaaagattccagagtgcttccttctccagataagatgtttacattgccatctcttccctcctgcctactctttatctccctgccacatccgaagttggacttgccatgtctcattactcaactcgctacaccaagtatcctagaggctaccttgttatcaaggatcctgccaactacaaatgtcggtttcactaattaattcatatttggatttttaaagtccttttccatgccttcttttttgcaacagctttataagatgtaattcacatgccatacaattcagtcatttaaagtatacaattaagtggcttttaatacattcacagttatgcaaccataaccacagtcaattttagaacattttcaccacatcaaaaagcaacctcatatcctctaactgtcactccctaggcccccaaagccccagtcttagacaaacactgatctactttctgcttctatacatttggactttcctggatatttcatataaataaaatcataaaacatatgatcttttgtgactggctgcttcttccatattgtaacatgtatcagtacttcattcctttttacagccaaatagtatcccattgtgtggatataccacattttatttatctgtttacccaattgatgaacatttggattgttcccacctttggttgttatgagtaatgttgctatgaacatttatgtacaaatgtttgtgtggacatatattttcatttctcctaggaatgcacacacacacacacacacacacacacacacacacgagtaggattgttgggtcaaatgatgactctatgtttaactttttaaggaactgccagacgttttttccaatgtggctgcaccagtttacatccccaccagcagtctatggaggaccccaagttctctacgtttcaatcagccctgtttcttatctaatccaatactttttaatgtgaaatctagcctcttttttgccttggctcctctttacttatcttctgtatttccccttgttctctagtacatacatgattcttgagaaattgatctctttactggccccataacacatcatgtttattcctaatgtgatatctttgcccatgctgttccactgtttttaacaccttccctccctctgtcctttgccagccaaaatatgcctgaaacctgcattgatcatttcagcccttttaaatttctatctcctctaagtttctctgtacttagagatgataccccatcagttagcagttaactatattttatcttgcactgtttactgcttcattgaatatttatgtcgtgcattttatcccctaatccatatgaaaactccatgaggatgggatgaccatatcttgtagttctgcagcccagttcagaacacacagtggatactctgtaaatatttcctggttgattgattccaatattataaaattccagtcttgtatttatcatgagttttttaatgactacttagaaactttaagaaaatgatttttgattgtttctcctttgaagttaggattatggtggaaatctccagcccatgccaacaataatgcagaagacttgtagccagggatgagctttaagtcacttgtctgaccagtgtgaaagatgaccagctaattatgaaaggatcttgtgcagttcccctccccacttctaccctgatgctgggagagttccactgcagagaactagtggacaaaggagaaaagcagcttgttgcctggcatgttaagaaccaaggaactgaaacctaaataggaagaagaaatgtatgctaactactagagctttaccacaatatatgcatttcaataaggatgtattactgacctctaacaaacatttgccatggacactgtaagcaatttatattagaggtgtaggatgatgttgtagaaaagccttgtttaacccgtagctccagcacttagtggctatatgacttttgcaagtttcttgacctttctatgcctccgtttcatcatctagaaaatgaagatactaatagttctaatccatagaggtgttgtgaggattaaatgatatagtatgtattaagtattagaacagggactggcacataggaagtacaaataagaggtagtttcctacctcttcacttttctcatctccttttccacacacacagacctggcatggcatgtggacaggatagtggaaactctatgattaggatgaaacatttgcactgacaagtcatggtaggtacatgggaccaaagtatggagggctttggaagctacctgaataagtttgaagcacatttcatctgagtcatggtaggtccccagcaggaagtgggaggggcacgattacagcatggagaaggatgatggccatgtcagaaaggcccccaaactgctaagagcaaggtttcgagcaatgtgggagtgagggcagtattaaagagcagaagaactgcatgttcctctgagggcaagaaggatgtgtcaggaaaaggatgtgttggggtagagacaaaaggatgtacaccactctgggtaggaggaagtcaggtcaccccaacagcgaggagggataggaagcggaggtggaggtaaaagaaaggaacacatctagaacacctcctctgcactgacggccttaaggcctcagtaaaaatgaaggcaaacataaggttgtcaaccatcagagaaggtgggaaggctcaggagaagacgagggacacaaatccttagtaggagccattctccatcttttttgaggatggctcagcagctctggttgcagaaccaggtagcagggagtgagggatccctctccttcatagacctgagttgaaagtcagggcagtcagggcctgccaatggagcagcgttcacagactgcaggttaagggaggcacccagggtgctatgcctgtgagcacacatagtctgtcatggactctgcccccaagcatgtcttggagctacttatggataaatccaagtgactcctctcctgtatttaatattccttactataaataaatgtttgtctaaaaataaagttaatacagatatcaattgttaagaagcagtgccatctctggagtggagtgggacaggagaggtactggctcagtccacgtgtttgtcacacatatcagaataatttggcctcagaaaggcctattaaggccattcattagatggactcagcccaaatgttgtcccagtgtgagattagacgttggattttaagtaccttaaaaagaatgataaatggctgggcgcagtggctcatgcctgtaactccagcactttgggaggctgaggcaggatggtcgattgagcccaggagtttgagaccagcgtaggcaacatagtgagaccttgtctctacaaaaccaaaaaaaaattagctcagaatgggagactactggagattcaggaggtgcagtggaaggtgtaccctacactcacaggctggaccctgccttactctcacgtggtgtcacagtgacacaaggctggcctcacatgaaagataagtggctgagtgcccactgcctcctcttgactgatgtcaggagcatgtgaggaagcagagccaggagcccagcgatgctgcagtagagtacagcaattaagagcgcaggattgtgaccctggacgagatacttaaagttttcagtgcctcagtttccccagaaataaaataagcttaatactatttgttgtgaggatttgattagataatggatataaagtacttagggtcgtgcctcaatggtagtaaaatgactgatatctaaaatgtttacatgacaacatgtggtatgtgttagtaattattatgatgacttttttgtgcaaaggctttgtgacatataaaaccttataaaaattcaaggatttgccatgactctgacaacaataatggccgggctttgcccacagcctcatctctttcttccttcaccccactctgtgaatcttggcagcaaagcacttccacagcagcaggatcataggaaaggaaagtgcggagaataagagcactcagtcatttctcctgtccttccccaatgcccagctcagaagatgccagggatggactctggcttataaatcctgcccctcctggggcaccaccaggtgatggcacacctgcagaacctttgacctggccagttgccaggtgagatgtctccctttcctttccccatcttcaagaaagtgtttcctaccctaatcataatttgaataataattaaagcccatggcttaacagggctgctgctaacaccggcaagtactttggtgtgaattagaaaaagctgtctcttcctcaagtcacgttcctcccactttgttggaacaagatagtctaccgttgttgtgcagggcacagcctacctaattagttctatgtggcagccctggggcttgtactcattctttgctcctctttaggtcctgaagcacctacggcatctaaactttacaaacaatatgggggagcaggtgacctttgatgagtgtggtgacctggtggggaactattccatcatcaactggcacctctccccagaggatggctccatcgtgtttaaggaagtcgggtattacaacgtctatgccaagaagggagaaagactcttcatcaacgaggagaaaatcctgtggagtgggttctccagggaggtaggtgctgtccatcagaaaaccagatgtctccaccaggggcaggaaactgtgctgggctttgggagggcctttggtttccccactggacttccaaaataaagagtccacttccctgaactctctggcctttgcaatcttggggctccctgtgaaatccacagtgtttagtgtaaagagaagaatctccagaacctgagccccatgccttcctactgtattgaaacagtttcatttttcacaaatatgactccctagctagtcacaaagtttccttggctaaaactttccctaaccagagcaaaatatttaagcaaatgtaaacatcggtcaagtcagtggctctcagctcggccaagggcaggggagacaagttttagagtggaggggactgcttttgggttgtcacaatgaccaggaagtattaatggccttcagcacttgggatccagggatactaagtgtccagcatgtgtgggacaagcttacatgacaaagaattgatcccgcctcaatggccagtaacagccattgaaagacactggagcccaaaatggagctggatgttttcacctgagtcatttggtgttgtcaccaccctcacagcctggacagttcacacagaggtagtgtgacagcccgggctgctgaactgtaaatcaaaagaacaatttattctcctcctccaggagacctgtaacaaagaggaggatgcttgtgtgtctgagtatcactgcagctagaagcctgttaataaccagaagcccacccctcagtcaatttgcacttgaggaagagaaacgtgatacactggaatgatgaccattctatgatgtttgtgtcctagaatatagcaggctgctaagaatccaggtcctctgtaagaacacagatcctagacagggcatcctcttaactctcccaggaagcctggataagacccaccacatttctatttgcatttgccttttttattatcacctttgagcatcttggaccacttttcttttttttttttttttttgagatggggtctggctctgttgcctaggctggagtgcagtggcacaatctcggctcgctgaagcctctgcctcccaggttcaagcaattctcccacctcaccctcccaagtagctggaattacaggcgcaccaccacacccagctaattgttgtatttttagtagagacggggtttcaccatgttggccaggctggtcacgaactcctgacctcaggtgatccaccctcctcagcctcccagagtgctcagatgacagacgtgagccaccatgcccagccatcttggaccactttttataacataaccaaagactcgcttcgtcttcttatcaaatgcttcttaggttgacaggttcctgatgagatgctacaacttcactgttacccagtatgtagatggattaccactgggaaggtctcccatagacagtgaatctcatccacagtgtgccgtttttaatagcttacaccccagagggtgggttcttaattataaatatgtcatgacttttccagatggagatttgggggttccagatgttatattcctctgtccactaattatacctttgtctaatttatcacgtattttcactgactggagtctaaattgatcagctatactgccacctgtttacccctgttggatcatccagtttatctttcacccccattaatgcatagaattgaattctctaatggcacatgtctctccactgcagcagggagctatctcctgtacagttctccatagccctaactgtcctctcccaggctatgtacatcatgggcttaaacattgatagatgaataacacagggaattctcattaattcagtcacttatgttcttggaatagttgacacagttataagttaaatctaatttttttccatagaaatattacctcaaacgtagcacacaatggatactcaacaaatcttaggatctactctattattttctgtgctgttgtggaaatgaccacaaaaataccacctatatttaactataaattatatattagtaacttccctatgtatttcacaaagttgttattgagatcaaatgagatcaaggatgaaaagcgtatgataaactgaatcatactactaatatataaatgcaaagtattaatatggcattatacttaactgatgttctcaattttcttacaaatgtagcactaaatttagagctagatagatctttaaagatccttgtatccaagcttccaatttgaagttgatgacactgaggttttaggatgcaaaggtgacttctcaggccaaacagatggtcagtataaaagctgagactagaccccaagggccctaacttagacctcagtgctccattccctacactgtgctgccaataattctttccttgttttgctacaacaaataagaagtaaaagagacaccttaattagggtcttggaattcagatgagcttccttggccagaattggacaggcatctttaataagactgttgaggaggcttggagatacttgactgctttttggaaaaatggatctttccggtggctacctcagcccactcctgtggtgataggatttctctttagctcatggttgctgaaggatgcagtaagcagacccagatggagacattcttctaagccttgactggtataaagcagagtttggtgtagtgaaaagtacagactttgaagactgacctgagcgcgaatctcagctctccagtcaagccattgtgtgaccttcagcctgttccttaaccattaagaagaagagaaaaagaggcaaggcagacattcctataggccctcgttatttatactcctctttttctttaaaaatagaactctattttagctagacacatgactacccagattcaagatgacatttttcagccttcatttctactaagtgcgtccccatgactaaatcctagagaatgggatgtaagtggcagtgttgtgggatggcttctgggaaccttctttaagaaagtgcttgcaagtatcctttgctctcttcttcatcccttcctctatcttgcctcctggaaaccaaatgccactatcaaggactatgaggcaaagacaaacatgtcagaaccaccaggtagaaagagtctaggtgtccaacattatggagtgctatatcactctagaccacatccctagacatttatatgagagagaaatacagttcagtcttgttgggagttattattttgagatttttggcactcacagcctagcagaaaccaagaaggaaagctactaaatttattttgtgatgataatataatcttgataccaaaaacagatagaacaatacaagcaaagacaattataggacaatattgtttgtatacgtagatgctcaaatcctaaataaaatatcaccaaacagaccagcaatgtataaaataaacatcatctgctagtagagttagtggtgaatgtacaggaacgtaatgatagccaaactttacaaagttcataaatgtagcttattacattagcagaataaaagataaaagttctgcaatgtcagtagacacagaaaaagtatctattaacatttaacacctctcaggttaaaaacaaaaatttttaacctctcaggttttaacctctcaggttaaaaacaaaaatttcattaatctaggaatagaagggaacctcactttaccttgataaaggatacagcaaccatcattcttttttcattgtatttcttttaagttctggggtacatgtgcaggatgtgcaggtttattacataggtaaatgtgtgccatggtagtttgctgcacctgtcaacccatcacctgggtattaaacccagcatgcactagctcttttccctaatgctctccaccccactaccctttcccaacaggccccagtgttgttctccaccctgtgtccatgtgttcccattgttcagctcccacttataagtgggaacatggggtgtttggttttctgttcctgcaaaacgtaattcatcacataaacagaactaaaaacaaaaaccacatgactatctcaatagacacagaaaaggccttcgataaaattcaacatcccttcatgttaaaaactctaaataaactaggtgttgaaggaacatacctcgaaataataaaagccatttatgacaaacccacagccaatatcatactgaaaaggcaaaagctggacgcattccccttgaaaactggcacaaggatgcccgctctcaccactcttattcaacataatattggaagttctggccagggcaatcaggcaagagaaagaaataaagggtattcaaataggaagagaggaagcaaccatcattctttaatggggaaaatttagaagcattcctagtgtgggtttggaaaacagggcctttagctttcattgagtgatcaaatgggttggcaactcaaggactgagagcacatctctgaggataccttgtcaccatagttgaagatgatgatgtgagttgtccttttccctcccctccccttcccttccctgggtcatgagagtcttggcaatcatcaggtccattactgcctttccattcctcattcattagaagataatgtcaatcatcttctgttcaagttttttttaactcctttgtcaagccagtcatttctgctagaaacaacgacagctactttactgctttctgtgtttgtaagacatcttacaaagtagtaggtagaggggagacccattaaatagacattatggaaatagtaaaagccctactatgtattaagcattactccaggctttgtacctggggttacaaagatgagtgagaagtgctctctacctctaagatacatatgctgttgcaaaacggacttcattcttatgatacatttcttgtctttgaaacatatacattgttagatagtaaatgactaataaattcctagaatgaataatcaattagctggtgcaaagaatgagatagaagcaggacttcttgaaatggtgaagcaatgataaaattgaacaaaactggacaaaaaccactgaagaacctggaagttaaccagaagcacacaacaaaaggtgaagggttttgtttatttgttttgttttgttttgtttttaacaaaaactaatgaaattctggtaagaacactggtagtctatggcattttagcctgggcctgctcttcagttgtttctaataattcggttgttcttttgggttttctttatggcaaccatatcatctgcaaataactacagttttatttggtccttttcaaaatgtatgcacttatttttcttgtctgattccactagctaagacctccagtgcaaagttaaagagtagtggtgatagtggatatccttgttttaaatggaaatacttttaatgttttctctatatgaatgatgtttactctaagaggttttttgttaccctttttcaagttaaagatatttcttcccactccttttttactaagcttttatcaatagtttgtgttggatttcatcaaatgctttttatttatctgttggtgatcatatgattttttttctccattaatttgctaatgcagtgaataatacttatagatttgtctaatattagacttttttgcactcctgagcataaacccaccatggtcatgatgcattttctttcttatgtcctttgagtctgttgtctagtgttttagtatttttcatctgttttcaagtagtagaaagtagtggcgcttttcccagatcatcatagaatcccaagggtgtgtgtctgtgtatgtgtgcatgcacatgtgtgtgtgtgtgtgcatgtatacacacacactttcccatagtcatctgtccctttcacagatatcagaaccaaggacctctggacctccctttgcctggaatgggcccaacgtctgtcacactgattcttgtgcccaaactcctccctcttacatgttttgaagagacagtagggctggcccctgaccctacaactacagccactcacctttgtgctgtctgtcctccaggtgcccttctccaactgcagccgagactgcctggcagggaccaggaaagggatcattgagggggagcccacctgctgctttgagtgtgtggagtgtcctgatggggagtatagtgatgagacaggtaagggaacccctcttgggcactgtgcagggcttggtccacttcggaggcctggggtcagtgaagcccatggaagggctgggctgagatggtgctttgcacagtttctcatttaacaaaggtatatctgagcatcacaaaatgttgggcatggaggtggaacagaaaaagaatgttagatgttcttttaataccataaaagataacaatacctattacacatctttctcttacttcatattgtcggccaatatatttcctttttgttagagtttagtggccctgcatggacacagttatgtctgctccagactccagagttaataggccatcatagaattgcctgctgggtgcctggcactgaatttgctatcttacttgtgtttttcctgtttctcaggttatttttaggtgggaataataattaaacctatcctatagaattttgagaattagatgattaatattggtaatgcacatggtaagttctagataaatatttgttaaataaaactttggcatattagaagtactctataaatattaactatagttgatattatctcatgttatcctcaccccagtgatggggttattgctgctcccattttataaattaggaaactgaggctctgagaggttaagaagcttgatcaaagtcacatcactagtaagttgtatggccaggattccatccagatctctaactccaaaacccatgctcccttcactgcccaaaactgcatactgcctgggagttagcagagacttagtaaacagttgtcagttgaatgagtctgcagcctccctcatcaaaaagctgtggatgtggagtgaggaaagcacaggtcatgtgcatgggatactctgccttgatctaaaaggaagtctgctctggcatgtctacaaagcccatccatatatccaaaataaatcactctccatgtgagatgtcagatatgttcatttgcctcactagagtagccagtttactgcccatatgtatcccacaacattatgttgtaaacctcaaatattacccaataatatttaaataaataaatcaggctaagcttgaatcattctgcgaagagttgatggaccatgctagacctctggtgtgcagggcagccacctgtccagcaaggttgatcattccctgccatcagaagatagtgttaagtgaaacaagggcctcacccatgtcatgtgcaaagggaaaacaaactaacaatagaaccatcagagttacatgaaattaaccatgttattaaacatgtcggggttcagcatatttttgataatgtaaaaatcagaatgatttcatcaaaatggagaaaatatgtagtgaccacatccaaaaaactatgtattcccaccaccacatgtacactcacacattttagtctgtgccacacaataactcactcttcactgggacattttacagatgccagtgcctgtaacaagtgcccagatgacttctggtccaatgagaaccacacctcctgcattgccaaggagatcgagtttctgtcgtggacggagccctttgggatcgcactcaccctctttgccgtgctgggcattttcctgacagcctttgtgctgggtgtgtttatcaagttccgcaacacacccattgtcaaggccaccaaccgagagctctcctacctcctcctcttctccctgctctgctgcttctccagctccctgttcttcatcggggagccccaggactggacgtgccgcctgcgccagccggcctttggcatcagcttcgtgctctgcatctcatgcatcctggtgaaaaccaaccgtgtcctcctggtgtttgaggccaagatccccaccagcttccaccgcaagtggtgggggctcaacctgcagttcctgctggttttcctctgcaccttcatgcagattgtcatctgtgtgatctggctctacaccgcgcccccgtcaagctaccgcaaccaggagctggaggatgagatcatcttcatcacgtgccacgagggctccctcatggccctgggcttcctgatcggctacacctgcctgctggctgccatctgcttcttctttgccttcaagtcccggaagctgccggagaacttcaatgaagccaagttcatcaccttcagcatgctcatcttcttcatcgtctggatctccttcattccagcctatgccagcacctatggcaagtttgtctctgccgtagaggtgattgccatcctggcagccagctttggcttgctggcgtgcatcttcttcaacaagatctacatcattctcttcaagccatcccgcaacaccatcgaggaggtgcgttgcagcaccgcagctcacgctttcaaggtggctgcccgggccacgctgcgccgcagcaacgtctcccgcaagcggtccagcagccttggaggctccacgggatccaccccctcctcctccatcagcagcaagagcaacagcgaagacccattcccacagcccgagaggcagaagcagcagcagccgctggccctaacccagcaagagcagcagcagcagcccctgaccctcccacagcagcaacgatctcagcagcagcccagatgcaagcagaaggtcatctttggcagcggcacggtcaccttctcactgagctttgatgagcctcagaagaacgccatggcccacaggaattctacgcaccagaactccctggaggcccagaaaagcagcgatacgctgacccgacacgagccattactcccgctgcagtgcggggaaacggacttagatctgaccgtccaggaaacaggtctgcaaggacctgtgggtggagaccagcggccagaggtggaggaccctgaagagttgtccccagcacttgtagtgtccagttcacagagctttgtcatcagtggtggaggcagcactgttacagaaaacgtagtgaattcataaaatggaaggagaagactgggctagggagaatgcagagaggtttcttggggtcccagggaagaggaatcgccccagactcctttcctctgaggaagaagggataatagacacatcaaatgccccgaatttagtcacaccatcttaaatgacagtgaattgacccatgttccctttaaaattaaaaaaaagaagagccttgtgtttctgtggttgcatttgtcaaagcattgagatctccacggtcagatttgctgttcacccacatctaatgtctcttcctctgttctatcccacccaacagctcagagatgaaactatggctttaaactaccctccagagtgtgcagactgatgggacatcaaatttgccaccactagagctgagagtctgaaagacagaatgtcaccagtcctgcccaatgccttgacaacagactgaattttaaatgttcacaacataaggagaatgtatctcctcctatttatgaaaaccatatgatattttgtctcctacctgctgctgctattatgtaacatccagaaggtttgcacccctcctataccatatgtctgcttctgtccaggacatgatactgatgccatgtttagattccaggatcacaagaatcacctcaaattgttaggaagggactgcataaaccaatgagctgtatctgtaattaatattcctatatgtagctttatccttaggaaaatgcttctgttgtaatagtccatggacaatataaactgaaaaatgtcagtctggtttatataaggcagtattattgagctctatttccccaccccactatcctcactcccataagctaagccttatgtgagccccttcagggactcaagggtccagaagtccctcccatctctaccccaaagaattcctgaagccagatccaccctatccctgtacagagtaagttctcaattattggcctgctaatagctgctagggtaggaaagcgtggttccaagaaagatccaccctcaaatgtcagagctatgttccctccagcagtggtattaatactgccggtcacccaggctctggagccagagagacagaccggggttcaagccatggcttcgtcatttgcaagctgagtgactgtaggcagggaaccttaacctctctaagccacagcttcttcatctttaaaataaggataataatcattctttcccctcagagctcttatgtggattaaacgagataatgtatataaagtactttagcctggtacctagcacacaataagcattcaataaatattagttaatattattactgatactgtaataattattttttcccttacttcaaatacaaaacaaaacatacatattaaccattcagattgtactgcctagcccactgatcacaatcactctctctgtaataagcccaagagctctgggcccaacacatggggtcagccatagtatcactggctcatggtgaggaagccagaaagctggtcagcccctcaggtggcccaatgccctgtctccgcagtgtcagggcctggacctccagcatccagggaagaccatcaccagtctagcaggaggttctaagctgaggccaaaccattgcaattaaatctcctgaagcctcaaattttacagctcttggtgacttcttcccctgaccactttcttccaaaggggcgcctttcagtgatttgtagggcaaattggtggacttgatagttgttaagattataatgagaaatcattagagggcaccatgtgggagcgcgactgtgagcagaaggtggtgactcaggatgacccaagtgaggtgcctgctccccacctaggaagggcaccggcccccacccagcctgcgcccccctgcagtcatgcctctgagcaaggcaccgagctgagtggggatttatatttaacattttacttggtcttaaaagaaatgctgaaaatgtgatggtttcaaaataactatgagggaacagcctcaacagaatgtgacatacttctccctccagggtttgacttcaatgtccatgtcacccaaggggctttaggaggaaaacataggtttacagtgagcttttatttcaccaagtgcttgcaaataaggagtctctcccaatgctgttgtcagaaaggcagatacagaaacactgtcccaatttatacgtagcaggcacaactcagcacaaaatcaggggtgtgaaatatgaacttgcattgtttttctacaacaacttaatttctatctcaaattcccctccagcctagtgacagaaacttcatcttagtcgaatcggggttttcacagtaacctcagtgttttctgagccaatttagatgtttggggatcaattcagaggttgttccttctcccttccaggagggcttttgtaatgttggggtgggcctcctcagtcatcagcagctccctcatgacattgctgaaagcaatcttatctggccttcgctggcgtgctctgaggcattgtatcctcatctggtcccatcatgggtttcgtggtggttttcacgcatgcctcactgtcctaaccagtcggtccctgtggggcctgctagctcttgcagctacctccatgctcatccctgaggcccagaaatcactggcagcctcactttcatgtctacttgactgctgtctccccatgacagtacacagagcttatggaggctaacaaagcttccagggtaccagagaagaaacagggtacatgtctccaaacctgaatagacttcgtagtgggcaaataatggtcacccaaagatgcccacatcctcatctctagaacctatggctatgttgttacatggcaagggtgaattaaagtatagtggaattaagattgctaatcagctgaccttgagataggaagagcgtcccaaattatccaggtgggtccagtggaatcccaagggcccttaaatgtggacgaagcagaagagtcagtgtgagagcaatacagtatgagaaaaacaccactggcctgtactgcctttgcgtagggaagtggacatgagctgaggaaggcaggctgcttctagaagctggcaaatgccagaaaaccgattctcccctaaaacatccagaaaggaatgcagccctgccaacatcttgattttagcccagtgacacccttgtaggactttggacctccagatctgtaagataatacatttgtgttgttttaagccatgaagtttatagtaatttgtttcagcagcaacagaaaacaaatacatttgtattgttatctccttccctgagttttggcagccagagcctgtctcagagatctattcctgttctcactgtggtcctcttcccttcacctagctcactccttcccctctaatattctattcctctacatctgcttgggaaagtataaacctcatattctaagtctttgctggctttggttatagaaaatacacagccgtgttgtctcattctattatctgtcagtagcagaaacctgaaattggtagcttcaacaaactagtgtttgcttttctcttgaataaaggaagtcaggaggtaaatatatgatcaccttttaattactttttaaaatatttcttaggttttgttaacaatgggaaactgcttacatttcttttgaaaattaaaatgaattataaagttaaaaagattttcactcaaatgaaagtgtcctagaagattttaagaatttaggttggaaatttagaggtgacgatcagcatataacatcaataccctgaaagtccctatgatcgtcacacgttgtctaattgcattaattttgattttggggaagttggggctaccctacctctgtctccaaaaggcacatttcaaggcaatgttgtctgtcgttttgctctggctgaaatcacatagctacgggctggttctgcccagccagagcttccctttgctcatctgctgcatttgaaataattattgctacaagaataatggaacatcaataaggggtgctaatcaccggaggaggtggccctcatttgtctgagcctgagtggtcattttaggagtccactggagacaagaatactcccaaaggtgggtggaattagggtaggtgggaggaagttgccacagtgagatcacagcctctgggagatgctggttttcctggcccagatcatggaaaaaaaacatcaagacttggatgacaactttgagtgactttgctattatgcaaggagtgaggcaggggtcagggaaacaacaagcacagggtagaacctgtcacaggaataaaggtgcattccaaggatccaaagaagaaccttagccttgagaggaaaagctcagcaagtggtatgagaaatggagaactgctaggtgaaggccaacagggcaggaagccgggcagagccagcatgaaggtgcctctgggaactggagggacaactgtgactctagcaccgagtggggctaggggaaccttctcctctgttgggaataaccaccacattcatcccctcccctgacccctggacaagagtggaggacacttggagtggagacaagcaggggtacctgtttaaatcaacagctgaggccagatgcagaggctcatgcctgcaatcccagcactttgggaggctgaggtgggaggatcacttgagccctaagagttgaagaccagcctgggcaacatggcaaaaccccatctctacaaacaataaaaaaaaaaaacagctggacatggtggcatgcgcctgtagtggcagataactcaggaggctgaggtggggggatctgcttgagcccaggaggtgaaggctgcattgagctgtgattgcaccactgcactccagcctgggtgacagagcaagaccctgccaaaaaaaaaaaaaaagaagaagaaaaacaattttattggtagaggcggggggaataatagagatacagcaccagctccctgcctctaaaatgtgggcacctgggtaactagatagcgcaggaagttagaacaaataaaagcagcaaactctgtgactgaagtttcagcacatggatggcaaatattttcaagtttggtgaaaataggtaagagatcaaagcccaagaataaaccctggggtcattacaggatttcctgtaaaggcatcaggaaatgtttttggaagaatgtgattgtcttcgttgatatcaacccaaagatgtggttattgttcagaatgtcctgattttctttaaatgttttgtttctatctgacctctcattataaatgagaaacttataaattataaatatacactcattataaatgaagattgcttggtaatggactaatggataattgtttctgcttctttaggatgttctaaatttttcccaagttttgtacattaagcacaaaattataacaggaaaataaagaaaagaatttaaaataaacatgcaaccaaattttaaacagataagtatatcatattagataggaatcaccatactgggtcagtcacccctcctccaaatttttctttattcttttttttttattatactttaagttttagggtacatgtgcacaacgtgcaggtttgttacatatgtatacatgtgccatgttggtgtgctgtacccattaactcgtcatttaccattaggtatatctcctaatgctatccctcccccctccccccaccccacaataggccctggtgtgtgatgttccccttcctgtgtccatgtgatctcattgttcgattcccacctatgagtgagaatacgtggtgtttggttttttgtccttgtattagtttgctgagaatgatggtttccagcttcatccatgtccctacaaaggacacgaactcctcattttttatggctgcatagtattccatggtgtatatgtgccacattttcttaatccagtctatcgttgttggacatttgggttggttccaagtctttgctattgtgaatagtgccacaataaacatatgtgtgcatgtgtctttatagcagcatgatttctaatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattataaatgaagattgcttggtagtggactaatggataattgtttctgcttctttaggattttctaaatttttcccaagttttgtatattaagcacaaaattataacaggaaaataaagaaaagaatttaaaataaacatgcaaccaaattttaaacagataagcatatcatattagataggaatcaccatattgggtcagtcacccctcctacaaatttttccagagctctaattagctcccaagagtttcatgggacttttaaatttctgaacgggccgaggacatagaatagtggaaaagagggggattctaggcagtatgacagataagttacacgtctttggatgaggcacttaagctttctttgtctcactttccactatgaaaagtacataggccaggcatggtagctcatgcctgtaatcccagcactttaggaggccaaggcaggaggatcatttgaggtcaggagtgtgagacaagcctgggcaacatggtgaaacttcatctgtacaaaaaatacaaaaaattagctgggcatgatggcatgcacctgtaatcccagctacttgggaggctgaggtggaaggctcccttgggtccaggaggcagaggttgcaatgaagcaagatgtagccactgcactccagcctgggcaacagagccagactttgtctcaaaaaaagaaaagtagatagactattacctgccataattaccaactatggttgtttgccaaataaaacaagtgatttgaaaggaacttcaggaatataggcaaaatataaataattattaaaaccatgggtgactgaagcttagagaatttgcttttgaaatctcaggaagtaccatggaatgcaatgatttcttctgtcaggtttcttagttggaggcaatagaattcactctaactagttcaagcagaaaggtacttgttatatggtattaggaagcttataacattttgggaggctcagtgatccaaatttagttgctatacaatcaggatcaattcacccaggagaaatacctaatccccctatgagggtgttctggcaaaagcttcataacctcccctgccttccacttagcaccaagacacagagaacaggacactggaaccttcactgaagctggaggaaccaaatccctctgcctgtgcttggccccactcacaccaactttccaagtctcatatcagccacatgcagagccctggctgtcaaggagtctggaaatgtagcatttgtttcccagcctctatagtggaggaagacctgctagaagagggtcagagtggctactgaacaagcccgtccgcagtgtctaccaccccaaaacaaagatttttaagatcaaacacaacatgaaaaacacactctcttaagaaaaatataagcaaaatatgatttatttttatctccacagctgtggtagatccacaagatgctgtgctggaggctgaactacacctggcattttactatgagggagaacctgctggcagaggagatggaaagacagcgggaacttgcactgcaggggagggtgctacaggggagtgtggcaacaagtgtgttttattataagccaattagtactatttgtctttttaaataacacacatatgtttgtatgtgtgtctttgtgtgtgttggtgttgtatggtaacccgacctgatagtaataagttaacaagaaatgacggtttccagatggaggttgctggggggagagtgctaagtgaacatgctatgcgaactgcatgctttttacaagaggttgaggttctcccatccagtccaccaccactgaactgccctgtatttaagtccccttcaggaaaccctgtgcctgctttgctggctccaggtctcttcttcagcctcttgaacctggtgccatccctactgcagttaatacgggtccagtacaacaagtgtctatttagtagcctggagaaaatgcataatgatttaatagtgattatgtctgggtgttagaattattagtgatttgtattttctttgtaatatttttctgagcttttgttccttaatttctttccatgagcgtaatgtatcgtaaaacaagaaaaatctgtcacttgagttctcagataggacaatattatggtcatgtttttggtttgttcatttgtttaagcttttatttggacataatttcagacttacagaaaatttgccaaaggaaaagtagtacaaagaacacttgaatccccactgcccagattcagttactgtttacattttagcccatttgctttgtcctttgtgccatggtcatttaaaaaaatgtgatgcgcattaagtacttatggatgaaatcatatgatgtctgggatttgccttaaaatactagaatggggaggaaaaaaggaataagggagagaaataaaacaggaagagcagaaaattatggtcattgaagctgggtgacaggtaaaggaaggttcgtttttctatttccctttcttttttttagttttaaatttttttccataataaaaaatgttaaaaagcagtggaaggataaaaaatactattagtcaaaaaaaaaaatcacaccaaagaatttcactgatttgactggttcaattagccacaagaaaagtttgtcaaacactcacaaaaaagagaacctgaaagtctgccaggcagctaaaattgtagttggacagcaaaaaatttaaaatcaaattaagacttttacaacaaggttaaaaagtaattctttggactatatcagaaaggccttcctggagcttaatgaaaaacaagtcccctggatcttctaacatttcatccatttatgatcttatccttaggtgaaccaactcttggctggttcacattttttatcgtcttctggcaaaatgttaaaaatttcttaacagatccttcttagcctttgtgccagaaatttctcttttatgcacagtcccaagtaaataatccaacaggcagcaaaattaattagttaccaacgtgttcaggctaaaagagaacctgtctgggccgtattgagggtaggcctgcacccggggagcactggcaactgctgacgtcctgtgagaaaaacaggagaggatccagcgcccaacacccaggctaaggaaattatgctataattccatgtcagggagcccacagacattagctgtgcaaacatgtggactatgtcaaaacacaatcaagttcaagaaataatgtttagggaagaacaggacacagaataggatatccacacaggataacatgaatacaatttcactgaaaagcaaaacgagggaataggatggaggaaactgagtttattgttcatttgcttttcttttgtaaagttacataactttgctgtaaaaaggaaggagagaggggaggaaggaagaaaagaagggaggacagaagaaagccttatctgagatctgagatatatattttaactgtgatttaagggctaagaaagccaagattctaggagacaggagattagaggaagtcacttttgggctcttgaggtaaatccagcagaattattgactggataggctatggagagtgctaattcatttcccacactctggtcaatattaggtgacctgtgataaggtggaagacaaaacattcaaagaacaattttttaacatcactttgttatgcaaccaaacacaaaacagaccaaatgttattagcattgctcaatgtctcctctttctgtgcctcatcatcctcctccacctcccaccatgctaatgaaggccccagacatctccagcctggaccatcacaactgtaacaatcttactgagcaagcaaagctcttgggatagaatcctaaagtaacttcacttttgtacactttcatgtgatagtcaaaactctgaacacagtttcatttgggcctcttccccttcctcagctcaggcctcctgcagatgaacaagcctatagtcagagaagagggtgtggttagccatttcccccttcaccccatttgtgccgtgccctttcctctgtgcacacgtggttaatccctccgaaactgggacacagggaggaaggaaagtaagttacagctgactcttttgcttgtgggtactttcatgtgttctttggagccttcttccattgctggagacctgtctcctccaggttccttaatgggggtgatatactctcctcacctggaagcatcttttgatatacctagtttctgtttgcccctccaggcaaccctcttgaccaggacctaagaacatgcaaaagaataaactctaaattcctattgccctggggttcttttccaggcagcaagggccaccggataaaataaatgacgcaatgcagatacacagaaacactccacttacttcccctgacagccacttccatggaagattcaacacagctgaaaggcccaaaaaaagttcttgagttcccaggtgtgaataataacagggacaaagactctttcctttgaccaaaactttagtcaagctcctctgagtgctcctcataactaggcccaaccttgggcttccctccctgtccttgctgaatcaaatgtgagcaagaatcctgttaagtcaggttagggaaaatcccccactctaggtatctgaccaccctcaatatcttatcaccctggcctgcctgcagcaagaatcctatcaagttagtttagccagacaccccttatccctgatgtttcctcttagtcattttccacccacagtcaccaccctgctccttcgctacgaatccccacttgtactggttggggtcagagttaagtctgattggcaagaccctgttgcagtggtccctacacctattgccatggccccctccagtaaaatctgcctgaccatcttgcctagtgcttgggtaatcttttttttaacaaccattatttcaaattcaaaatcatgccctcaacatcacttccttggtcccaagccccctcccagactc

SEQ ID NO: 1048 - DNA, 32391 bp, Homo sapiens
tgcacagtctcgatcctaaaactatatgagaaagatgtcatcattaccccattttgagatgaggaaaccaagattctgggattagataacttgcccaatatcacaggtccctaagtcacatggaatgaagcccaggtcttatcttttagggagataaggaaaggaatcacctggtttgaggccagggccaagcaagctcttcccttcttgagaatgactatcagaggcagtaattgcagtaaccagggggaagaagccagctgtgccagcgaaagcttgtgagtcactggcgaggctgcctgccagcaaagataaaggactaccagctactctggataagagctccaggatctgcacaaaatacagctgtgagaggagggcaggagtttgagagccacggctagatttctacagaggtgtcaagactgttctagggccttccttctgagagccccactactttgggcttagctctgttccctcctacaggacctggggcctcacttacttatttccttgggtccttaggaaacctcagcctgactaagatttgggatgtagactcctccttggtgttcccagttagctactcccccacagaatcttcttggacccaccacaccccaccctttctttcttggggtttggctgctagccccataaggcagatggaaataaagtatcaagcttgggaggaaatcagattcctagggaaaggggccattcaatccagtggagtgtttgctcctagtgcaaacactaggagccagaagcaggaggcagggtgggaggattctagtttgggttaagctggagtttggcttgaggctaggatcagaggtggtggtcaagctgggttagagctgggatcagagccatgacccacgtcagggcaaatgttaggctggccttaaaaaacaacatataggccgggcgcggtggctcacgcctgtaatcccagcactttgggaggccgaggcgggcggatcacgaggtcaggagatcgagaccatcccggctaaaatggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaacatatagaaaacagcatgcattaggtgccaactagacttgtattttagttctgaaacatcacttcctagctggggggctctcagcctcttcctcaaaatctttcagggttgtttagagaaatgctgaagatttaaaaatctaaacaagataatgaatgtaaactgcctactagtgcctagacggtgataatttcttagtaattaacagtagctatgactattactcgtgtccctctagcagctattgtgtctttgagggccctgggcacaggttgtcctgctctgcttgtcccaggcctctggcggggcttccaggttgtgcaggcaataccaggtctgaccagcagagagcagaaggcacttcttccttccttccttccagctcactcccaggcctttggattacattgccttgaaaagcttggagaatttctcagggagaaatggaatcttagggacagggaacaacgttggggaattgtgatctcaactgctcttgtttaagcttttttcacaatgactgaaatatatcagtggtaatgctgaatgacgttactgaagaggatgtgctaatcagagcctaaagcagccctgtcgcagtcagcaccactgaatgactgggaacattcagacagcccctcaccaaagtttgaaaattctttgtgcttctcaccactagttcacatgaaccctctctgtgtctgtcttcaccttttcagtccccataccttggcctgttgtcctcagccttttcttcaccagtatgtccaacagacagggccccagaggctattagcttgtatgcattcatggaagccttctctcggaatgacctcctgttggctttctcaacctttgaatgaggccctgacctgggagatctaggcctctcttggcctacccgtgagggtctacatctgaagtcaagtatccagccagagccagcccctgaatgggtgcctctgctcttccccagcacaagccccaggcttctgaaaggccagtccttgtcctggtttctttcgtctgctcaatagccctgcctgctctggctctagcccatctgccttctcagctggcttcctctgtttaatcatcccaagagaagggcctcctgtttgggcagggaatgtgtgggcaggagctcagcacagaagcaagtctgcatgtcatagaaatgcagagaacagaaggccttgaaagatataaggagaaggtggcctaatcagacacagagggcggggctgagccaatggggaaaagggcaagctgggcaccccaaggactaaactgtagctgatttctctcctagcgccagacctcagctgcacgtgtgtgcgtcagaaccaggagtgctggaggcagagcgtattacatgaccctcacactactgggaatgtaaacactgggtttcctggttaaagcactgatattttgtggaccttgcaagctacctagaataagcagtcccttataaagcagcttatctggcactgtgcatgaggcagtaggttctgctctctgcggttgtttcccatgaatatttactgaagttttatttcaatgttcccctcttatctcagttgtgatatagagtattgaaagaaggatcgtgtgcccacatttgggccaatggggcagtaccatgggagattgagacttcccaaaagggaaagtaaattgttctagctacaagagtcaagctaggtggtccaaaatccccctctaaaaaaccaaaaccaaaactaaaaccaaataacaaacaaccttggcaggtcaaagcttgagttagaaagacagattccctcaggactgagcccaggcctacttcaggacctcttgcatgtgcttccttgacctcttagttttctgacttgttcctggacaagggtccaagtctctttcatatgcctttgcccacattggctttgcaattccttccttactccgatctaaagcatccctattttcttgccctgagatatcccattctctccaaaatgctggcttatgtctagcaaaggaagtatagatggaatttcatgatttcgagaaatgagttatacccttttagcactacattttcattcctttcccctccatcctctgctccccctcccttcttcactatagctattacttgttttttattttcccttttacaaaacatcttgaaatcaatctacacatgccatctcctagccctcaccttccataacccatctgcatttagttagaggggagaatatgggcaagatacaaagatgatgaaaacttggcatccacaaggaaaatataagatatttgaggctcctgaagccaagtgtgaccatccagctagagccagtgtttgggtgtgagagtaaacaaaagatagaaagtaagtaatgacagtagtgtgacgagaagtctgagaaactattggagagagggacatgtattagtcagctcaggctgccacagcaagacaccacagactggatgacttaaacaacagaaatttattttctcacagttctagagcctagaagacccagatcaaggtaccaacacattcagtttctggtgagggctctcttcttggcctgcagaaagcatcctcacatggtctttcccctgtgtgtggcttgcagggggaagaggtggcaggggatgagggaaatggtggatcacaagatatctggtgcctcttccccatcttgtaatgacaacagttctagccccacccttataactttatttaactttaattacttctttaaaggccctatctccaaatacaataacaagggcaggagccagacccttggaatataattctctcttctccatgtccagctgagattttatggcccgttttttcacacttgtccctttattttgccattccattcatctggtaaaattccaactttggatgaaccaaaccatcaacattctccttgcttgcatccaaccagctgagctctgctgagaaattgatcccactagaaatttgtagtcatcaccccttaagtgggccctcagtattttcctattatttcactacattcctcaggtctccttttcccttctcccattatatattgttttcttaaaccatcttgactactaaaaattttcatcacacgcacacacacaaacacacacacaccactctctgataaccagatctccaactccatagcaaaaataaaaactatcagacagcagctccctaccaaatctacaaacaactgtctcagttaagatgcaggttaggttgccctgacaatagaggaaaaaaactgtaacgagttaagactgcagtttctttttcatgcagaagaatcagggatgataaaatggtttgagagtataggagacccagactccttccattttgtcactctgccatccctaatatgttaccctcactgcatgattgaaggtggcttgctttcctatttacattcctattgccctcccataggggcaaagaggaagagaaggtccatttctctcctttaagaccttgatgtggaagctgcacatatcacttctacctacagacactacctagtcatagtgtgcattttttgcacttagctgcaaaaaggtctaggaaatgtagcggttaatttgtaggccataacttattttcatctataatcatctttttctactaatttcctctcacaattgagtctctactgcaatcaaaagctaggatcctccacttccgctctggattgcatacatccctgacttctcaggaaccttgcattattaattagccattctcctgtatctttagtctttttatatattggagtaattccatctgccaaaaaaatgaaaaaaagagaaagaaagaaaggaagaaagagagaaagaaagaaaagaaagttcaagtccacccatcttaaaaaaaaaaatctttcatttgacatcctcttgcagctctatcccctttccttagtaactacatttcttaaaaacttgtctgaagtcatttactccacttcttcccaccatattcagttttcaggacatctaccctgccttctgcctcaacaacctcactaaaatggctctttctaaggttgccaaagatctccaggttactaattttggaccacatttctcattcctcattttgcttacccaggagcagcatttgaatgagttcaccagtttcttcttgcacctcttctcttttagcttttatgatgcttcactctctgggtttcctcctgtccctctgtctactctttcttggtgtcttttgcaggctcatctttctctatccagtctttaataatgacctctaaaagtctgacttgatccttcatttgttcttattctacacactctaattctgtggtttgcattacttcctatatgatctgtatatttagcttcctaatggaattctacttaggtatctaatagacatctgaaacttaatatgtccaaaacagaacagatttgatggtgggagtttctctgtgctagttactattttctctatgaagttggagtctaggttgagagtgaagaatgctctgtgtctctgtgtgtgtgtgtgtgtgtgtgtgtgtgtgtgtcagggtgggagaagaaattagagattttatgagacgagaaaatttaaaaacaatattgtgtaaaatgagagaaagaaggtaatcagggaaatttggtaagacatctactcattctaagcagcacagtatgaacaactgaattctgatttccaaaatccctgactttgacttctggctctttcacctagtagctttgtggctttgggcaagttacttaaactctctctaagccatagttttttcatctaaaatagtgatcaacaatattggacctaaattcatggttcttcatgaagattaaatgtacttacaggtaatgtgccttgaacatcataggtgatcatcaaatagtttatattgagttaccagaaaccttattcattttttatctcatccttctttctcaccctccacatgcaaattatctttaaattctgtttctacctcctagataggtcttagatcaatcttttccactacgtccatgactttaggtcaagccactaccatctctcacccaaattactgtcatagactcccaattggtcccaccttttaagttgctccccacactaactccactgcaatctttccaaatctttctaaatcttaacaaatttccaatgctcccaattcttccttgcatggcttgcaagagtctgcatttgctgcctcatgagatagaaggtgtatgatttgtctgttgctgttgtaataaattaccatgaatgtagtggctaaaaacaacacccatttattagctcacagatctattggccagaggtctacacagtgtggctgggttctctgctcagggtatcagaaatcaaggtttcagccagactgaattctcttctacagactcgggggaggactgaagtctctgttcttttgctggctgtcagctagagactgctgtcaactagaggccactctcagggcttgtcctgtgccctccttcaccctcgagccagaaaacagccaccattcgttccttgccacattatcccctccatcttcaagctatcaacagtgtgttgaattcttctcattcttccaatctctttgatttcctcttctgctaccagcaagaaaaaaagaacccttggcttttaaagaactcatgtgacttggttaggactagccagataatctgtctatcttgagatcaactgattagtagaattaactccatctgcaaaatcccttttgccatataacataattgtgggagtagtatctcatcatatgcacaggtccatccacacacaaaagaagattatataagggtgacagtcattggtggtcatcttctaattctgcctacccaaggagaggaagccaggggaaatatccctgaagaatcgtagcttgagctgagatcagatggatgagtaagtgttaactaggtaaggaaggaaagaagaagcttccagagagcatatggaaaagtcatgcaactgaaggacatatagcaaaaaaaaaaaaaaaaaaaaagaaaagaaaaaagaaaaataaaagagaaaaaagaaggagtgaccaaaaaaaggctaatgtgtttacagtggagagaataagaatcattgtgactcttatttgaaataatgtgatttgaaataatgtggctagagaggtaagtgggagccaggcctcacaggctttctaaattctgttaatatgttttctcattcccaaaagcaaaggtcaaaagagtgggatagtcagatttgtattctgagcatagtacttcggctttaaggtgaagtatagatgtagagaggcatcagtaaaatgtggtggcccatttaggaggttaggagtgtggttcaagagtagggtaatatcagtggacatataagcaggcagattcaaggaacactcagtagctaaaatgaacaggactttgtgattgattcaatatgggagtgatgtagttatgttccccaggaagcagactctcaaacaaagattactgtggaggatgtttactaaggagcgttcttggagttaacacctgtgcaagagagaggatgaaaataggattgggcaaaaggagaagctgagtagtaattcagtcccagcaaagacctcagtcaaccatatgaagggttctaggggtgtgagcatctttcagagttgtccaccactgggttgaggggattaaacttttatacctctgtgctgatcggtcattggatatagaatgcccaagaaagggagcataaccttggatgagctggctttcttctgcttaggcaactcctgaagggttatgacagctgagggccatcttttaggagcactctccacagctggaaaataaatcctccatttttgaagagggttctgggctttgcatcacagcatccagcgcaggggtgaaggagcataggggagtaaggcatcaataataattcctaaatttctgatttgtacatcctggtgggtgcacttaacgaccatatattacaatcattggcttgcttgggaaaatcccactagagtaggtgctactgaggggcaaactatattggacaactagtgcatacccctagaactggcatagtttgctaaataagtgaatgtccatctatttctattttcactcccctctcccttacatcctttgctcccttccctcctcatcgtactgtcatccaatgtgggaaaacttgagcaggttatctgaggccccacctgtgctggagcggaacaaatagcaaatcaagctcctctggtccaggctctctgatgggcaagacaggcagtaccaggaggaaggaaagggggagcagttgatgacatctcaggcataaactgtctttcaactctctttcaatgcttcagcccctataaactcagggctggctgaaccaggtcctctccaaaagattaattggataagggcctgctgaatcccccataaagccagactccattctctaatttgctcttccactgatgcccgcccccaacctcttacagctactgctgggggtcagaagaatttcacatcgtattggagttcatccggaatctgaagaatggataggaatctggagataggaatctggagataggaatctggggaagaaaaggaatggataggagaatgcatagggagcagggctgaaatagtagaagaggcaaatcctgccccgagaagctgaacccagttcagtcctgcacccttcagccctgttcccgctgcaccgcagtgacccagtccccttctagccccctctcgtgggaacctgacaccctacacaggcagctctgcctgcactgagagcaaacagggagcgttagcgtgtcgggtgggcgtgggcgctgcctggagacggtggagaaagccaaccttctccttctcttttgcctgcgctgggccggcgttagaattatatcccatcctcaccttactctggtttatccttgtcagtgcttgccaccacccccaactgccctcaacactcaagtcagaagcttcctcccgggagcccttttccctggcaaggcttccctggagccaaatctcggccccggccccacccccactcccgcccagctgtggagggctccttgggacccttaagtgcaagcctgagtgttaagcctcagacaggagatggagggtgcggagacagatgcaggagctaccccaggcccgcagcgaggagctgcagggaactacggtagcaatagtgtcacggtcactgcggccactgcaacacagtacggtaaatgcggctctaggctcagactaaagcatccgcgcctcagcaggtgacgcacgcagacctggtctccaacgccacctccacgttccctgatacaccagagaaagatgctggatccgtggcagccgtctctacccaacccctcctaccctcccttccccgaaacctccccctacgctgccaatactcttgtcttcaatctctctctctctctctctctctctctctctctctctctctctctctcattcctgggaatcgggggtgggggcgggtgataaagagaggtgggcaggagagaaatctctaagaggagacgggacacatctagggagggggcgagcctggaggacagtcgcacagggaggggcagaactcccgagccagggagggggtgcacagtcacctggcgggacagaggctggcggagggacgggaacccaggcggggcgagccgcgggagagtggagggcaggcgcctgggctgggggcggggaccaggcggggcagggggcagggagaggagggcggcgggagcctgagccggaatcgcagcgtgagcaggtggagccgcgttgggagcccgccgggtcgagctgagtaaggcggcgggctcggcgggggccatggagctgctaaagctgaaccggagcgtgcagggaaccggacccgggccgggggcttccctgtgccgcccgggggcgcctctcctcaacagcagcagtgtgggcaacctcagctgcgagccccctcgcattcgcggagccgggacacgaggtgggtgcctccctcagccccccccacaagctatttctcactgtaccccagaacactaatagagtccccccaacgagctccacactaccttctcaaacgtccacaccgtgcctctcatagtactccctcagcccccaaacagctcccctcacaccttcacccccacagcctacaacttcatcacagcttcacaccacctggtcggaactccttcacatcctggtcccctgaatacacctagagcccctgctcaccccaaagcacagccccttccccaacacgcagcccctcctagacaccagtcagaaggcgaggacctcctcttgccaaccctgcagatctccttttccctcttacatccagttcacagagccacaacagagaagggaaggaagaaaggaaggcaggactgggaaaagaagggggctggttgagggagggagcactctggaaagcttgaatgcgaagctgaagttgtgatcacatctgacaccccagcccccagccatcccaaaaaagatcctcaaatctgaattaggctggacactaggggatgctccttagagctgcctgcctccatttcactccttctcaaacccctctgcctccctagttggagctttcgaggctctgtgccctctctctttgtctgcaagtaatgtctccagctatcttccaagctctctctccagccctaggctaggtgctgggggcacagggcaaactagacccagtctggaccctcatggcccatagccaagtgcagagagaaaccaagcaaatggaaaaatcacagacacaatggaagtcccatgaaagggtctaaactgtgggcaccaaaagaacttcacagaggctagaaccttagagctgggtcttgaagttgagtaggcagaaaaggaaggagtgggattctaggtgaaggagcaatgttaagcagaaggaaatttttctaaactcaaaaagggaaagttggaataaattgtaatccaagtatttatttaccccacgaaataatctatgctttctcagccgagttgttacacactcacacttggattctgtcattcagccaatatttattgaaccagagattgtgctaggcagtgggaatgtaagttgaacaaaaccgacacaattcctacttcacagagctcaaagtttaatgggcgagacagaaaagcaggggattgcagcacaaagtggaagagccttgacagggaaaagatagtgggaacacaagtggaacacctctagcccagcccagcctccttgagaattaaagttggcctcttgaggaaatgagctacaaagtcaaaaaaattagggaggctggctctaagcttcctgttggcaaaaaaaaaaaaaaaaaaaaatatatatacacacacacacacacacacacacacacacacacacatatacatatgggagagccagccaagtgaacgggcagaagaggcagaaagcatcccaaataaaaggacaagatgtataagaagctcaaagtttgaattcatggcacttttatccactgtgacatagttttgagtgactagaacatatatcttaagaagggaataatgaacaggctggagaccagcctagagggtttgcagagagcctgctaggcctgaccatggaacatggactttctcccgagggcaataggaactactaaaagattcggtagtactaccaggattagttctataatgtggagaacggattggaagacataagatggaaggcagggggatactttacaaggttactatattacactgttctgggtgaaagatgatgctagctgagactaaggtaatggcaagggagatggagagaggtggatagatttgagagcctcttctggaaatggaatcaacagattagaagcagagaggatggaagaggtcaagggatgacattcagatttctaacttggacaactgaatggatattggtgctatagcaattgtatacaatgagaaagataacaaaacagcagaaacaggtttggaagagggaattataaattcagtttggaacccattgagtttaaatgttagtggggcatccaggtgaggttacctagtaagctgttgaatccaggggtctggaacttacaggagaggtctgaggtggaaatacagacttgaagaaggtctttgcctacaggatgtagaagccccgagaatagttaaaatcataaaattttgtatagaatgagaagaaaataggtcctaggtcaagactctgcataagaccattatttaaaagccaggcagagaaaggagaatttatgaaggagattcagatgaaaccatcagaaaggcaggagctacgcccttccagaaagcaagaaaaagagagtttcaagcaggttggggtaagtgatatcaaatgctattgacataagttacataaataaaaaacaggacagtcagaacagcatccttcacattcaataacaagaaaatatttaggagttgtaggtattgaggcttgactatggtaggttaaagattggactggtgagagaaggagttatgagaagtgaaccaaggtatgtagccaaaactttcaagaagtctggtaggcaaagaaagagagagagagagagagagagagagagagagagagagaaagaaaagcaggatattgccaaaaatagcatgagattgaggaaggggggagtgggtatgtgcataggtttgttacgtgtgtgcgcgtgtgtgtgcacgcattttaaaacaagagctttttaaaatgtttgttggtgattgggccgagagaggaagattgaaggtgcagataagaaaggggatagtcaatagagaagattccctgtgaaagcgggatgtgacgcaattcagagcacaggtgcaaaaatttgcctcacttatctaaatgctcctcacacatttggatgttacccagccagtcagatgttacacacagagaccctgtcagccacactcattcagatattatccctgcagatgcataggttacccaggttcactccaatgttaccaataggaatttggatgttaccactttattctccttatataatccatgcagacttgagtattacccatgttcactcagatagtacccacagaaagacaaatgttaccacactcactttaatattgtccgaagtcattttggtgttacccatccatcaaacactactcactttcattttattattatccacacacaaccagatattacctatgctcacttaagtaagcttttcccagatactacccataaaattacaaatattactctcacatactcagataatacccacaaaagcttaaatattacttacattcactcaggtgctcagttatttcatttactcagattaacatcttttttttttttttttttttgaggcagtctccctctgttgcccaggctggggtgcagtagcatgatcatggctcattgcagtcttgacctccgcaggctcaagtgatcctcccacctcaaccccctaaatagctgggactacaggcatgtgccaccacaagtggctaattttttgtattttttgtagagatagggtttttccatgttgcccaggctggtctctaaatccttggcttaagagatctgcccacctcagccttccaaagtgctgggattacagatataagccaccatgtctggcccagattaacatcttaatttagttaacatgttaacatctaacatctgtactcaaatactacccatacatacttggatattacttctgctcagtcagcaatttctatcattatttggatattccactactcacaagtagacctctgaatgtaatctatgcttcctgaagatgttacctacaaaatgttatctacagagagttggatattaacccttgctctttcaaatgttactacagtgactcagatattatctaaacttaaatgtaagccatattcaatcggatattacctataagcatgtagatgttaccattctccagatatgtcccacagaaataagcgtgactttcacctacccatatactatttcaaagattaaagtatgcccaacactcactctgatattacctacacacccttgcatattacttctgctccctcagtacccactatgtggattcccccattcacccagccactacccacagtcagttggatgtgatccctgcttatcatagagacaagggtattactttgatgtctgtgtgcatgggtgaacagatcaaacctgccagtagaatgcagaatttaaggcatcagcagcttcagtgttctgtggagtttttccttagaaagtcttggttttcattttatgtcacgttgtctggatttttgcactcatacttctctgccattatctagacagaacaaatacagatcttctaaacaccaggagaagaactgaactgtcccaatcttctgagtcgcctggtctgatgccagttttcctcatccccaggaagatgatgagatgatgctcacgggtagacttatcaaggcacttgtggatgtaccccagcaggtgctatctcccatccttctacccatgcctgtttcctagtcactgaagccactgtcatcactcatattccaccatgcaaacacacatcaatacacacacacacacacacacgcatacaagtctaagtctgatttattttgtgcatgactttttaaactaatggattatttttagagcagttttaagtttacaaaaattacagagtgcccatacacacacaaccacacatatacacagaatttaccctattattaacagcttacattagtgtggtacatgtgtcacaatttatgagccaatatcaatacattattctctaaattctagagtttacattagggttcactttttgtgttgtatggttctataggttttgacaaatgtataatggcatgtatccatcattacagtatcacacagaatagtttcactgccctaaaaatcccctgtacttcatctatttatccctcgctctgcctctccaaactcctggctctaaaattgcttttaattagaatttttcacatttctgaactgttcaacagcaaagacgtgtggagacagtggtggctggaaataagataatagctaggaatgtccagtaaaacagcagaacactgcacagttgctggtcatttttactgggactttgtcttataaatttcaggagtccccaagcatattgcaaactttataagggtaatatttagctccatctttatggtctatcacaattagccaagttcaagggcacacacatgggacatcagctggatgaatgaatgagaaattgcttttcatgcttcacagtactgtaccaatttgaggtgtggcgaattgcatcaataattagttgaagaaagacatccagggcagatgtaagcaagataatggaactagaaagattaaagaggtggaggctgggggtgggaggacaatggatttggagaagaaacagtgagtccaagataaaccaccagctcttttctgagtccaaggacctctctgacagaggtctccctcctaaaagtcctttattctccaccatacacacttactcccctcaaattttgtcacctataagccttctgtaatccttccttacagagagaggcccagcttctaaaggaaatatagatggtttgcatataaaaaacaaaagttatgcatctgaaatcataacctctcactgacccccacaaggaccttccaacatgtgtctccaaaaagacagaggcaaagaagaagaagaaagggcatgctggagcacctctgcagagatgacggatggatgaggagggggaaagcaggtgcacttctgtcttgaaagacagaatcatccaagattcattaacaagcatgtgttgactgcctcccctgtgctagggatgatgagtgctagggatatactggagagcgagatggaccttgccactgtcctcaagaagctcctagtctagtggggaagacagagaattacatacatactaatacagtgaaaaatgccatggttgagtatagagagagggagaaagaggcatttagattgagatttgattaagaaggaggcagtatgggccaggcgtagtggctcaaacctgtaatcccagcactttgggaggccaaagcaggtgatcacctgaggtcgggagttcgagaccagccttaccaatatggagaaacccatctctactaaaaatacaaaattagccgggcgtggtggtgcatgcctgtaattctagctactcaggaggctgaggcaggagaatcgcttgaacccaggaggcaaaggttgcggtgagccaagatcatgccattgcactccagcctgggcaacaagagcaaaactccatctcaaaaacaaaaacaaaaacaaacaaacaaacaaaaaacatggaggtagtatgatgaataacagagtactgcaggaacaaacagtaggaggcaaagcacattagggatcagggacttggcttctattctgattcagccccttatcaggtgtgtggtcttgagcaaagaatgttactgctgagttcggtttggaagtttttataaatagcatttatttgatgcctacaatttctaaataaattggtttttgttatgagaaaatacagtcatgcattaactaatgatggggataccttctgagaaatgcatcattaggtgatttcattgtgtaaacatcatagagtgtttgtcacacaaacctagaaggtatagcctactacatacctaggctatacggtatagcctactgctcccaggctgcaaacctgtacagtatattactgtgctgaatattgtagggaagagtaacacaatgttatgtatttgtgtatctaaacatagaaaaggtacagtgaaaatacagcataaaagataaaccatcatacacctgtatagggcacgtaccgttaatggaacttgcaggagtagatgttgctctggctaagtcagtgatgagtggtgagtgaaagtaaaggcctaggacattactgtacactactgtagactttataaacactggatacttaggctacactaaatgtatttaataataaattaaacttagcatactgtaactttttactttataaactttttgactcttttgtaataacacagtgtaaaacaaaaaacacattgtatggctatacaaaaatattttctttttttatactcttatcctataagcatttttctgtttttaactttagaaaaaaaaaaaacctttctgttaaaaccaagacacaaacacacacattgggctacacagggtcaggataaatattgccatcttccacctctacatcttgtcccactggaaggtcatcagggcaacaccacacatggagctgtcatctcctataataacggtgctttattctggaatacatcttaaaggacctgcctgagtctgttttatagttaacttttttaaaaaaataagtaagagtatactctaaaataatgattgaaagtataatgtagtaaatacatcaaccagtcacacagtcatttattatcactatcaagtattatgtacatcattgtatgtgctaggcttttatatgactgacagcacagtaggtttgtttataccagtatccccacaaacacatacgtaatgcattatgctgcaatgttacaataacattactaggtgatagaaacttttcagctccattataatcttttgttgttgttattttgggttttgtttgagacagagtctcactctgttgtgcaggctggagtgcagtggcactatcatagctcattgcagccttgaactcctgggttcaagcaatctttctgcctcaaactcctgagtagctatgactataggcacgtatcaccacacccagctaattttttatgttttgtagagacgggactttgctatgttgctcaggctgatctcaagctcctggcctcaggtgatcctcccgccttggcctctcaaagtgctgggattacaaagataagccactgcactcagctgttcattacaatcttatgagaccaccatcgtatatgaaattggtcatttaccaaaacatcgttattcagtgcatggctgtagttttcaatttgggagctaaaatgagaatcagtcaaagtatggggctctggaagagggggctgcagctttgaggctttccttctctgcaatctaggaggctctgtcccctgccctctctaccttccagctctaatccctctcatgctgaggccataggtgtgagtaattcagtcctgttcaatccaattcgattttatctaaatctgcttggctgtgatgtggtggtccaaagattaatccatcttttaatagacaatgacacaaaagaatggggtcagcctcccagcccctctgcctcacacaggtgtccctcctatgagctccaacagcaccttatacatccttcagcctcactccttatcacatctgtttatgtatctgagtttacttccccactgtgagctctcaaatggcagggatcttgtcatgttcatctctttgtccccagtgcctagcacaaagggagtcctctgtaaatgtttatagagtgagaatgaatgtttggagagaattaaaatacaaggcagaagtaaaataggctgtaatagttgtgtaagaaacaggcatgggtcagagaaagaggagagtagaagggccttacagaagggccttacagaagaagtagcagtcaatttgagtcttgaccaacaagggatgaataggaattcaccagatacagaaaataagcttgtgatgaggggtagaagttgtgaggagggttggtaaaagagtattccggtctgagaaaccagcttgagcagggagagagtcacaagtgcaaatgatgcattcaagaaattgagtcatccagtggcttgcttaaatgcctgctgtacagggagggggtgggagagaaagaagtcccttctgggaggatcttgatgatattctgaggggttgcagacagtagagagtaagtgaagtattttttttttttttttttttgcttttgtttttagagaataaagacatgatctgatgtgattcaaaaggtagtgggttgtcaacagtgtagaatactctagcggggtcaaatagagtaggctaagaaaggacctttgaatttagcagttaaagattagtgtacttgggaagaagtatgcactgatagggcacagaatattgtattgtaatggaatgaagagtaaatgagaagacacaaatatcctcttaagaagtttgtctgcagaaagaaggaaagatttggaacgaaccttgagaagagacaggctttcttaaggaagggcagagttgggccaatttaaccaaacctcaaggggttagaaggctaaaggattcaagttcaccatttactgagcagttcatcggtggggaatgtaggcatctggctgggtagtgagggttggggataagacggaaggagggggatttgactgaatgaaggctgaccccctactgccacctctcccttttcttacccagaattggagctggccattagaatcactctttacgcagtgatcttcctgatgagcgttggaggaaatatgctcatcatcgtggtcctgggactgagccgccgcctgaggactgtcaccaatgccttcctcctctcactggcagtcagcgacctcctgctggctgtggcttgcatgcccttcaccctcctgcccaatctcatgggcacattcatctttggcaccgtcatctgcaaggcggtttcctacctcatgggtgggtgagacaaccaccccacccccacttgccactctccccgcctaaagctcttgtggatgtaggggtcttccccggttggcagggaggggtgtgaggaagtcccactgatgcttgtgtagtgcaagtttcctaggtgactccttcctttctcttcccttgtttaggggtgtctgtgagtgtgtccacgctaagcctcgtggccatcgcactggagcggtacagcgccatctgccgaccactgcaggcacgagtgtggcagacgcgctcccacgcggctcgcgtgattgtagccacgtggctgctgtccggactactcatggtgccctaccccgtgtacactgtcgtgcaaccagtggggcctcgtgtgctgcagtgcgtgcatcgctggcccagtgcgcgggtccgccagacctggtgagcttgcccataaactatcctaggaattcctttctcacccctattagatgcttacgaccattgcccagaatcttcctccagcttcccggagaattaccacgccaactcctattctgcatccaccaccctggagttccagtttggggcccctccccagttctctctcccttcccagcggcacccccaaatcctactcctacttcaggtacctggccacagccctagaaacactagtccttggctttttctccatctgtgattacagctggacagaaacccgagtgatctgtctgtgttgccttcaggtccgtactgctgcttctgctcttgttcttcatcccgggtgtggttatggccgtggcctacgggcttatctctcgcgagctctacttagggcttcgctttgacggcgacagtgacagcgacagccaaagcagggtccgaaaccaaggcgggctgccaggtggggctggaccacgtgagcaaaatctgggcgaggcggagctttggagggcgacggggcctgctggagtgggtgggactgaaatgaaggtgagggtgagaaggaagctggaaatggagttgagctgggagcggaggtcaggtggggactgggctggagactggggggactcgcctttttctctgaccgcccaccctttgtgctcaggggctgttcaccagaacgggcgttgccggcctgagactggcgcggttggcgaagacagcgatggctgctacgtgcaacttccacgttcccggcctgccctggagctgacggcgctgacggctcctgggccgggatccggctcccggcccacccaggccaagctgctggctaagaagcgcgtggtgcgaatgttgctggtgatcgttgtgcttttttttctgtgttggttgccagtttatagtgccaacacgtggcgcgcctttgatggcccgggtgcacaccgagcactctcgggtgctcctatctccttcattcacttgctgagctacgcctcggcctgtgtcaaccccctggtctactgcttcatgcaccgtcgctttcgccaggcctgcctggaaacttgcgctcgctgctgcccccggcctccacgagctcgccccagggctcttcccgatgaggaccctcccactccctccattgcttcgctgtccaggcttagctacaccaccatcagcacactgggccctggctgaggagtagaggggccgtgggggttgaggcagggcaaatgacatgcactgacccttccagacatacgaaacacaaaccacaactgacacaggaaaccaacacccaaagcatggactaaccccaacgcacaggaaaaggtagcttacctgacacaagaggaataagaatggagcagtacatgggaaaggaggcatgcctctgatatgggactgagcctggcccatagaaacatgacactgaccttggagagacacagcgtccctagcagtgaactatttctacacagtgggaactctgacaagggctgacctgcctctcacacacatagattaatggcactgattgttttagagactatggagcctggcacaggactgattctgggatgctcctagtttgacctcacagtgacccttcccaatcagcactgaaaataccatcaggcctaatctcatacctctgaccaacaggctgttctgcactgaaaaggttcttcatccctttccagttaaggaccgtggccctgccctctccttccttacccaaactgttcaagaaataataaattgtttggcttcctcctgaacttcctttctggattcttctggggcaggtgaggaggcataggattttgcagtatccttctgtcgggtctctcccactgttgcacactgctgtgcacaaccccttgccagaaagcccagcctctgaggttcagcgtggctgtgcatattctttctgagttttcatcctctacctacattccaatgttgcaataactgtgaatggggatggaaaatggcatatccatgacatatcatgattcctgatcacattatcccaaagtggtgccactgttaaggtactatattaatggatgcttattaaattttgatgaaaagataaaagaggaagcactgtataataagactaagtttattcaatgtgtgtttgaaacaccagagatcagaccatgacaggtatacagaatgaatacagttaattaaagagtagggattttttgctgtactctcttccccagtgtcaaaacctggccaagattctgccaaatggaagcacttttagtagctacaacaaaaaaagacctgaataggagtctgagaacccagtctcccttttactataagaatgatctagccccagagacaggcaaagaccaacaatatcacctctttacacacaatgacaaatgaggaagaacaggaactgaggacctcactaagaggacatacgtggataatcagaggcatagtatattggaggaggggtcttttgatgcttcatcttgtaacagacaggggaaactgaggcccagagcaggaatgtaagctgcctaaggtcatacagtaagttagagcaagatagaataatggtgttgaagtagaccctgggctggagatggggaagaagacccacccatgaggagcagagacaagttttgtgggacctaaagtttataaaatcgggtactctttttttaagaaagaaaaagaatacaaaatcacagatacaaaattactgggaccctgaccagggccttgaaaggggcctgtgcaagtgatgagccctcaattttaggcctcattcacttcccagccaatatgcctctaaaatacacccactaactaccctggagaaggctgcatggagtagaggacagtgagaaaggagagtggttctgtttaccagtgctggggttgctcccatccatcgtttctacaggattctgggctgcaagaggcaggaagaaggaagaaaaggagggagaaggcgttccaagctgtcaactatgacagggatggttaaaaatagaatcccagctggtctgaggagctgcaggcagatattgggcctttctttctcatgccagcttctctgtggggtgggagtaggctggcccataggctccctagcactccaccgttccttctaaagactgcctgggactgttagccccctctagctggagcctgggctccagatgaccacgaaatggcagcctggagctgggtagagggctgggtctacagaatacttttacctccatcaccccattccatgccctatccagctgtcagatatggtctcttgagctccttccatctattttccatttcttgagatctgataaaacatttcaggtctagatttaatatcactgtccccatgaagtcctactttgtcattctgacaaagcttgtatgctcatatggtacttactgctttctctcttttgtcatagtcatctgtgttcctgcctaatttatcctatcagcctgagagcagcatgatgtagtaggaagatgactgagcctggtcgggggacagaggagggtagtggtaagatctaattctaagtgataggcattttatatacactgattcatttcattctctgaatacttccacagaacatttctcctcattcaaaagacaaataaagtgaagctaagaaagcttaaggcagttatacgaggtcctacagccagaatacagccaagaactgagctcgggtatctgacttcaaagctttttctatttccattatagtgtgttgccttctttcaagtctttccagtcctagttctatcttttaaaagttgtgtgattttgtgcacgttatctaagtgagtttcaggctcaggtgtaaaacggtaatattatattaaccttacactgccattttgaaacttaagtaaaataatgcatataaagtgcttatcattgtatcaggcacatagcataagaagagttagatgcatcaagactggaaggaagcaaaagcaccaggaaacaaagccttctgtagacaggtagccaccaataattgaacaggacagaactctgggtccaaggggaggctcagagcttgctacgagatgatattagaaagtgatatgtgtaggcaaataaatggtaggaaaaaaaaagaaagtggtgtacactggaataaaactagaaatcaaaaacaagaaaaattttggagactatacaaacacatggaaattaaacaatatgttcctgaatgacagtggatcaatgaagaaattaagaaaaaaaatgaaaaattccttgaaacataatgataatgataatggaaacacaacataccaaaacctatggcatacagcaaaagcagtactaacagagaagtttatagcttgcctatatcaaaaaagacagcctaatgatacatcttaaagaactagaaaagcaagaacaaacccaaaattagcagaagaaaagaaataataaatatgagagcagaactaaatgaatttgaaatgaagaaaaaaatcaaaagatcaatgaaacaaaatgttggctttgtgaaaaaataaacaaaattgacaaacctttaactagaataagaaaaaagagagaagacccaaatatataaaatcagacatgaaaaaggaacattacgactgacactgcagaaattcaaaggatcattcgtgatgactatgagcaactatatgccaataaattggaaaatctagatgaaataaattcctagatacataaaatctaccaagattgaaccataaagaaatccaaaacctggctgggcgcggtggctcacacctgtaatcccagcactttgggaggctgaggcgggcagatcacctgagttcaggagttcaagaccagcctgaccaacatggagaaaccccatctctactaaaaatacaaaagttagccaggcgtggtggcacatgcctgtaatcctagctacttgtgaggctgagacaggagaattgcttgaacccagcaggcagaggttgcggtgagccgagatcatgccattccactgcagcctgggcaacaagagcgaaactctgtctcaaaaaaaaagaagaagaaagaaagaaagaaagaaatccaaaacccgaacagactaaaaacaagtaattatattgaagccataataaaaagtctcccagaaaagaaaagcacgagacccagtatcttcacagctgaattctaccaaacatttaaagaactaataccaattctactcaaactattccaaaaaatagaggaggagggaatacttccaaactcattctgtgaggcaagtattaccccaataccaaaaccagacaaagatacatcataaaagaaaactataggccaatatcaatgatgaatattgacgcaaaaatcctccacaaaatattagcagaccaaattcagccatacattaaaaagatcattcatcattaccaaataaaatttttccctgggaggcaaatcaatcaatgtgatacatcatatcaacaaaatgaaggacaaaaaccatatgattatttcaattgatgctgaagaaacatttgacaaagttcaacctcccttcatgataaaaccttcaaaaaactggggatagaaagaacatacctcaacataataaaagtcatatataatagatccatagctagtatcatactgaatggggaaaaactgaaagtctttcctctaagctctggaacatgacaaggatatccacttgcaccactattattcaacagtcctggaagtcctacagcaatcagacaagagaaagaaaaaaagaacatccaacttggaaaggaagaagtcaaattatcctcatttgcagatgatatgatctgatattgggaaaaacctaaatactccacaagaaaactattagaactgataatcaaattcagtgatgttgcaggatacaaaattaatatacaaaaatcagtagtatttctatatgccaacagtgaacaatctgaaaaagaaatacagaaaggaatcccccagttaataggattcctattttaaaaaagaagaaaagaacaatattaaaagaaagtaatcccatttataatggctacaaatgaaataaaatacttaggaattaacaataacaagtgaaagattcctataaaacattgacaaaaaaaattgaagaagacacaaaaaaatggaaagatatttcatgttcatggattggaagaatcactattgttaaaatatccatagtacccaaagcaatctacagattcaatgcaatgcgtatcaaaataccaatgacattcttcacagagagagaagaaaatcctaaaatgtatattaaaccaaaaaagacctagaacagccaaagctatcttagcaaaaagaacaaaactgaaggaatcatattacttaactttaaattacactacagacctataataaccaaaatggcatggcactggcataaaaacagacacatagatcagggcagcagaacagagaactcagagataatcccatacctccacagtgaacttatttttgacaaaggcgccaaaagcatacaatggggaaaggacagtctcttcaataaatggtgctgggaaaactggatatccatatgcaaaagaatgaaactagacccctatctcttgctatatacaaaaatcaaattaaaatgattaaagacttaaatctaagacatcaacccatgaaactactacgagaaaacattgggaaaactctccaggacattagactgggcaaagatttcttaaacaataccccacaatcacaggcaaccaaaacaaaaattggcaagtgggattacatcaagttaaaaagcttctgcacagcaaaggaaggaatcaacaaagtgaagggacaatccacagaagggagaaaatattttcaaactacctgtctgacaagggattaataaccagaatatataaagagctcaaacaactttataggaaaaaatctaataatccgatcaaaaaatgggcaaaacatctgaatagacatttctcaaaatgtacaaatggcaaacaggcacaaaaaacgtgctcaatatcactgatcatcagagaaacgcaaatcaaaactacaatgagatatcatctcacaccagttaaaatggcttttacccaaaagataggcaataacaaatgctggcgacaatgtcgagaaaagggaaccctcatacactgttggtgggaatgtaaattagtaaatcactgtggataacactttagaggttcctcaaaagagcgaaatagagctactataggattcaacaatcttgctcctaggtatgtacccaaacgaaatgaaatcagaggggctgagctcagtggctcatgcctgtaatcccagcactttgggaggccaaggcgggtggatcacctgaggtcaggagttcgaggccaccctgaccaacaaggtgaaaccccatctactaaaaatacaaaaattaactgggtgtggtggcatgtgcctgtaatcccagctactcgggaggctgaggcaggagaatcgcttcaacctgggaggcggaggttgcagtgagccgagatcgcgccactgcactccagcctgggcgacggagcaagacacggtctcaaaaaaaaaaaaaaagaaaaaaaagaaaaagaaatgaaatcagagagatctgcactcccatgtttattgcagcactattcacaatagctaagatttggaagcaacctaagtgtccatcaacagatgaatggataaagaaaacgcggtacatatacacaatagagtactactattcagccataaaaaggaatgagatcatgtcatttacaacaacactgatggatggtccttatgttaagtgaaataaaccaggtacagaaagacaaactttgcatggtctcacttatttgtgggagctaaaatttaaaacaattgaactcattgacatagagagtagaaggatggttaccagaggctgtgaagggtattgggggagcgaaggggaagtgagaatggttaataagtacaaaaaaaaaatttagaatgaataagacagtatttgctagcacaacagggtgactatagtcaaaaataatttaattgtacattagaaaataacttattcaattgtttgtaacaaaaaagataaatgcttgaggtgatagataccccatttattcttaagtgattattatacattacattcctgtatcaaaatatatacacctactatgtacccacaaaaattaaaaaataaaaattttttaagtggtggagtaaggatttgaacccaggtctgcctgatcccaaaggccatgctcttttcactatatattctgactctgcctagagtgatcattcagggctggaaagaaatgaactggtggggagcagtttggaatcactcaagactcctgagcccaatgtagaagaaaagaggtttaaatttatagctctgcagacttcaatccctcagcaagcaccgggtgtactgtccttctcaggtgcctctccacacccctagaacccccatccacatgctgaaggctgggtgctgctgagagctttgcacttccaacgcctgactgggagaaactgaatgatgcacggaaatggctaaggccagcatcagcagagaggagggaaagaggccgacacagagtagtgtctcaggctgaaatgggcattcaggacaaggaggtgggagagaggggaggaataagtgcaaaaagagtgggtaggctaggaggaggaagggctggggaaaagcctgtcaggtcaatgggaccaaggaagggtaatgagaggaagggggccagggtgaggggaacgggcagtttgagtgagtgatcaaacgggagtgggaaatagatgggcaagaaggagaaagaggaaaatgaaattgaagatggacatttgtcttgggaaaaagaaagaactttggaggaaaaccagtgtgctcacttactccagcagggacaggaaagacatcgtgttgctgtggaacccagaagtagcaggctgcctaggtaaggcttgattctaatatgtgttgatgatgggatagggctctcagcagcctggccgacattactgtaacttttgggtttcccgtgatctggcaaatgcaagtaactgtactaattccacctcctagttagataataaccttttttttttttttttcctgagactgagtctccctctatcacccaggctggagtgcagtggcacaatctcagctcactacagtctcaacctcccaggctcaagcaattctcttgactcggcctccagagtagctgggattacaggtatccgccaccatgcccagataatttttttattttcagtagagacagggtttcgccatgttggccaggctggtctcgaactgctgacctcaagtgagccacccgcctcagcctcccaaagtgctgggattacaggcggattacactgcacctagccagataacaaccttttctaagtgctttcccttgttctcatctggtccctgcaacacttaaccagtatgatgagatggtcccattatgcccattttacagggaaagaaattaagactcaggtgaaacaacttgctcagagtcatagatcaagtacgtgactgaatagaaacaacaggttcgttgtgattttaccaaaaccattattgaccagtctgagattataggccgcagtggctcaagccggtaaccctagcactttggaaggccaaggcaggcagatcacctgaggtcaggagttcgagagcagcctggcaaacctggtgaaaccccatctctactaaaaatacaaaaattagccaggcatggtggcaggctcctgtaatctcggctgctcaggaggctgagccaggacaattgcttgaacctggagggcggagtttgcagtgagccagggtcgcgccactgtactccagcctgggcgacagagtgagactccatctcaaaataataataataataattattattattattatagcaggaagtgactcagtgacaagaagtaacatacaggtgaggacgggctgagcccaccaaaaaatatccccaccctcaaaaaccattccttctttgtccataaagtcgatgaaggcagatgcttctcaccctagacctcaggtcttcaggtccctcgtagcagctctgagagtcctcagtgtggagccccatgtcaagcattccctaagtgaaaacaataatcagtttagtaatttgggagccatcaagaactcattcatggcttagatattgtcaaatatgtgcaagtgaaattactgctccttgttcttcgggggtgaggtggtattacatacctctatcttatctcttaggctgctttgcttgccctattgttttagaaggtgattagctttttttctggttggtgtgcaagacccatataacttaggtggtcattttgtaatgcccaactttgttttttcctttattcacctagccttgtttctcccttagctaagagaaccagacaaactccatcttggctctttcactggcagccccttcctcaaggacttaacttgtgcaagctgactcccagcacatccaagaatgcaattaactgataagatactgtggcaagctatatccgcagtccccaagataacgcccaaaaccccgcgtctatcaccttgtaagtcttaaagcccctgcacctggaactgtttactttcctgtaaccatttatccttttaactttttgactacttgacttctgtaaaattgttctaactagacccccccactccccttcctaaaccaaggtataaaagttaatcaagacccttcctcggggctgagagaattttgagcgttagccgtctctttggccgccggcttaaataaaggactcttaattcgtctcaaagtgtggcgttttctctaactcgtttaggtataacaatttgatctactgatgctgaacactagggattccaaaactttttattgctaagaaggagtcagctgcctgaaagtctgggggaagagttttccaggcagatggaacagagacaaaaaggctctagggcaagagtgatcttggtgagttcaggaaacaaaagtttggtgaggctgaaatgcagggagcagccggaaaatggcatgaaaaggctggatgcagtggctcatgactgtaatctcagcactttgggaggctgaggtgggcagatcacatgaggccagaagtttcagagcagcctggccaacatggtgaaattctgtctctcctaaaactacaaaaattagccaggcatagtggcacactcttgtagtctcagctactcaggaggctgaggcacaagaattgcttgaacctgggagatggaagttgcagtgagctgagatcgcgccgctgtattccagcctgggtgctctgtttctgaaacaaaacaaaacaaaacaaaaaaagaagtcagagaggaaggcggcgttcaactatgggatccttgcaatgtagggtatgaaatctggacagggatgggctgccagaagagataggaatgtcccctttggagtccccaatttaacattacagaatggcagagaaagtgagactgaggaaacccattccaaccatgctgagcccctaaacaaaggaggctgttagaaatgaggtgggtgattgggaggaaacacaaagaccaccagtttgcaacacaaaaagcaagtggcctgaataactttgttaagcaccacaccaacttcttcaacttagagaacaagggtggttcgagaggatattt

SEQ ID NO: 1049 - DNA, 21920 bp, Homo sapiens
tctcaaaaaaaaaaaaaaagaaaaaaaaaattctctctcccagatcctagtcctgaattgccatcctgtcagaggtgtgtgaaccagagtgactccatcttgaataggagctgggtaaaatgaggctgagacctactgggctgcattcccaggatgtgaggcattctaagtcacaggataagacaggatgtcggcacaagatacaggtcataaagacctcactgataaaacaggttgcagtaaagaagttggtcaaggctgggcatggtagctcacgcctgtaatcccagcactttgggaggccgaggtgggaggatcacctgaggtcaggagttcaagactagcctgaccaacatggtgaaaccccgtctctactaaaaatacaaaaaaaaaaaattagccgggtgtggtggtgtacgcctgtagtcccagttacttagaaggctgaggcacgagaatcgcttgaacccgggaggcagaagttgcagtgagccgagatcatgccactgcactccagcctgggcgacagtcagattccatctcaaaaaacacaaaaaaagagattgcagtaaagaaggcagccaaaacccactgaaaccaagatggcgatgaaagtcacctctgatcctcctcattgctcattataccctaattataatatattagcatgctaaaagacactgccaccactgccataacagtttatagatgccacggcaacgtcaggaagttacgctatatggtcttaaaaagggggaggaatcctcagttccaggaattgcctacctctttccctgaaaactcatgaataacccaccccttctttagcatagaatcaaaaaataactgtacgtatgcttattcgagcaccccatgacactgctctgcctatggagtagccattctgtataactttactttcttaataaacttgctttcactttactctatggacttgtcctgaattatttcttgcactaggtccaagaaccgtctcctgaggtctggagcgggaccccgtttcttgatagtttgtatgtccagcaaattactaatcatatgtatatcttttttgttgcacaaatagtatcatccagtatatactcttgtgcactttgatttttttcatttaaaaatagatctttggaagggcgtggtggctgatgcctgtaatcccagcactctgggaggccaaggcaggcagatcacgaggtcaggagttcgagaccagcctggccaacatggtgaaagcccgtctctacaaaattcaaaaattagcccgtggtggcaggtgcctgtaatcccagccactcagggaggggctgaggcgggagaatcgcttgaaccggggaggcggaggttgcagtgagccaagatcgcaccactgcactccagcctgcatgacagagcaagactccatcccaaaaaaaaaaaaaaaaaaaaaaaaaagatctttatcaagtcatctatgaatgggcaaatgagcttgttgccagttttccacaactaccgatattactgcaataaacctccctgcccatgcatctctgtgcatttgcatagggttcccttctggaagtggagttgctgggtcaacagatatgtgtgttaagcgttttagcagatgttactagattgtcctccaaagaggctggtccagtagacactctagctggtagtgcaacagagtgccagcttccccacactcccaagtgcctgctaccctcttcttctgcattgcctgcttcaatcctctcaaggcccctggctggagtatagacaccatacgatacaacctctgggaaaataaatgaagaccacccaaatgaaaactaacacactactcactctgagcttgctacagcaagagggtcagcctccatccattgaagagactcagaggcaggcaggggagagggaacactttgcagtaggaaagagggaaggcacggggtgctttgttttacttatttctttatttttgagacagagtctcactctgtcacccaggctggagtgcagtggcacaatctcagctcaatgcaacctccacctcctgggttcaagcgattgtcctgcctcagcctcctgagtagctgggattacaggtgtgcaccaccacacctggctaatttttgtatttttagttgagatgaggtttcaccatgttggccaggctggtctcaaactcctgacctcgtgatccacccacttcagcctcccaaaatgctgggattacagtcatgagccactgcacccagcctgatggaccacatatacaacggtggccccaccccataagatataatactaaatttatactctaccttttgtatgtttagatatgttcagatacacaaatacttatcattgtgttgcagttgcctccagtgttcagtagtcacatgcttgtgcaggtttgtagcctaggagtgtagccacccgataggttctccttgcctgctgcctagacagagccagtttatcaagataggggaattgcaagagagagagtttaattcatgcagagctggctgtaaaggagaccagagttttattattactcaaatcagtctccctgagaattcagggattggagggtatttttggttgttgtttgtttttttgaggcagggtctcactctgtcacctaggctggagtgcagtggcgtgatctcagcttactgcaacctccgcctcctgggttcaagtgattctcctgcctcagcctcccgagtagctgggattacaggcacacggcaccacgcctggctaatcttttttgcatttttagtagagacggggtttcaccatgttggtaaggctggtcttgaactcctgacctcaggtgatccacctgcctcggcctcccaaagtgctgggattacaggcatgagccaccgtgcccggccctaacttgatcacctttcattagttttacaagaacagtttagttttggggaagggctattaccgtttaaactataaactaaatttctctcaaagttagcgtggcccatgcccaggaatgagcaaagacagccaacctgtgaggctagaagcaagatggagtcagccatgtcagatttctctcacggtcttataatttccttggttttaatttttgcaaaggtgggtgcagaagcaataggctagaccatctaacctaggtgtgtaggaggttagcccatctacttttgtgtaagtccacttgatgtttgcacaatgatgaaatcatataataacacatttctcatataacccttgagcaatgcacgtctgtatcgttgactttcttttcttttctttttttttttttttgacggagtctcgctctgttgcccaggctggagtgcagtggcactatctcggctcactgcaagctccacctcccaggttcacaccattctcttgcctcagcctcccgagaagctgggactacaggcgcccaccaccaggcccggctaattttttttgtatttttagtagagacggggtttcaccatgttagccaggatggtctcgatctcctgacctcgtgatcccccccacccaccctcctcagcctcccaaagtgctgggattacaggcgtgagccactgcgcctggcatcattggctttctatggctggttctgagttggaaaagtggggagaatagggaagctggcagctactgaaactgtctttgcaaaaaccataatagtgagaaaatgatgacagtgaaaaagagctgacccaaccaacccccatctttcctttaatctccaaactgcccttggtcattcctgggcttggaccaagctaacttgggggaaatttagtttatagtttaaatgataatagcccttcccccaaattaaaccacctttgtaaaacacaagaaagaccacaaggttaggaggatgagaggggcctgaattctgcaagatttaggcgagttaccagccattgttccagaagtcacaagatctgcaacttctccaattactcatgtagataacatcactattgcagaacctgtgatagactttttttggtttgtttttgttttttttttttgagacagggtctcactctgtcacctaggctggagtgcagtggcatgatctcagctcactgcaacctctgacttctgggttcaaatgaattcttatgtctcagcctcctgagtagctgggattacagctgcatgctgccacgcctggctaatttttgtatttttagtagagactgggtttcaccatgttggccaggctggtcttgaacccctgacctcaagtgatctgcccgcctcagcctcccaaagtgctggcattataggtgacagacactgcccctggcctatgataggcctttgaagatgtgttttcaggccgggcacggtggctcacacctgtaattccagcactttgggagaccgaggcaggtggatcatgaggtcaggagatcgagatcatcctggctaacacagtgaaaacccgtctctactaaaaaatacaaaaaattagccaggcgtgatggcaggtgcctgtattcctagctactcaggaggctgaggcaggagaatggtgtgaacccaggaggcggagcttgcagtgagccaagattgtgccactgcactccagcctcggggacagagcaagacatgtccaaaaaaaaaaaaaaaaaaaaaagatgtgttttcagacttttgcatttctgactgttggatgagtccacccagaccagtgactcctctgtggctctacccagaagcagactcaatgtaaaaggaccattttccacacctgtatgattgcatccccaaccaatcagcagctcccattccctagcccactgcctaccaaactattcttgaaaaaccctagtctctgaactttggggaaggctggtttgagtaacaataacgctccggtctcctgtacagccagctctgcatgaattaaattccttctctgttgcaattcccctgtcttgataaattggctttatctgggcagtgggcaaaatgaatgcactggatggttacactatggaccaagcaccggctctccaggctgaatgctgcagaggctgtggtgagagtcctattgtcacatgcagttgggacactgtctgtatttcagtctcatccctgaatgctctggctctcctccctctttaggaacatgctctctctccagggtggaacccaagtcaccattcaggtgccaactctgtgaagctggttctgcaggctccttcttcccatcagaatgtcccctgctgtgtattgtttagcattgctacttattctgctttgcattagacttacaatagctttagtagctactgtatatgcagtgcctactactgggcctctgtgtgctctgcagactcctggctgccagtatgtggctccctgtgcctgggggcttttttttaaccatgggaacttactctgctcccacttgctgaaagcccacccctcacgcacagctggcaaagactgatggagtgggtgtgtacttccgaggaggatggatctgtaggttgatggatccccaccaggttatttaagggtatatgttggccacacatggtggctcatgcctgtaatcccagcactttgggaagctgaggtgggcagatcacttgaggctaggagtttgagaccagcctggccaacataatgaaacgctgtctctactaaaaatacaaaaattagtcaggtgttgtggcgcatgcctctaatcccagctacacaggaggctgaggcagagaatagcttgaacctgggaggcggaggctgcagtgagccgagattgccccactgtgctctagtctggagtgcaaaaaaaaaaaaagtatatgtgtcagaagcgtgtgaaccagagcaactccatcttaaatatgggctaggtaaaacaaggctgagacctactgggtgcattcctagatggttaaggcattctaaatcacaggatgagataggaggtcggcgcaatatgccggtcataaagacctcgctgataaaacaggttgtggtaaagaaactggctaaaaccaaccaaaaccaagatggcaatgagagtgacctctggtcgtcctcactgctactctcccaccagcgccaggacagtttacaaacaccatggcaacatcaggaagttaccttatatggtctaaaaagggtaggcatgaataatccaccccttgcttagcatatcatcaagaaaaaaacataaaaaatgggcaaccagcatccctcagggctgctctgtctatggagtagccattcttttgttcctttactttcttaataaacttgctttcactttactctatggactcaccctgaattccttcttgtgtgagatccaagaaccctctcttgaggtctggattgggaccccttatatgtctgctgcttaaacctcacctcccaggccatggtgctgagccaaggggcaggtgtcgcggagaacccaaaagtcccagagcatatccgggaacatagccaaggcagacagtctcattgcatacaataggcaaagagccagaaaattagcttcaaagcagcatagagatgggtagcggggtggatctctgcagtggtcctgctgctagctaggagtccctatatgtaaatcctcacacactcacctactcgccaggctggacttctctgagttctttggtctcggctctttcccagcttgggagaacattcttctagacaattgcgagttttctccatgacagggtctcatgccacttcccagtggtttgagctctgattgtcctctgctaaatcatgcactttttttaatttttaattttatttttatttttgtggagatgagattttccatattccccaggctggtctcaaactcctgggctcaagcaatgtgcctgtctcagcctcccaaagtgctgggattacaggcgtgagccaccatccatgcccctctgatcatgcacccattttttttcttttctttttttttttttggagacaaagtcccgctctgttgcccaggctggagtgcagtggcgtgatcacagctcactgcagcctcaacctcctgggctcaagcaatcctcccatctcagcctccaaagtagcttgcaccaccaccacatccagctacctttttaattttttgtaggctgggcgcagcggctcacacctgtaatcccagcactttgggaggccaaggcgggcagatcacttgaggtcaggagtttgagaccagcctggccaacatggtgaaacccatctctactaaaaatacaaaaattagctggatgcagtggcatgtgcctgtagtccttgctacttgggaggctgaggcaggagaattggttgaacctgggaggtggaggttgcagtgagctgagatcataccgctacactccagcctgggagacagagcaagactccgtctcaaaataaataaatttattattattattattattattattattattttgtagagaaaggatctccctatgttacccaggctggtcttgaactgctgggctcacaagatcctcccaccttggcctcttaaagtgctgagattacaggcatgggccactgcactcagccagagaattggaaagctgcatggtgtggaaaacttacatatttggtgtcaaaactgtcgcgagcatagaaaaagagtttttctctttcaaggtcatgcaacttgtaaagcagaattggctttgaacccatagtgctcttgattcacgagtgtgttcatgttataattctaattctttgaagcaagacatcatcgtgtatcatttttttagcctcctaatacccataataactccttgtgcaataacatgtttgttgaaatattttaaaaatttggggccaggcagagtggctcatgcctgtaatccttgtaattccagcactttgggaggctgaggcaggtggatcacttgaggtcaggcgttcgagaccagcctgaccaccatggtgaaaccccatctctactaaaaatacaaaattagccaggcgtggtggtgtgtgccttaatcccagctacttgggaggccaagacagtagaatcgcttgaatccgggaggtggaagttgcagtgagccgagatcatgccattgtactccagcctgggcaacaagaaagaaactccatctcaaaaaaaaaaaatttttgtttggggcctggtgcaatggctcacatctttaattctggtgttttgggaagccgaggtgggagaactgcttgaggccaggagttctagaccagcctggacaacaaagcaagatctcatctctacaaaaaatgaaaagattagccgggtgtggtggtgcacacctgtagtcccagctacttagagaagctgaggtgggaggattgcttgagcccagaatttcgtggctgcagtgagctatgattgtaccactgtactccagtctgggcaacagagtgataccctgtctcaaaaattttttaaattatttaattgaacctagctgtgcatgtgtgtttttcaaagtcaataacaggactcccagcggcagggcaaggtcactcccagatgctttgggctccggctgtcttcttcccctccaaccttggagaggcagcctgggatgctttctggggcacgtacaccattggtcacagcccaaccctaccccctccaggagagtcaaaaacacaaaatgccgggcgcagtggctcacacctggaatcccggcactttgggaggctgaggcgggtggatcacctgaggtcaggagtttgagaccaggctgaccaacacggtgaaactctgtgtctactaaaaatataaaaaaattagcagggcatgatggcagatacctgtagccccagctgttcaggaggctgaggcagaagaattgcttgaacctgggaggcagaggttgcagtgagctgagatcgtcccattgcactccagcctggggcgacaagagcgagactccatttcaaaacgaaaagaaaaaaaaaaaaagaacacacaagacacaacaaccttcaaagaaaaaaagaatcgcattttatttggcctattatttgagaacagcaactgtgtctacactcttgataaacccacacagtatatcatgcatagaaaaaaaaagctagagtcttttctccccctaatccccccaccctatcttcccctcaccaaaatgtggggtgagcccagatttgaaggcagtacaggcccttgtccccaagacagcatggagcaacctgtcacaaagcagggaatctccttaaagtcatgtcttcccaaaaagattaaactacccaggctggcccttcaccccagtcctccacgttcatttcctttaaaaaaaaaaaaattatgatttttttttttcaacataaaagtttgagtaggctgggtgtggtggctcatgcctgtaatcccagcactttgggaggccgaggcaggtagatcacttgaggccaggagtttgagaccagcctggccaacatggtgaaacctcatctctactaaaaatacaaaagttagttgggtgtggtggtacacacctgtagtcccaggtactcgggaggctgaggcacgagaatcacttgaacccaggaggcggaggttgcagtgaaccgagattgtgccactgcactccagcctgggtgacagagcgagactccgtctcagaaaaaaaaaaaaaagaaaaagcatcagaaccaggtcaggaggagaaggcaaagagttgccactgctctccttctgggatcttctcacccagctccagaaaggcaaggggccttggatgcttggagccattgctcagcccccgggaaccacatcacctgctccctcgggtttttcatagaagagacacatccctggagagtgttgctaagaaacaggaaaattagctcttccccccatcactgtggcttctccaggccccgagtagcccgccaagcagctcaggcccaaactcagggctggagggctgggcggggattagcaggtggtttggttgccaggatatctctggacagggcccttgacagccactgccctggccctaggggaagccttcttctgcttggcgtccaggttcttcatgtacctctggacccactcctgcttggggtcgccacagaactgctggcccttcttggtggtgaagctgtggaagaaagggacaggggatcagctgaggtcgacagggaccttgggccactccacttcatggcgggggggatgtggacgcccagagacagtaaggcttccttgcaagttgctgagatgatgtcatcttcattttttgacacagggtctcactctgttgtccaggctgcaataaagtggcgatcataactcactgcagcctcaaattcccaggctcaagctgtcctcccgccttagcctcctgagtagctgggactacaggaacatgccaccatgcccagctaattttttttatttttttgcagaaacggagtctcactatgttgcctaggctggtcttaaactcctggccttaagcaaccctcctgcctcagcctcccaaagcactgagattgcagatgtaagccactgcacgtggccttcttattgtatttctatttcatgcctctgtttacaaaatgagttcacagttactacttatgaagctatttggaggacagacacatgtcagcccacgtgaccttgagcaagttaccttcctgagcctcagctgtcctctgtaaaatgggaacaatcatcgctaccccatagaattgttgagagaattagataagatattgtcttgtgcccctgaatagtgacttgttatatatttggtgctcagtagatattgaatctaaatccttctcctggtggatcacgcctgtaatcccagcactttggaaggctgagatgggcagatcacttcaggtcagaagttcgagaccagcctggtcaacatggtgaaaccctgtctctcctaaaaatacaaaaattagccgggcatggtggtgcgtacctgtaatcccagctactcgggaggctgaggcatgagaattgcttgaacctgggaggcggaggttgcagtgagccaagatcgtaccactgcactccagcttgggtgatagagactctgtctcaggggaaaaaaaaaaaatcctcctcctggctgggtgtggtggttcatggccgtaatcctagcaccactttgggaggctgagatgggaggatcacttgagcccaggaggttgaggctgcaatgcaatgagctatgatcgtgccactgcactccagcttgggtgacagagcaagaccctatctcctaaaaagaaaaatgaaattaaaaaaataaatatatcctcctcctagttttatgggcaaggaagttgaggaccagagaggggaggtgacttctccagggatgcacagagctggggctggctgaccttgcttctcagggaccctggagttgcacctgcccccacccctctcctgccacgtgcccatgaaggatacctacatcactcctgccttgaggcatgtgctcctgctggacagctggtagctgaccactcggttctcaggaattctcttggaaacaaagaacatgcagcagggagaggggatgaccacagagcctagaagaggagagagagaagagccacgtcttttcccagcctccccttggctctgggcctcagagctggagcttgaaccctgcaccaaacaccgccagtccattcactgggccaccctttccccagcgcttccctccagccccaggctggtcagtcctgcaccccccactgtgccatcccagccatgcccttggaactgcatcctgtcggaggtcttacccgtagggatgatgtggtgggcacagacaccaaggaacagaaggctggttactatggtcatcaggcctgccatgtctcagagagcagaagcaccagctcggggctcaaagctgacgtgcaggaggaaaggacctagggataaatagctcgggtccttgcagagtaccccaaactccctccctctgccctttatggggcaactagaaggaaacacgcccccgagccccctccacgcttccttgaaaatcctgaggcctgtggtctggaaagaggaagttgttgtcccgttgttgcccagctgagtcaagggttatcttgggctccgaacgaaagaactgggggaggggacatcaccccacctaggccaagttcaaaggtgttggatgcattgtcagaaggcccatgggatcctggctgtgttggccactccctgtgggatcctggataagtcactcacctccctgagcctcagttacttcagctgaaaatgggcagagtcatccctatcttctcccttccattcattcattcattcattcacccaattatttattaggcatgtggtctgtgccaggcactgggaggactctaatggggagacagatttgtgatcaagtgtgtgtaacagacaatgagaggtcagctgggcacgggggctcatgcttgtaatccctgtgctttggaagtttcaagtgggaggatcatttgaggccaggactttgagaccagcctaggcaacaaagcaagaccctatctctataaaaaataaaaaaattagccaggcgtggtggtgcaggcttgtagtctcagctcttggggaggctgaggtggaaggatgacttgaacccaggagttcaaggctgcagtgagctgtgatcacaccactgcctctccaggctgggcaacagagcaacaccctgtcttaaaatcaatcaatcaaccaatcaatcaatcagtccatgacaagtcttgacagagcaaagcagatgctgtcaggaccgctttccatcagctctcggtggccttgaagtcccaacagccatcgcctgtaccctcaagttgccggagccacttagtcaccaagattctagggaagtgggaaatgcctggaaattcacatcctctgaggtggccaatgtctgccagagggatgccgactccagatccagcatgacctaccctgtttcctgagtttccaactcggtcaaatctgtgactctctgtgcagccggactttgcttggccccttcccgcgccgaccagattcccagtcccccgatggtctctcgtggaagcatctcttaataaaccacaagcccatgaatccctgccaagggtctgctttggggaccctgacccaggacaaggtatgggggtggtgggtgggaggaagggaaacataggagaaaccaggggccgggagcggtggctcatgcctgtaatcccaatgctttaggaggctgaggcgggaggattgactgaggccaggagtttgagaccagcaggggcaacatagcaagaccctgtctccaaaagaaatagaaaaattagccaggcacggtggtatgcgcctgtagtcctagctacttgggaggctgagggggcaggatcacttgagcctaggagtttgaggctacagtgagctaggtgagcaccactgaactccagcctgggtgacagagcataatcctgtctcttaaaaaaaaaaaaaaagaaaggctgggtgaggtggctcatgcctgtcatcccagcactttgggaggctaaggtgggaggattatttgagcccaggagttcaagaccagcctgctcaacatagcaaaaccccgtctttaaaaaaaaaataaaaagaaaacaaaaaaaccacgggaaaactggccaattgtgccaggaggaaagttcaggagggactcatagctgacagctgcactgaggttggaggacagaaggcactggcaactacgcggaagcctgtaagtcataacgtccagttcagttgtaagggactgaggcaactttatgaggcagagtgggacatggctcccacctcactccacccccgattccaggatcccaggtcaggacctcatgatcagagactcccttcacctgccactcccatgtggctgactgccacggaggctctacagccctttgtaattattgggtaacaagaacaaggaggaggaggtaacaattggtcagctgcttaattgatcacaggttcatattgctactgacaggcttcaattatgcctaaccataagaaagatttgtgctgtctccaacactcccatacccaacccctccctacggttctctccatttgccttctccaacctccctgctctgggattccagggcacacaccgatgtaagacccacacagtggcatagtgggagcacagtggtactcgtcacttggtggccagctgggtgtctgcgtctcagtctcatgcttgacctgaacgccttgagataaatttatatacccgccaagtgccgagcaaatcacctgtgccatggccagcatttgcagaatgaatagatgatggatcaactctgaaacaacttcctctggaccagggactcctgtgtgggttttgcccacagagcacaactggagcctgcgtgtacacaaggtaagtcagcaaggcgggtcccctgatggaggcaagactgaagtcggggaggctggtagcacctgatctcactgcctatgcttacagagtgaaaaatgctgagagcccaactcagggcttcattagcctggcacctgcccctgtctgccttcacctccccatcagccaacagtaattatcctctgctggcagagcaattagggaggattaagtgagaaaagtcatgggaaggccctttatacatgcagaggtttttttctttaaaattttatttatttatttatttattatttttgatacggagtctctctctgtcgcccaggctggagtgcagtggcgcgatcttggctcactgcaacctccacctccgaggttcaagcgattctcccgcctcagcctccccagtagctgagattacaggcacccaccatcgtgtcttgctaattgttgtatttttagtagagacgggatttcactaggttggtcaggctggtcttgaactcctgacctcaggtaatccacccacctcggccccccaacgtgctgggattacaggtgtgagccactgcacctggccaaaaaaaaaaaaaaaaaatttgagacaaggtctcactctgttgcccaggctggagtgcagtggtgtgatcatagctcattgcagcttccaactcctggactcaggcgatcctcctgcctcagcatcctgagtagctgggactacaggtgcacgccaccatgcccagctaattttttaaatttttagtagagatggggtacccctatgttgcccaggctagtttccaactcctggcttcaagcaatcctcccacctcgacctcccaaagcgctgggattacaggcatgagccactgtgcccagctcatcatgatgtcttatgacagctcttctaatttttgctccccagtgattcagaggggatgccggttgactgcctgcattttctcactcagtgggtgccgggagtgtggtgtgtggggaggaggaagttggggggagaaaggatggtcagacagaggcagcactcaggagaagagtgaggctggggtaaatagggcggggatgcctgccatccccatgttgcaacaggagtgggcgagcagaaggtcattgggtgggagtgtgtggggtggggtgcttcaccccagattagtaatacccattaagggcttttccaaggccttaaaaaacacaaaatatccaatttttttttttttttgagaagagtttcactttgtcacccaggctgcagtggaatggcctgatctcagctcactggagcctcaacctcccgggttcaagcaattctcatgcctcagcctcctgagtagctgggattataggcacccatcaccacacccagctagtttttgtttttttagtaaagatgggatttcaccatgtcagccaggctggtcaccaactcctgaccccaagtgttttacccacctcggcctcccaaagtgctgggattacaggcatgagccaccgcactgggccaaaacacccaatgttttgttgctgttgttgttgtttgttttgttttcagacacagtctctctttgtcacccaggctggagtgcagtggcatgatcttggctcactacaacctccgccccccaggttcaagcaattctcctgcctcagcctcccgagtagctgggattacagatgcacaccaccatgcctggctaatttttatatttttagtggaggcggggtttcaccatgttggctgggctagtctcaaactcttaatctcaagtgattcgcccacctcggcctcccaaagtgctgggatgaccagcatgagccacctcacccaaccaaaactcctaatctttatgctctatacagggaaattgttaaggcagggattaccaaccctgttttacgagggaagagctgatgccttgcaaggataagtgagcagacaccatcacagggccacttagctcccgaaatgggagcccatctctactacaaatacaaaaattagctgggcgtggtggcacgcacctgtagtcccagctactcgggaggctgaagcaggagaatcgcttgaacctgggaggcagaggttgcagtgagccgagatcgcaccactgcactccagcctgggtgacagagtgagactccgtctcaaaaaaaaaaaaaaaaagaaagggagtggttaggtaaaaagagaaagagccaggtgcaatggctcacacatgtaatcccagcactttgggaggccgaggtgggaggattgcttgagcccaggagttcaagtccagcctgggcaacatggcaagacccggactctttaaaaaaaaaaaaaaaattagaaagaggaagagggaagcagtagaagtgggaacctggcaggggcagaaacagcatgtgtggaggaggctggagggtgggtgggaggtgacccacagcagtgtgaggctcttagaacccctgatggctccagcacagaccctgtccctctcttggcctcggtttctccatctgagaagtagcgtgttggccagagcggcctctccccaagtgtaggaccaccagccatgatacaagaaggaacatttctcattttatttaaatgttttgttatggtcaccctctttaataagggactttaaggaactttatatatatatatattatagtaatacaagatttccctaaggtaagaaatatgagggccagggctcacgcttgtaatcccagcactttgggaggccaaggtgggcagatcacctgaggtcgggagtttgggaccagcctgaccaacatagagaaaccccatctctactaaaaatacaaaaccagctgggcgtggtggcacatgactgtaatcccagctgctcgggaggctgaggcacaagaatctcttgaacctgggaggcagaggttgtggtaagtggagatcgcaccattgcacgccagactgggcaacaagagtgaaactccgtctcaaaaaaaaaaaaaaaaaaaaaaaaaaaaaaaaaaaatatatatatatatatatatatatatatatatattcataggctgggcgatgtggctcacatctgtaatcccagtactttgggaggctgaggcaggaggattgcttgagctcaggtgttcgagaccagcctaggcaacatagtgaaacctcaactctacaaaatataaacgaaaaattagccagacactggggtgcatgcctgtagtcccagctatttgggagactgaagcaggaggatcgcttgaacccaggagttcaagactagcctgggtaacataacatatccccatctctcaataaataaataaaagaagggggctgtcatctctgaagataaatgactttaaatacctgaggaagggtcccagaaagggggcactggatctgatggccctaattagggtaaaagtagaccacacacacacacaaagaaagaaagaaaaaaaatcctgtgtcttcttactaaggtctgaactgaattttaggtcaaaccataggcccaagatgggcagctatggtgtagtgacatattttagtccctgacctgctaaaaactggctgtatgagcctgggcaacttgctcactcctcccaagctttgatttcctcatctatgaaatggtgggggcggggaggatgaggccactttttacccatgatctcatgtgattctagaatcctagaaagttacggatgtaagggcttttagtaaactacttcttcttcttcttcttcttcttcttcttcttcttcttcttcttcttcttcttcttcttcttcttcttcctcttcttcttcttcttccttcttcttcttcttcttcttcttctcctcctcctcctcctcctccttctccttctccttctccttctccttctccttctccttctccttctttttttgagatggaatcttgctttgtcgtccaggcaacagcacaatctcggctcactgcaacctccaactccctggttcaggcaattctcctgcctctgcctcccgagtagctgggattacaggcgcacgccaccacacccagctaatttttttgtacttttagtggaggcggggttccaccatgttggccagactggtctcgaactcctggcctcaggtgatctgccagccttggcctcccaaagtgctgggataacaggcatgagccacctcgcctggcagtgcacatgcaagtcttcaccatctagcaggaaccagacccttaagctagaggaactcagccccaagggaggtgtttcaggtatccatccatccacctacccattaattcatctactcactcatccatccatccatccatccacccacccacccacccatctacccactcatccacccatctatccatcatccatccatccatccacttattcatccatccacccttcatccatctacccatccacccatccacctacccacccatgcatccacccctccacccatccatccattcacccacccatctactcatctatccatccatccattcactaatccatccatccatccatccatccatccatccctccacccatctatctatccatccactcatctatccatccatccattcattaatccatccatctatccatcaattcatccatccatccatccatccatccatccatccatccatccctcatcgaaccctgctatataccaggtgccccatcccaggcataccaagaaaaactatatacaggtgttgccttggggaactctcacactagccttgagagacagaggcaattatgacacaggtgataagtgtccagatggaggaggtctaccgaggccacagtggagagcagaagtcatagaaaacttcctgaaggaggtgccccttgtgctgagttaggctgaccaaggggagttgggcttgacagggaggaaactgggcagagaagggtatttcaagccctggaagccacagagatgaagtcaaagcagaggggtgacttggccaggttggagccttaaagaaatcactctggctgcagtaagtcatgtggcagaactggtgggaagcctgtggtagggaatctaggatggagaggtggaggaagttaggatggaaaaaagaggatggatttgaggattactcaggattccatttgctgagctctgatgccatatggttgaggaaaaggaaggattgtctaggataacacttgggtttcaaacttgagtgcatgtgttggggggaccattcatggataaaaacagtctgcaggggctgtggggcttccaggggttctggtagatgcccgaggcaggcagggcaggtagggagaggtctggatgtccaataaattatcagaacaagggaggggctcaaggctgtaatcccaacactttgggaggccaaggcgggtggatcacctgaggtcaggagtttgagaccagcctgatcaacatggagaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaagaaaacaaaattagccaggtgtggtggcacaagcctgtaatcccagctactccggaggctgaggcaggagaatagcttaaacccgggaggcagagattgcggtgagccaagatcgcaccattgcactctagcctgggtgacagagccagactccatctcaaaaaaaaaagaaaaaaaatcagaacaagaagaacctttggagtctcacctgtcccgacactttgtggctgggaactggaagcccagggagattagacagcctcaactgccccacccagctcaagacacagtgtagtaccatggggagggcatggccctagaggtagacactcctgggtttgagcctcgtcccaaccatatgctcacttggtggcccaggcaaggtgtttagcctctgtgaagcttaattcatttactaaaagatgggtgtgtgactgtgcacctcccaggatggtggagggagtaggcctcaagcttcagtgagggactccatgaaacgccaccagaccagcatcccttcagctgttcccctaaagccctacatggctcctctgaactcatcttatcctcttattgtccccatgtcaccagtaaggaaactgaggttcaggctgggcatggtgactcacgcctgtgatcccagcactttgggtggcctaggcggtggatcaccaggggtcagttcgagaccagcctggccaacatggtgaaacccatctctactaaaaatacaaaatttagccaggcgtggtggcaggtgcctgtaatcccagctactcaggaggttgaggcatgagaattgcttgaatccaggaggcggaggttgcagtgagccgagattgtgccactgcacttcagcctgggtgacagagcaagactcaatctccaaaaagaaaaaaaagaaaagaaaactgaggtttagagagttaaatgacttgctcaagactcctaagccacgatggggcagaactcgtcctacatcttcctgggaaggaacctatgcccttgtcatggtgccaggcagcatgctccgctgagtggcaccaatgccaccacaccgagttcactttccgagctgctctccgatccaccccttactttagactctcacggccaccagctttgcacagcctccatcaattctttcttgcattcttgtcccagcctcctaaaggaagcgggtagacatctggggtgtgatgcaggggggagagggcagtggggtgccaggatgaatgggcactgtggtggggagtgcaaggggctagactcaggcatgcagactgggggtgtcactgcttcctgggatatcctgcttcctcgataccaaacacacacacacaaagtcccagaatactgggcacaggggagccacttacccggaggtaacagggtgacagccttggtgccaagtgcagagcagaaatgatttcctctgactcaccagatctgggatggcaggaagaatgggacgagaggaggggcacctggggagggaagggcgcctcccctgcatctcgcctggcttggctgggaaattcaggagtccaaggtttacaaggacttctgagaggttggctttgtggcaacaggcaggccctgatgggggcccatgtgcagggtgggtggtggtccccatcagaagagcacagtgagcccattgtcagacagacttctgtccacacggacagacttctgccctggaaagggtgtggtcccagacggggctggggaggaaaacaggtggcagctatggagtgccttaccctttca

SEQ ID NO: 1050 - DNA, 22294 bp, Homo sapiens
tgactccctgaattatagtcagttccgtacctgaatctccctctagaatgccagtgccacgaggacagaggacggttccactttgttcactattttctccccagggtctggcaaagttcctgggacttgggagaggtgtccttcaggagcttggcagaagccaaacggcacacttaagtagggcaactgaggtgagtttaatgaaggattctatacaaaaatttggacaaggtatagggaggccacaatacacagtgcagtgcctggtgccagtgagagcagggcactattcccactgcaaggccagacagggcaaggggagggagctgcctgacaagagctgcccttacgtcaagggacacatcagcccactagaccccatcaggagggagccagggcctgactcccctgaccttgctctccaatcttctgcctaaaattccccatcagccaaacacaactgaaaactgaaagacaggggagcctgctgttaataaggtgagcatcccccagaataaagctgggtagagagtggagaatggatatggaagggcaaaaggaagatttataagacagtgggcactaaatatctatgagatgaataaaggaaccacattttacaacaaacggtcattgaaacgctactcaatggaaagagatcatttcggtcactgtctggtgcagacaaatcaaagcccacatgcatcaaaaaggccatgtccgtgtaactccgacacggggcagacagcaaggctgaagcctatggggtatgtggagccggaactgagagatcctgatgtaaatctagcacttgggaaaagggggactagaagaaattcacccacaggcagaggaaaacacaaacacttatctatttttgcctaggctttaagtggtatgggaaaaatctctgagactacaaatcctgtgcttcatgcacaggtttataataccctcaaaatggaagaccccaaaacccaggcgcggaaaattcatatcaggccattgatgccctcaatgttcccggctgaaacaaactcaaaactcctctggaaaggagtgctcccacttcaagccatgaaaagctactgcagagaaaataatccccagtcaagacacactcacattgaaactgcaaggcacacaaggaaatggatcaccttgagtgatagctggcagagctaataaacctctgtatacctctaagaagctccacgcactagtataacccttaaagatttgatgaaatcattactttattaaaattgtttttataaaaaatcaaaatccaaaaaaagcaacaaattttataccagagccaattcggtatatacaagggtgtcttactcttttggaatttgtcttattgtcctaactcagcacattgtcctggtctatgaaaagtcctagaaacccttctaccctctgtaatgtaggagctttaactcaatagggttttttaaattcttttttcttgtctttttttcttttttaattttttccattttttcaagtcaaactgaagaaatatttttcttttctttctaggaatgcatattcaccccccaaggccacttgtctcctgattggagagtattagacaattctcaggatttctttattttccttctttattccataggattgggaaacccagtaggattgggtttaggcatatctctaaagcaccatgtttcaacgttttgatgtaagattgtgccctatttcttgttcagttgctgccagcagatgttatagttttaaaactagtttttggtcattgagatattagaggagggaagagtctgctatcctgctttactcatcttcatctacactacactgtcatcttcactgcaaagtcctgtattaatgtttttagattctataacattttaacaggtgtcaaaaaatcttaagcaccacttcagcttgggaatctctaaatgtaatggtgtttgtgggctggactgatgtctgcgtcttgttgttgttattgtctgtagtaatggagagccgggagatcctggacacttcctgttcatgggcacttgatgcattagctgccccagcagctgattacatttaaacaaggatgtgtgggtgaacccagggagaccaatctcagtggaatggtgggggcagaagccaggctgcagggtgtagagtagggaatgagcagtgatgaagtagaaacagagtttggacaactagtgaaactgcctggaagagggggagaagagacagtaaatggtctgaccaatgtttgaggtcaaagtgggtttgtaatctttatttaagggacagatctgagcatttaaaaattctgaataatctaatagagaggaaaaagttgggactcaaagaaaatgtgggaaaaaatgatgaaggttaaacggaatgagatccagagtgcagggggagagattagcctttggtgttagaggagcaactctgtccatggagagaggaaaaatgtagacataccacagttgcatttgaagttggggcctgaggagttgaggagttctgagaaaagcagaagatgagatcatttcctgagagtaaatgggagtcattagaacgggggtgaagagactggaagctttaggtagcttgaaatagttgatggaaaaattggataaagtgacaatttgtcacactcagaacagctatcagggaatctagaagaatctctggaagctagttgaagatcttaaattaccaatgtatcttgtccacatagctaagcggttttacttatttttatttttttgaaacagggtctcactctgtcacacaggctggagtgtagtagtagtagcacaatcacagctcaatgcaatctctgcctcccgggctcaagcaatcctcccaccccagcctcccgggcctgggactacagacacacaccaccactcccagctatattttgtacatttgtagagacagggtctcgccatgttgcccaagctggtcttgaactcctgggctcaagtaatctgcccacctcggcctcccaaagtgctgggattacaagcttgagcccggctgctaagtggttttaaacagctgttctcggaaacacacactcaaagaaaaaatgtagaggataatttatctaaggctggggcttcaagagaggtcagggtgttgacaagagaatgactaagtggcagactactggatctcagctagataaagagggatgtgatcgtgggaggggctgatagtcagaggctggaaggcttgatgaacaacacatattacacaaagaataaatggagtgagagaaaccaaaggagtaaaagttgtcatcagaaaagtgagaaattttattgtgagaattcagtggtaaatcaatgttaacaaacctcagctgggcactagtggagtgaaaccgaaggccagggagttgagttaatgagctgagacttgggcaccagatgggggtccacatggacaactaagccaccaggatgatgtgggaaactggggtgaatagaagccccttatccatgtgcacaagtcttgaataaaataggggcaaccaggcagtcagtggatgatagcagtgaggtggagcagagagcaatgtagttggagaagtggagcccacagcagtctcctttatatctagaagggaattaatagccaaaaaatggcaccgaggccaaggatgtcaccttctgactcccaaatctgagacagatgtgagagggaaggagtatcctcaagggacaggagatggtgcgaatgtttttggcataaatcaaagatgtcagggaaattgtcagaattcaggttccagagacacagaggaaaagcgtgggagaaagtggaatattgggaggtgagattagggcagaggaagcacaaatcaaagaacgaggaatagaaaaagtcatatgagctgaggagttggccaaacatgacagaatgggaatatgatggaattaagtggctttatgtgttccaaaaggattggtccacgcaggccacaggaaaatgggaggtaagaagaaagggatcgaaatgctgcaaagtgtattacttcatggtaagcaaaggactcaagactctagaaaatgatgcccttccttccaagactatgttagtccaaatctttcaagatacagaacccaaggtggggtctggcatacaagaagtataatagaggaaatgtctgtgacatttgcaggactgcaaagggagccaggagaagctgggaaagccatgagatcacaagcaggtctgactccaagtgaaggagatggggaatgacgcaaggtttggctgaagcatgtgccaaaggcacccatcagaggagtccctctccaagggatgggcctatcatagtgtccctaatagtgtcatggagtgggagcagcccacggagggcacagccttggcatgaacgcagacatgggtctcagagtgcagcagctgggcccctcagtcaattaggctccctcagagctggggcaggaggtgcactagaccacacagtaatatttatttattattaatttaattaataatattaatttattaatttaattaataatatatttatttatttattattactagaccacacagtagtatttgtatgtctaaggaagcatttctcagaatatactcactgaacttttagcctataagtacctgtatgaaaattttaaaaggggtttcatgatcaaaacattttgggaaacactccataccctttcttcctcatgaaggatcataatgcctattagtatatgaagggctctgagaagtcctgtagtaaagaaacttgctttagttttttagtccagcaatttttcaaacttaaatgagcaatagcctcccatccttttttttacactttttagcatactgcggaataaactcaacatgcattgagaaagactgctttagggaatagtcaacactatttcactcccagtaagtacatataaaatctgtatttccagggtggattatcaacacagctgtattttagaaatattatctgccctcccaggtatcacagctactaattattgggtactgaggtggaattttagggatcagccaattatgggaaagaaaatctgggggcaggataagatggtctccgaagccttaaaattatatgccattatttacctctttgatctactactcaatatcaaacaactaattcagaagaaaattgattgttttctaaaagtagtttttctacatttcccattaagaagcagtggtatttaaaacttataatggctattatgtgagattatcactatcatagtttttctctatacaaattttctgtaacattttatttgctaataaaaattagatagatggattgactaattgataatctaagaaagattatatttgaagaagccatagtaagggacagattaaattatcatcagtctaaacattctaatacctatttctctttttttgaaattttccaaatttgttattatgcatttaaacaataattttttgaacttttattttaggttctggggtacatgtgaaagcttgttacgtaggtaaccttttgtcatgagggtttgttgtacaaattatttcatcactcagctatcaagcccagtactcaataggtatcttttctgctcctctccctcctcccgccctccagtctcaagtagaccccggtgtctgttgttcccttctttgagttcatgtgttctcatcatttagctcccacttataagtgagaatacaaggtatttggttttctgttcctgtgttagtttgctaagggtaatagcctccagctccattcgtgtttccacaaaaaaacatgatctcgttcttttcatggctgcatagtattccatggtgtatatgtaccacactttctttatctaatctgtcattgatgggcatttaggtttattccatgtctttgctactgtgaatagtgctgcaatgaacattcacatgcgtgtgtcttcatggtagaatgatttatattcctctgggtgtatacccagtaatgggatttctgtttttagctctttgatctaatacctatttctcaagatcaagttagatctctaaaaaaggcatcatcctagcatttccccatcccttccctgaactaaatttaatgttgtgtgtatcaatcagcatacagtcaagacagaaaccacacatgaacattaaatataatgagttattaacttataaaagggtatgaactactaaagggggtaaggagaatgctgaagaatgcaggaatggcagatgtagagagcagccataacctctaagctaaggcacagcagccaaggaaggggcgaactcaaaaaatgccctccctccccagctgatccacccttgttggagggggtgtggctgcaacccaatggatgcccaagaagtttgcagagttgtggcaggttggggctgctgagcaggaaactgcccgaaggggtaccagtgagattcccaagaatgtgggcatgcctctggcgaggaagacgctcttggagtgccagcaaaatttactaggaagctacccagtagggtgccagcaaaagtcagcaggaagccactgtcgtggtgtcggcaaaattcactgaggagtgggcactgcagggtctccacccagcactggcaaatcagccaaaagaacaaaaacaaaataaaaacaaatcccagaaccagaaagaaaaaactctgcctcttactgcgaccctcttatgccttctacagcaactggcaaaggagaaatgtttatggggtccagctctagactcacaaagcagaacacagaagagtgaatgaagagctgaaaggcgataaatcagtaactggagcctcacatcctttgccttttttattgagggtcaatatattaagaagaatatgtctgcgtcttcggtaaaattattgctaaggttatcacccagtgtgtgttttcaacctccctgatataagaacttagtgacaagaaagaatgagacaatgatcatgaactattggacccaaccatttgtggctttagtgcccatcttctcagcaaggctttctctctctctctctctctctctctctctctttttttttttttttttttttttttaagatggagtctcactctgtcacccaggccggagtgcagtggcacaatcttggctcacggcaacctccacctcctgggttcgagtgattctcctgcttcagcctcccgagtagctgggattacgggcacccatcgccacccctcctggctaatttttgtatttttagtagagatgaagttttgccatgtcggccaggctgttctcaaactcctgacctcaagtgatccacccacctcagcctcccaaagtgctgggattacaggcatgagccaccacagccagctctcagcaaggctttttctgactacactatttaaaatgtgatccctgagccaccttggcctctcttgctgtccttccctgcttcgccttctccatagcacttctctcctactaatctacaatttacttgagctctgtgaaggtcaggatttttgcctattttgtccattggtgcatccccagcacctggaacagagctaggcacaggctaggcactctagaaatacttgctgaataattgaattaagtaaatgagtgatctacacgtagtggggaatgagagtatacagtgatagttccttcgactaaaactggggtcaaattatagtgataaagaggaactcagaccttcagaggtaagctttgtggaccacttgccaaggctgcagaatgtgatgtcgtttcacaaacaaggaggccctattatggcttcagatatgagaataataaagagaactttcctttcgcctcaactgcagccttctaaactcttccttccttcctatgtagaagtttcaaggacctcatggcctgagtgtggataggcagaatgctgggaatcaggcaaaaataaaataatactgaaagtgaaggtcatgctaatattagtaagccagggtgatcctgaatttacaaaacatttttctttgggaaatttcacacctcacatgattctgtgtttttacttgggaaatttcacatctcacatgactctgtgacatgcggtacatgaggtgcctgactgctgtttttgtcctctactaatgaggaagagtgtgcgtactcccagcgttttgcaagtttcaaagtctgacttgactttccttccttttcctggaactgatccatgagtatcgagagtaaagctgcccgcacctactcattcaagatcctgagtgtcctgcccagctgcaggaggtggagagacccaggaggaggggccactgctgatcccaggctgtagggggtgggaagagtgtcccagggcaccatgacccccactcactcactcacaggagacccacacaagagaggagagggcacttacagcttaggttcccaccagcaccaactcctctgccatcaaacatcattgtgtttctctttctgccttgtctgtcggcacacgtggagttaaatttaatgctcaatcacatatttgtctgggctctttctgtgtttatttttctcttaatagttctctctcctcccttcctctccccgcccctcctcctccttcttcttttttttttccagagacagtgtctcgctctgccacccaggccagagtgcagagtggcatgatcatggctcaccgcagcctccaactcctgggctcacgtgaacatcccaccttggcctctggaatgtctgggattacaggcacttgccactgcatctggctaatttttatattgtttatagatccgggatctcactatgttgcccaggctggcctcaaactcctgggctcaagcgaccctcccacctcatacttctgagtagctggggctgtaggaatgcgcctcagtgccaggctagtttcttaattttctatttctattttgacaggtacaaattttgtattcaatcctacctcagacacatctttggtgggaaaaggatgtcatttaatcaatatataaattctaagcaaataggtctgatccccaaattaggttagtcacagctgctgagtcgttgacccaagagaagctcatctagattttttcattattttcaagttcctcttctcggttcgtccttcttccagaccgtgccctccccgtcccactctcttcccacagcctcccctccccacagcctcctcccaccattccaaatctgggctgttctctcaatttccttctctctggactcaaacctaccctagcccccagcctcagtttggggttaaacttgtcctcctcacattctctcccacccaacttgatgtcgcctctgtgtcatcaccacgggattttcctcctctgggttctccttttccgagtggggtcagctcccccatgagtcacagcaccaatcacttctggctgcttgcaaacccctttgctttcctcagtgttgacacccagggcagccctatgctcactgccgctgagaccccacctctgcccctggccttttcccagctgacatcaccctgtggcttccattttcctaaaattctcttttgaggcctcagtcttaaccaaagcacacagtgcccctcaaaaatgacaataaaaacccaaacacaccgtgactgtcatggcaggttcctggtccccgtattgaatcagcgggtgggtttctgcgaacactggtgagaggccgcattagagggtcaggaccctcaggtctggactcgtggtcaccacataccttcctccctgctgacagtagctggtacctgttacctactcagagtgtcacatgccacaagccagagcgtcttggcagttctcagcaccttgacatcacttccttgctaccactcagagcggcagtgacacagttcccttatctcagaaggccagaagacggctgtcaaaggtcacagggaaatcaaaggcggggtacagggccagagggaggaggaaacaacttcccggttgctttcagacgcttcagagatcctctggaggcctgggggagcttttgagtactttatttcagttggtccctgagctcggtgagtggggcgggtagagccaccaggggaatcaacagtggtttctcgtgcccctcagggtcaggagcagtctgatcaaaaggagggcatccactgtccggggccattcccacagctcccggatgctgggtctggaggctgcgcccttcccctgcaggagctcagcccagtggtaagtcatctgtgtgtcatctatgtatttaaccccttatggccatgttgatgctgagcatggtttcacttttgcaaacatttatttatacccttcgagagaaaaacgtctcagctgtcacaggaagctgcttcggggggtgagcaaactttttaaaatgcagaaattatgatctacacccgtttcttaaaagtaagccatcgtacttggttctctttaattatatattttcttacatattgtgttcatgtaggcaagtcctgtttctgctaaaagaaggtaagttctaccaaggcggtgtcatgccagctttatttcccgtggcacctggcacactgctaagcacttacatgcttaacaactagattgggaatggtgctgctctggggaagtgggcacacgttaaagaaatgtttatttcagtcttctgaaatagggaattactctggctaaaatgtagctccagaaagggaaagtggggctgtatgaatccaggtccagtttgttgtttcctccaggataaggcagctgtcggaggggaaaatcatctcccatttctccacagggcagtctgaagatggccaattacacgctggcaccagaggatgaatatgatgtcctcatagaaggtgaactggagagcgatgaggcagagcaatgtgacaagtatgacgcccaggcactctcagcccagctggtgccatcactctgctctgctgtgtttgtgatcggtgtcctggacaatctcctggttgtgcttatcctggtaaaatataaaggactcaaacgcgtggaaaatatctatcttctaaacttggcagtttctaacttgtgtttcttgcttaccctgcccttctgggctcatgctgggggcgatcccatgtgtaaaattctcattggactgtacttcgtgggcctgtacagtgagacatttttcaattgccttctgactgtgcaaaggtacctagtgtttttgcacaagggaaactttttctcagccaggaggagggtgccctgtggcatcattacaagtgtcctggcatgggtaacagccattctggccactttgcctgaattcgtggtttataaacctcagatggaagaccagaaatacaagtgtgcatttagcagaactcccttcctgccagctgatgagacattctggaagcattttctgactttaaaaatgaacatttcggttcttgtcctccccctatttatttttacatttctctatgtgcaaatgagaaaaacactaaggttcagggagcagaggtatagccttttcaagcttgtttttgccataatggtagtcttccttctgatgtgggcgccctacaatattgcatttttcctgtccactttcaaagaacacttctccctgagtgactgcaagagcagctacaatctggacaaaagtgttcacatcactaaactcatcgccaccacccactgctgcatcaaccctctcctgtatgcgtttcttgatgggacatttagcaaatacctctgccgctgtttccatctgcgtagtaacaccccacttcaacccagggggcagtctgcacaaggcacatcgagggaagaacctgaccattccaccgaagtgtaaactagcatccaccaaatgcaagaagaataaacatggattttcatctttctgcattatttcatgtaaattttctacacatttgtatacaaaatcggatacaggaagaaaagggagaggtgagctaacatttgctaagcactgaatttgtctcaggcaccgtgcaaggctctttacaaacgtgagctccttcgcctcctaccacttgtccatagtgtggataggactagtctcatttctctgagaagaaaactaaggcgcggaaatttgtctaagatcacataactaggaagtggcagaactgattctccagccctggtagcatttgctcagagcctacgcttggtccagaacatcaaactccaaaccctggggacaaacgacatgaaataaatgtattttaaaacatctatttaatgtattttaaaataatttgtaagttgattttaaaaccaatttaactacattccaaattatagacagcccatttatatgggagtaacttttcaggctcattgcctcgccggtgatgagaagaactagctagctggaagctgtgggaaaaagaggtaaggtaacttgttctgtcgaagttctctaaattctcttgcttacttgccacacccctaggcccccagcttcccctaacccaaggtttctggtattttctcgtactttatcaagactatggaatcttaggagacttaacaaaagcaaatgagaaattatgtttagaaatgtctaacaaaatgaatgctttgtccttttaagtataacacatacctcaggcctcaccagcacataactacaaaaggttgtcccacttcctttctgtggctgagttagtagaacacaggctcccacctgccacatcagcagaaggtcacctcaacatgtgagctacctccccggagaccccccagatccgtaaggatgatgcatccttgatcctaaaaacattttcctgttcctggtgttcagaattggactccacactcactggtctctttataatcttgcttctggccctttgaggcctcaaagctaccagggccttgctgccaggggacaatcaccactcccggctgagtcctgcagacatagggcctgggctggctgcctcctcctgctggcccagcatcttgcttgcactaaagagagctggaggcttggcactgatgcttgctaaaaacctacccaggccgcccactgctgccgcactgcagggcaccagcccacactcctcccctcctggcatcaggcacacgttcacggcactaaaccttacaggaaagcagtggaaccctgtctttccttcacaggaggcactttccttcctaggcaaaaacgatgatacccatgggcacagcatctcacatagggacacatagagatgtctgactcattaaaacccaagtctctggccaattaaaaggggtccttaatgtcctactcaacagtggtggaaggaaatttgctctatattgatgaaatgaggtggagaaaatctgattttccaaacatgagaattctccatatgccaccccataaccaaagaccccttatttgtgttagatgaaacattcaaagagcctattaggatagcggatgagacccccaagggacatgcttatacaacaataactggctccaaaccacactccatggcagtggctctcaaatgccagctcacatcacaagccctgtgctaaaacacagagttctgggccccatcccggagtttgtggttcaggaggtctggagtgtgacctcagaatatgcatttctaacaaattccccaggggatgcagatactgctgacccaaggccctccttctgagaaccactgttccagggagaagaaactcagctaagtaagggtttggctttgtgctgaagacaatgtggaatttagagttggggtgaattattcaggaaagtagagaggtttggagatgtgagggtgggaagcgcagtggagggaggcagagaggaaatatgaagcagcgtcagttggagagaaattaggaagaggaataaaatgatatatgccagggatttcagttttgctgagcccatgatgacagactcttctctggcaccttatgccactcattgagggcttgtagctggctctgctctttcagagtcataatagggctatgggtctgacctcaaggtgagctggaatgggcacaagtaatagataaaactgcaagaagtcactcaagggtccttcctagaacaaaggatccctacattccaaaggcgaatgccggtcactatcataaaagaaaagaaagaaagaaactgatggtgacattttaaatggcaatttttctagcttctaaaaggttgtggagcaactggaactttcataccctgctggtgggaatgtaaaatggtataatcactttggaaaaattggcagtgtcaccaaaagcaaagcctatacctactatccatttcactcctcagtatttacccaagagaaatgagcatgtatgtccatacaaagatttggacccaaatgttcatgacagccttatttatatagcctcaaactagaaaaagtctgtctatcaacaggtgaatggataaacaaatactggcctgtgtatctaatggaatactgctcatccacaaaaagaaacgagctattgatacacacaggagcatgcacgaaatctcaaaatgctgaatgaaggaggccagattttaattttatttttaattatttatttatttatttatttttgagacagagtctcgctctgtcacccagcctggaatgcaatggtgtgatcttggctgactgcaacctctgcctcctgagttcaagcaattctcatgcctcagcctcccaagtagctgtgactacagtcatgcacaagagcaactgactaatttttgtaattttagtagagacggggttttgccatgttggccagctgctctcacactcctgacctcaggtgatccacctgcctcggcctcctaaagtgctgggattacaggcatgagtcaccgtgcccagccggaagccagatattttttaaaagtacttattttgtgattctatttatataaaattctagaaaatgcaaacaaatccatagcgacagcaaatcagtggttgctggagatgttggaggggagaggagaggaatagattgcaaaggggaacaaggaaattcggggggacagtggatatgtctgctattttgactgtggtgatggtttcattggtatatacatatgtcaaaaacgtaacaagttgtatacgtgatttattatgtgttgactatacctcaaaaaggctattttttaaaatccccctcaggctccaggcactccattacgttggtgtgacttgtcttggaaatatactttgagcatttgccggaggagatccagtgcctgggcctctgtttcttctcccaagtagaattggcagctaaaacgggatgcccatgggcacaacttgtcacccccatcaccgaacagggagcagaaggaggctgctgggggtgcccccacagggagcacagtctcatcgggaatgacctgccatggcaaataaaatcaccagggcaagtcaagggagagaccagggaagagagtgatccagtctatattaaaaaaggatgagaaaggttgaagaaaaagagaagaagggacagaaattctcttcacacatttgcagaagtaggtccggactctccatccacttctcctcctccgataggtaggacaggaatctcagaggaaatggcatcatcttcccatgtttacagacacagcaatgaactcaaagaacaatcttatcaggattttccaaatgaaaacatggagcatatagagaataaagatccataaactcgtatggtggctgagactgaaatggttaatgaaaagcaaaagtgtgtgctgaatgacaccagccacaatggcctgaacacttaagtagtgtaatatacttggaacattgacagctaacaaggtcttcctcccatgtcagaccaagaacacagtttcctaaagataaaaatagcacatgcttttccacttttccataagtgactgcattagaaaactaacaaaccatgaaaagcaaaatatggctagtctattcaagaaaaactggtgtttctattttgtctgtaaattactttctaatacaaaaaacaattcctgttacattgaggtaattctaactagggacatatgagagagagattgaaatctcatgagctgtctccttttcatctcaattctgtgtactcgtgggtacaaatggaactagtttttgtttgtttgtttgttttttgagatggagtcttgcgctgttgcccaggctggagtgcaaaggtgtgatctcggctcactgcaacctctgcctcctgggttcaagcaattctcctgcctcagcctcctgaatagctgagattacaggcgcctgccaccatgcctgactaatttttttttttgtttgtattttttagtagagacagggtttcaccatgttggtcaggctggtctcaaactcctgacctcaggtgatccacccacctcggcctcccaaagtgctgggattacaggcgtgagccactgcacctggcccggaactagttttaaaacaggaaacagttgatatactgaatggaaaaacaatacaatttgaagttgaaaaaacaaaataagatgcccagttaaatttaaatttcagttaagcagctaatagttatttagtataagtacaacccatatacgacaattgcagtatttgttatttatctgaaattcagacttacctgggcatcctagtatcctgttttttgttttgttttgtttttccctttgttttcttttttttccccgaaatctgaccaccttaactttaaggtatttattcatttttaaaaactaaatatttttcggcagtcagaactagagcaaagataaatgatcccaggactctgtttagcaggcagtcaggaagtgtgacagtgtggtgggtggcagccccggccaggcctttcctcttccctaaactgccacagcaggactgccacacttgggaatcccagtttccatctgagcagcccctccagagtttggaaggagtcagtgctttagcctgaggagccgtggatggctctaacactttgcttgtcggttgaataaaaatcaacccaaaggtggcctacactcattgaagtaggaatgccagaacttcagtggtgtcacatagaagaaaatatctaagtgcttagggagatggcagtgctagtggatctactggatcattaagactcactcacccacccagcgcaggtctagaggacacacccttgccacactgggaagtgtaaatgagctccagcatctttatttttttttattttttatttgttttattatactttaagttttagggtacacgtgcacaaagtgcaggtttgttacatatgtatacatgtgccatgttggtgtgctgcacccattaactcgtcatttaacattaggtatatctcctaatgctatccctccccccgcccccggtgtgtgatgtcccccttcctgtgtccatgtgttcttattgttcaattcccacctatgagtgagaacatggggtgtttggttttttgtccttgtgatagtttgctgagaatgatggtttccagcttcatccatgtcccgcatctttaaaaaaaaaaaaaaatctctaagtggtggctcttctctgtagatcaggagctgtagtgagcaatgctacaaaactggagtttctaaatacaggggggatggtgggattctgaggaaggacaggccacgtggtaacacttacaaaagaccaagtgggtgtggttgccactgtggacggtggagccaaagcagtcctcagaatagtctgacccccagaggtctttggcattggctggttgatcatggtgtccctggaattgaaatagaaggacggtctactaaatttttacctgatctgtataagcagaagagttctatctctagtgaacagaagtctaactttagtcaccagaactgagagtcaattcaatcaattcccagatttgacatagtttatagacctagaaccccttgaatgaaaggtaagctggctccccttgaggaaggaccctgttacatttccggcattttattctgataatcttttttcccagccttccccaaagcaacttagggccatttaccagggaaagccatggaggaaaaggaaataattaggctatttggagattccaggacactggctctacgctgacaccagttctaagagacccaaaatatctttgtggtctaccagccaaagtagggcttcatagaggtcaggggtcactagagtttgagctcaggtctgtttcactgtgagtctagagggtccctgaacttatcctatagttattcccccagttccagaatgcagaattgagctgagagcagtggctcatgcttgtagtcccaacactctgggaggcgaaggtgagaggatcacttgagccaagcggtttgagaccagcctgggaaatatagtgagaccccatcttttaaaaagacaaagaaaaataaagaaaattgacatggaaaaataatataaaatgtgaataatctcacatctactaaagaaatccaatctgtaattagaactcctcccacagagaactataagcccagtgcccccatcaactggagaaacagaaagaaacaatcttcttaacagaaagcataattggaatagagatactctgcatcggggaagaatccccatattgattctctgatccatagagtgaaggccaagtggaagcctttggaactccctctacctgccaagatactaaacaaaacaacactgcacgtctggaggaattgtagcaagaacttgaaagatgaaggatgatgatgtccacctctctccattcagctcacctatctggtttgtgcagaagacaaataggtgttggaaaatgacagtggaccagtgtaaacttaatcaggcgggggctccagctgcagctgcaggatcaggtgttgtttcatttctgcagctaatcaacccttctcctggcacctggtgtgcagatggcaatttttcttttctattatctgttagtaaagactatcagaagctgtttattttcagttggcaaggtcagcaatacactccaagggaagagcagtctgtctcagatcttaccgatgcctggggatagggagggagtggccccctcaccgtctccaaggcctagtcctctgctcctgctactggcagcaaatccacgcaggtctgcaacaacctcaattcctgcctcctcagaagaaagaattcaattgagggacataagacagaaggagagactgaggcaagttttagcacaggagtaaaagtttatttaaaagctttagaataggaacaaaaggaaggaaagtacacttggaagagggccaagtggacgacttaaaaagcaagtgcgtggtttgaccttttgacttggggttttatacgtcagcatgctttcggggtcttgcgttatttctcccctggttcttcccttggggtgggctgtcccatgtgcctgcctgagcccactggctcaactcctgagatcttatagggaaactactgctcaccagtttcgagtgttttctatctattaggagccggcttttccctgttgccgggtgtgaccaattattactttagaaagacagtcaacaaccgccagaccatcacctgatggtcacctgacactcctggtgtgtggggtatggggagccctctcctgccctgctctttctgactagctacccactataacactcccagagggacctgcacattttgtgctctttgcaagacagtgcctgcccagcacctgtaggcctgctcaccccttcagggtcatgatttttgctttttaccgcaggtacccataagcaaaacatggcattgttcaccatgcttttacattattcacataattttaagttatttacacaacaatgtaaaaccatggtgaaccatgccacatgttgcttatgggtacctgtggtaaaaatcctgctactagctcattttgcagtgtctataatgacaggtaatgctccattcactcctttatgacacttgcaaaaactgagaacataacgcctcccagttaagcaggcatctgggcaatgtgaggagaacagaaatagaccacgctgcatttatctctcttgatgacaggcattgagatttccactttttctggtttcttattatgtctctactgggcattcttacatacatcttgcacgccatggaaagtttctctagggcagtggttcacaaactttttggatacagaatacttttatgtgcttgaaaactgaggaccccatacagctttagtttatgtgggtgtaaggttctagcccaaactgaagtccgaagggagttggtgggtgggtgaggggtagctgaaaaaacacccgaggaatcataggcagtttgaacatggccttatcctctctctgggcacgagccatatgtccagtgtcagcagggtaattataccttttacagacaatagaggctctgaagcaatcacgagctcacgtgagtggtcacctaatgcacctcaagtggcatggttcataatgtgcggagtcgtgtgcctacgctccaaacccactgagtcatggtgcaccaaaaagtggcctcagcctgctcctgactaaagcgcagccatcttccttacactccacccctaggccaggggcatcctccaggtagggacatgtgcccgtagggtggagccctgaatccataatccacagcaacaatacggagagcaacagctcacgactaggattccagctatgctacttatgactatcagggcccagcgtaggccagagcccagggatgtctaccatctctgcagggggtcatcagtaaggctcttgactaccttaatctcctgtgagaccccttgcagggctgctgttatgttctgccaattgtcagggataaaggtacaacattgtgttcctaaaagggcacaggtgcctccttaggcagcagttactatgtctaagaccattcggtttcgcaacaccacctttctgatctgatcaacctcatccattaatgggaagagggccactcaggtgtaattcagagcctgagcagcatgctctgcaagagcagtaacttggcttctacagttgtgacacacactccagggctagtgcctgtcaaggggtaaaaccaccagggtgctcattacacttgcaaaaaccgagagtgtagcacctcccagttatgcaggcatctgggcaatgtgagaacagtggcaggtacatgaggccaccctcaggtataatgtccagtccagtttgcttataggtaaggccaccctgtgtccccacagacccataaactcccagggggcacacagtccatcgaggccccttggtggggccgcgtcttccaccatacctttggtgtggtgacatgtattatgcttacacacactgtgacgggtacccatcccacagtgctattaccccagtgttgctatatgcaccacagtgcctgggccaggggtactgcacgttacctcactagccagccccacccatcataaatgctatgggccagccagggaatggctgtgctgtgggtcttgtggcatcctttgtccaaaacttgccacgttgcgttccaggcatcagccatgggaccccaagtctccagccatgtctggttctctgcagatgctgaatgtatgtgctaaggcaagccatctgcagctgctagaagggcggtgcagatccaacagttggaaacattggtcacttcagtgtaggtgtgggcccagtccacaatgcagttggagcatgttaacctacagttggaatgacagagtaggcataggtactaacagaggaaaatcacatccctcaggtaaaatacaggctaacctttcatccctggataacaatgcagcccccaaggggttctgccctgggcaatagtaccacaccttttcagctccccatggttcctttgggtcctgtattcatgcgaaagtcacaggggagcttgtagtaggccacacagacagtacatttgaaccctggaggaaagtttcttccctggccgttttcctacaaacagttaacttcggggaccattcattgaacacccaaagagtgacatacaagtcatactgtaggccctccccacagggagctacgatggacaaccaccagcagccgggggcttggaggggctatggccacagccaggttttctgttcccctgccttcagggacgttggggcaggcaacaacaggttactgttcatccccatacctggtca

SEQ ID NO: 1051 - DNA, 52624 bp, Homo sapiens
gtggcatttggttttctgttcctgacttagtttgccaagaataatgtccctgcaaaggacttagtctcactgcatagaattccttggtgtatacgtatcacattttctttatccagtcttccattgatgagcatttaggttgattacgtgtctttgccgttgtgaatgtgttgcagtgaacatacacgtgaatgtgtctttataacagaatgacttatattccttgggtatatacgaagtaacggcattgctgagtcaaatggtatttctgtctttaaggtctttgaggaatcgccacactgtcttccataatggctaaactaatttacaccctcaccaacagcattcttttccttccacaaccttgccagcatccgttattttttgactttttaataatagtcattctgactggtgtgagatggtatctcattgtggctttaatttgcatttctctaatgatcagcgatatcaagcttttttcatatgcctgttggctgcatgtacatcttctactaagaagtctctgttcatgtcctttgtccactttttaatggggttgtttttttcttgtaaatttaagttccttatagatgctggatattagacctttgttggatgcatagtttgcaaaatttttctcccattctgtaggttgtctgtttactctcttgatagtttattttgctgtgcagaagctctttaattagattcaatttgtctgtttttgtttttgttgcaattgcttttggcatcttcatcatgaaagctttgccctgcccatgtcctgaactctattgcctaggttgtctttcagggtttttacagttttgggttttgcatttaaatctttaatccaccttgtgttaatttttgtgtatagtgtaaggaaggagtctagtttcaatcttctgcatatgactagccagttatcccagcaccatttttttttttttttgagacagagattcactctgttgcccaggttggagtgcagtagtgcgatcttggctcactgcaatgtctgcctcctggggtcaagcaattctcgtgcctcagcctcccaagcagctgggattacaggcacctgccaccatacctggctaatttttgtatcttttgtagagacaaggtttcgccatattggccaggccggcctcgaattcctgacctcaagtgatccacccacctcggtctcccaaagtgctgggattagaggcctgagccaccacacctggccacagcaccatttattgaatagggaatcctttctccattgcctgtttttatcaggtttgtcagagatcagatagttgtaggtgtgtggtcttatttctgggttctctattctgtttcatcagtctatgtgtctgttctcataccagtatcatgctgttttggttactgtatccctgtagtataatttaaagccaagtagcgtgataactccagcttcattctttttacttaggattgctttggctattcagactcctttttggttccatatgaatttcaaaatagtttttttctagttctgtgaagaatgtcaatggtggttcaacagaaatagcattgaactataaattgctttgggcattgttttagttcattctcacactgctataaagaactgcccatgactgggtaagttataaagaaaagaggtttaattgactcacagttctgcatggctggggaggcctcaggaaacttacaatcatggtggaaggggaagcaaatacatccttcttcacaggatggcaggagagaatgagagcagagtgaagggggaagcttcttataaaaccatcagctctcaagagactcactcattatcagaacggcatggtggaaactgcccccatgattcaatgatctccacctggtcccacccttgacacgtggggattattacaatccaaggtgagatttgggtggggacagagagtcaaaccatatcaggcactatagccattttaataatattgattctttctatccatgagcatggaatgtttttcaatttgtttctttcatctctgatttctttaagcagtggtttgtagttctccttgtagagatctttcgcctccctggttagctgaattcctaggcattatattctttttgtggcaattctgaatgataattgtgttcctgattttgctctctgcttgactgttgttggtgtataagaatgctaatgatgtttgcacattttgtatcctgagactttgctgaagatatttatgagtgtaagaagcttttgggctgagactatggggttttgtagatataggattatgtcgcctgcaaacagagatagttcggcttcctctcttcctgtttggatgcgctttatttctttctcttgcctgattggcctggccagaacttccaatactatgttgaataggagtgtgagagagggcatccttgtcttgtgctggctttcaaggtgaatgcttctagcttttgcatattcagtatgatgttggctgtgggtttgtcatagatggctcttattattttgaggtatgttccttcaacaactagtttattgacagtttttagcataaatcgatgatgaattttattgaaagtcctttctgcacctattgatataatcatgtggtttttgtctttaattctgtgtatgtgatgaatcacatttattgatttgcatatgttgaagcaatcttgcatcacaaggatgaggcctacttgatcgtagtggataagctttttgatgtgctgctggattcagtttgccagtatcttgttgaggatttttgcatcgatgttcatcaaggatattggcctgaagttttctctttttgttgtatctctgccagtttttggtatcaggatgatgctaacttcatagaatgagttaggaaggagttccttctcctcaattttttgtaatagtttcaatataaatagtaccatcttttctttgcacagctggtagaattcagctgtgaatccctctatccctctggtgctgggctttttttttttttttttgtttggtaggctatttattactaccttaatttcagagctcattattggtctgcttaggaaatcaatttcttcctggttcagtcttgggatggtgttgtgtgttcaggaatttatccatttcttctagattttctagtttatgtgcatagaggtgttcataatattctctgatggttgtttgtatttctgtggggtcagtggtaatatcccccttatcatttctgactgtgtatgtttgaatcctctctcttttcttctttattagtctagctagtggtctattttattaattttttcaaaacgccaacccctgaatttctggattttttggatgttctttcatgtctctatttttttcagttcagcactgactggtaatttcttgtgttctgctacttttggagtttgtttgcatttggttctctagttcttttagttgtgatattaggttgttaacgagatcggtctaagtttttgatatgggaatttagtcttatgagtttccctcttaacactgctttagctgtgtcccagagattctggtatatttatctttgttctcattagtttcaaagaacttcttgatttctgccttaatttcattacccaaaagccattcaggatcatgttattcaatttccatgtaactgtatggctttgggtgaatttctctgtcttaatttctaatttgaattatttaaaagccctttcaaaaaggatgaataaaaacaagcccagattgtgaagattgaaataaacaatcaactctgcaatgtctagacattagtgaatgtttgcaagcatcaggaacattgaggaaaatgtgatttcattaagtagattaaataaggcaccagtgattaattctagagtgatggagacatgcaacctctcagacatggaattaaaaatagctgtctttcagaagctcaacaaacttcaagataacacagaaaagaagtacagaattctatcagagaaatttaacaaagatattaaataatttaaaaaacaaagcagatattctggagcagaaaaattcaattgacaagctggaaaatacaacagtgtctctcagcagtattgatcaagcagaataaagaattaatgagcttacaaaagaagacatttacactgccaacaaacataaaaaaagctcaacatcactgttcatcagaaaaatgcaaatcaaaaccacaataagataccatctcatgccagtcagaatggcaattattaaaaagtcaggaaataatagatgctggtgagggacacttttacactgttggtgggaatgtaaattagttcaaccattgtggaagacagtatggtgattcttcaaggatctagaaccagaaataccatttgacccggcaatcccattactggatatatacccaaacgaatataaatcattctactataaggacacatgcacaggtatgtttattgcagcactatttgcaatagcaaagacttggagccaacccaaatgctcatcaatgatacactggataaagaaaatgtggcacatttaccccattgaataccatgaagccataaaaaggaatgagttcatgtcctttgcagggacatggatgaagctggaagccatcatcctcagcaaactaacacaggaacagtaaaccaaacaatacatgttctcactcataagttgcagttgaacattgagaacacatggacacagggaggggaacaacacacatcagagcctattgggaggtggggagtcaggggagggaacttagaggatgggtcaatagttacagcaaaccaccatggcacacatatacctatgtaaccaacctgcacattctgcccatgtatcccatttttttagaagacgtaaagaaaaaaaagaattagtgagcttgaaaatagctatattaaaaagacagagtccaaggagaaaaaaagagttaaaaggagtgaaaacacctacaagttctagaaaataccctcaaaagggcaaatctaagagttattggccttaaaaaggatgtaaaataagagatcagtgaagaagttttattcaaagaaatagcaacttttcaaacctagaggaagatttgaatacccaggtacataaagctcaaagaagaccaaggagattcaattcaaatgagactacctcaagacacaaaataatcaaactctcaaagttcaaggacaaagtatcctaaaagcagcaagagaaaagaagcaaataacatgtaaaggaactctgatacatgtggcagttgactttttagtggaaaccttacaggccaagtgggatggggataatatattcaaagtagtgaagaaaaaaacctcttcaacttagaatgttatatccagcaaaattatccttcaaacatgaaggagaaataaagactttccaagacaaacaaaaacctaagggatttcattaacatcagccctgctttgcaaaaatttgctgaagggaatttttcagtctgaaagataaggtgctaacaaacaacaagaaatcacctgaaagtataaaactcaccagtaaaagtaagtacacaaacaaatatagaacacctctgacactgtaattgcagtgtgtaaaccatgcatatatttagtatgaagactaaaagacaagcctatcaagaataataacaactacaatgatttgttaaatacaggcaatataaaaagatatatagacaacaactcaaaaaatgataaggggagaataaagttaaagtgtagattttttagttttctctttgcttgtttccgtttctattatgagtataattaagttttcatcagcttaaaaaaatctgttataagatgttatttacaagcctcatggtaaccatgagaagaaaaactaaaatagatacataaaaactagaaagcaaaaaactaaaacatactaccagagaaaatcacttgtacacaaaggaagacagtaagaaatgaagacaggaccaatgaaacaactagaaaacaaataacaaaatggcagtagtaagtcctttcctgtcaataatacattgacggttaatggactaaattctccaattagaacacatagagtggctgaatgaataataacaaaaagacccaactgcatgcttcctacaagaaattcactttgcctatataaacacacatagactaaaaatgaaaggatagaaaagatattccatgcaaatttaaaccaaaaaagaaaagggaatagtcactcttatatcagacaaaatagatttcaggacaaatctataaaaagaaacaaggaagatcattatataataataaaggagtcgacttagcaagaggatataacaattgtaaatatatatgcacccagtactggagtccccaaatacataaagcaaatgttattaaatgttattaagttaaagagaaataaacccaatacaactgaagttgggaacttcaatattccactttcagcactggatagatcatcacaacagaaaatcaacaaagaaacatcagagttaatctgcactatagactaaatagacttaagagacatttatagaacatttcattcaggagcttcagaatacacattcttctcagcacttagaatattcttcaagatagaccacatgttagaggacaaaacaagcctcaagaagttcaaagaaattgagatcatatcaatttttttttctgaccacagtagaaaaaaactagaaatcagtaacaaaagtaacattggaaactataaatacacagatattaaaaaatatgctcttgaatgaacattggtcaatgaagaaattaaaaataaaatttaaaaattttgtgaacaaatgaaaatggaaacaaaacataccaaaacttattggatacatcaaaagcaatattaagaagaaaatatatatcaataaacacatccatcaaaaaggtagaaagacttcaaataagcaacctaatcatgcatcttaaaaaactggagcaaaaacaagagcaaatcaaagccgaaattagaagatgaaacaaaataataaaaatcagagcagaaataaataaaattaaaatgaataaaacaatacaaaagatcaacaaatcaaacagttggttttttgaaaattaaacaaaattaacaaacctttagtttagtaagctagactaagaaaaagagggagaatccgaataaataaagtcagagatgaaaaagaagacatgaaaattattactgcagaaattcgaaggatcattagtggcaactatgactaactataagctaataaattggaaaatctagaagacatggacaaactcctagacacatacaacctacgaagattgaacaataaagaaatccaaaacctgaacagatcaataacaataataagattgaagccatagtaaaaaatctcccattaaaaaataaaaattctgggatccaatgggttcaatgctgattctgccaagcatttaaagaagagaactaataccaatcttactcaaactattccaaaaaatagaggaggagtgaatacttccaaactcattgtataagtgtaaattagttcaaccattgtggaagacagtgtggcgattcctcaaggatctagaactagaaataccatttgacccagtaatcccattactgggtatatacccaaatgattataaatcattccactataaacacacatgcacacgtatatttattgcagcactattcacaatagcaaagacttggaaccaacccaaatgtccatcagtgatagactggataaagaaaatgtggcacatgtacaccatggaatactatgcagccataaaaaagaatgagtttatgttcttggcagggacatggatgaagctggaaaccatcattattagcaaactaacacaggaacagaaaaccaaacaccacatgttctcacttataagtgggagttgaacaatgagaacacatggacacagggagagcaacatcacacactggggcctgtcggggagttgggtgcaaggagagggagagcattaggacaaataccttaaaacctgcagggcttaaaacctggatgatgggttgataggtgcagcaaactaccatggcacatgtatacctatgcaacaaaactgcatgttctgcacgtgtatcccagaacttaaagtacaacaataataataataaagggtggggcacgggaaatttcatgacaatgattctttggaaataaaacacagacaacaaagatgaacgtaaacgaatgagtttacatcatactgataatgggttaatatccaaaatatagagagaactcaaacaacccaatattgagaaaacaacctcattaaaaatgggcagaacaacagatatttgtcaaaggaaaacatacaactgtcaaacaggtatatgaaaaaaaatccttaacatcactaatcatcaggaaaaggcaaattaaaaccacagtatcacctcaccttatacctattagatagctataatcaaaaacatgaaagatgaggattgatgaggttgtggggaaaagggatcccttgtaaactagtggtgagaatgcaaattaggacagccttaaaaattaaaaatagaattaccatatgattcagcaattccacttctgtctatatttccaaagtaaaggaaatcagcatgttgaagagacatctgcatgctcatgtttattgtagcactagtcacaataacccacatatggaatcaacctaagtgtccgctgatggatgaatgaagaaaatgtggtacatatacacaatggaatactatttagcctttaaaaagagggaaatcctgtcctttgcaacaaaacaaatgatcctagaggacattatgttaagtgaaataagccaggcacagaaagacaaatgtcatattacctcatttataagtggaatgtgaaaaagttgaacttatagaaacagagagtagagtggtggttaccagtagctggaggaaggtgtctagaggatgttggtcaaaggatacaaaattttcattgggtaggaggagaaagttaagagatctattgtacaacatggtgactacagttaataacaaggtattgtattctcgaaaatcactcagaggaggttttaagtgttctcacagaaaaaagtaagtatgttaggtaatgcatatgtcaattagcttgatctagccattccacaatgtatacatatttcaaaatatcatattgaacatgataaatatgtaaaattttgtcatttaaaaaataaataacacaaagaaaggataaatgcttgaggtgatgaatacctaatttaccctgatgtgatgattacacattgtgtgcctttatcaaaatatctcatataccccatatatatatacacttacagtggacccactaaaattaaaaaaaaatcaattgcatagaaaactaggatatttagcaagttagtaggccctaagtttagtgttgtactactttaaatgctatcttttctttatgtgaatatgtatcataagtaacttttagtaatatacaaacttactttataaccattatatttacatagaaaagacatagtttatgtatgtatttaagctttacttataatgtcctgaggaatgagaaacgaaaccactgagtctttgtgccctcaccaggtgtggctctgcattttattctagtgaacagaattacagtaacaaaaagcagttaaagaatcgttgtgagtcatgccttataaagttagccatatattatttacagacccttcaatatcattaacttttcctgtcttagaaaaactaaagtaaaaataaatttatttttatttggtaataggaaaattattcaaaccaaataagaaaaaatatacagtactgtatatgcaaattgaaacactgtcaaataaaacacattataatacatctaggaaactctacaaaaaattaggaagcccatttagaaattaatagaattaaggacaagtaattaaagcaaactcaaatcaataacattcttatttatttatttaattcccttgaaagtctcatatacaccactaagtagtcacattcacaaacttaatttttataaattcagcagcagtcttaggaatcctaggagaagaagaactccataaaaatgcaactgtaatagtcagtgagagaggtgaatttctgctccattcaatagtccaggtcttcatcaaggtatcttaaaggctgaactaaaaccataaatagaaaaatgtcattttcctctccatatgcgtataagaattcattacattataacacaaagagaaactcacttatgttaaaaattatactactttcctgagcagaaattttaaatgctatttttttttaacttcagtgtgcataagaattacttttattccatggaaatacagtaagattaagaaatgccatttataggagctggcaagatggctgaataggaacagctccagtctgcagctcccagtgagaccaacgcagaagtctctgcatttccaactgagtcatttctgcatttccaactgagtggcgcctagaaccccagggagacagaacctttcactcccctggaaagggggctgaagcaagggagccaagtggtctcactcagcgggtcccactcccacaaagcgcagcaagtcacgaactactgacttgaaattctcgatgctagcactgcagtctgaagtcgaactcggacaatcaagcttggtcgggggagggacatctgccatcactgagacttgagtagacggttttcccgtgacagcgctaaggaggccaaggaggccgttggccagattgcctctctagattcctcctctctgggcagggcatctctgaaagaaaggcagcagcccccctcaggggcttatagataaaactcccatctccctgggacagagcacctgggggaatggggcggctgtgggtgcagcttcagcgcacttaaacattcctgtcttctggctctgaagagagcagcagatcctgacaaggagaattctcccagcacagcgctcgagctctgctaagggacagactgcctcctcaagtgggtccctgacccccatgcctagtgactaggagagacctccaagcaggggtcaacagacacctcatgcaagagagctctggctggcatcaggccagtacccctctgggacgaaacttccagaggaatgagaaggcagcaatctttgctgttctgcagccttcgctggtaatacccaggcaaatagggtctggagtggacctccatcaaactgcagcagaattacagaagaggggcctgactgttataagaaaaactaacaaacagaaatcaataatattaacatcaacaaaaaggacccctacacaaaaaccccaacaaaggtcatcagctccaaatatcaaaggtagataaatcgatgaagatgaggaaaaacaagtgcataaatgctgaaaattccaaaaaccagaatggctcttctcctttaattgatcacaactcctgtccagcaagggcacaaaactggacagataatgaggttgatgaattgacagaagtgggcttcagaaggtggatactaacaaacttgtctgagctaaaggagcatgttctaacccaatgcaaggaggctaagaacctgattaaaggttacaggaactgctaactagaataaccagtttagagaagaacacaaatgacctgatggagctgaaaaacacagcatgagaacttcgtgaagtatacacaagtatcaatagccaaatcgatcaagtggaagaaaggataacagtaattgaagatcaacttactgaaaaaaggaatgaagacaagattggagaaaaaagaatgaaaaggaacaaacaaagcctccaagaaatatgggactatgtgaaaagaacaaacctatgattgattggtgtacctgaaagtgatggggagaatggaaccaagttggaaaacactcttcaggatattatccaggagaacttccacaacctagcaagacaagccaacattcaaattcaggaaatacagggaacaccactaagatactccccaagaagagcaacccgaagacacataatcatccgtttctccaaggctgaaatgaatgaaaaaatgttaagggcaccagagagaaacgtcaggttacctacaaagggcagcccatctgactaacagcagaactttctccagacaccatacaagccagaagagagtgggggccaatatttaatattcataaaggaaacaattttcaacccagaatttcatattcagccaagctaagcttcatgagtgaaggataaataagatcctttacagaaaagcaaatgctgagggattttgtcaccatcaggcctgccttacaagagctcctgaaggaagcactaaatatggaaaagaaaaactagtaccagccactgcaaaaacacaccaaaatataaagaccaatgatactatgaagaaaccacatcaactaatgtgcaaaataaccagttagcatcatgatgacaggatcaaattcacacacaacaatattaaccttaaatgtaaatgggtgaaatgcccccaattaaaagacacagactggcaaattggataaagagtcaagatccatcggcgtgctgtattcaggagacccacctcatgttcaagacacacacaggctcaaaataaaaggatggaggaaaacataacaagcaaatggaaaacaaaaaaaagaaaacaggggttgcaattctagtctatgataaaatagaccttaagccaataaagattaaaaaaagacacagaaggtcattacataatggtaaaggaatcaatgcaacaagaagagctaactatactaaatacatatgcacccaatacaggagcacccagattcataaagcaagttcttagagacctacaaatagacttagactcccacacaatagtagtgggagactttaaaaccccattgtcaatattagacagatcaatgagacagaaaattaacaaggatattcaggacctgaacacagctctggaccaaatggacctaatagacatctacagaactctccactccaaatcaacagaatatacattcttctcagcaccacatagcacttattctaaaatggacctcataattggaaataaaacactcctcagcaaatgcaaaagaacagaaatcataacagtctctcaaaccacagtgcaatcaaattagaactcaagattaagaaactcactcgaaacctcacaactacgtggaaactgaacaacctgctccagaatgactactgaataagtaacaaaattatggcagaaataatgaagttctttgaaaccaatgagaataaagacacaacatacaaaaatctctgggacacagctaaagcagtgttaagagggaaatgtatagcactaaatgcccacatcagaaagtgggaaatatttagaatcaacaccctaacatcacaattaaaagaactagagaagtaagagcaaacaaattcaaaagctagcagaagacaagaaataactaagatcagagcaaaaccaaaggagatggagacatgaaaaacccttcaaaaatcaatcaacccaggagctggttttttgaaaagataaacagaatcgacagaccactagccagactaataaagaagaaaagagagaagaatcaaatagatataataaaaagtgatagaggggatatcaccgctgatcccacagaaatgcaaactaccatcagagaatgctataaacacctctacacaaataaactagaaaatctaaaagaaatggataaattcctggacacatacatcctcccaagactaaacgaggaagaagtcgaatttctgactagaccaataacaagttatgaaattgaggcagtaagtaatagcctaccaaccaaaaaaaaaaaaaaaaaaaaaccatgaccagatgaattcacagccaaattctaccagaggtacaaagaagagcaaataccattccttctgaaactatcccaaacaatagaaaaagagagactcctccctaactcattttatgaggtcagcatcatcctgacaccaaaacctggcagagacacaacaaagaaaagaaaattccaggccaatatccctgatgaacattgatgcgaaaatcctcaataaaatactggcaaaccaaatccagcagtacattaaaaagcttatccaccacaatcaagttggcatcatccctggatgtaaggctggttcaacatatgtaaatcaataaacgtaatccatcatataaacagaacaaatcacaaaaaccaaatgattgtctcaacagatgcagaaaacgccttcgataaaattcaacagtgcttcatgctaaaaactctcaataaactagatattgatgaaacgtatctcaaaataataagagctaattatgacaaacccatagccaatataatattgaatgggcaaaacctagaagcattccttttgaaaaccagcacaagacaaggatgtcttctctcaccactcctattcaacagagtattggaagttctggccagggcaatcaggcatgagaaagaaataaagggtattcaaacaggaataggaactcaaattatctcttgttgcagatgacataattgtatatttagaaaaccccattgtctcagccgaaaaactccttaagcagataagcaacttcagcaaagtctcaggatacaaaatcaatgtgcaaaaatcacaagcattcctatacaccaataatagacaagcagagagccaaatcattagtgaactcctattcacaattcctacaaagagaataaaatacctaggaatacaacttacaagggatgtgaaggacctcttaaaggagaactaccaaccagtgctcaaggaaagaaaagaggacacaaacaaatggaaaaacattccatgctcatagataggaagaatcaatattgtgaaaatggccatactgcccaaagttatttatagattcaatgctattctcatcaagctaccatcgactttctttacagaattggaaaaatctactttaaatttgatatggaacaaaaatagagcctgtatagccaagacaatcctaagcaaaaagaacagagctggaagcatcacgctatctgacttcaaacttactgcaagtctacagttatcaaaacagcatggtactggtaccaaaacagatatatagaccaatggcacaggacagaggcctcagaagtaacaccacacctctacaaccatctgatcttcaacaaacctgccaaaaacaagcaatgaggaaaggattccctattcaataaatggcgctgggaaaattggctaaccatatgcagaaaacagaaactggaccacttccttacaccgtatacaaaaattaactcaagatggattaaagacttaaacataagacctaaaaccataaaaaccctagaagaaaacctaggcagtaccattcagtacataggcatgggcaaagacttcataactaaaacaccaaaagcaatggcaacaaaagccaaaaattgacaaatgggatctaattaaactaaatagcttctacacagcaaaagaaactatcatcagggtgaacaggcaacctacagaatgggagaaaatttttgcaatctaggcatctgacaaagagctaataaccagaatctacaaggaactttaacaaatctacaagagaaacacaaacaacccatcaaaaagtgggcaaaggatatgaacagacacttctcaaaagaagacatttatgtggccaataaacatgtgaagaaaggctcatcatcattggtcatctgagaaatgcaaatcaaaaccacaatgagataccatctcacaccagttagaatggtgatcattaaaaagtcaggaaacaacggatgctggagaggatgtggagaaatagaaatgcttttacagtgttggtgggagtgtaaattagttcaaccattgtggaagacaatgtagcaattcctcaaggatctagaaccagaaataccatttgacccaccaatcccattactgggtatacacccaaaggattataaatcattctactataaagacacaggcacacatgtttattgcagcactattcacaatagcaaagacatggaaccaacttaaatgcccatcaatgatagactggataaagaaaatgtggcacatacacaccatggaatactatagagccataaaaaagaatgagttcatgtcctttgcagggatatggatgaagctggaaaccatcattctcagcaaactaacacaggaacggaaaaccaaacaccgcatgttctcactcataagttggagttgaacaatgagaacacatggacacagggaggggaacatcacacatggggcctgctgcggggtgggggcaaggggaaggagagcattaagacaaatttaagctcctaatgcatgcagggcttaaaacctagatggcgggttgataggcacaacaaaccaccatgacacgtgtatacctatgtaacaaacctgcacattcaacacatgtatcccagaacttaaagattaaaaacaaaaaaagaatcgtcattttttaaaagcaccctcatgtgattctgaagcagttattcagcagtgattactctttcagggaaaagtagttcaattatcatttatcacatcagaaaacattcatatgcttcagattataaatcaaatattattcatggttctcagtttacaacactagaatttttagcttctttatgcacatatgaatgcataattttatagatgtaagcattgtatttaattatagccaatacataaatggaatattattatattttataatgattttttcttttttagttgcctaaaccgtcatttttccagtcattactccatcaattggcattcactttgtttctagtttttgccactttcaacaacatggcagaaaggaatctttgtatatttgtcattacatactagtgactttattggtaagaagaaattctcagggatagaattattgggtcaaagggtctgtgaatctttgaaaataatttttaatagaaactgccagattgctttctccaaaggctacctaccatatctcacacttccaaaagcagtgtttgaaatggcctttttctctgtattcccgccagtaataaatattgatggtatttcaaatttttgttagtctgatttgtataaagtgatagctcattgttaattataatttcaatcctccagacatttaaaaatgtctgtcatttgaaattcattttgtgtcaattgtcttttcatagctttgcccaattatctattagatgttacacatacacatacatacaatttacattcacatatattaacccttttgtgctctgtacagtttctaagaactctatgtatctatgtgtgtatatatatagtatgtaaaattagctctgcattttatagatattcacaatttatatttcatgtactttaagagttccaactcttatcctttgtcttaatctatatttcgtatatacaaatattctgtagtgtcttgtacagtctttaccatagcatgtattatacaatgtagatatataatatgtagatgaattataggaatatataatatttctataaaaaatactttttctacatttcatttctagatgtagtcttccccaaattattattttaaaaacagaaaatgtatctagtaactcatttcacaatctttttctcttgatgtatagcttaactatacgtcttgttcacatttgaatttttttttatgtttttctcatgaaagcaagttgtaaaatgcaattctaatcatcttgtctcatctgaaactttcaaagctcatcatcacctcttcaacagacccccagtgaaagagaacataaagtatagcaggtaagaccattcattacagggctctatgcagccttttcagcttagattctaaccacctctcttctctccacatggcctcttcatattaccacctatagactatgatatcttttattaaacaatcatgtctttgccaatagtagattttatctctatcttcagtgctcacggtgccacttgttaccataaatacgttcaatatacgtttttgaataaaaaacttcttatagttccctaaaggcatggttcttttttctgcctctagtttgcacatactgtgtcctttctttggaactgtctatttttcagttatttttaaagtttaccttaaatatcatatcatcttacaacaaccccaaagtttcttaggcaaactttctgtagtgccttgtacagtctttaccatagcatgtattatacgatgtagatgtataatatgtcttatctttttcctgaaatgatacctgtaatgtcttcaaaagattaatttgtatttgtttactcagtttctccttagctccatggatgtgttattactatttgtgtgtataattaagagatgaatcagttatatttataagcttttatatattctcaatatagatatatacatatacaaacatatgcacataagcaaataaaatatgtttatatacattctttctttctaatgccagaagagctctcagtcctcaaaaggaatgcagctgttttgaacaatgactaataaattctcatcactcacctcactgggttataaattcccattttccttttcagtgtggctcagaatggcctccttttccattccagaaataggaagaaatttagacacagaaattagttcagcagcactgaaatcagctgactcatgggaattttctgaaaggaagaaaataattactgggaaataaaccagacctcttctcacgtaactgtgaggctctttgagcaactaaaaacaccacccataactaggaagaaaagcatgtgtgatttaaggggcagagaaagtctttcctatttcttaaatatgtttcctgacacagtaacagtacatgttccttaaatatgttccctgacacagtagcagatgcataattctttggatggaagaagtgaggcaggcccctctcagaaggtcagggacccttcatggagtaaagacaatgggttttgggatatttcttccaacccagtaaagtcatcctgcccagatgcagaattagtgcactggtgctaaatagaagttcaaggataaaacagcatgatgtgatgagaaataaggctagttctgtggatttgtatggcttctcatgcaataaagatattgaaagtttaaggttttagacttttagggaaaaatataataaatatcaagctagagaaaaaaaatgacaggaaatgggaatggaagaaactgtgaaagacgtatgtaggtcagaggatacaaagtagcagatacgtagaatgaaccagtctagaggtctaatgtacaacatgaggattataggtaataacattgtgctgtatgtaggattcatgctaagtgagtaggttttagctgctcttgccacaagaacaacacaaaaaagggtaactatgtcagatgatgggtgtgttcatttgctttgctttagtaagctttttactatctatatacatcccataaaatcatgttgtataccttaaatatacacaacaaaatttaaagaaaaaagttaaactgtcacttatgacaatcttttgtaagattaatttctgttttaataaaatgaggtccaagtcataatattcctctgcatggttctttccatacctctatcaggaataatcacaggcctcttaagctaaaggcctccctatgattgcaattttgatattctccaagaataattttcagtcattcttgtccattatatgcatctaagcttcctattacatttttagacttttttaactgtttatcaaagtagaatgtctgtgcctcaactgcagccactgatctgaacccctgggcaatagaccctccaagaacccacagacctgaggaattcattaggtccagatcatctgcattcaggcaagaattcatctcccggtattgaatttggtggactaagttctctcctcttgaggaaactgaaaacagagatccctaggttagggatcagctatcataataaaatttcccttgctgtaagtgtgttttttccaagcgctgcaaacatacctcgtctttatccctgctattgtttctatcccattctactaccaagctcttcccttacaattccgcacactcaaatgaaataggcacaaggctaaatcttccccactgccattgtattaatataaacaacccactgtttttacccaaggaagccagcagtcttccataactcactggagcttttcttaagtatctctaaaagtctttcctctcccctccattctcactatatatgttatagtacttttcatttttcacctcaactgttacaaaatgccattcctgtcagtcaagtggtcctccttcaatcctcctagatcccgttgccaaaagatcttcctaaaagatatcttgaccatttcactcccctacatgatactctttaatgactatgaatcttatgtgaaacataagaacttcataatttgtgccttttctcttcttcagacttagcagcctctctcctcacactcaacttttctccccccgcccctcaggaaaaaaacaagaaatgcttcatcctttaggcttctctagacttgtacatattcttctctagaatgttcctcacccaattctctgagcctctatgttcgaaatttgtccccaagcctctttgaagcctccagtaatccccctcccctttcagttaattactcccttctctgtgccacttttgttcctttttcctattaatgtaaaatggctacattgtagtgtatttgtttacatatatatctcttccactagacttgaagttccaccaagatttattgtccatgtctgtatcttcagagcctaatacattgctcaacagaacagtaaaatttgtaataaggagattgattatagtaagagaaaataaatgtttaggtaaaaagtcatcctaaacaatatctaacatattcattctgaactttcaattctgtaatgttccagttaagcatgtagatagaacacaggaatcatcaatgcaacctaaaccccttttctcctctgaaatcttattccctctatttaaaaaatgaaaaaaatctgtagaaatgggagctccctgtgtggcccaggctggtcttgaactcctggactcaagcaattctcctgcctcagcctcccaaagtgtagggattacaagtgtgagccactgtgcctggcccttccctctgttttgagaaactgctcaaacctcttttagagtccatctttctggccattagacttgagtctaatattttcgtcttacaagaacccccttatcctgtagacatattagataaaccaaatttggctcaaacctgcaagccgctgtctctgtcttcgctttttagtcaagaagaataatgcgacgaaaatggccaacagaacaaccccaaggatcccgactgcaataaaggatgactgacgggatgagcgacctaagtaaaagtaaatatcaagagatatgatcatgtcttatcgaaaagatcaaggtccctagttactgattctctcttaggtcaaatacttgatccctgaggtaaatatcaaatcctcagaacgtctgacctaaaatttctaaacaagaaaaattctatgtatgcagataattggtctcatcatcataaactccatgatatacctgttgtggctttttgtggggttttctgcactgaaatatctgtaggagaaaagaaagagagagggttaattctttgcatgatatatagaacaagccttctgatttccttgtctgaccccttagtacctctcaaccaagtatatgactctttcccacctaaaactagagtcctctagtctttctttctctgcacagggaatataggttgtatgtgtctccttggtgaaggccgttgtataacaattgttttcatcattctttcagtagagacattatgattctctgagaatccccaccagatccctgtgctgataaatccggtttttacacaacacacatcactgcccaacccctctttgctgccagagattccaagctcaatccaggcttctggcacttacctgtgcaattcactgcagcgtcttccttgtgcccacactcactatggccccagcgtctggcaggacaatcccacaaggaagactcattccctttgcacttcacttcattgagccatatcggtccagtcccctgaccaaactctgcttctttgaatgctttcaaagctggaccacagccaagttgttgacacaccacctgagcatcgtccaagtcccaagagtcatcacacactgtcccccaggaacctccatgccagatctccacacgtccagaacaggaagtgggtccttcctgaagtcttatcttgtctgaaaaatcagagacatgtagcctatttctaagacttctaaaagtttccaggagttcacaggtgaaaagagagatttgaaacttaaaaaaaaaaaaaaactatttaaaattttactgaatgtgcatattaaaatttatatatatatatgtatatatatatatatatttttttttttttttttgagacagagtctcgctctgtcacccaggctggagtgcagtggcacaatctcggctcactgcaagctccgcctcccaggttcacaccattctcctgcctcagcctcccaagtagctgggactacaggcgcccaccaccacacccggctaattttttgtatttttagtagagacggggtttcaccatgttagccaggatggtctcgatctcctgacctcgtgatccgcccacctcggactcccaaagtccgattacaggcgtgagccaccgtgcctggcctaaaatttatatttttacaaaatttatcttttataagaggacttgtcattacagccaactaggtatattccatcctgcacataagatacataatgtgacccagtaaatgttaaatgattaaagttaacattataaatatgtgatgtcaaattctttcaaataggcaagatcttgggaaactggcaggttgtcacaaatctcacagtttaagaagatgtagaggccaggcacagtggctcacacctgtaatcccagcaatttgggaggccaaggcgggtggatcacctgaggtcagaagttcaagaccagcctggccaacatggggaaaccccatctcaactaaaaatacaaaattagctgggcatggtggctcatgcctgtaatcccagctactcaggaggctggagcaggagaattgcttgaaccaagaaggcagaggttgcagtgagccaagatcacgccattgcactccagcctggggaacaagagcaaaactctgtctcaaaaaaaaaaaaaaaaaaaacctgtagaatgtggaaatacttcagaattgatctttctgatttctgactgcttttctccttatattagtgtaacaagataatatttgaaagaaaaatgggaaggtaaggtagaccattcaacagtcaaatattaaaccacatattctctcctcctcagagaaagcaattgaataaatctttcaagcagaccatggggagtatgatattctttagaataataatagctgatcctgaatatctacaggccaaattaaataaaaccagttacactatccaggtagaatagatattacccacaagttacccattcttgcttaattcaatctaacaatttaagccagtgtgagaataggaaaataaaatccagtgtccattatcagaagatgatagcggggctgcagaatggaattttcatataggtcgatggatactcactgtcacatgtgatccaggtctcctccgaggggctggccagtctcttctcccatggagatgatgggcactgccacagcgtgtcaggtccttttggacactgaacattgtccacccacatgggaatggacatggccttgtctaaagatgcagggttgattttccctttgtctgcacagcccagctgcctgcacaccacacccacagtggtttcagacatgctactcttgccaacagtgccccaagctccattgtaaaaaacttccagacgccctgcacaggcctctctgctggcttcactggtcagtctcagagacatgaattctgcagcgaaacatagaattagtagttttgcatcttttctgaagattcagagactccttccctttaccttgatgtaagaatggctttaaaaataggtacaatagtacaatatgtcagttactaataattcgttagtaacttctggatgatttcatagatattattaaaatattttatttattctataaatacattatagttttttggtctttggttttggactcagagtcctctttagattaccctcaatcattctaataggcttttttcagttacatagtttggattttttcccaaaaatattctcctttttttgcaactgtctttgatagttaaaattgttagacactcaggcactaaaatcaatgttttgtgtacatctcttaaaatgacagttcatttgctgacacttcacagttttgcagtgcatgtcttctaccagatttatgtcattaaaataggaataaatcacttctgagatacagagtttttcacttccttaagttactgaatcatagttctgttccccataatacatatgaaatagtacatttttaaatttcagaatgttttctaaaactcaccatgtatacaaagcagtatgagggcagtaacctcatgctactttttgtttctatgacaagtaagtctcatttatctgccatgaaaaattgcttgggcatagtaattatctttttttctgtagaatgatgcaacatatatatttcttcttgtccctttaaatctacttctttactaatactgtaattatcaagtgttgctattggatcgctatctaatatctggccccaaatatatttattaaaaaccttcattattaactttgttgtcattttcatgatatacaagaccatttctggtcttttctctttacaatgttgcactaccttgctcatgaagtaccactagcacatcaaacccagacttctgttgtcctgactcccacaatagttccttttggatcaacttttcaggaaaatctttaagattaatacccctcactacccttcctcagtcctttctctatgtaattatgaccaaaggtcatatgcataatttacctgagcagataactcccgcatcctccttgtgcctgcaattttgctgcccccagccgtgtgaatggcactgccaaatgcgggattcttttccattgcatttcatctcatccagccagatgggccctgttccttccccaaaatgagcagaaccagtggcattaatggcctctccacagcccagctgtctgcaaaccacgtgggcatcactcaggtcccagctgtcatcacagatggtgccccaggagccctcatgatagatctctactctcccagcacagcgacctcctccatttaccaggcgaagttgaccactctctgcaaagagaaatgaaactattaataatgagcattccacttgttattaatattttcatagatttgtcacagagtcttacctatgcaggccacagcactttcttctggaatggtaggccttgttgggcccaaagacgatgaattgcacgaggacagtgtttgggactggtttcctgcaaacaccaaggtactcagtcatacaagacacaaaaggttaggggagtcagatgaaatgttatatggatgagttgaggacaaacatagcttagagagagaggggaaggtggatggtcaacaagtttgaaataaatcaggtgctttgagatgggcttggcacatagtaagcactggataactaagaagtccatcaaaattaggtttgctcaccctctgaaaagacaaatgaggttaatattctgaagcatgaattagtattcattcttctcatgacccttcaaaatggatcactgcgttttacttttgttcttcatccctatgtacaccttctcttaagacccatcactggctgcccgtcatcctcttacctgagcagattacagaggccacttgctctgaaggacataatgaagcacctagagcagttacaggacaatctcccatgtgctgctcagtcccagtgcagtgaaacatatgcctccagatctgaccatttccttttccaaaacgtgctcctcctggggtagaaagggcaactccacatttaagctgctggcaaagaacatgggcatcttctatgtcccagtgagagttacagagggatccccaggcaccaagcgttttgagctccactctgccctcacacggggtcttgccattcaccaagcgaatttctgtgtatcctggaaggagacagggctttagaaaaagacagctatgactccctaaccctgtccctttcacagtatgagaaccaattaaagatgttttctgggtcttacttgagcagactactccaacatccctgctgtggctacaagttccttctgggcggggtgctactgggcagagtgaaagatgggactcatgtccctcacactggaattcttcagcccagatctgtccatttccctctccaaagtgagctccccccaggatagagacaactgtgccacactgtaattccctgcatagaacgctggcagcttccagagagaagtccgaatcacagatggagccccacgtgtcaccatgcttcacttcaacacgtccagaacagggaatgtcccctccaaccagtctgggttccctgtgggctgaaaaataaatattatttcagtgagaggtaatatgatttccagatttccattcatgatgagggtgaagaaggtggtgtggagtgggaaatggagaccagggtgctcagtgatttcctacacttgtttgtcttggcttttctgcctcgagttgggtatggataaatctagacctccccattcctagctgaactcatccatctgagagaattctgggacttcaccttgtgcagccaaccatccccaaaggcaatgataactctgttcttccaaaattttgcttactttattcataataacattagagaccacaaacaatgtgtatctactatcgctatctcttagtcttgcactcattcctccatgtactgcaatctggggtctgctcaacctttttgaattgttctatgtaaagcttttcaatatacttctaattttcagaatgaacatcagacttcttccttttgacgtctgttacgtttggtatacgtgacccttcttgtcccattttctcctccattctttctgacagtgctttatcaaaacatttcgtgtattccttgagtcaaagttctgtccgtaaccttctcatctgctcaatggacatgtctcaactgctaataaatatattttcatccatacttttttctttaattttagatccacaaacgtatctgcttagacatgtggagcttaaagtattcaaagttgaatgaattattgtatgacaagcccactatattctttacttaattaatgatatacaggccaaattagaaccacctaaaattgacccactttatctcaccacaaataatggtaataatgatagcagtgaatattaagtgagcgtctattatattacatatatggcattccaataagcatttaacaaacattatttcattcaatccttaaaattgccttaggagataattgttaatatcattctgattttacagacagggaatctgaaacatagagaggtgaggtgtagtaatttgctaaggtcacacaagaaattactacagaattagtaagagaacagaatttgaagccagacagtatattccagagcctagaatgttgactttcatgatacattgaacatgtagaaaaccaccatatctgttggtcctccagcatatttcttcttctgcatatttgttgctattgccataaagtgatttgtcatcatctgtcatgcagacctctacaatagcttcgtaaattgtttccttgcttcaaagtcttttttccaagaaatttatgccatgattataaatatattaataaatttcaaatattttcatgtgatgtttttcctttagatgacttaacgtttccttaaaatgtatgcaatgatcccttacataatttcttataatttctgtaataatcatgtatgcaataattaatccaaaagtatcaatgtaatgacctataatgtaacaacctgtaatgttctctgactctattttaggcatttgatgatgggtgggttaaaaaggccgccacagaattcagtctgtcagtgaagatagataatactaaaaataataatcataatcatattagctaacatgtatttatagctcactgtgtaattcctgtgaggtaggccctattaccactcccatttttcttctgagcaaactgcagcacaaacagttttcatagattccctaatttcgtccagctattaaaattaaggagaggtgataaacactaattctttagtacactttaaaatagtatgctgttaccttaaaagctttaatatctattactttatcaacctaatttgatgctccagcctaaagatgcttgggcatgccgtaattttcatgcttctgtgcctctgtagaaacttttctctctacttaaaatttatttccctaccttatatacctaggaaaaggctacttcttttcaaggctgttcaatttctcactaatagccttctcctccatgaacacagttcactacaagatatacatattttaatagtgatgaacccaaaaatagaaatatgtattagacataaaactaacaaataaaggagtcattcactctgttttagactatgggggagagaataacatagatctaaactggatcttgaaaaaagatgaggagtttgccaaatacacagtgtgtgaaacaatctttaaggaatatggtcacgaaatgcatggtgtcattgaagaattataagtaacttactgtagctgaaatttaaaatataaagaaaagacacaccagaaataataaatggaatttatattatgaagatgctctttgtcaagttaagaaacacaatcatcaagataagtgagtttctttgaaaatactcagaggcaatataaagtacttaagagatacaaactatttcttttaacttgttctttaagagaaataaagaaaatgcagttgaaaattagaccttctgaaggtcttaagtcctttatagatacctgctatcaaatatcaacaatttttgtaatctcttgatgttactatcacaatgatatagatacaccatcagcccttgccaatctacatactctgatttcctttcatctctcataaacctttcacctgatacaaaaatgtcttagaaaatgtttcgaatatgaccatgttctgtactacagcaatatagaatacctcaacatgtcaaaatttcacccattatccattaaatctgcgcaaagcaaattcctatccaaatttgaaatgaaaaacatgttgctttctaaacatagctcagagtttaaagcaaataacacctctacaatacaaataattaatgacccttgagtgggatggtctttcatttcttctttttgaatctttattcaagcatgaaatttctctaagatatcattaactagtattcatatgatcccaacctcttttggacagccctaaatctttaagtaaaggcagtctcctagatcaagccaaattctggtttcttgtaacttcttactctttcatttggacccatcttgaacaaaataaaccaaaagaaaaccagtgaaaaacaaacaaacaaacaaacaaaaatattttcttttccattgtgaaaactcattaagcaattgagaaaaagtcccttctataagtatcctcttgttttctttgtactaacatatttgagtcaaggcagaggacaaattctccaactcagaaagtgacttggagactccatcctcagcctttatttcgtgaatctgctagtaacatgttaatctatcctatgggtcgctttgcttatatcgttactctttagacatggatagaatattggaaatgtatccctttaatggatttttttctgctaagtctctgactgtgtttttacataaaaaccattaagtaaatttttgcacctggatttagcaccattgatcaacaactacagttttcccctggcataagtaactgaatctgtttttctttctttttctagaaaaataaatagatctacaaagagctttaacataattagagacataattaactagaattacttccttttgtttagtgataaataaaatatacaattatgatttaaagaagctttaatgtattttcaacatttaatgcttttcagactctgaagaagtatagatcatcataatctcagaattatttctccatcctaagttaaaagacagcatagctcaaatgaactgtttcttaaggtcagatgtcctctacagtacatacacagacatcacaaacaaaatgtctgagattcaaagtaattttgtggccaaaatttcctagacctttttctgtcaacaatttatcttaaattgtttccaattctcctgcttagttgaattctcctggttcttttaagctgtatagccctgtactatataaaagttaaacaatttaaacagatgatcaaattcgtagcttgaatttggcaggcacagagacagcatatcatcattgacagagacagtatgtcatcattgaaagtatcaagtaaataaagaaacaaaagtacaaactatattactaacaaaacatgtaaaaagctaaaaaccaaggcccccaacataagtagaagaacttccaaaacctacagcaatataacaaaagagtttgtaaaaggaaacaaaaagtgcacatggcaaatagcaaacaaaaatacagctctgtgaagtacggagcccaccttaagttgcaaatttatgttattcatgatttctattatacacatctgaatagaatcctgaataatttagaacatgttaccataagtaaggtattctagtaatgcaacctaaaatatgggtgtggttgaatggagttgatgggcagaatgcattaatgactcaggtgtgagaggctaaaaacctaaggagtcttacacatggtaaaatatttgggtaagcctcactttgaaaagaaaaccgtgtgctcactgatgcttaaaaaatgcagaatttattgggcaaagtacaagaaacaaaactacaaaaaatcagaatatttgcatgacgtggattctccttgccacttttagcatttacaagaaagatgaattcagactacaagcagtcagaatgcaagcagaaatgggaggagaaatatcaattttataagggggtatggtctgcctgcaggtgttgtatattgttaatcaagagtcctataatttggaattgaagaattgaagaaaaaactctaagtatcctgtccccccaaattgaggtggtggtaaaactgtagccttgtcagaagataaaattgatactccagatacaaaggcaatgagtctaccggcaaagacggaatttaggtcttgtccttcctcccaaacccacagtttcaaacggccttaaggcagtggtcaataattaaagagaagggctggtcacagcatagatcaaagtatatttatatgctcttggactatagttactttcagatggcattgggttataaagcaagtagactagaagcttagtaaccttggaaagaacttttttgttgaatttgagggcagctgacatcagcccttgattagtcaatctttaatccaaaggtccctaaaccaatattagcagaaagtgggttgtgaaaggtgtgctgtccttagatagagatactctccaaaccaaacttggatgtaactgtgaagaataatgtgccaggaagaactgccctgagagcaacactggggcccatgaaggacagcggacagaagacaccttctcagaggccagcacttcgtctaccagattggctttccaaggaactcactgagctgcggggtggcttatccttcctgtccggtaggatttgatacttactgcagcaaatctattctggatgtttcttggtgacaacagagacaccaaaacagccttaaactgcttatctatttgactaattttaaatgagaaaaagtgaacactgtctttcttcagtcactattatttgtttctcttttagatacagcagaacttaatgctaatcaatgtaaaatacaattaataagaaaatatacaaaccattataaatttagaaggaaaatctataacctaaaatatttatattagtaaatcagaagaaataaaacttaagattcaactcaagaagttgggggccaaaaagaaatcaaactttaggaaatctgaagagaattattagaaagaaaagtaaattttaatgaattagaaaggaaataaaagtaacattaattttttaaaatccaaataatggttttttaaaaaaaaatttaggtaaaagaatggctaaccttgtcaggtaaaaaattaaaagaataaatgaatacacacggtaataaattataagaaatgttatagatatggaagtaatttcagacagctctttaaatactgatgtgaaatttgatcaagaaattttactaagtgaatacttcaggtacaaaacaatttatacaacatgccaccatttggataatgaaagcaaatgatagctatatatagatttgtttgtattttcttgtatttacatgaaatatctcaaataatatataaatattccaaccacataagttgtctgtgaggaaaagaattggatagtagtgggggaagagtttacacttttttattttgaagtttaaaccatgtgattatattgcctggtccagaatattttttaaaaagtaatatagaaattcaaatttatatcttaaatgattgccttttttcaatcggaggataatttctacttaactagaggtaagcaccatttgtaacatcagggaaatgcccctcactgcatgcctaggttgggaggtatctggagccatattgttggttagaggacatgcagcacgtacaagtttccattctgtgaggtctctacatgtttaatggttttcttgtacactgtgttttctaaagcctttttgttgcatgagtaaaagttacatttactttagagttatttaaaaagcatcacttttcaacaaagttaacatttgtataaatataattagcataaaatactaaagattatccacaaacctaaccagtttacaactcatttttgagctttttaaagaggttgcagtgaaatattcacaggttttccaaaaaaaaagaaaattctttcacagtacaatagagggagctgaaggttatgtcagtttatctaacatggttattttttaaatcttttggtgacatcctgtgaaagaaatattgaattctattttttaaattttaatcctccttaatcttatacctctattgatctaaaaattactcaaaaaccaaagtgagcaaaacccaaacacttctatctaaagtgcaacatgaattgtaaacttatctgactctcccagtggaatttgtgtagatatttcctggtttcttgagagtgatctagtcataaggaccaatgtttcttttcaatttcaaaggtagtactggaaatttacacccttcttcttaacaagttgattgaaagtcatacctgagcaggtaattttggcttcttcatagtgatcacaggtaagtccaccccattgccagttcttgcagtcccaaagagaagtttcatttccgttacagctacttagaaacagccatgtgtttgttgcctggattttggagtacacttgataagatgttttgagtgcagatccacatcccagctgcctgcaaaccacatcagcttctttcagtccccagcctctgtcacacaccttccctaacagtctctgaatctccacctcaactgtcccagcacagcggctgcctccacctctaagtcttagctccagatctgatccatctgcaaaagaaacataaacttaaaccatcgatacatatggaggttagcttccagaggatttttttttgtcttttttcttctctgatactgatgcattgaaaattataggtaacttatttcctgactttttaagaaacaataatatagaccataaatttttgttagaaatgggactgtagtttcaagggttgataaaaattgtcaatggcagaaagatatgagcaattcagctttaaaagagattcctcaaaaagtgggtgaagggtatgaacagacacttctgaaaagaaggcatttatgcggacaacaaacatatgaaaaatagcttatcaacaatggtcattagagaaatgcaaatcaaaatcacaatgagataccatctcatcccagttagaatggcgatcattaaaaagtctggaaacaacagatgttggcaaggatgtagagaaataggaaagcttttacactgttggtgggagtgtaaattagttcaaccattatggaagacagtgtggtgattcctcaaggatctagaactagaaataccatttgacccagcgatcccattactgggtatatacccaaaggattataaatcattctactataaagacacatgcacatgtatgtttattgcagcactatctacaataacaaagacttggaaccaacccaaatgcccatcaataatagactggataaagaaaatgtggtacatatacaccatggaatactacgcagccataaaaaagaatgagtttatgtcctttgaagggacacagatgaagctagaaaccatcatcctcagcaaactaacacacaagaacagaaaaccaaacactgcatgttctcactcataactgggagttgaacaatgagaacacacggacacagggaggggaacatcacacactggggcctgtcaatgggtggggggaaaggggagggagagcattaggacaaatacctaatgcatggggggttaaaacctagatgacaggttgatacgtgaagcagaccaccatggaacatgtttacccatgtaacaaacctgcacattcaacacatctatcccagaacttaaagtaaaaaaataagtaaattaaaaaaatttaaaaacagattcctaggaaattttgtctctctgagctccaggtagattctgagtttgaagtgtgctccataaaagcagtctgagtaattattacagagaatgccgtcagacaaccttccaaactagttgaataaagaatgtgtcaaagattacaggtataaaggaattcccagcaaggaatttactaggcatttctacttcttaaggagcacgttcctactcttaaggagcacaggactttccgtttctgcttttctttttgtttagtgttttggttttggtttggttttaacttaccagaacatgtcacgccagcatcttcattgtgattgcaataatgctttccccattcatggtgtttacattgccagatagcaggttcatgtccctggcaagaaacgctgtcaagccagatgtgtccaaatcccttactggcgttaactcgaccaatggctgtgacggcagttggacatcccagttgcttgcatgccacagcagcatcgtaactgtcccagccgtcatcacatattgtcccccattctccttggaatctcacttctaatcttcctgaacattcagtgactccatctaccagtctcaggctcagatctgctccctctgtaacagagacacacaacaggtctgcgataaggaagcaagaacatgagactataaatagctatacctgagatgagttaaggaaaaggggagagatataagtggagacagagaaaactgtgatgtactgtactaccactggaaatcattcaagatggaaggaggagtggatcaggcaagaagatgggacatctcagtatagacagcatatactacaggaagtgtttctaacaggagatacagggactgaatttcatctagagacctgctatttgaccaccacagagttcttgttagaactgtttactttttctggttaaaatatatttgcatgtgtttaggtgactccctcatccttcagtttgcctccatacttagcaatcccttttgcctctgactgcattctccattgatactacctagcctgtgttgtacacctgaacctgttgtgaccacttccttagtttaaaagcagagcaaagagaaaggaggcttcagtactacaattttcaccttccccaaatcaatattcttcaaagaacagacgttgattctgaagaatattctgtaataaattaaactggttgtttcctctggcagtttccgttttcattcccacaatgttattcattgtgggattgtgattcgtcagcatgtgctaactgggggcctagagaaatgttgatgggtaaaagagaatggaaggtacagtctgtgttttttctactccaaattcttcacattcttaacctaacaaaatctatctttcttgtaggagttccattcattgtggttcaggctatagctgatcacattgttcaacaagaaaaagcttgttcaagacatgcagaaagagatagaacccagatgacattgttcaagaacctgaatccaaccatgcatgaggctaactataccctctggatttcccagttttgtgagccagtattctcttctttttaaacaagtttgaatggaagttcctttatttacacacacacacacacacacacagagagagagagagagagagagaaagggatctggtgaagatagggattttttactcttattttcctaagtgttctctggggttcaagacacactcaatctccttttatactaagaattcaacagaaaaacgaagagtggtatctctgcacacacaaacgattttccccgcccccagtctgagtatacaacgtgaaagtctctagacagatacaatgcatatctagtataaataaagttttaatgagaaaccaatattgatttttaacaagtgattcgattctgtgaacttgaaaaatgatttgggaaggagtgggttaatgaggctaatgaggaggcttttgtggattagatgataactggagtggtttggtcataaaacttcatagtgcaaaatatcctagtaaagcccttccttctttcctttttcccctctttttcttttcggtctctccctttctttatgggcttttcctaaacactttcttcttttcttatgacctggatctcagtttcactatgcacttccctaacctatttctcctaatttcagttaaggtaaaaagtccacaggtatcagaactggaacctgaagttaggttaaaatgcggtgacaaaagaagcagacttcattatgttcttaagagttcaggctcttaagatttattacccctttcttttgtcctctcctggagaatagaatgagccaagatcagtccttacttgagcaaatcactccagcatcctcagcatgatcacagttatgctttccccatccttgatgtttgcagttccagagagctgactcatttccgttgcatataagatcatcaaaccagattggtccagagccttctccaaaattagatgaaccagagaaactgacagcacttccacattcaagttgtctacaaatgacagatgcatgatctatgttgaagttatcatcacacactgttccccaccgtccttggaatttgatctctattcttccagaacacatattccctccacgcgtcagcctcatttccaaattggatccatctggagcagagaaaagaccagagttcagaagttacattcatttagaagtgattttagaaaagaagtttcctctggacacttgggattttatgttgtccttaaaatggtgcctgattttggacattgcccagctccacacggtagagaattttaatatgttaaaatctaggaagcaattaggatttttatctatatctacttacaaaggaaaatgtttacaggttaaagtttttaaactttctgttttgttttgtttccatctattactaggacagatgtaaatactcttttttgtacagaaatagataaattcgactcaagttatttaaatttgactcaggttaaagctttaagtgtataaatttcaaaaagcaaattgattaactccactggtagttataaaacaacagaaaaaaagagctaaaagtactacactgttttagctaaacagccagttctatacacagcaataattatgataagagcctgctaaaatttatgataattttaaactttgcagtagatgttacttttgttattccccatttcacacctcccatagtggttaaaaataagaggaaagaaggaggagaaggaggagaaggaagaggaagaggaagcggagaaagaagaaagagaactgagtcaccaagagaactgagccatgaggatcttcagcacctgttacataccaaacagtgtaccagtagttttacatgtattatatcattgaatcctcagaaactgaagtttagagagatttgacaacttgcacaaaatcacaggatattagctatgtgaaaatttatttcagcatttttctagatgctactgtgtgtttctcttatcacatcatgatgcctggacagagataagtcctttctatagtcagtcctatgggagagagagaggctgggaggtgagaggattgtataaaaattaatgaaacaggccagtcacggtggctcacacctgtaatcccaggattttgggaggccgaggcaggtggatcacctgagctcaggagttcgagaccagcctggccaatatggtgaaaccctgtctctactaaaaatacaaaaatcagccaggtgtggtggcaggtgcctataatcccagctactcgggagactgaggcaggagaattgcttgaacccgggaggtggaggttgcagtgagccgagatagcgccatcgcactccagcctgggggacaagagcgacaattcgtcccaaaaaaaaaaaaaaaaaaaaggaatgaaacaaacaaaaagaaatggggatcccaggaatctgagttggatcagaaatgtgcccttgggatttgtcagcagaaaggcctgacacatgactttctcagttattgtggggtcaattgcaataaaacatatggagatgttttgtaaattaaaagcacaatgtaaatgaaatgactagcattgcacactggtcaagcaattatactttcaaagaatccttcctacaacaagaaatgatgtattaatgctagaaatagttgttttttgatttactaagttgattatcagttaatggacaaaatggtaataatttgtgggtcaacatatcaaaacaagtcactgggaaagaacaaggaaataacttagatgtcatgatatttttatgatataggaatagtaggttacagtaagcttactgaatatcaaatttaaaccaccacttcttggctttttggctaagatcatgtataaaattgaagccagtcacctcctcattaatcacagtgttcagaattttttttattaaaaaaaaatgacctcgtgttttgtggttttctagcaatggatggagtacttttatacatgaactagattgcttacaggaaagtggcttattctaggttttaacccatctacatatttttttcccaccaaggattttgtgttgaggctttgactaatgcaagtcttacctgagcaggtcactccagcatcttgttggtgagtacagttactatgctttccccatccatcatgtttgcaatcccaaagagctgactcattcccacgacaagaaacatgatccatccaaatgcgtccagaacctgcactggaattagcccatccaggggctttgatagcagttggacatcccagctggttacaaatcacagagaccgcttccatgctccagccattattacacaccgttccccactcctcctggactttcacttccactctcccgctacacttgttttcaccatccactagcctcagctccttgtctgttcctcctgcaacaatggattaagacagtaattggccaaggtcgcaaagagcaagtagaaaattatttttttacattacttatttatccttcaaactcagatttgagaaccatcctagtcctatccatggtaaaacagaagaatgttatttcacagtcattcaaatataagtatcagtatcactggtttcaaattaagcagtgctatatgaccagtaaaggtaagtaacacaatagtgtttaatagctttattttatggctggatagccttaatagtggcaatttatataattcctgtgaagcattttcgagttaaataagatgctacaaaacgttatggggatgaactttttacatttctccaaaatcctaaggtcgatagaaagaaggctgatagagaatttatgaagatgaaaagactagttgtaagaaatttaactcttatttcatacgtatatgtaaaatagcataaatcttaaaaacgctagactgaaacttatctaaaattaagatggagatattttctgctattttctaccataaaataaacctctttgtactctcttcccatccccagatgatagatgatctcagttgcctccttggcattattttagctttatgtaggaatctggtcccaccaacctggcatctctcaatacatttttagataaattttggcatttgaatttactaatgtgtttcccaaattcacttttgttttaatgattctgaagtttctcctcctttgtattctttcctatttttcagttcaacattatttctaatctttaagtaaaattcatttctctcctgtgagtttatttcatttggtgaggaaccatgctaatattttggttagatttttattgtgtgcttttaataatatctgatcctttgaatacatggagcatgtcacctagtttttagatgctacttggccttcagaaaaattgtttgccttttaactgttcttgtcagagtgggctaaggctgtaagtaaatttgacaaagtactcaccaagagaactggtgacaaaacaggcactgagaagtaagaccacagtaatggtgaagggactcaagttgacaaaatgtcttctgaagtctgtgaaaaagaaaagagggcaaaagtagcatcttcccaaaaagagactttggagaagatagatggtttcagaggttaattaacaaagaagctcaaaccaagacagaaaactcttcattctaaattgcaaggcaggcagaaaacattcatacccaggctcatatagtttcagtgaaatggttttgaaaatgttcatgtttataggcaacctagaggtgacggattagcagaaggttggtggtggaaacgagaattgcaaggtcaacccttaaaacctggaaaatggaaacaacatcaatgaaacttagtagtggacaattctcccagcaggcacagggaaggtatcctgagatttctctattccctaaccaccttgatattcaattatggatgcccccatctttaagactacctagccgcactgatagaggataagttccatgagtaaacgaattatatctatcatgttcaccataatttcaccagtacctggcttgatgcttgccaaatagtagctagcagaacaatacctaagtgatgatatccatatctgaaaaactcaaatattaaatcttgtcatctctacctgtatccttatcacataatacactctttaatgctgttattactctcatatcttctcgttactctaacccaacactaatttaaaactaaaaatgctaaatgattttaacatgtccaaataagtcttaaaatagataactcacttatcagagtagataactttctttatgtaattaactctctatcaatattcctttctgcatattctatcttttctaacaactattttttcatactcagtacatttcagttaactttagttcctgacttaatttcacctcagcagttttacaaaattaatgccgactctgattcccatatcacatcttcaattttgaatctatggcagatcaaaggtgctgccatataagcctatgtcctttttccactccttactctcctgatgccaatcacttttaaatcacatccattgactgtcataataattacataccccattaaaggggaaatgtagaataaatgagaagcttttaccagcagatccagagtcttcaagtagcaccattctgagtttgctcattccaaagatttataacttcaatgattcctaaatcttcttgtattattccctagaaatgttcttctaaagaaaacaactaagaattctaaaaatcacttcactttcatgaaaatgaaaaggctacatatggaggcggagtcaactcaaaaagggaagtcattgaaagagctgaggttccatttcatactcatgttttcttcaatatagcacatgaaacaaccaaaggaaattgggaaacacttcccacagatttcgaaaaattagaggaaatactaactcatatgctgctgttgctgaattaaatattttacatttttgaacttcattttggacaaatatataagacacaaaaaattactaattgtcatgtagaaaaattatgtaaaaaactaaagcaaaacaggcaaaacataattaaataacattttatcatatgcacttttaattttatttccataatcaaatgtgtctaatgagtaattttgtgtaagttgttgagacacagcatttgtcatttcttttctaatgggatgaagtacaccaagagaattagccatgactattactgatattacaaatggtgaaacaaaaattagcaacacatgattttagctctatataactcagattcaagtaagagaaacacatatgataacaacaatgaacataaagctaaagtgcagtgttaaaaataatggacaaagtagtcctatctattgagagaaaggaatgaacagtcagaaaactattttctctgaggacaggcttaaattgtgtcctaaaagatgagaaaaacattgccaaagggacaaatgataaaggagtttaaggcataaaaaatagcacatacaaatgaatatttgtatataaaaacatataagctcaaaagaactactaatagttcatcatggcatacatattgtcaggtgttagtgatgggcctgaaatggggaattaaagagcaactccagccttccagagagacattcactagaacccagtcaacaaaggcaccccagttttcttccacttctcaggcatgccaaatctctccctgcctcatggtatgtcatacatattgttccttctgtgtttactgcctccctacccgtacctttctctaagataactctcactcacgtatactttatttctcagttaaacctcccttcactaggagaaataactctaacgctgaaagaccccagaaaatatgcactcatgatagcctgtacttatgagggttgtcaattatatatatatttttttcctttttttaaattattattatactttaagttttaggatacatgtgcacaacatgcaggtttgttacgtatgtatacatgtgcaatgctggtgtgctgcacccattaactcgtcatttagcattaggtatatctcctaatgttatccctcccccctcccctgaccccacaaccgtccctggagtgggatgttccccttcctgtgtccatgtgttctcattgttcaattcccacctatgagtgagaacatgtggtgtttggttttttgtccttgcgatggtttgctgagaatgatggtttccagtttcatccatgtccctacaaaggacatgaactcatcattttttatggctgcatagtattccatggtatatatgtgccacattttcttaatccagtctatcattgatggacatttgggttggttccaagtctttgctattgcgagtagtgccgctataaacgtacgtgtgcatgtgtctttatagcagcatgatttataatcctttgggtatatacccagaaatgggatggctgggtcaaatggtatttctagttctagatccctgaggaattgccacactgacttccacaatggttgaattagtttacagtcccaccaacagtgtaaaagcatgcctatttctccacatcctctccagcacctattgtttcctgactttttaatgatcaccattctaactggtgtgagatggtatctcgttgtggttttggtttgcatttctctgatggccagtgatgatgagcattttttcatgtgttttttggctgcataaatgtcttcttttgagaagtatctgttcatatccttcgccaatttttgatggggttgtttgtttttttcttgtaaatttgtttgaggtcattgtagattctggatattaaccctttgtcagatgagtaggttgcgaaaattttctcccattttgtagatttcctgttcactctgatggtagtttcttttgctgtgcagaagctctttagtttaattagatcccatttgtctattttggcttttgttgccattgcttttggtgttttagatatgaagtccttgcccatgcctatgtcctgaatggtattgcctaggttttcttctagggtttttatggttttaggtctaacatgtaagtctttaatccatcttgaattaatttttgtataaggtgtaaggaagggatccagtttcagctttctacatatggctagccagttttcccagcaacatttattaaatagggaatcctttccccattgcttgtttttgtcaggtttgtcaaagatcagatggttgtagatatgcggcattatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggggatgtgggctcttttttggttccatatgaactttaaagtagttttttccaattctgtgaagaaagtcattggtagcttgatggggatggcattgaatctataaattaccttgggcagtatggccattttcatgatattgattcttcctacccatgagcatggaaggttcttccatttgttggtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacgatggggttttctaaatatacaatcatgtcatctgcaaacagggacaatttgacttcctcttttcctaattgaataccctttattttcttctcctgcctaattgccatggccagaacttctaacactatcttgaataggagtggtgagagagggcatcccagtcttgtgccagttttcaaagggaatgcttccagtttttgcccattcagtacgatattggctgtgggtttgtcatagatagctcttattattttgagatacgtcccatcaataatttattgagagtttttagcatgaagcgttgttgaattttgtcaaaggccttttctgcatctattgagataatcatgtggtttttgtttttggttctgtttatatgctggattacatttattgatttgagtatgttgaaccagccttgcatcccagcgaagaagcccacttgatcatggtggataagctttttgatgtgctgctggatttggtttgccagtattttatcgaggatttttgcatcaatgttcatcaaggatattggtctaaaattctcttttttggttgtgtctctgccaggctttggtatcaggatgatgctggcctcataaaataatgagttagggaggattccctctttttctattgattggaatagtttcagaaggaatggtaccaactcctccttgtacctctggtagaatttggctgtgaatccacctgctcctggactttttttggttggtaagctattgattattgccacaatttcagagcctgttattggtctattcagagattgaatttcttcctcgcttagtcttgggagggtgtatgtgtcgaggaatttatccatttcttctagattttctagtttatttgcgtagaggtgtttgtagtattctctgatggtagtttgtatttctgtgggatcggtggtgatatcccctttatcaatttttattgcgtctatttgattcttctttcttgtcttctttattagtcttgctagcagtctatcgattttgttgacgttttcaaaaaaccagctcccagattcattaattttttgaaaggttttttgtgtctctatttccttcagttctgctctgattttagttatttcttgccttctgctagcttttgaatgtgtttgctcttgcttttctagttcttttaattgtgacgttagggtgtcaattttggatctttcctgctttctcttgtgggtatttagtgctataaatttccctctacacactgctttgaatgtgtcccaaagattctggtatgttgtgtctttgttctcgttggtttcaaagaacatctttatttctgccttcatttcattatttacccagtagtcattcaggagcaggttgttcagtttccatgtggttgagcagttttgagtgaatttcttaatcctgagttctagtttgattgcactgtggtctgagagacagtttactatgatttctgttgatgcagtttcttcctagccttgatagtctttacattttgtcatgttttggcagtggctggtaccagttgttcctttctatgtttagtgcttccttcaggagctcttttagggcaggcctggtggtgacaaaatctctcagcatttgcttgtctataaagttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggtgttctctgtatttcctgaatctgtatgttggcctgccttgctagattggggaagttctcatggataatatcctgcagagtgttttccaacttggttccattctccccatcactttcaggtacaccaatcagacgtagatttggtcttttcacatagtcccatatttcttggaggctttgtttgtttctttttattcttttttctctaaacttcccttctcacttcatttcattcattttgtcttccatcactgataacctttcttccagttgatcgcattggctcctgagccttctgcattcttcacgtagttcttgagccttggctttcagctccatcagctcctttaaggacttctctgcgttggttattctagttatccattcatctatttttttttcacagtttttaacttctttgccattgatttgaatttcctcctgtagctcggagtagtttgatcatctgaagacttcttctctcagctcgtcaaagtcattctccatccagctttgttccattgctggtgaggagctgcattccttcggagtaggagaggcactctgctttttagagtttccagtttttctgctctgtttcttccccatctttgtggttttatctacttttggtctttgatgatgatgatgtacagaagggtttttggtgcagatgtcctttctgtttgttagttttccttctaacagtcaggaccctcagctgcaggtctgttggagtttgctggaggtccactccagaccctgtttgcctgtgtatcagcagcagtggctgcagaacagcagtggctgtagaagagcggatcttggtgaactgcaaatgctgctgcctgattgttcctctggaagttttgtctcagaggagcacccggccatgtgaggtgtcagtctgctcctactgggggatgcctcccagttaggctgctcgggggtcatggacccactttaggaggcagtctgcacattctcagatctccagctgcgtgctgggagaaccactactctcttcaaagttgtcagacagggacatttaagtctgcagaggttactgctgtctttttgtttgtctgtaccctgcccccagaggtggagcctacagaggcaggcaggcctccttgagctgtggtgggctccacccagttcgaggttcccagctgctttgtttacctaatcgagcctgggcaatggcaggcgcccctcccccagcttcgctgctgccttgcagtttgatctcagactgctgtgctagcaatcagtgagactccatgggtgtaggaccctccgagccatgtgcgggatataatctcctggtgtgctgttttttaagcccattggaaaagcgcagtattagggtgggagtgacctgattttccaggtgccctctgtcacccctttctttgactgggaaagggaactccctgacctcttgcgcttctctagtgaggcaatgcctcgccctgcttcggtttgtgcacagtgcgctgcacccactatcctgcacccactgtctggcactccctagtgagatgaacccagtacctcagatggaaatgcagaaatcacacgtcttctgcgttgttcacactgggagctgtagaccggagctgttcctatttggccatcttggctccacccctcccaattatatttttatatttattgtttatcttacttgctagtcttaagataccaggataggaactgtgtttttttcaaaaagatatctaccagtccctgccagatgctaggctcaatattacctattttgttgttgttgttgacaatgttgttattattgctgaggtaaacaaggactacatgaagaggagttttatataccatgttaaagaattataattttacactgtaggcaagtaatgacattaaatagtttgaaacatgagtattaaattgctttgtcttttacatatctcatcttggtagcaactttgaggatgattggtggccagggtaaaaatggaaataagagcaagattaaatgcagtgcaagtgaatattatagcaaaaatctaatagaataagagcccgattgaaaagatatagtagaaaaatggaagaaatagattggtgcaaaattaaaaagctaggtgaacaagacatttttgcttttattcaaaatgaagaaacaggaagtgtgtttactgtcccaccagaaacaactaaaaacaaagccaaacatgtgtaacaatgattttcaagacactgaaaatgaggcaacaagaagagttgttgcctggatctcaaagatagtgatccatgagagatgagaagctaagctgagtttactgccttgagatagtttccaggctaccatggaataggaaacccagagaatgatcagaggagtctcagagttgggaagaagcagctgagaatctgggagactaaggtggctagaattcacagcaaatagtctcacagaggagaaacttgcaagaagaaagagagagagagagagagtagggaggaggcaaggagagagagctgaatatctgtagagtcccctttgagtattcagctgagtattgttaagtgcatgcatgtgagcaaatcacctgagcctggggaaagaataatgaaaggattagagttacacacagggccaggaaaagtgactgttcacatggaaaactcacaagtcatggggtattgggtagagttcacagatgagtcttaccacagtggtgggaaataagtagccctagctacttgctgattagatcccacctaacaaattttaaagacaagacccaaagaatcaaattgtttccaagaatataacaacattctagactaaacgttagaatatctaaagcaataaaaataatttaaaactcagcgaagtttagtttacaatgtctggaattaaacaaaatattacttagtgctatggtctaaatgtttgtgtctcctcaaaattcatatgttgaaatcctaacctcaaaggtattagtaggtagggcctttgggagataattaggtcatgagggctctgccttcatgaatggggttattgccctcatgaaagagatccctgagagaagactgatcccttttgccgtgtgaagtacagctaaaaaatggtaatctataaccctggaagtggactctcaccagacactgaatctgacagcatcttgatcttgaacttccagcctccaaaacaaagaaataaattgctgtttataaaactcggagtctatgttgtgtagtttcttttttggggagttggggagagtgctgattataatctcaaaacatgcaattacaaatgccataatcctaaatgttaaaatcccaaagttcaaaatccctaaagatcaacatctctgaaatctaaaaattcctaacatcaaaaattgcaaaaattacaattcagaatgttgaaattctgaaagttgaattctgtggaacagatcagtacatttttggttgcatacaggatagttgcattctgttgtttacaacacgttaggcggaactattcccttggtattgtctttatttggaaattaaatataggttaaggagatgcaattaagtatgggtgccaagttgacaaggggtggatttatagacataattttaggtgtcaacttgattggattaaggattctagacacttgataaagcattatttttcatgtctgtaagagtgcttccagacacatccaaaataatggataagattagtgtgtgagtctgagtggactaggtggggaagatcttccctcagcgctggcctgcatcagggatccagagagaacaaatacagaaggaaaattggtctctctttgagagctgggccagacttttcttgtgctactttggacagcagaactgcaggctcactggcctttcgacttcagcacttacatctggagtggctccagaatgctaagacttttggtctcagactgagagttacaccatgggctcccctggtgctcaggcctttggacttgggctgagtcatgctacagtcatcccatggtcttcagcttacagaaagcctatcatgggacttttcagccaccaaaattatgcaagccaattcccctaataaattctctctcaatgtctatatatatatatgtcttactggatccgcctctctgaaggaccctgactaatacagatttggtattggggaagccaaattgattccttcttacggtattttatgacacagtgaaagagactgtgaaattttactcttgtaaaatgttgtgattaagtgtgcaagtctagataatggcaaaagataaagtttaaaagctaattgttattggtgctgtaaaaacagaaaataggttaatttcaatagcagtgttggacagtatattcttacaaatcttataccgtgtgattctatttatatagaattctggaaagtgaaaattaatcgactgtgactagatgcagtggttgcttagagatggatgggaaggagtgcaaggaaagaatcacaatgaggggtaatcatgatgaagttttttggagtaattgatatgttcattgtctttattgtgttgataatttcacaggtatacacatacgtcaaaactaaactaatggaacacttaaatatgtgcagcttattgtatattaactatgctccaataaagatgtttttaaaaatctttgtgagctattattggtggaggacaaaagaaagagagaagtccaccagcagctcaatctttaagatttacaacaattgtgaagtcaaaccctccaaaaagggccaggcttgggggaagctgaagacacaaaaatgttgagtggacctgtaggttagcagatgatttactcagaaatttgtgacatttttatgtgggcatattcatggggaatgggaaaaagaagaggaataaataaagggaatggtatcagattttgaaacttgttctgaattttggaatagatttgaggcttgttagtaatctcat

SEQ ID NO: 1052 - DNA, 38152 bp, Homo sapiens
gggagggaggacacccaggcaccaggccatggtcatgacacgggtctctttgtccctcccggtctgccaacctcctgagtcactcctgacggagatgactgatccatccctggcccgcctcccaccctgtccctgggacagtgcctggggcaggcagctccattatcctccttgatgaaagagctcccagccagcactggccactccagagcctcctccccaggtgggtgatcatgcagggctgggctcttgcgactggccgggggtagagatgcaccgcactgctgagaagtgctttctaggagttcaagaccagcctgggcaacacagcagacattgtatgtagaaaaaaaaatgtttaaaaataagctgggcacagtagtgcatgcctgtcatcccagctactcaagaggctgaagcaggaggaccacttgagcccaggagtttgaatctgcagtgagctatgagtgcaccactgcatgccagcctgggcaacagagtaagactcagtcactaaaaaagaaaaaaaaaaagatcgaatgtggtgctcatgcctgtaatcccagcactttgggaggccaaggcgggcagatcatctaaggtcaggagtttaagaccagcctggccagcatggcaaaaccccatctctactaaaaatacaaaaattagccaggcgtggtggtacgcgcctgtagtcccagctactcagaaggctaaggcaggagaattgcttgaacctgggaggcggaggctgcagtgagctgagatcgcaccattgcactccagcctggacaacagagtgagacttggtctcagaaaaaaaaaaaaaaaaaaaaaaaagaaagaaaagaaaaagggggagaaaaaaaggagaagtaggcgagcctctttctttccccactcttctcgctctcaactccaggctgctccttaaacaggaggtgacaacctcaacctcgcaaattaaaaaaaaaaatcttttaattttgaaataattatcacaggaagttgcaaagatagaacagagaagtctggcagcagctgagccaaaggccccttcccaccctagagctcgatctgcctggggagcgggaaggaaatgacagtttagtcccaaagggcctctctgtgaagctcaggctagggctgagtagccagaggtgggtgaattaatgtctgcagggagtgctgggtcagcagcgtaagtgacaatgtctggaataatgacagctcacttttacagagagcccgttccatagcagccaccatgcaaagtgctgtaggggctggggacctgtcacagcatagccctgaagtcataacagcaatcttattatcaccctgggagggaaactgaggtgatgtcacaacaaacacgtggcagacctgggactggaacccgggtctttttaccacatgcttgtcatgggatgtgcgagttgctgagtgtgtcctgtgtgtgctgtcaccagcccggtgaggaaggcactatcattgttcccgtcttaccatcctgggcagaggttggggggtgagggggacatagccaggcagggagtagccacccagggctcacagggactctgttagttgcctgctttcactgcttccctggtaaaggggtgacagtcaagtcaccaaaaaaggagaccaacgacctgtttgaaggaacagggaggaagagtgaaagcgccgaggctgcgttctcaggagtcctgctcctcctcccttgccttctccacgcagcccttggcctccagaaatcaagacacgtccacaagcccaatctcctcctgttagaagactatgagccacacctggtgctgtggcctgcagaaacctcagctactccttctaggtgaggagcaggaattcaagccccaaagggtaccctccctgagacctttgggacctggccacctggcttggagtcccccattgagattcctgggattaaaaaaataaaaatatacggccaggtgcggtgactggctcctgtaatcccagcatcttggaaggctgaggaagtggattgcttgaggacaggagttggagaccagaatgggaaatgtgagaccccgactcaataaaaaataaaaaataaattaacggggtatggtggctggtacctgtagttctagttactcaggtggctgaggattacttgagcccacctcaagttcaaggctgcagtgagctatgatcacaccacttcactccttcctgggtgacagagcgagactgtcttaaatttttttttttttaataagtatagattcacagaagttgcaaagatagaatagagaagtctggtgtactcttcacccagcatcccctgatggttacttcttaagtcattcaggacaatatcaaaaccaggaatttgacattggtataatgtgtgtgtacagttctatgtcattttatcacatctggatgtatataacaacaactgcagtccagatacagaattattctgttactacaaagacctcccttgtgctactcccttcatagtcagacactttcccctaccatccctaacccctggcaacttttcatcttctccacctctatcattttgtcatttcaagaatgttatgcctgggcgtggtggctcacacctgtcatcccagcactttgggaggctaaggcaggtggatcacttgaggtcaggaatttgagaccagcctgaccaacatggtgaaaccccatctctactaaaatacaaaaattagccaggcatggtgttaggcaccttaatcccagctactcgggaggcttaggtagaagaatcacttaaatcctagaggcagaggttgcagtgagccgagatcgagccactgcactccaacctgggggacaagggcaaaactccgtctcaaaaaacaaacaaacaaaaagaatgttgtaacacatgtgatccttggagactggcttttttcactctctgtaccactcttcagaatcgtccaagttgttgcctgtatcctcttcatatctcactcctttttattgctgcatagtactccatggcatggatgtaccgtaatctgttaagccactcacctagtgaaggacgtattggttgtttccagtttttggttttgcttttttttttcttgagatggaatcttgctcttgttgcccaggctggagtgcaatggcgtgatctcggcttaccgcaacctctgcctcccaggttcaagcaattctcctgcctcagcctcccgagtagcttgtgttagaaatgcttgatttttggtgctgtaaagaaatagcactttaatgtaaatttaatttcttcagcaaggctagttttactttctgcagaaagggtatactcgctagcagttttgctacaaaagtacactgaacaaaggagacagggtcatttataacttgatgcatctactttattgctgtgtctggtttctattggctgaaacgggacctcacattctgtatttgtctggattggctagcaacttagaactttttaaaagaggcaaaggcagaggagaacaaaggaaggagaaagtaacgtggaatactgagaaaagtaaaaacatttctaaataaggaagaggaacaggctttgacttaatgctttcttggactagtataagcatgctagggcaaatctttaggctaaattgtaggatctaagaacataaagtacattgatttttttattatggctagtagatatttaagaatgttagcacaggtctttgaataaattttgcttctaagagaagttactatttattcttaattagatggggaggacagtctctttgaaaaggaacttctactttactatttacactgggattaccagcatgtaccgccacgaccagctcattttgtatttttaatagagacaggatttcacaatgttggccaggctggtctcgaactcctgacctcaggtgattgccctccttggcctcgcaaaatgctgagattactcctgacctcaggtgatcgcccacctcggcctcccaaagtgctgggattacaggcgtgagccaccgtgcctggcctgtttccagtttttggctattacaaacaaagctgctgtgaataattgtgtgcaggtttttatgtggacatacgttttcatttcttagggataaaatgcccaggagtgcaattgctgggtcatctggtaggtatattttgtttagtttttcaggaaaccggcaaactgttttccagagtagctggaccactttgcatccccaccagtcgtgtgtgaatgtttcaagttcacagcatcctcaccagtgtttggtgttgtcattattggttatttaattttagctgttctaaagcggtatcttgtcatgggtttcaatttgcatttcactaatggctggtgatgtgagacatcttttcatgtgcttatttgccttctatataccttcttcagggaaaggtgtcatcatgtcttttgcctattttctaactggactgttttttatttatttatttatttatttatttatttatttatttatttagagacagagtctcactctgtcgcccaggctggagtgcagtggtgggatctcagctcactgcaacctccgcctcctgggctcaggtgactctcctgcctcagcttcctgagcagctgggattataggcgcacaccaccatgcctgctaatttttgtatttttagtagagatggggttttgccatgttggccaggctggtcttgaactcctgacctcaggtgatccactttgcttcccaaagtgctgggattacaggtgtgagccatcgtgcccagcctgatttttattttatatatatatatatgtacacacacacacacaatatacatacacacacatatatgcacacatatgtgtgttaaagctgtatgtaaagctgttatatattacatatatactacatatataacagctttgctgagatataattcacataccataaaacacacccatgtaaaatgtccaattgaatggttttgggtctattcactgaattatgcaaccatcaccacaaccagttttagaacatttcatcaccccaaaataatctcacatccattagcagtcactcttcatttcctcttacctttcccaccccaccccagccctacgcaaccgctacatctacttctgtctctacagatttgccttttctgaatatttcacgtgaatggaatcatacaatatgtgacattttgtgattggcttctttcacttaatgttttcaaagttcatccatatccaggcgccgtggctcacgcctgtaatcccagcactttgggaggccaaggcgggtggatcacctgaggtcaggagttcaggaccagtctggccaacatggtaaaaccccgtctctactaacaatatgaataattagctgggcgtggtggcggatgcctgtaatcccagtcactcagaaggttgaggcaggagaatcgcttgaacctgggaggcagaggttgcagtgagccgagatggcaccactgcactccagcctgggcaacaagtgaaactcggtctcgaaaaaaagttcatccatgttgtagtatctatcagtacttcattcctttttattatcaaataatattttattgtttaggtctcccatattttctttattcattcatctcttcatggacatgtgggttgtttctgctttttggctttcatgaataatgctgctgtaaacatttgtgttcaagtttctgggtgaacatgttcttatttctcttggttatatatgtaagagtggagatgcaggagtgtatggtaattctatgcttaatctttggaggaactgttttgagacttttttccagagtggctggacaattttatattcacactagcaatatataaatgatttagtttccatacatctttccagtatttgatactatcttttattttagctgttcttatagatgttagtagtgatatctcatcatggtcttaacctgtctaaaggctagtgatgttgaatatctttttagataattattttctatccatatatccccttgggtgaaatttctctttatatcttttgccagtcttctaattggatgatttgatttttttatgtagtgtttctatgttgaatttgagagttctttatatatttgttctagataggagtcctttgtcagatatgtggtttgcaaatattttctcttagtctgtaatttgtcttttcattctcttaactaggtcttttacagagcaaaaaaaaattaattttgatgaagttggattgatttttttagggatcatgcctttggtgtcatgtctaagaacacttcatcaagctctaagtctcacagattttctcctatgttatcttccagaggttttttgtttttattttattttactttttaattaagacagagtttcgctctgttgcccaggctggagtgcagtggcaggatctcagctcactgcaacctccgcctcccaggttcaagtgatcctcctgccttggcctcctgagtagctgggactacaggcacgcaccacccaactggctaattttttgcatttttatgtggttgctttcgagaattttctctgcctcttgtttttagaagtttgactatgatgtgtcttggcatgaatttctttgggtttatcctgtttgtgatgcgctcagcttcttgaatctgtagacatatgttgtgcgtgtgtgttgtcaaatgaagataatttgcagccattacttcttggaatatttttttaaggcccaccctccttttcctccccttctgggacttcaatgacaaaatgttagatcttcttttattatagttactcatgtccttgaggctttgttccattttctttcatctattttctttccattgttcagaatgggtaatttctattgttatacgttttgtttcactgcttctttcttctatactctccattctgctattgagcccatccattatggtttttatttcagctcttgtattttttagttgtattttttagttctaaagtttccatttggttcttctttatattttctatttctttgctgatactttttattattttatttgtttcaagcacatttataatttctcagtgaaacacttttatgatggctgctccaaaatctttgtcagataattctaacatctgtgtcgtcttgatgtttgtgtctgttaattatcttttgttattcagtttgagaatgcctgattcctagtatgacaagtgatttgccattgaagtcaggatattctgggcactgtgttataagattctggatcttctttaaatattttgttttagtgggcttccctttatactgctccagcgaaataaagtagggcactgcctgattgcttccagacagggataaaagtccaggttctccatccagcctttcctgaacctggggggttgggagagatgaggcctccatgttattgtttggtaagggtagaagttcaggttccccactaggaatccatgacaactccctggctgggagtgggagggatgcttcattactgctccctatgtggctttcactgacactgtgtgtggcagagagaggggggtgcttgttaccactgagtggtggcgaaagtcccaactctccaccaggccccctttgacactactccaatggggccgggtggaatgcctcatttctgcattggggtggcagtggatgtccaggctgcccacatggtttccaccaacaccacatcgggggagggtgatcccagtggggaggaatgtcccagctccaactctagcatcactctggctgagtatgggagtggcctagggttctttgttacagcctggtgaaggtgaatgtctaggttttccatccggcctttgctgacaagggtgatgatggaacttggatggagcggagcaggtatggactaaaagagctctgtctttctaggatgcccctttcctcgttctttggctagaaaagcatagttttgctagaacttgttctgttgggactttttcttgtttgtgccccttggcattttcagttgttggcttctccagtattcagcctgagatatatgaggcaaagagaaatcccagggaattcaccaccattccttaagtcccgaggttcctaaccagtctgcttctctccatctttcagtcttcttatgcttgtcttgtcacgttcaaggttttcagttatacttggcagaataaataaatacatctactccatctttccagaacatcactgctttttgttcattttatttatttattatttactgagacaaggtcttactttgttgcctgggctggagtgcagtggtgctatcatggctgactgaagccttgaactcccaggctcaagcgatcctcctgcctcagcctcccaagtagtttggaccacaggcatgggccaccatgcccagctacttttcattttttgcttttgttgactagccccacagagttttgctgtgttgttcaggttggtctcaaacttctggccttaagcaatcctcttgccttgctctcccaaagcgtattacaggcataagtcaccacacccagccctatcggtgcttttggaagaaggtgttcttccctctctctgtttccctccctatggccagctgcccatagagggcagtggtgctggagtgaagacctctcagcgcatccctcttcatctgtaggatgtgcatggcttccaatgctgtctgttctgctcctgagacactcgctggctacaggattataaaggtgatgaggtttcagcctaaagactctccattcaataacacttcctacaagatatcttttttgtttttttgagacaggatctggctctgtcacccaggctggagtgccacagcgcgatctgctcactgcaacctcagcctctcgggcttaagtgattctcctgccttagcctcctgagtagctgggaccacaggcgcccgccaccacacccagctaatttttggattttttttttttttttttttagtagagatggggttttaccatgttgcccaagctggtcttgaactcctgagctcaggcaatccacccgccttggccacccaaagcgctaggattacaggcatgagccaccatgcccagtcctacaagatatcttttctttttctttctttctttctttctttctttttttttttttgagacagagtctcactctgtcacccaggctggactgcagtggtgtgatctcttctcactgcagcctccgcctcctgggctcaagtgattctcctgcctcagccccctgagtagctgggactacaggcgcctgccaaaacacttagctaattttttgtatttttagtagagacggaatttcaccatgttcgccaggctggtctcgaattcctgacctcaagtgatccacccgcctcagcctcccaaagtgttgggattccaggcatgagccaccgcacccggccgagatatctttttcctcctcaatatctatgtgctcctccctcaacccttgggggcttcagtgtaggtggtcagattccccaccatttatgcctatgatgaaaagagtggaaatggtaataactggatggtgtcactaaactacaaatactttcaggtaggcctgtgcctttttcagcgggctgcagttctcctgcttggcttgagtcattcgcatttcctgagagctgggtagagggggagttgtggaggagcccattctgaaactgatctgatattgcaaacccatacacggaaaggaagaactgcccatacgtattcgagtcttccaatctgactccgagcccgcatccccctcaatcgtctcttttccccactccccagatcacggtgctgcttggtccccctcagagccatagagaagcagggggtgtggccatggaggggaaacctctgtcaccagagactttactgtacttctccttttgctctcagatgctgccagggtccctgaagagggaagacacgcggaaacaggtaaaaatcattttgcttttattttgcattcaacaagcaagttattacggaacagcagttatgggccaggcatacctcccagagctgggaacacagtggggacctccctggctctctcttaccggtgttacaacaggttgtagacagacccctgtcttgagcatcctccttgccaggcctgctgagtcttctgagagtagggtaggttattggatgcccaggagggaagaaggagccagggaggtcagccccaaggttctgcaaggccctcaacaggcctggactgaggaggtctggacagcatggccctgtcctgagcctctgtgcataataactgctgtccctaacctccaccccaccctcagccttccaattcccgggcctggggccctactcctgtgctccagagactcctggagctccttgaggcagcacacagtcctgctctggaggcgcccatctcccactcatgctgggatgctccagcccgtcccagagcaggttgtggctggagggtgctggcagaggagggacaatggcccggctcctggaggcaagtgttggctgcagggaacggagtctagtccttgccacagcccttgttaccccttaggtaaccttaaggggatttcaaagaactctggctctgcaaccctgctaagttttttatggaacatgtaaaatagatcccatggccaaagaagtatggacaatgtattatactatactctaatccccatgtctagagattaatggtgtagatagagtttactgaaaggtttttaaagtcctgcagtaaagaatcttacttaagccaggtgcggtggctcacgcctgtcatctcagcactttgggaggccaagttggggggatcacctgaggtcaggagtttgaaaccagcctggccaacatggtgaaaccccatctctactaaaacaaacaaacaaacaaacaaatcagacgggtgtggtggcacatgcctatagtcccagctactcaggaggctgaggcaggagaatcacttgaaccctggaggcagaggatgcagtgaactgagatcacaccactgcacttcagcctgggcgacagaagaatgagactctgtctcaaaagaaaaaaaaagaatcttacttaactcttttaccctgcctttctcaagtgtatgtgaccttgaagatgttttttgcatgtgacatgatgagtacctgcggggctgatgtcagctctgcctggggaatctgcctcagcttcagaccctgcaccccaaattcatgcttagcccaggccagacccccttcctgctgtcggcaagcagcttagctttccgcacacccatgaacagatacccagcagcctttggcatgagccatgtggcccgaggagataaacagacagagagaggaacattgatgcgtgtgaaatgttggcaggtgagtgggaggggcttgggttggtgctgagaccggagacacactctgctgtcacatccttcagggtccccgggggccagcacggagggccatgatcatgtaaattgggacttaaatttaactctatgtaaatataactctatgcagaggtcagggatggtagaggacaagctcactgcagagaaagaaagaaagatgggcaacagttgcagaacctaacccacagataggttttgtttgaccagctctgtacatttttagtttattttttatctttttgagacagggtcttgccctgtcgcccaggctggagtgcagttgcatgatctcggctcattccaacttctacttcccgggttcaagcaattctcctgcctcagcctcatgagtatctgggattacaggtgtacgccaccacgcctggctaattttttgcattttgagtaaagatggggttttgccatgttggccaggctggtcttgaactcctgacctcaagtgatctgcctgccttggcatcccaaagtattgggattacaggtgtgagccactgcgcctggctcacccatactttgttactggttttagaattcctttttacctggtctttcaaaccaagttttgaccatgtctgtccctgagtataatccttgatgagtagcaccagagagagctccacgttacccggggcctggcattcaaagcactcagtggtctggtgccactcaaagcctgtgagccaggcaggaagtttataaaattagagatggatgaatggatggatgggaaaaagcaagcaagggaggaaggaaggaagaaaggaaggagttctgggaagagagagaggctgcccccgcagggctctcagtttgaaggagaggtgcagcacactcagaaaaaactcccggccaggagtggtggctcacacctgtagtgccagcactttgggaggccaaggctggcagatcacctgagatcaggagttcaagaccagccaggccaacatggtgaaaccccatctctactgaaaatacaaaaatcagccaggcgtggtggcacctgcctttacccagctacttggggggctgaggccagagaaacgcttgagcctgggaagcagaggttgcagtgagcggagatcacaccactgcactctagcctgggagacagagcaagactctgtctcaaaaaaaaagaaagaactccgtgagcatcccaaatgccacatccccataatgcaaccagacccggtcctcccggatccaggggaagggtcggagctcagtgggtgagcaagaaaagccacgtggaagaagtaagcggccagatggctcaaagacaaactctcccctgctcaggcttgcacccagacacgacaccatgcatctcctcggcccctggctcctgctcctgggtaaggactgtggcctgggctagtactggggttctgggatgtcagtgggcactggaggaggaggaaagacccaggcagagaggcgtcaacatagggtagggtgggggcagcggtgtgtatagataaatgtacatacaaatatatatgtttcccatatatacatacacttctctcattgcatcctgctgtctttgtgtatctctgtatttctcccactatcttcagagggaattctttagtctttagaaagctctctgctgggtgcagtggctcatgcctgaaatctcagcactttgtgaggctgaggtgggaggatcacttgaggtcaggagttcaaggccagcttggacaacatagcaagacccctatctctaaaaagaataaaaaattaaacaaattttaaaataaaaaataacttttaaaagaaggctctcatgcccccttagtaatgctttctgatcactgtggtgagttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctggtaaggccttcggggagcgggtcctctgctctgggcaggggtgagtgggaggcaggaaatacctgactcctggcacagagctcacaaaccgagcttcctgcagagctcaggcaggggacgccagcggatgacgatggcgatgcagcagcactagacagagctgcgggacctcggatgtcccatctgaccctcagttcctgcccctctgggacctggattccaaagttatcggatctcctgatctttccctctttctttctcaccatgtatttttcagcttttgtgacaaactcgtgtttggccttagtactggaaccatccaagcaccgcattcctttagtggggtgggtctgcatgtaaccagcctcagctctcccccaggctggaccgcccccttcagacattggggtctgaagctgcatcgctcaccccaaacttagggctgctcagagctccctatagaggaaactgggtgtggaacggagtaaccacactccctagggcagaggccccagacctgtgtttgatgggtcaaatccacccctacatgtgcagtgccataactgagcctgtgttataaaaatcataaaatgtttgttttactttttttcctcttcttttccccttccccttcctttccctttttatgagacagggtctcgcactgtcatcacccaggctggagtgcagtggcgcgatctcagctcactgcagccttgatctcccgggttcaagcaatcctcccacctccaaagtagctaggatcacaggtgcatgccaccatgcccagctaactttttaatttgttgtagaaatgggtcttgctatgttgccaggctggtcttgaactcctggcctcaagcaatcctcctgcttcaacctctcaaagcattaggattacaggcatgagtcaccgcacccggcctgatcttctgatttttcaagagacgatggaaatctagattttccagtgaaatctcccagcatgttaatgttcatggcaagttctcatgagctcttcaaggtcagatgacactgttgttgaaccccaaaggccaggtttgagctcccgatgcgtagtcagccaaacactgacacctcagtgcttagaagctgagataggattatttaatttagccaaagcaaggggacagaagagagaaactctcaaatctgacctgactttgagcgttagtgggggcttttatgagtaaagtaggtgtgcaggaggtgacctcccgatcgtcaaagctgttgtgcccctcggctcatcaaatttctggatgtcatcaaggaggtctgtgtgacctaaggatcattgttctttgaaagagagacaagttcatttatcttgcaggcagctgccagggagtcaggatgtaagttaaacaattatgagtgaattaatggttacctgctactgaaatgaccaaatgtaactaatcatgcatggaggaaggaaaggacaaagagaaaagaaaagaagtaaaacgaacatcttataatttttataacataggttcagttatagcactgcacatgtaggggtggctttgacccatcaaacacaggtgtggggggcccctgccacagggagtgtggtcactccgttccacaccgtttcccggatgggcagttctgagcagccttaaatttggggtgagcaatgcaacttcagaccccgctgtctgaaggaggtggtccagccttggggagagctgaggctgggtgcacacagacccactccactaaaggaatgcggtgcgtggatggctgcaatactgaaggaagccatgaaagtaacacaagtttgtcaaagctgaaaagtccgtgaactaaactgataaaattcacttagaggtggtgggaataggccgggcacggtggctcacgcctgtaatcccagaactttgggaggccgaggcaggcggatcacaaggtcaggagatcgagaccatcctgactaacacagtgaaaccctgtctctactaaaaatgcaaaaagttagccaggcgtggtggcaggcgcctgtagtcccagctactcaggaggctgaggcaggagaatggcgtgaacccggaaggtggagcttgcagtgagctgagatcacgccactacactccagtccgggcgacagagcgagactctgtctcaaaaaaaaaaaaaaaaaaaaaagaggtggtgaggtggtgggaatagaactttgcaatcattcagaaagcagacatccggcaatgagcatgaaagaaaagtagatcacagttcccaaggaggcttagtgtggtcaaggcctttcagaggggatttcgggtgagcaaaagtgattcaaagtggagaaaagcaggactgcgttgggtgcagtggttcccgcctgtaaccccagcactttgggaggctgagatcggaggatcgtttgagcccaggagtttgagaccagcctgggtaacatggcaagaccctgtctctacaaaatgtttaaaaaactagctaggtgtggtggcacatgcctgtagtcccagttactcagggggctgaggtgagaggattgcttgagcctaggaggttgaggctacagtgagctaggattgcgccactgcactccagcctgggtgacaaagcaagaccctgtctctaaagaaaaaaagaggccgggtgtggtggcttacacctgtaatcccagcactttgggaggccaaggcgggaggatcacttgaggtcaggagttcaagaccagcctggccaacatggcgaaaccctgtctctactagaaatacagaaaaattagctgggtgtggtggtgggcacctgtaatcccagctactcgggaggctgaggcaggaggatcacttgaactggggaggtagaggttacagcgagccaagatcgcgccactgcactccagcctgggtgacagagggaaactccatctcaaaaaaacaacaacacaacaacaacaacaataacaacaaaaaaacaaagcaggactggagagaggtggaatgaagtggcaaggggttcctgaggggtgatttgggacaggacatctaaagccaggtgtacgctcacgtcctcagtcccccaggctcctgcacgggctctgttcttttgcagaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcgtgagtctccccggcatgcctgtgggaagggcaaggtctgtgtcaccttctccccagccccgcagggggcatgcacccagggcagggggaagcctgcacagacggcggcatcctccagccctggtcacgccgccttgtcagccctggtgtttcgggaaaaagatttgctctagcctaacagaataaaatggtccatcctcaagccatgacatgaattggggattatctggttaggtctttttgttcccctcttggtggggatttttttcgcatcattatcttgtgcctcattcattcaataaatacgtatcatgaacctactaggtaccaggccttattacggctgccaatggggggcatggggcggtgggcagggtgcagcagtgagcaaaactcttgccccacgcggagccagcgctgcagtgaaagagacagacaacaaatggattaccaaagaaatacagagcatgagccaagacattagaatctggaacaaagcaatgttaacaaagaaatatacaacactattgtaggtagtgatatgtgtgttaggaaaaaaataaggccgagagaggggagtgatggagagagacctctctaagaaggtgagcacttaggccgggtgcggtggctcacgcctgtaatcctagcactttggaaggccgaggcggggggatcacaaggtcaggagatcgagaccatcctggctaacatggtgaaaccccatctctagtaaaaatacaaaaaattagccaggcatgatggcaggcgcctgtagtcccagctacttgggaggccaaggcaggagaatgacatgaacccaggaggcggagcttgcagtgagctgagatcgcaccactgcactccaacctgggtgacgagtgagactccatctcaaaaaaagaaaaaaaaagaaggtgagcacttaagctgactggaacggagggagtggctgaggccggcacatatttgggagaggaggatttcagggaaagagaagggcaggttcaaagctttgaggcagcagctgggtgggaggacctcagaggctgaagttcaccgcctctgagggccacatggtaggacaggaggcaggagatggagcaggactctggatcccgagggctgaggtgagggtttgggattctatgcaaagcacagaacccgctcgtggtttccagcaggattggcgaggtctggtagatggtgttaggaaccctgcgtgctgctggtggagaccaagaagtagaggaagtgggagggggaagctgagagccgagttaggaggctgtgaccatcacctgggtgaagggactggcaggccatggctttgtcagaataaaagcactttccacaccctccaccctctgaggattccccgccccctccccgactgcccctctgctcctccagacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtgtgagcccctcggagctggggacaggccaggcagggaggtagcaggggtggacccggagaggggagccacgggggctctcggggccgtgtgcacaggttgggggtgctctcctcacccctccactcgcctctgccccctcttccagatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacgctgggacttattcctgtgtggcagaaaacattcttggtactggacagaggggcccgggagctgagctggatgtccagtgtgagtagccacggagcctctggttctagggagagaagatggacacagggaacggggaaggcagatggggtgcagggcattccggggtcctggagtcaagagcaaggagcagccagggtctcctgttcacaactgctgtctcagctcctagcatagggcctggctcatggagggtgcttggtagatgcttgtttttttgtgttttagttttttttgagatggagtctccctctgtctcccaggctggagtgcagtggcacaatctcggctcactgcaagctccaccttcccgggttcatgccattctcctgtctcagcctcctgagtagctgggatgacaggcgcccgccaccacgcccggctaattatttgtacttttagtagagacggggtttcaccgtgttagccaggatggtctcgatctcctgacctcgtgatccacccgcctcggcctcccaaagtgctgggattagaggcgtgagccaccgcacccggcctgtagatgcttgttgaatgaatgaggccaggtgcggtggctcccgcctgcaatcccagctctttaggaggctgaggcaggagggtctcttgaacccaggagtttgaaaccagcctgggccacacagcgagataccatctctacaaaaaaatacaaaaattagctgagcatggtggtgcgtgcctgtggtcccagctactggggaggctgaggagggagaatcacttgagcccaggaagtgaaggctgcagactgaactatgttcctgctactgcactctagcctgggtgacagagcaagacctgggtctcaaaaagaaaaagaaaatgctgggactgggattataggtgtgagctgggcacagtggctcacacttgtaatcccagcactttgggaggccaaggtaggcagctcacttgaggccacgagttcaagcccagcctgggcaacatggtaaaaccccatctctacaaaaaaaaattagcctggcatggtcatgcatgcctgtagtctcagctacccaggaggctgaggtgggaggatcacctgagcctggaagtagaggctgcagtgagcctgtgatcatgccgctgcactccagcctgggtgactgagtgagaccttgtctcaaaaaaaagaatggattggccaggcatggtggcttacgcctgtaatcccagcactttgggaggccaaggtgggcagatcacctgaggtcaggagttcgagaccagcctggccaacatggcgaaaccctgtctctactaaaaatacaaaaaattagccgggcatggtggcaggcacctgaaatccacctacctgggaggctgaggcaggagaatcgcttgaacccaggaggcagaggttgcaatgagctgagatcatgtcactgcactctagcctgggtagagtgagattctgtctccaaaaaaaaagaataattaactgcaagataccaggactccatgagggacacagagacttagcgtccctaggcagtggctgagtcttgagagatcttgaaatttttaatgagaactggggcaaactgtctcattacctctccattgtaagacccttttaacacagtgaatcttgttaccatgtagagcacaggacaaaaagaacacataagctcgatccttggaccctgagatgtcatatgtgctaacaggacaggggtgcccaaatcctgagcatctcagacagctggatgcgtgaccacagcagccacagtgatgtttgtggagtgtttgccacacgccacactctgctctaagggagtcatctcatttccttcttgaaacaattcccaggaggttaggaactctcaggactcaccccccacccaccccgcactgcctcttgtttttaagatggagtctccctctgttgcccaggctggagtgcagtggcttgatctcggctcactgcaacctccacctcccgggttcaagcgattctcttgcctcgaccacctgagtagctgggactacagacatgcaccagcatgcatagctaatttttaaaatttttagtagagacagggttttgctgtgttggccaggtctcgaactcctgacctcaggtgatctgcccacctcagcctcccaaagtgctgaaattacaagcgtgagccaccatgcccggcctcaggaccccatttgacagacgtgtaaactgagacctgcagcccatgcccgtgcgcctctcagcagccgtctggcttcagcgctgtgccctgaacccctgcaccaaaccacagccaggccagagagccagggcagggtttctgttctcacacagatgcaggaaggacgcacaagcccccctttgattaatttaggacctgtgcagatgcccgggacaggtagcgggagaagaggaagcaggagggaaggggtactgtggacagctggcttttctttactcacctctctggttttcttccagatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtgtgagtccctgggctaggcagggggatctgggaggtggcccggctgggatgaggggatgaaggcaacgaggccggagcctgggccagtgtcttcaacagaattgagggacaggagcctggcgtcagggccaaggggaggggaggcctggggacagcaaaagggacagggagcggagaggtcagcttgggacccttgccctccagatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtgtgagtgagggccggaggctgggagtggagcagagaagggaccagtggcctgcctggtagtgacttcgcaccccctccccctgcccgccatgcagatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactgtaaggcctcttcctgctcttgttcttcttggtggtggtcagtccttccttccttccttccttccttccttccttccttccttccttcctttctttctctctttcttttcctcctcctcttcttcccctcctcctcctcttcctccttcttcttcttcttctgctttctccctctcctcctcctctttcttctccttctccttccttcttcttcttcttatagagacaaggtcttactctgtcacccaggctggagtgcagtcgcataatgacacctcactgcagcctccaattcctgggctcaagcaatcctttcgcctcagcctcctgagtagctgggactatagacatgcaccaccacatccggctaatttttacatttttgtagagatggggtcttactatgttgaccaggctggtttcaaactcctgacctcaagtgacccttctgcctcagcttcccaaagccctgggattagagccatgagccactgtgcctctccctgtttcctctcatgctcctctctggccctgtctcctccagtgacttcccgaaaagccttccagaccagctggccccttcttccccacctcactgtcccctttcccattcacaccccttgctccaggccatctgccgctgtgctggaggagtcgtcttgtcctgcgtcaccagtctctctttttctacctcccctgcagtctctcctgcctccctctagggtcccctctcaggctgctccaccttccagaagtcctgagctcctactgggtccctgtctctctctctctgactactctgtctctctcagccctgacaggctccttgtttttatcttttaaaacgtaaatgattttttttttaaacggagtctcgatctgtcacccaggctggagtgcagtggcgtgatcacggctcactgcaagctctgcctcccgggttcacgccattctcctgcctcagctccccgagtagctgggactacaggcgcctgccaccatgcccggctaattttttgtatttttagtagagatgtggtttcaccgtggtctcagtctcctgacctcgtgatccgctcgcctcggccttccaaagtgctgggattacaggcgtgagccaccgcacccggctgattttttttttttttttttgagacagggtctcaccctgttgcacaggttggagtgcagtggcacaatctcagctcctgcagcctcgaccccctaggctcaagtgatactcctgcctcggcctccacagtagtaaacttgagtggtttttaaacagatcatacaagcacctggtaaaaaaataaaatgtaagcatgaaagggtaaatagtggaaagacagacgcggctcactcttgatccctgagaactctcatccccaccaaaggtcctcactgcacacagtcttcccatctcactgcacacagtcttcccatctcctccaggggtatttttcacacgcacaattcacacacagaggtctgtgcctatatacccttcctcatgacacagacgaggcagagcccacactttgcctgggaattttctttgcttttttccatgtaataatactgtttggacattgttctgtatctatgcatacacagagtgtctaaagtctggaggctgggcatggtggttcatgcctgtaatcccaacactttgagaggccatggtgggaggatcacttgagcccaggagtttgagaccagcctgggcaacatagcccacacctcatagcaggatctcatctctacaaaaaataccaaaaaaaattttaaaaacgaacaaacaaaacaataacaacaacaaaaaagagtctgaaagcatatggaagatacctaattaatttattgtactttttcagattaataattggaaacatggccttaaattgagggaacctgaccaggcacagtggctcacgcctgtaatcccagcactttgggaggccaaagtgggtggccacaagcactttgggaggccacaaggtgggtggatcacttgaggccaggagttccagaccagcctggccaatggtgaaaccccatctctactaaaaatacaaaaattagctgggtgtggtggcgcgcacctgtagtcccaactactcgggaggctgaggcaggagaatcgcttgaacccgggaggcagaggttgcagtgagccaagatctcaccactgcactccagcctgggtgaaagagcgagactctgtctcaatcaatcaatcagtcaatctagggaaccatcaccagcacggccgaaggccaaaggaaaacatctgaaacatgttatctggaaatgtaacagacacatcccatcatataaaaccattgttccctgggtatcccctttgcagacagcctgagagcctcctctttttcctggggccatggagtcctcgcgtatgaaggttgcatacatcctcctcccagtgccctcttcagggcctaggtctgcagcctcttgttttgggcacgcctgcaaggacagttgcaagatgcattcccatgtggaattgctgggtggaagacaggtgcactttcagagctgatcacacagctatactgccgtgaagagctgcacccatttatgcgggtgcgggtcacaggctctgggcgtgccacgtctgtgggaaaagcagctcctcaggagaattagtgccttattcctaaagggaggcccagagcaagcaggggccgttgtcaccctcttcctctgcacccctgcacgcatgcaggggagaaggacgagtctggctgcagagagaagtccaggatgccttccaggcaaaggctgccagggagagctggcccctcagttgattaaggtctctcctttctccacccagatagcccggagaccatcggcaggcgagtggctgtgggactcgggtcctgcctcgccatcctcatcctggcaatctgtgggctcaagctccagcgacggtgagctcctgccatcccccaccacctcctctatcccttggcagaggcccgtgtccagttgctccatctcgaagcctccagcctgtggagtccctgaccctcacacatgtgcctttatttctcagttggaagaggacacagagccagcaggggcttcaggagaattccagcggccagagcttctttgtgaggaataaaaaggtaggatggggctgggcacgatggctcatgcctgtaatcccagcactttgggaggctgaggcaggtggatcacctgaggtcaggagttcgagaccagcgtagccaacatggtgaaaccctgtctctacaaaaaatattttaaaaattagccgggcgtgatggtccatgcctgtaattccagctactcgggaggctgaggcaggagaatcgcttgaacctgggaggcagaggttgcagtgagccaagattgcgccattgcactccagcctgggtgacatactgagactctgcctcaaaaaaaaaaaaaaaaaaaaaaaaagggtaggcatgaggcagactgtgaagctgagtggggaaacaaggtgaaggaaggggataaaatgtcctctgaggagacctgggctgtcagaggccagggaaggggacgagggttggggaacaggtggttagcacttcatcctcgtctccctcccaggttagaagggcccccctctctgaaggcccccactccctgggatgctacaatccaatgatggaagatggcattagctacaccaccctgcgctttcccgagatgaacataccacgaactgggtactgagggtaccaggagggtgaccctgcaccctgggagggaggcgggaggaaaagctctgtcccgcctgccctctttgtgccaggcccatgccaggcaccctgatacatgctctgcctcattcccactcggcaacaagcctctgggtaagggccagtctccagaagtggacctgctccttcaagtcagcagcacacatgcccagtccgttcttatcacaaagatcaagacctcatgatacacacccacgcctactccctccacgcacatttgcacgagctcctactgtgagctttgggcactggggaggccacaggttttacataaggggctgaggttggggtgctgttgggggctctgggtgttgagagggaggagagttcgtgggagatgcttcatgcgtggtcgtctatctgccctgtctctcagagatgcagagtcctcagagatgcagagacctcccccggactgcgatgacacggtcacttattcagcattgcacaagcgccaagtggtaaggagggtctccccaggtctccccagaggggctgtggaaggctggggacagggcctggcctcagtggtgggtcccacataggaaggagttgggtaggcatccgtggtggcagaggttgggtgttggagacggttgctccggcagagctggccagagccaggcaggtacctccaggtcctggatgccggccacagccagtttcctgacacgaggacacccgcctgggcttttggacccccgggtggaatgaaggagagaatgcggagaaaagcggcggtggaggctggcgacagtggggccaggctaaccaccatgcggttttctcagggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacagggagacgtacgtatcagcggccccttgactctggggactccgggtttgagatggacacactggtgtggattaacctgccagggagacagagctcacaataaaaatggctcagatgccacttcaaagaaccagtgaactcttttcagtctgtggagtcagagtggggatgaggagaggggaaagtcttcatggggcctggggggaaggaaatggagtcacagtggtttactgatcaaaccagcagattagagagtctggtgtcttgttaggaaaagcatactggctttgcagacagacaaacatgagaacttgaatcttgattcttcggcttaactagcccggtgatcttggcagggctcgccagcttgcctgagtctcggcttctccatctgtaaagtggagagggaaaggccactgcctaccacgcaggtggcccacgataggaagtgaggcatcgtcttctatatgctggagccacattgagacccagcacagaagccgaaagtcccccagaaaaccaacctccatcctttatttgcatttttcgaagaatgtgaaaaggggaagccgattcaaaacagctcttcccaaaagtgacgctacccaattcttgcacaacccatagctgccagagaaagtcttgaagaccagccaccctgagaaacctcacagcttttctgtcattcgaggtcctctgcacccgttctctaattctgttcactgattcagactttccagttaggtgccccagctcccctctccgcttctcgggtttgatctttctccacccattcacctgcttctgcaaaggggctaaagcccattctccttagagggcaggggtgtaattatctgatcatcagggagattggctcctggcacgtggcaggtgtccccaaactgccaccttcctctcccaccttcctttccctcccatctctgctcagtacccggacggtaactctaggaattatggttcagggaggccttgatcgccccatcaatccactttgtccctggtttgattcttgtgagcaccattaacttttctggaggaaggtgaggctttaagaactgtttaaagcccaggcgtggtggatcacgcctgtaatcacagcactctgggaggccaaggtgggcagatcacctgaggtcaggagttcaagaccagcctagccaacatggtaaaatcctgtctctaccaaaaatacaaaaattagctgagcgtggtgattcacacctgtaatctcagctacttgggaggctgaggcaggagagtcgcttgaacctgggaggcggaggtagcggtgagccgagatcacgccactgcactccagcctatgcaacagagtgagactccgcctcaaaacaacaacaacaaaaactgtttaaatgagacaggagggtgttggggtgtctgtgcccaaaatggggtctggtgtcattcaactctttcttcattcattctgcacacagatactgagcacctggaaatgcacccagtacagagccagttgttaggacaccaaaaagataaggcgtaggaccaaccttggggatctctagtcgagagccgccaagggtttttaaggcaagataccctggagggagctgaggcagtcctaagcctgaagggcctggcttaagctccctggcaaccatcgagcatcttccccttcccaccctgtccctcagcacagctgctgacataaacctactacatggctgattgaccatgagatatggccatcaatagacattgctgaggcgtgaagagcaggtgaagagcaggtggccaggaagctagggggccaggactccagacgcaggccgccctccacaaccccagctctcacagtcctcccagggtccagacaatggatcgtgcatttaggttcccaaacacctgctgtgcaacgtgtagtagacaaagcagaccaaagcctttgccctcaggaggccggcattctagctcaggagccagccaagacgatgtcgcactgaagaaagacaacaaaagtgagattcacaggagggatgagtgtggctgaggcacccgggaaggccctcggagaaggtgaccttgggcaaagatccagacgccaggtgggtggggccaaagcagagaagatctggaaaacccaatggctccccagggcttcgctcttgctgcaggaggggaaaccacactgctgtggattcttcctccattctgtccatttctcagttcccaacaacacactgaacagtaggaggccagttctccgctcacagcgggcgctgcaccccaggtgctgctctcgagaaaaaggcgagcatggaccaatttagtggctccgaggtatgaaaagcagtgagatggtgtctttgagggagttagtgataggctgagacccccttgctgtcccccctgaagcctggtgaccagagctgccaggaggccacacagagagaggtttatgatgggggacctggaattcggaaggggcagagtggtcaggtgacccatacacgcctgagaaaactgatgtggagagctgtgttgtcattctgaggcaggaaatagagacagactgacagacagacagaaagacacgggcacattgagagacagagacagaatcacagagcagagctggcttctcaccagcaggcgtgggcacacctgagagagcatccagagaggttagaaatcttccttaggtcctcctgggaggctcaggtgaccccagtgggaaacatgaaaggctgggaggacttccagggctgagagaaggaagctacgcagccggccggtgccacattccctgtgccttggggagtgtcccccagtgtccccagccatgcaccctggggggagtcggcttggacatctgtgccaccccttgacaggcagagtgggggccacaacctgggccctccagtgctggtcagcagaggctgcccccgccccttgccttcctcctcccgctccttcctccagccctgggaaggtcggaagccaccaccatggggctagtgcggaagcagagggagaacagaggggccctcctcgcaaaaactaaaacaagcccacagcctgtgcagaaccgcacccgggtgtgatcactccttaccccacacacccactgccacttggagatggcttcatggctgcagtcacagggcaccctgtgttgtcaggggtgagccagtgaggcccgggacctgcccaggggtgcatcaagggtggagaagacctggccccagcgcaggtgtgaacaggcaggagggctggggagggaatagcgctgggttgtggccgagcccccaagccctgctcttgagaggcactggctacacactcggcccctacccagacaggaccccaattcctccctggcccctctgtgttcctgcatcttcccagcccctcacctcctctggcgtggcctcacctccagccgggatgccccattagctgctcacccaagctgctagaacctcaggctaatggccctgtcacccgccctcctccccttccggctcactgcccatcccgggcatcctccatcagcccgctgaggggactgctgagcctcagagacatctggcagcaccaggaggtgggtccctctctctgtggctcctctcttcacctgactgttccccagacccccagaccccctgcccaggtggcccctgagaactgctaagctcaaccgtgacatggatggggcctggctgacccttgggctctccctgggggacccccttttcctgtccctggccacaccctcaccttatccacacccttctcctccctgctgccccgccggctttccaatgtgggtggggggtgggggcagctcctgccttgccagggaaccagggagggcagtgggctcaggagtcaaactcccattcccagggaaggctcaggctgtgggcccagccctgttctgaattctctccacccctcctccccacagagtctcagaaatcgagaagctttcttcctctgggacctgtgcgccacatcctatctcctgtgacgctgcaggagcttccctggttttaagaggtgacatggtggagagaaagcacaggactgggggccacaggtcctggcttctcatccaggctccgctgctccctgactgctgcctttctctgtgggcctcgtttcctccctgatcccaccaggtgaattgtaattctccacacagggctggaacccgcgagtgatcccaggagcccctcctctccggggccccaagatctgaggacagggagccaggttgcacacaggagccgtgcaggccaggacggcggccccatggacctgcccccgcagctctccttcggcctctatgtggccgcctttgcgctgggcttcccgctcaacgtcctggccatccgaggcgcgacggcccacgcccggctccgtctcacccctagcctggtctacgccctgaacctgggctgctccgacctgctgctgacagtctctctgcccctgaaggcggtggaggcgctagcctccggggcctggcctctgccggcctcgctgtgccccgtcttcgcggtggcccacttcttcccactctatgccggcgggggcttcctggccgccctgagtgcaggccgctacctgggagcagccttccccttgggctaccaagccttccggaggccgtgctattcctggggggtgtgcgcggccatctgggccctcgtcctgtgtcacctgggtctggtctttgggttggaggctccaggaggctggctggaccacagcaacacctccctgggcatcaacacaccggtcaacggctctccggtctgcctggaggcctgggacccggcctctgccggcccggcccgcttcagcctctctctcctgctcttttttctgcccttggccatcacagccttctgctacgtgggctgcctccgggcactggcccgctccggcctgacgcacaggcggaagctgcgggccgcctgggtggccggcggggccctcctcacgctgctgctctgcgtaggaccctacaacgcctccaacgtggccagcttcctgtaccccaatctaggaggctcctggcggaagctggggctcatcacgggtgcctggagtgtggtgcttaatccgctggtgaccggttacttgggaaggggtcctggcctgaagacagtgtgtgcggcaagaacgcaagggggcaagtcccagaagtaacgccactgctcgggggaaggagcatggggcaggagggcccggctgcttctccaggcccctgcggggggctgcttcggaggaactgcagggcagcctggcccggaggcctccctggagccactcaagcagagagcggcgcctgctgagggcagcaccccagtcaagagaggagcaccgagccagagcacggtggcagggggaggtaagtttgcccctgcacgtgtcgaggaagtttgtcccttcctcgcctatctttctctcccctctgcacgtcctcacctgcctgtcttccgtgggccgcgagcagaggccttgtacttacgggaaggaggaggcagtctgtttctgacccacaggaactgccactccggtgatgcacttgaggacagctactctgaaatcagttcccaggagagaacatttgatttccgagtaggagaggaggcaggaggcaggataatgacgctgttataccatgtgaaactcgcaagggggcagccttggagcttggaacggaggctggcaggaaaagatgcttcagccggggagggaaaatgcaaggtcccgcagtgatgggcaaaggctacggagttgactcttgaacaacgtggggatggggtgccgaaccccacgcagtggaaaatctgtgcatgactttgactcccccaaagttcaactactaatagcctactgttgaccaaaagctttacccagtatataaacaattgagtaagacatatttgaagccaggcacagtggcttatgcctgtaatcccagcactttaggaggccgaggcgggaagactgctcgaagccaggagttcaagagcagcctgggcaagatagtgagacccccacctctacaaataataaaaataaaaataattagctgggcgtggtggtgcgtgcctgtagtcccagctactcaggggtctgaggtgggaggatcccttgagcccaggattgaggctgcaatgccatgatcgcaccactgcactccagcctgggtgacagagcaagatcctgtctctggaaaaaaaagaaaaaagacatattttgtatgttatatatattatgtgctgtattcttacaataaagtaagctagagaaaagtacatgttactgaaaacattattagaaagagaaaataccttcacagcactgtgctgtatttatcaatactgtaagttttgttgtctgtttataagagaagttgtctgtctcaagcggcagtaaccgcggctgcagatctcaatctgtggtagatatcaagcagttcaacccttttttataatgtcatgacttttctttgcttcttggaacagctctggcatcactagtggccccgcatttggggccaagggggttattcaaagtttacggtattgcattaaacatggtgaaacatatgcaatgactatgaaagatcactttttacttctgtacacagtgtactggcgagaactgctcaccaggaggtgattagcttcacgtggtgttggaagcagatactcaacagttgagctcacggagaaagcacaggaggtggctacgaaattattataggagtacagtatgtctacagtaaatatgcacttatgactttaatactgcacatctttatgtttgcttgcatttctcttgacttcaaatggcatcaaatagagtttgtgtttgcgtgcatatatttttgataaattttaacttttttgttttgttttgtttttagacagagtcttgctctgtctcccaggctggagtgcaatggtgtgatcttggctcactgcaacctccgcctcccaggttcaagcaattctcctgcctcagcctcccaagtggctgggattacaggcacctaccaccacacctggctaattttttgtattgtaagtagagatggggtttcaccatgttggccaggcctgtctcgaacccctgacctcagttgacccacccgcttcggcctcccaaagtgctgggattacaggcgtgaaccacggtaccctgccaattttaactttctataagagatttgcccagcctgggcaacatggagaaaccctgtctttaccaaaaatacaaaaaatttagctgggcatggtggcgtgtgcctgtagtcccaggtacttgggaggctgaggtggaaggatggtttcagcctgggacgcagaggttgcagtgagccgagatcatgtcattgcactccagcctgggtaatagagccagatcctgtctcaaaaaaaaaaaaaaaaaaagctttgtatccattttggcatacatagactagtatgtatggcagtaaatagactagtggcagtaaatagactagtacctacatatattttttgtattcgtggcatacttaacttttgcttaattttaaaaatatatttctaggcttgtagttcctctgtaagttttttcaaattgttgcaaatctctgaaaatgtttccaatgtatttattgaaaaaaatccacaagtaagtggacctgcacagttcaaacctgtgctattcaaaggtcaactatatagtctgtaatacgtgatgggtgtcacgctgagtgtctacagtgagtgttgtctcacttcagcttcacacaacgctgtggtttagccttgccactgccgtacggatgagcgggtgttcactacacgaaggtactgggcagaggagcaaacactgactaaattctagcctgtgctttgctcaacaagccacatgcctgccttgcttgcatcaagggaaggagtattgtgttctaatttgaagaaatacaccagccactccttaggcagcacttggtgcgggatgggctcctctggaaagggagcacctaatttgcacaaaggtgctgcaccaggtagctacgatcctggaatgggatgaagaaacttgcctaaggccctacagcaaggaaggggtaaaagcaggatgtgatccttccaagcagaacccccaagagccaggggacatttgggaaacctgggggtgtgggggttaaccctgtatttgtggtccatttcgcaaaggatagcatcccacatccatgagagggaggtcagaagggagtggctgtggctgtgaaggagacagacacctgggcacctgctctaaattacagcaatgccatgcacatgatgatgtattggagcacaacaaatggcagccaccagctggggtgcacgcaccaatttctacaaatgagctctgttcaggctgaaatgtctacgcatgcaaggatttttcttgtaattgatgatatatccccagcgcccagaagacagagtggcacgcagtaggtgctcagtaaatgttcgctcaatgaatgaatgaatgcctctactagccttccaaagaaagttctatgtctgttttatcaatatggaaacaggccagagaaattaagtaacttcttttggaagccagaaacaagcccggcacttgtgcagtgacaacaccagggaatttcagtaaaaacccaaactccaccccagggagccccagtgcctcctcccgcatcacagggtgccagggcccactctctttgactcctgctccatagcccctgctgggtactgggctgcttctcccagttcctcctgcctccccccacttagggcaaatccagtgcctccctggggcccaggagactcagtgtgatccaccccaggcgcctctcactcctgtgagacccaaacctcctatcagctcccccagcaggccaagtctgtgcacccgtgactcccctgccccaatgttccctccagtggctctttgcctcttcagtatccacgtcttcatgatccttcccctactccatcccccaagccctcaccaccaaatgtaatgtaaacagcatgacagcaaaaactttttgttcacaactgcgtgttgttttttttttttttttttttttttagacacagtctcactctgttgctcaggatggagtgcagtgacacagtcatggctcactgcagccttgaattcctgggctcaagcgattcttccatttcagcttcccaagtagctgggaccagaggcacatgccactaaacccagctaatttcttttttctttctctcttttttttttttttttcccctgtggacatagggtctcctcatgttgcccaggctagtctcaaacaacctgtgctcaagcaatcctcccacctcagcctgccaaagtgctaaaattacggacctgagccaccgtacccagcctactgctgcacttttaacagcttaattgagatattatgtacatatcatcaaattcaccaatgttaagtgtacaattcaatgatttttagtaaatttactgaggtgtgagtccattaccatcagctagttttagaacattttcatgaccctagtaaaggattttacttcatgttcatttaaacttaatcttgggccaggcggggtggctcacgcctataatctcagcattttgggaggctggggtggacggatcacctgaggtcagtagttcgagaccagcctggccaacatggcgaaacctcatctctactaaacatacaaaaattagccaggcgtggtggcgggcacctgtaatcctagctacttaggaagctgaggcatgagaatttcttgaacccgggaggcagagtttgcagtgagccaagattgcaccattgcactccagcctgggcgacaacaagaccctgtctcaaaaaaaaaaaaaaaaaaaaaaaaacaacttaatcttcatttctacctccatcccccagacaaccacgagtctactttctgactctataactttgcctattctggacatatcatataaataaatgaaatctgacaatatatgtacatggtcttttacgtctggcttgtttcactcaacataaggctgtagtgtgtatgggtagctca

SEQ ID NO: 1053 - DNA, 113533 bp, Homo sapiens
ccaggtgtctccgtttttatcattgtttgtggtgtgacaggtgcagtggacctaggaaataagtgaagaaatgagtacagaccaagacatcaacatgcacaaccccccattagaagaagaaacaggggaaaagactcagaggaggagcaagggatggagagagaagtgtagcaaagacaacagcttcctgaactccacgttcttctctttcctctggactcacaactggaccacataacctttccagctttccttgcagttaggtgaggcaacgcgactgggttctggccaatggaatgtggatggaagtgagggtcccactatcaggtctagcccataaaaacctcacaaacaattctcctccatactctttttccttccaccaactgaatggaagtgacctcagtgaactcggaagtcatgtattgaaaattgcagagtttggccgggcacggtggctcacgcctgtattgcagcactttgggaggccgaggcgggcggatcacgaggtcaggagatcgagaccatcctggctaacacggtgaaaccccgtctgtactaaaaatacaaaaaattagcccggcgtagtgtcaggtgcctgtagtcccagctactcaggaggctgaggcaggagaatggcatgaacctgggaggcggagcttgcagtgagccgagattgtaccactgcactccagcctgggcgacagagccagactcagactccgtctcaaaaaaaaaaagaaaaaaaagaaaaaaaaaagaaaattggagagtctctatcagcctgaattgtttatccctcttcaccatcctatctaaccagaaacccttacaagtattaggtaaccacaggataaatgtgtatgtgtttaagccgttttacctcgtagctgaaattggacccaaaacacagaaagataaattaatctgaaaggcagaatgaaagataggctatagctgtatctataaagacaagggaaaatataattttaaggaagggtgagtcaataataacaatgactgttttttagaccctgccatattctaaactcttcgataagttgaatagatgcatgattacattatatactttaattttcatgataattatatcaagcattaaatggggatcttaagctcaaagaggttgagtacagtgcccaaaattccacagcaaataaacaatgctcttcaacagcatatcatcttacatccaaaataataagactaaagagtcagttaaagtgacttgcagaatagtggatgggattgagccagggaaagtggggcgtttattgggcatcagatggtgaggattgagtaacaggacgctgctcatccatcaagatctggcccgagtacccttcctctctatagagactttttgagctacacatgttggtatcaccactctgaatttctttttttctctttttttttttgagtcagagtcttgcactgttgcccaggctggagtgcagtggtgctatctctgctcactgcaagctccgcctcctgggtttacaccattctcctacctcagcctcctgagtagctgggactacaggcacccaccaccatgcccagctaattttttttgtatttttagtagagacggggtttcaccgtgttagccaggatggtctccatctcctgacctcatgatctgcctgcctcaacctgccaaagtgctgagattacaggcataagccaccacacctggcctctgaatttctttattatttactactccttacccagtgcattacaagcttccttagagtattactggacttgttctaaggtcgatttatatgctagatttttactgcttactcacattgggttcttatctacctttaggcaaatggaaggattacccttccccagtcatcttgcacttaggtgggatcatgtgactaactctagctaatgggctgggaaaagaagtgacatctattatttctgagacaaagcatttaatcactggcatgaggccttctactattctttttccctgctgcagcaattgtgttacgagacagaggtagcacaagatcagtgagcaactgcatggaagacagttgttttagagagtttcctgaacccacagccaacttagcatggcaagaagtcacctgggtgattgtgtgaaaccaatgagactttgcttatgttgttactgcagcacaactcagagtactttgacaaatacaatttaatcttccatcatgatcagagatgtcaaatattaatcatcagtgttaccactgcctcatgctacagacatgatgtatattattaatccatcaatggacttttatccattgaactgtaaagcctcagaatctttctcatcacagtgaactaagcagtcattattaattgattagaggtgaaaattaggggaaacccactaaagtcattccattccactcggcataaaatccaaacttcttactggggcctgcaagggtgcacaagagctggctttaccttcctcttcaatctcatttcctactacttgctttctcattcactctgctccatccacattaacctttttggttcctcaaacacactaaaaatactccaatctcaaagcctttacatttgctttgcactttttttttcatgtaaatttgcctgaaatgttacctcttcacccagaccttcctagtctaccttattaaaattgcctgcaccctccacccacttcctcgatgataataaaatgccagtctgtctttttgtgctgttgtatttttggaatttagagtagtgcctggaatatagaggtgcatacaaaatagttcttaaactaatgaaggcaactgatctgccaactctgatctagatcatagtctctgaagagagagggcaggtcctcctcatctgtggcttgtcctctgtggcgaatccatgtagtgcatacagaaggtgtccattaaattcccattggatgattaaaagacttttattttccattgcttcatcatggagtcacatctgtgtcttttgccttctttcaccttcataagctctctcaagacgtctcttcctttctctctccctagcccaccctccccacatcctctcccattaaagttcagttcaacaagtctctttctcacccacgccatgccttctacagcagcattcttctgtggctgggaaacagtagccagcaataaaatgcgttttggcctggcctcacatccatgttctgtacctattccttttctacaggatttgatgctaagcccagtcaggacttggcaggagccttatgcctgtacgttagagcccagaatttctaccctttgggtgttttaaagagaagcagctgttaccatctgccagatgaaaggttttgccctttgaaaatagactgtgaggcatgttcaggcagacaggggctctctggagaagatctgggaggatgggactcggaagacctgccactcatttggattgacatacaactgtaggcaaagtatcagagatgtctagtttctatcacaacgaaggagagagaactgtattctttgggtagaatgggatgatgtggggagggattataggtgaggccaactggtgaaaagagcacagacctcagaatcagaagacctaagatttagagtcaaagtcctgaattcaagacccagtggtaggggcatccgccatccacttgagccactgtttactcttttgtaaaatggtgtgatgctctcctatattcatcaagtctttttggttgcaacggaaaccagcttatgctaatgtaaacagaataaaaggaatttattggaaggatctgactgcattcttgccattggcttctgtgaggcacaagtgtgtcaagaatggactagaacaagaaacccgaaaagtgttagaactctagaagtatttcctgcgtttctgtgagcttctggtttattcttatttcccctgcttctctgtcctcatggaggtgtattgctgccccacagcttccaagtttgtgtcttaaaccttcagccatgctctaatcccaaatgtcaggaacaaagactctgactgatcaggattgctttaggtgtctactacggggtcgaatcagtcctgggcatgggaagtaggggtcacatagtacaactgtggctgccagaagctgctcttcacaatctggatgaaatattcagagaaggaactataacttgtgggttgggccacaaatccaaaaagggtcttgtgagtattatcgtcactgaataaactctcaggtgctgcaaagagaaaatggtgttatttctagtcagaatatacaaccatctcacaatgatactctaaggaatcaaggcatagtcctatgcaaatctaaaattgtccattgaatagccacggtccgagtctacacatttaaagttgtcttattctaggattctaatttgtcagagggctgtgagagtcaacattctccattctctaccttagcaatactcttttcacctcctccactccaacaaaagcttccaaaggaaatcttccttcttaaaagaaactgatttccatgattcagaataaaatttagtaaagactgatgaattaggactccattaatttagcatttttgctacatcaagaatcaaaaagggattaaacttttctatccccatatctcttaaagccaggaaagatttgctaagtgaaataaaaatgtgactttggacaagttttgtaacctctctaagactttgtttccttatctgtaaaatagaaattaacttttcataggattgttgtgacaattaaatgacattaggcttgacatgtagaaagtactggctattagctatgatgttgaagataatgttggttgtagtgatggtagtaataactctagtggtgatggtggataatggtagtggtggtggtgatgatcgtggtgatgatagtggcagtggtgatggtggaggtggtagtggtgatgatggcaatagtggcagtgaaggagtggtgatgattaattatgacagaaccaagaatgtataaattgttctcagcacatagtagtcacatagtaaatgagtgcagagaacaagcaatttttagataattacaaggctcttagttaccatttacataccaaccatggatatgtccaaaacaaatcatgcttaaatgttcatcaaaacagattcctaaagccttccaatagatgtttaaccactttgtatgaagtggagagaagaggaataaatatgaattttagttactacatgaacataaaataaatataattaaaaataaatataattacattcccttaagtaatagtgcataaaatatagactgttttgcttgtgttccttccagttagcttgctacataaagccacataccattaattcaaatttcatcgtcaaaaattcacatttctaagtttgttatcatccaagtctaggaattgtcctatctgcatactattttaacctccaaaggtctgcgtaaaacccattttgtggctaacatggatctatctaaaaaatccagttgcatctctccccttgggacttccagggtgcagcagccacaccaatttctttatttaccataatttgaaagccttattaatcctaaaggctcagctctataatcacatttggttagcttgagactaatccttagaggttatttatttttcatgaagattgcttcccagctactggtttatttagactttactaataattatttcgcaagagcttttttcaccactgctcatttatatgtgtagaattcacactgtgaatatgaactaaggatgaatttttttaagagttaaggtttaactggaatgtcattttttctttactgtgccagatcattccttttctgggaagctgtcccgtgaaataattaaatattgtccctttaaaagagtctgtgacctgctgcatttgtaatccttgaattccatgattcagcccaagatctcccagctttccatttcacactcctgctcacatttggtttagatttggcttttctttgctcgagaggaacaggatttattactaccagtcagaagccatcagtccccaatatttcagcaaagaaccctagtctgccagagtgagtaatgctctgtttgcactcaagtctccctgaaccagtcaccccaaataggatgtcactgcttgcatttatttagaaactgtcaagttgtctatgtgtttcctcccaccagttcatgtgattcctgaaacacccctatgcgctttgatgggagggaaaaaaaataacagtccctcatacatttatgtaatgcttatttatggagcacagtgtatatgttagggactgagagctgagtatgtgctggcaccccagaaggacatgtccctgttctcaggtagcttagaggtcattgagtcccaccatgaggcaggcacaccaggaaatggtcttgatgtcttctttcactgactactcataataaactatgggaaaggtctgattacccttgttttgtggctgggattaccgaaactcccagaggttaagtcatcctctgataagggggaaagccaatgctcagacctggactttctcggtccaaggctgctgattgaattctggattcttcccaaatagtgtaatctcgtgtcaactcaaatcaattcaagtttcctttccagtttcccacatcccatggtttggcttagaaagaaagatggtgcaacacacaacagatatcaagcatctaagagtttgggaagggtttgtgtgaccagtggtgtgggcagggtgtctttagaatggaaagtggatgagaggggagctcaaagaggtgatccaggaattcccaaaggtggaccttgactcagtaagtcaccaggtctgttatttgaaatgagtcatttgtggtatgggggcaaatgacctcagtccctcaccaaactatcgggaagcaagcaaacaaaataatccccgcttctggggagaataatcctaattacagcccctagaatttgcatgcccttctacagtttgcaaagcactttcacacctatattttccttggtggaattgtttactgcactaatggagaagggaccaggacttgatatggcctagtttgttggtttttatatattttttaagaataatcatctgtcaaaatgtaatttcatgcaatagtctggtatataaaactgatgcaagtggaacttctgtggttgggatggggcctggggagggagaggcacagcttactcctcagcttttactctgaccactaggtctgcttctgaggggtctctaaggaacctccaggttccatgaaacacagtaagacagacattgttcctagtgactccccacgtcacttcactttcttgctccaagaaaaggaagctgaaatccctggaggttgcatgaggtgaaaaaagctgctccttgtcctgtattcttgtgcatggaacctaccagggctggtttcctcacatgagtagggactgaagccttatctgggagccagtttgcccccagttgtttcaagaaataaagtgtcctcttggtcacagacagcagcagtaacaactttttcctgcggactggcagcattttccaagcacctgctcttcaggtgggagttacgggtcactgtcttcattccagacgggcggctctttgagtcatggcatgccagcttctgagtggctgaggactagatccagacaaggatttttcagtcccaaacactcttcctgaaaatgcaagaggagtagtctttagtcaaacagaatctccacaactgaaaaatttataccggactagacagtggtagtggttgcacaatattgttaaagtactacacgtcactgctataaacacttttaaatgggtgaaatggtaaattttatgttatgcatattttaacataacaatgataataattttaactaagtacgttgcctccttatttcctacagggtcaagttcaaactccctggcatagcttacaccttgtagtccccatacctgtaacctcatgtctgctatcttcccccagccccttcatctgatctatgttcagatcagctcacattgctctctattctctggacaagccatgttctttcacttttctatgctcaaacacaattttgcttttagtaatgatagcaaacacttatttaaagtgcttactgcatgcatatgtagacataaatctacggcttaatacatgcagggcttttgagtcatttaatcctcaccaattctatgaagtaatagaattgtaatagtaataatagatactattattaagcccattttatacttgagcaaattgagctaattgccttaggcaaggtcacacaactaagaagcagccataatagggtttggatctaggtgttctagctcctgaatccatgctgttcgtcactacactgtactgcctgtggatgacttacttgtccctgtagtttcatctgaagaattcctcctccttttcctttgaggcctgcctcaaatatcacttcccctgtgaagactgcctggtgttctccaggagagagtgtgactcccttctctaggaatggtagcaccccaaacacacacattttgcagcatatttcaccttgcatggtaatggcctgcttgtgagttttattccgtaccagagggtgagggctctgaagatagcgccaggtcttatttacctcgataccccacaacactcattacatgtctgatgaatgaatgcatagggggatggctgggtgcatttctctcaacttttcaatttcttgaaataaataacaaaatcttaccttccctcagaagtcctggcatggttcctttcatcttgccacagccactgataatcactttcattttctgtgtaactcaccaggcaagaagtccatgcagatttacttttagtagttcacatgacaaataaatactgcgtttgatttccaaacattaaaccatagtatattatagatagatatagagttatcattcaaagtatgatatttcaatctcaaaaggcttcccctgaagaatattacaaactcttcctctctttaagatctgctgggtaggaaagatgggagaaaatgaattaatgtttacacagaaaggaggataatgggggcaaaaataatagatgaacgtatgggtggatgagagaatggataaaatgataggtggatatgttgatcttggacagatgggaaatgagtggatatatcaataaacagatatgtgggtggatgggtggagaagaggatggtggatggttgtggttttatgaagagatgtgaaaaaggaagtgtggaatgatggatgagaagttgtatgggaagatgaatagaagaataggtggttgaataaattaaaaggtgtgtggttggatgaatgaatgagtgggatgatagatggacctaagtggttagtggatggacaggaggatggatggatgtgagagccccagaaggacataaggaaagatgggtggatagatggatgggcggatggaaggatatttaggaggatgaatgagcatgtgtgtggagagaggtgcccattcacactggcttgaacacatgggttagctgagccaaatgccagccctatgacaggccatcagtagctttccctgagctgttctgccaagaagctaaaattcattcaagccatgtggacttgttattgaggggaaaaagaatgagctctccctctttccacttggaagattcaccaactccccacccctcactccccactgtgggcacggaggcactgcgccacccagggcaagacctcgccctctctccagctcctctcccaggatatccaacatcctgtgaaacccagagatcttgctccagccggattcagagaaatttagcgggaaaggagaggccaaaggctgaacccaatggtgcaaggttttacggttcggtcatcctctgtcctgacgccgcggggccagcgggagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcggtgagtgcccgccgcagcctgggcagcaagatgggtgcggggtgctcagcgcggacccggcggcagcccctccggctgagtcggccctgggggactggagtcaagtgagctgtctgcgaagtgcattgggctccggaaagcagggctgggatttgcgctaaaccgttggagaatgtgtctgtggaagcaccatttggttgaaagaaaaagagaaagagaagaaagtttgttgggcaggctgccggcgcgcagttttgggcgaggtcgctagagctgcagcacatggcagaaagtaaccgttctcccggatgcgcacagtcgttgtctggactaacaggctcctgtgcccaagggctcgccaagccccaccgggctgtgtctaggcagggcagagctgggcggggcagagactggggctggaacagggcgagtggctgttatcaaggtggtcacagaagggatcacaattccaagtgtgagactagctggcaatgggttttccagaaaggggtcctgggttctcccagctccccactgagccttgttccaaagcttacagtccgcagtgtcactgccaccttagcgctgtggaagcttgaaccagctctgcggtgaggtcttgggtctccatgagattccagcctgggatagggagcatgaatatgagaggcaaccactggaccagctgcttggtcctcaccacctcctgcttctgccaatcagtgtggggaaatctcaacagtaaggtggcttatattccctgcctggcagcctcagagcagagagaagagccttgataccagggcaacatcagggaccctggagctagggctccaatatctcatccaaacagggtcagtgctttgtggtggctatggaggggaggggctgcgtgtaaggtatattctagcacggctcaactccaagcattctctttctttgtctatgtatgtacagataattacatggccgatttgcttatcgctggccaaaattaatctttcttttaagaagtgccagctgggtcattaagacagctcagcctgcatgcagtaaattctactcagcaaatatttattaacccagttccacgggagtactgagaaattgaaacacacagtctcacccaggtagtttagattgagtacccagtataaagtatcttgaattactttctgctttctctatcttcctactttctgcagtaggaagaaagtgaccctaggtggaggctaggcaggatgagttctctgtgcatatgcatctccctttctgtgtgagtgagaggtctttgctaggtggggatttggggatctaggatttatactactgaagctgaaataataataataatgatagcaacaacacagcctgtcatggtggcccatgcctgtaatcctaggactttgggaggctgaggcagcaaattacccaaggtcaggagtttgagaccagccttggccaacatggtgaaaccccatctttacaaaaaatacaaaaattagcagggtgtggtggtgcacacctgtagtcccagctgcttgggacgctgaggcaggagaattgcttgaacctaggaggtgaaggttgcagtgaaccaagattatgccattgcactccagcctgggtgacaaagcgtgactctgttaaaaaaaaaaaaatgaatacagtgctagctaccatttactgtatattttcactgtgccaggcattatgttaaatattttccatgtgttatctcattctaccctcacaatggcctagtaagaagcttcctgttatcaggcctgtttgacaggaggaaaactgatgcttagagacgttaagtgacttgctggcattcacatagccaggagcagtgctggatggaaacccagctccactgagctccaaagcctaggcttagaatatgttagactgtataagatggacgaacttggaaggatttcagggagggaaggattttggtggactctaggccttagggaaagttccaaaagggactggagctcaaataagcccttgaaaagtggaaacattcaggatgggagagaagagtcaagctggagatcagggagagccctgggcctggcctgaaagaagagggccctggtggtttccctatagtctctagggaagtttatttgtatgttacctaccagtgccatcttctgctttgtctttgggcattctgactcctgactccttccaacctgtctccccgttccttctaaaaggccccacttccaaatatttggcactgtcctaacccttgaggttctcccagagacccgcagtctccctcctgccccgtgtttccacggcccctttgcgcagcatcatttagaggaagtacaatgaagtgccagtagcaataactgccccggccctcgctttcatgtgcttgtaaagttgtttggcaggaactgggacttggaaaggagacatgactttgtcagagggcttggggctgggcatggtgtgggtggcgaaggggagaaggaggaaaggggaaggaaaggagctcttgttgccccattctggggagtggtggactctggacaaccacgaggaaactttggaaaggagcaaggctttgaggaggagtccagtctttgtatgggaaagcaaaaagtggagaaatggccaaatgtagttaagtgacattggacccagaaactctgagttggggaacagatatcttgaattcggggtcttgtgcaggaggaagaaagtggcccttggtggaggccaggggggatgagtccttcatgcacatgcatctccttgtctctgtgggtgaggggatctttttttttaattattattatactttaagttttagggttcaaccattgtggaagtcagtgtggcgattcctcagggatctagaactagaaataccatttgacccagccatcccattactgggtatatacccaaaggactacaaatcatgctgctataaagacacatgcacatgtatgtttattgtggcattattcacaatagcaaagacttggaaccaacccaaatgtccaacaatgatagactgggtgaggggatctttgcttgggaattgcatgcctggtgttgagaaagaggagagcgtctgagagccctgggtcttagggctggcacacacctttctgctcccttctctctaattgagcattagagactccgccccctgctgggagttagaactttagctgtgttttcccatgtgaaggagcaaagaggcaaagcttcatctctgttggggctagcatcaactaattcaggtattccccatttacacattggacatctacttgctgcaaaggcatggtgacaagtccttgtgtgggaggctggcagccagtaggaaaatgttccatttgttttttcccaaatttccccacaaaggaggggatgctggacagcatgaaattcttagttcatgacagattcccttccattcattcaggaactatttcctgactcattgtcatagactcagagatgggaactctaaggatcatttagaaaatctgaaagagagggactagtgacttcccctctctgcgacttgttaagatattagggcagggcatttctctcatgtatctctatcatgaggactgtgggagcctcaaccccaccccctgcagtgggtggggagggtgtggtctactggggtaacaacatttgtttcacaccttaaatactaccttacagactcattacagttttatatattactctacaatatacccaatttgagtttaatacaataataatgatatatatttttgaccatatagcaatgttggtgttcgacaatgattctctgtattgtcctggggcttctagcacctcctggaacatcgctagatggtcaggagcaccaaagttttaaaaacctgatgctctgctgtggtaccatatggtcctgtgtaaagcagggtcctaagtcctgagtctctaggaaatactgctcagtgagcactgactctatactagatgtgaagccgggggtagcacaggatatcttatctaagcctcccaacagcccaatacacctagcactctctttaactccattttctagataaagagatcgagacttgtggagatggcatgacttgccccaggatccagtggtggagttgggatttccgcattatctaacatcctcccatgttagactccaatgcttatgctccttcaattcattacgtgtctggaggactttggaagctatacgtggctctcccacactacctgtcccctgtggccagcataagtgaactcttgcatgggtggcttctctctccatccccggcaggctgtggactcttggctgccctgccctggcctgtctctccccaggtttggccacagatatcagagatgccaaccaagttatttgtaactaaaataaatcacatcccttatcagagtccagctgccctcccagatatgctctgatttacaggcttggaataaagagagaggtggttgcttgtctacaggacaagttagggcaatgccctctgcctgaatattaggaaagcagcattacaggagctctcactctgaccaggcaagcatttcacatgcacagacccagagacccactcctcacatgctcattagtaggttgtgcgaccctgggtaggaggctgacatgggtcttgaactgaaacccagtgtgtggctctaggtgacatgtggccacccaagtgaggtttcggatccacctgcagtgtcagatgcttcaaggctggggtcccctgatggagaggaggtggttggagatcacctgggcctcctcagcactgcctcctggctggggctggggctggggataagagagtaactgcaattgtgcttccccggcaccttcgctttaggtcactccaccgaagagcctgaaagggaagtggttcttgcgaaagaatgagctgaagcaggtggcagatgctaccaggcaccgtgtagttttcaaaggggatctttttctgcctcagagagaaattctggggtttgcacagcaagaaaccgatgactcaatttcctttgtgtccctgctttaatgggaaggttgtaggcgttctttagaatggcagggtaggttgataccttctaccttaaatttgaatcccacttttcactcacttagcaggttgaattttttttaagtgtaccccccacagctgcccaactgggtttgcgaggcaagcccaacttgccagagtaaaccggaaggggtgctttctaaagtttgtggttctggagtctggccaggcatggatacagtcattgtgcgttccagattttctgggagagtcaggatctcaaatatgcaaacactctaccaattgatgtctagtgcatattttgactaaatgtttatatatttttccacaaataaatacatgacttaatgtaattgaaagtcaaacactttttaaaaatgctttttgcataaagaaattcacatctttacaactccttaactaggatggtgtcaattaaattaatgtttgattcaggacatgtgtactttggaggtaagtatttcatattcctcccctctccattgctcaattgccccactgggtgacgtaccaagataagccacatgtttgattcttgtttgctggatgtggacatatgcacattgcaggtatgcctataagtacatgcctgaaggatctatgtgtgtggtgggaattggtgatgccaaagaatgctaaagactttcatgccccttaaaggggaaaataaccacaacaaaacaaattccaatgtatcttctcctgtcttctgcagcactgggggagtcccctgataacagggatcatgtcacattcatttttgtgggcccagatcccagtaatattgacccataactgttgaactgcaatgaatgtctagaatataaaagtcatgatatctatatatatggaagcatgctgtcagtatgggctaaggtgcaaatacatttatgtgtaagtgagaaccatggtgatggctgtgttgctcaggacagggctgacttggctggctgactgcccaccacaggcctcatgtttggtctaccccaaacagtgagctcacccatctgtttgtttgcggctttggtggctgcctgctgtgaccgctggggacatctggctaaagacagggttactagatagttgggctgagaagggagtgggagccagtgagatgaggacaccaaccccaaatttaagcctcaaaacaaaaacactccccagcagcagccaccttggggttctagttattttggagatactgatacgaggttgagatccttgggtgagaggcccacactcctccaacccccatgtctgcttctggaaggtggtggcagaggagagaagtagaagtactatatgggagatgcgggagattcttgccttctctgtcggtctctttgggcaattatcaagctgtcatctgaccagatactaccatagcttcttcgggggcaaatccgtagggaatcctgacatccgacggggagccactttggcaatggcaaacggtgtctcctctccacagagcttgtgatgtcagaaattacccataactggggcaggttttgtcttcccaaagattgtctgcccagctagacctgagagacagggagacaaacacagaatgagggggtgggtcttgtgggggtggggaacgatggaaactcacagagccagatctccccgagtttgagttgcactggctgcctgggtgtgtcctcctgaggtaagtgtccctgcgaagtgcaagtgtgggcagacagatctcaggtgggtggggagggactgagtcaccaaggaggtgatttgcaaaactcaggtcccagaaactttcaggtcttcagcttttaaaagtaaaggttaattgcaaaactccggggttgagggaagagattattcacatagaccagtcattttgagcatctgctgttgtggcattgcaagtctccttcgcagtgcctgaaagttcatttgtttttgagagctcttacgctttttctgtttgcatctttgcacaagttctatgtttctgagaaccctcaccactattagtaataatagcaaacacttacagagtgttgaccatgtaccagcgccattctaattgtttcctatatactgccttgtttaatccaaacactgacttcatgaaggtggtgctgttattatctgtcttttacatatgaggaaactgaggcacagagaatttaagtagcttgcccaaggccatgcagctgataagtgatggcgctgggattcaaactcacatctggctacagagttcatgctctttgtcactatgttagagtgcttctcttggtatattaagatatcgaggcaccctagaaatccagacgattgtacctggaagtactgtagttgttttcaaaaacttcatttgggaatctagttgtgggtgaggtcataacatccactgagcttttaaacatgatgtcagaggaaggggttagaattgcaaaaatgaaggaggaggaagttgtaatggaaacttctgccaatgcatattctgagttgactcattcattctgatctctgaatagaagctctactctcttccatgtgatggaaagttgaggatagggtagggctgagagggatgtgaattgagttgtttgttcattaggataggatagggctgaaagggatgtgaattgagttgtttgttcattatcacttcattatttgtcacctggatgaaaggtaaaggtggctgattagtgtttctccatcagctagaactttgactgggaaatgagccaatcaaatagcagcaaaatatttgccctcaccttacaggcccttggttccagggtcttctctccaccggctagaatggatgagggagggagagaaactctgagaaaagaggctgtcaggagtagggctgtacatatccagggcacaaggaatttggcaaaagctggaagtatactatagcccttctctccagccctagcctaaaccagatgaccaggcttctatttggcccagcatgtgaccatcccatcagggagcaagagagtttcctctgggtacccctcactgagaaaaaagccacccaggaagggaggaggcaaggccccctgggaacatctggctcagtccacaggaagggatgcaggccttttcctgggaatgaggactcatcccatattccagcccccttcccccaacttttttttttttcaattttagtgcatctctttacacttaacaggtctgcagtgacttctaggaggatccacacaccaatcgtggaactaggcagcatctttttccacttcctttccaagatagtagcacgataacagtaaagcccctttgcaagtgttcactattatgcacattaagatgccagggagagggctgggaaaggtggctcacacctgtaatcccagcactttgggaggccgaggcaggcggatgacctgaggtcgggagttcgagaccagcctgaccaacatggagaaaccccgtctctactaaaaatacaaaaaaattagccgggcatggtggtgcatgcctgtaatctcagctacttgggaggctgaggcaggagaatcacttgaacccgggaggcagaggttgcagtgagccaagatcacgccattgcactccagcctgggcaacaagagcgaaactcggtctcaaaaaaaaaaaaggtgccagggagaaatgaacaattccatgcagccaacacctggtctcctgcgtttggcttagaagggcatttctgcccaagcccccagctctagtctttgcacactttaaatgagtagctactacatgccaatcacagatgttgcctctgctgagtatccagtcaaaaaaccagaatctaacagagctaactaagcaccatcttgcaggaaaccagctgacgtcagctccgcagccaccagtgagttactgggcccacatctgcctgcaagagggggaggggaattcaggtaacccacaagaggggataaaagttcggggaagaaatctcctgtcaaggagtttgtttttgcagtggatcctctgcagtgagactagttgtctttacaatatcattagaggtcaggtacattcctgtagactcccttaagtgacttgctttctcctattgttccccctgaaaattcataaaaacctcacaaacacatctccatttaaaaagagaaagtttaaaggatgccatgtaatggttatctcttttcttttgccagtgagcataaaagctccttagggaaaagcccaaaccctctatacattttcatattcatgatagccctgagcggtcagcacagttccccaattatagtgggtgctcaataaacacttggatggcttactgaattaataatgtttctagacttggctagcaaagccatctccgttacttatcttttgtgatttttataggttctgtctaattctttttcttcattttttttctttctggtctatacaaatcttctttcatttttctctattgctacttgtagcgatcctcaacccgcctcctcccttgaaatttctgttctctgcactctcttcagtctaaagagatctttcttgaggtttgaaatgttacacaaggcaggggaagtttagagctaattgtattttgtccagtagaacggggatctggatttcctataggtctggctgcctctttgtctacacctttacttccaaatctggcctcatgtataaaaagaccccaaaccttaaaatcatgttctcaacaatactcagagaaaaattgttggctttttggtcaccatgctagaggaataaaagggcagttgtttctttcggtcaatggtttgaaaacctcccagactaaaaatcacctccatataatcagatgcttggtgtggtgtaatgaagatgaggaggtctggctttgataagagtcatttagaaggtataaaggcagtggaacaagacgggaggacccatacaccagttgattcccctcttgccacttaacagcagcgtgagcttgggcagttgcacttgttaaatgtctggaacaatacttagcacgtaatttctaaagcttaatgtttagttcacagaaggtatcccaagaatagaaatgattattatattttagcttctctctattactgattcactatgtgctgctaggcaaagtatttcacccccatttacttctatttttccatgtgtaaaatgcgagggttggattctagttgatctgtcaagtcctttccaggcctcatgttctataaattcaccactctgtgggcttactaacacctgagcctcataaaacctaatggaaagaataacacaaaaccaccataaggcagtgtcaaaaaaaattgatgcctgatttgtattaaatgtcaaaagtgaattattaatccatgccagaaataaacatatggacccaattacactctaactccaatgggcaagagtgttgtagggacaaagtgctttgcccgtagtacttcatagaatcctctagaccatgtggaaggtgagcagatgaagcagctctggccagagaagttaggaacatgtcccagtcacacaactgaaactgcaggaagtcagtcctgggattaactgcaggatctgaacactgtactctttatattgtactttaaaaacattgcttcacatggccagaaaagccaacctctgaagaagagaaaaattgttcccttcactctcagagcttcatgagcaccttggacttgccagctttcctcaagcaacccctgtaacttgttggcacaaaattaaccacaatattcagacaaagcagtacttacagggtgagtgctagtatcctatgcaactagggtagcctgagaatctaggggaaaaaaagctagaccaaacaaaagattatatataatctttccccaaatcaaggcactgagcaaggcaggcctgagagatggtgaatttctgcttctactgagagtcctccagacccccagtaaaaatttcttttcatcataaaaccagagaaactcttgctcaggaaaaagaaagaaaaatggaaatcataaagattgcacgacttaggattttgtcaaaatgtgtcagaggctataatataaggctagtttttggcattctgtcagtcactgaatgtccttcgtcagatcacagctccttttggttgtgctgactttatacccatctggaatccactgaccattagctgaaataaaatcccagatgtgctcagatctcacatcctgtgcaatgccctcagttattgctgatacggttcagtcatctgtctctccagctaatcatacagacacagtattctaggagaagtgagaacccactcatagccaggagagcttctccctctcagtcacagggtgactgtgggcaaggtccttcccctgttggttgcctctgtctccccagttataagatggtgacaaactgaccaacttaaaatttccttaaaatgtattggcactgtggacagaaatgaggaaagtggaagacctagtttctgtcctcagggagcttaccatttggtggaaataaagttaaacaggtgaaagaattatgcaagagagcataaccaagtgtcagaagacaggaaaaacagacatctcgattgcatgtgaaggcttcaaggaatttgaggatgagttgaatgtggaaaagaagatagacagagagaggggagaggagagaaacccagggaaaggcaaaacatgagccaggtgtttaaagtgggggaataagaatggcttgattggggccaggggaggggtctgtctgcttggataagagaattcatgaaaagaacagtgagagatgaggtcggacagattccaggcaatcaagtaacagtggcactgtccactggcagaagatccaatttttctgccccagaaactcagaagttctcatgaatcaccctctcagacagtgctagacagagttcagaagcaggccagctccaacagtgagaaagaactttggcaactttgcctgggttagagagtggcaatttaagtgaatcccaaacaagacctactgtggcaatagcaaatagattttagctcaaggaacatttcccattgactcctagaggcttcccaaaatgctgtactaagaagtcaaaccttggctcaggtatggagagtgctgtgatccattagtgatgtctgctatgggcacaatatgaaggatttgacccccatgcatcacatggacatcaccgtagtggagcagcaggctttctttgttaatgtttctgagagttgtgtgtatagtcctctgggagtttagccattctagaatctgtccagctagccatactatagactctatctccttctagaacagtaaaaaagcagtctcttgcccagagggcagaggttagtcacttgagccttttgttaggattcactcccattctgtcttcccatttacccacatgaagttagatgctgggagccagatatttcctgtgtttgaacaagggccagacttcctggcaaagggtcccttcttcccatcagtttcttcaactgcaaactgagaagacaaaagtgatgcctcacccgtggtggcgacaggaggaataactagctaatgcgaggaaagcttttgaagatgaaagggtggtatgtgcatgttaattacaacttttatcagccctggagcctctgcattctcagctgccactggaagctcttctgtgcctcccaaatgcaaacagcagccacattccatgagctggcctcactaagtcctgcttagagcatccaagtcaagaaggttggattttgagctcaggctggccagctggctcactctgggccactcaagtttcccactactcatccccaagggaaaaagtaggctagctacctgggcaggtaagataagatagaaccaaggtataaacaaaaggctccatcaaaagtctaccagaaatagcccctgggtaagattaggacactctgctctaattcccaccctgtgaaagcctaattgtttgaccttgggctattggctttatctgtctaatggttcaatatactgtgtgaaccatttggggataataatccctctgcctcccctagacctctccacctttgcctgctggtgtgaaagtgttttgtgctagtaggcagaaacacgtgatataaaactacaaggtcctattattacctaggataactttcgcctctatctatgtctcctgttgctggttgaccccaatcattgaaactgtattctttggaatgctcagcagtctcctccaagctgccattccctccttatctaggtgggcccagtattggctcaggcttcttggttgtgccacttcctaaggcttgcaaatgcattcagcctgcccttgctctcagtgccagctctcagtgcccttgctgggataactcaataaagggctagaggtgggaatgggataatcatcagatgctttgctagtgctgacgggacagcttagaaggtataaactgagctgggcccatgcagcaacaccaaaatatgtgttcaaagagggagaagaggagaaaaagagaaaggaagttatcgtggtctgataacagggcatgtcagaatgggaaagggtgttaggaattatgtagccaacttgtttgattggaaagataaggaagcctcaagggctgcaagtgactttcccaaggtcacaaaactaattggtggcaaaaccgtggtcttctgacttgtccggtttcctttcattttatcctttgagacgataaaggagaggacactaactaaacaagaagacaatgatctgatcaggacaagaagacttggagtacaaaatgagaagaagataatagggtaatggattttttagtggcacagtgggaaatggcgtaggtgtttacactgcactggagccctcactgtgcttggaactggttccctgtgcacagtcttgcacacccatatttggtatttttttatcctttttgacttaatgagcatttggaaaccataaggcccacagcaacctgacctttgacttgcccagactctctgagcaattttgtgagttgagtcaacaatcaatggttttcaaattattcaattgttcactcaacgcatactagttgaacaccaatatctgtgctctgctaggcactggggataccactgtagacaagagaggcatagtctcctctctcctggaacttacagtctatctggaagacagacagtaaacaactaatgatgcctttgtttaattacacttgtggtaagtgctatgaaggagaagcactggatcttgtgagagcataatagggagatctcatctgatttaaagcaccagggaaagcctcccaggacctgttggatgaatagcagtaaccatgtctccaggatccccacaattccttgaggacccttgttgtcagacttctcagagctgtaccagccctctcactgtctcaccattgggtcttctgagtaagaaagcaagaaaaaaaattttactcctcaaaattctgaaagcaagtggtttatcatgtctgccctgtaatagtggtgggaagaaaatcatgagaacctctaagctgactcaggattttagaagcacacatttggggagaagggaaacaaaaattctggagaagcaaaaagtgtcatatggtatagaagttattttaagctactggggaaaattcataatttacttagggatcttgagtgtcaagcattggtttagagacaaatcttatccatttcgttgaaagttccttgatcttgtggctgaagcttgggcctagggttttattagtgtacatttaggggatggtttacagggtgtctttcaaggtcatacaggtgcctcttttggggtcaggcaggaggaataggacaaactctgggatacgaatgtacaaccatttggctcctagggcctcagtcctttagctccttgcttctggtgacttcttggagacaagagtagactttttcagaacagcgagatagttgtgctgacaaaacaaaaacaaaaacatcatttaagatgccttcagatgcaagtacatgtcataatagaaatatttaaaaattagtagagtataggcactagctaattcaaatgcttggttgtaaacaactatgtcttgtaaatgagaataaagtttattctctcaatgacgatgataacatctttctcactcacttttactcaaattggctttattgggcaggagagacagagatggagttataggtatcatgattgaacttaagctacaacccatctatgcatcaaaccatcatgtgtctcgtgtgattgttatctgttgtgtatattttggtatatccctatctgtacataccagctgaatatttctgtaagtaacagaacaatcagctctcataaaatattacctcccagggcaagaagtctgggatgattccaggaagtcaatgatattatcaagactcaggtttatttttccaactttcaattctgccactcccagtgtcttcctgcaatttagcacccctcatgttcctaaactaaatcccacagttccaggcatcctaggaaaaaaaaaatcaatatttagcagcagaagaaagagtgtatattcacaaacatctcttctaaaattggaggagcggctttttgggaagtccttaattgacctctccttatttctcattggatgaatggggtcacatgcccacacctaaccaatcactggcaagaagagcttggaccacagtgcttgacttagaccaatcatgatccacccactggagctgggatttgaggtctcacctgtcctgaagcacaaattcagggtttctgaataaaattgcacttcaggtagaatagaataactttttttgcattggtaacaatgtgggctacaatgagtaagggagtccatttacctgctagagttgtggtttgagactatttgggctaaggaaagaaggcaaagctaagtttttgtgcctctgtgccacaccctcaacctttttctgaaaagacatgcctcatgggtagagctcacatgggggacacactgcagtttgaggtttagatggtctgtggcttatactcaatgataatacctaaaactttatcctttcctgtcttctacaaaagagaattatatcagggaataatcttaaatctgttataatttacaagaaatagccagtcttctgcacacttgagtactttattattagaaactcattacttgcaacccatctcagcactgttggagctacaccatgcatgaggaccgctgctctagagtcatccattaaaaaagaattcctacgaacctgaatgagcatttctttctctaaattatgagatgatgaccctcaagggaaatggccgtcttcccttttctactgcactcttagagtgcattaatgtgtgtgaagtgttttcggttccattatctaaagcagccctcatattaacatcgtggttggcattactggcctcctgtatgggatgaaagtttaatgacttctgcaaggttatgaaaggtcaagatcacagctaattagtgcaaattcaggatttgaattctagtttctaccccagagctgatgtccatgtcaccatggacatcatttgctcccaatatacctgatttactttcaaggggtctggaattgactattggattttatattaaaaattgctctttcataggcaggaaaaagtccttcctaatagtttgagtccaaagcttaagggtctagcatctcaactttttaatgaacccaaaaatgaacaggagggttttctgagccagtcccctgcctccacacagttagctcatgaatccaacatcatgggaggaagtcttcaggattttgtttcccattccttttttatcacctaaatatagttaaaggatttgtgatgactgcatccagagatgtttaaaaatggacctgaaggatgtgattgtgtcttaggcaggaagggtgccggttcttttcagtatctaatgatgaacgatctaaaggaaatggattctaaaccatttgattctaaaccaaaatggtgtatgtttcttttgagggtgaatttcctgatcatgagccttgttgagcattagactggccggctggttcctaatccatccttcagttctcagctgcagtgacatttccttagagagacagatctcctttggggacagcacaggacttgagaaaaaaggcttccctttccactgagcttggctccaactacacctcatgtgtctgttacatttatcatgctgtgttgtcaacttgtttaatgtctgtcagtggctcatgcctgtaattcagcactttgggagcctgaggcaaaagacttactttgacagcagaggtttgcagaggttgctgggcaacatagtgagaccctgtctctacaaaaatatatttttaattggctgtgcatggtggcatgcacctgtagtcccagctgctcaggaggctgaggtgggaggagtgcttgggcccaggagtttgaggttacactgagctaagattgtgctactgcactccagcctgggtgatggagccagaccctgtctctattaaaaattaggaaaagaaatagcctgtctactctattggtccataacctctatcgagacagtgaccttgtctgctttattcaatgcctggatcttttcctagcacagtgcccagcacatggagacactgaatttggattctcctttttgaagtccccatatccacttcagtattggggtgattttgatgggattgtgacttaccatggtggatgcatcctgtgagttccaaactcaacttcttaaaaaaccttgtctatcatctatccatctatctgtctgtctgtctatctatctatctatctatctatctatctatctatctatctatcatctgtctgtattctatgttccatctatcatctatctgtcatatatctatctctatctattaattatctctatctttatctatttatatctatcatctatctgccatatatctatctctatctcttaattgtctctatctttatctatttatatctatcatctatctatatctatcatcttttaacctatctgtttctattggaataagagacaagtgcttgaaaagcagaggagagtcaatacacaggccacatcttctctcactccctccttcctcctcatagctgtgagccaccccagtccctgtacctgcttccttggctggcatcatctaagaaatcatctcttccacagtttcctgcaagggcatcaccccaagggaagctgaacacatgcaacatctgcccactcaggataagtgtgagggataaggaggaaacatttttcctctagagacaggactgttggggcaagggctggggaagcaagacatggatactccaggctacttcttgctggggctgaggggagtgctcggtgtggctcccctctgggacgtgtttagggcagctctctcgcctctgaaacaagcctcatcagatcatccccaggcttccttccgcatagtttctgatgatataggaaaggagcccgattatctgtttgagcttcctgttctttgtattgtttggaaggctaaagtcaacagccacttttgtattctgcattgtttgcgttgttaaaaactctggaaaactcatctggtttcttctccaaaagtagcttcccagagccctgggagacactcagaaataagatccttttcaaataggccagcagggaccagggtctctcagaaccagctttcctatcttcttccaaaggccggaattgagaaggtttactccagcccacataattgagtctctgggctgtcaaggacgcattggggagtttgcttctggtgtgctgggtgcttagaaagccgtatgaattgcagagatagagttgggttccagttctgccagtcaccaattatgtggccttaagcagtttacttaacttttctgagcctcaattttctcttctctaaaatagagttgtaatatacctatggcttagagttgtgtaaggactgacgcgatcacagacttgaaacccttgatagaacgactggcatggagtaagcattcaacagtcataattaaggtcattgtgatgattacacttggggcctctccattcaccatttgccccaactgtgttcctgctgcacttgaaaatgattccagctgcctctggaagattttcatcccatttctgggaaaaacattagccaataaactctcattgaatttggcagggcgggcacaccagcaagctgacactatgtgcatacaggcttcctggaacaactgttgctgagcaaatgaagcagcatggaatgttccgggaagcaggattattgctgtagctggtgaaagtgaactgggaaacgcactccaggtcctgtctttacttgcacaattacagtcaatccccaaggctgcttgtctcagcaggatcagcctcttcctgccttctgtcctggcagtgggtggtggggctggaggaagaaatggtgttttcctccctctcccattgcaattgtttccttacagtgctgttctctgaggccagagaacagaagggctctttccagaggcagtttaacagagtagcttccttttcattctgagaagtttggagtttcccagagtccacttcctccctagaagcgcaagcttggaatttcttggttgccaatgaggtgccagcttctgagtgcataaagtgtgtccatcgtttttaatcaattctctcatctccaaaaatacctttaattgcctttagctgcttagttctgctgtcctctaaagaaaacaagatctggccactcccagccacacctcagaagtgagtaaggcttttgcaccttttaataggagtatttacatgtgtgtcggtttctcatctgcttttaatttcattagagtgtgattttggactgttgtttgagatgaaagagcagattatcaaagtgcagatgattttttcatggtgcaaacacatcataaattagaaactatgagacccctttgcagcggggaagactggggccagtcatccaaggtttcatcttcctgtaggagaagggaaaaaaaacggacatttattaactatctgttatgatccagactctctactggtgctttttgtatatttattctctaactcccatcaacttctctttgagagaggcagcaaatgacaactgaataaatgaatggctgaatttcatcagagccagtttacaggcagagaaactgaggctcataaagcggacgtaacctgcctgagatgtctcagcttttatatggtggggctggaattcaattcagagctccttctcccttttaacactacactgcaagttcccattcagcttcatgggattaatcctgttcttctgtccctagaatggagccttgaaagttcaaggtgtctccttttcctaagaaactggatttttctggctccttgagaattgaggagctcaaaacaattgagaactcttgggaggcatcttcaggaaaggaggtggtggaaactttcctctcctcactctccccaggggcaatggggcctccaaggccatcaaagatcaaggtgccaggtgggggatgcctcccagcttcccattcatttttcagttgggggccactcagcagctcctcaggtgaggattgtctcagaactgaagaatggttcaaattggcccaagatgctgaaatttattgcagggatcactgggacagtgtgtagcaatttaggaggcttctctctaagggaatcagtagctgctgcatttctcttaattgaaaccactctttccctccagcttcgatggggcaggttctcatatctgcgtgctgaaaggcgtttatttggtgtattctgagagcaggatgctggtaacactttcttttgtgttttgccaattgtttctttttactggctagtccaccctgtctgacgcattcattataccataaccaccttgacaccagagtgaaatgccatttctctgcaggtaggagagagtcacacggattccttgagtgtttgtagcgtaagtgagaaagatatgtagccttcttctagaggcagagggatgggttggctgggacttagagatattcaaatccaactctgttcttgtctgataaagtaaacgaggcctctgaaggtaaagtgacttctgtaagtactcacagcttatcagtaagaagcctgatattaaaactccaggtcactagaccttcaacctaatgttcttcccactaaaccaagttaacatttattgtacaccatactaaatggcagacactggggacacaaagatgaataaggcatggtcccagtggaacccactttggttatatgggttaggacacttgaggcaggatcctccttagaatggtgttttataaagtctctctttctctttctctctctctcatctctctccaatctatcctctctatcaagagagaacacatgtaatgtagagtgagagcccatgtattggataattaggcttctggctcctaattatcaggaagcctggaggtcttgagtggttgtaaccaaggatactgaaagtggttgaccagttaataaagaattaagttagagtaagaggcactttacttttaagctgcctttaatacactttaatctttgagatgattggctaatatctgttaagtaccaggctctttgcagagagtcaggtcctttgctaaatgatttaggtatatttcttcatctaatactcaaaaagcaccccataaggaaggcattacttttattttactgatgaagagactgaggcttaaaggttaagaaaacatagcatgcataacatcccacaagagctcaagccaggacttggacccaagtctttcttggatctttccgatccaagccatatggttactgcaatctcacaatacaatgagggtaaatccttgcaatcaccagttaccagcaattgtgaagcaatggatggcatagatgtcagggggtcaggagagccttgcaagcgttcagagggcttgggagtggacacatcacagttgcactctgctgggcagcgctgtaagtctctgattggattttgccttgaattttttctggtcaagactcagaaaggatggatgtagcttcacttacaccaattctacccagcttgtgacccaaatggaactcttatcccttaagccaggtcattcagttgttgtagcctttgccttccaagtttcccttgtctaccctactgagtctgaattctaaggacatcttcttatggactgtgggaggcaaagatgaattccaaatcttatttaatctgtgtgctgggggggaagaggagtgtatttccttttgccaggtatctgagcctacaaaaagccccataaataagtaaaatgtgtccatgagttcataaaagagtgagccttagacatacagaccacctgtcaaaagagccctgtcattctctattatattatcctcttttattttctgtgtaacactatgagtatctgaaattaccgtattcatgtattaatcatttacctgtatactatatcctcactctagaggtaagctctttgagggcacagatcgtgtctgactccccagcccccaagattgtatctggcttgtatcaaccatatcatagggaaggtgctgtgaattgacaccttgcaccatgctttatggaaactaatggtgctttaagaggcacagatttcatagaaagagacccagttgttcccaccctgatggttctaggtctaggtctaggtcaccaatgtctatggtgaaagaatgggcttttgcgaggtatggtctcctgtcatgtatgagggtcatttatttaagggaaaaccaagaccttattttctttgacaactgcacacaagggtcatttgtaatgtccttcatttccaagcctctggatctttgcatggatcatgctccttaaaagaaggaagttatgtttggcctgcttcagctaagcatggaatggtaaagattttggtccaaaccctgtgacttgagttggatttaaaagcttgtcagaaatgagttctctggagcttggcatttgagactggcatccgttgttccagatgagatttcacggattgaaagctcaggaagaggtgtgaattacaagcaattagttcacagggcagttggaactgtagtaatcctggaaaccttttggcccacattttaaaaatatccccacaatccagcttctccctctgtagggcttctgcttgggaaagtttgtgtaactccccaaaacatctgaagagtgaatagcagtagtgttcttggactgcgaaggagaccctgcttcttatgtgcatgctcttgtgcacacagacagaaacacacacatacatgcacacacacacagacatgtacacccatgttcgctttagcatctgatagaaaaagaggaacatgaggaaagacagagattgagtcaccaacatgtgacctggtgatttctgagtcctctgactttgaaatcagtggaaatttagagctctactttgtcacttgtaatgctttgttgttgcaaataaatatttttgcagctgcatcacttcattgctaatatatttgaagaaggcaagataacctaaaggcatgaatcttgttctgttttaatccacctgtaagtcagtggtggttgtaaggtaaattgtaagtaagagctattggccaccaagtgccaagggttatgaatgatttacctttttttttttttctaaactgaaggaaactcatggttgttcctagaaaaacatgcacactcacttgcttgcattcggataagcttctttgagtaacagggaagaggccactaggattacaaggcagttagtgcccattggagtgtgactggcattgtgcaccctgtgaatcatagtggtggtatggggaaaggggtaaaaaagcatcaatctatggagtatgcgaaccagatggcatctgtcctgggaagaacaaatatccttcataggagaattagaggactatactagtcaggcagaaatccagtccattcatcaagcttttcctcttgctgtggtccctacagggtcagccctgtttaggctcaagcctcttaaatcccagtgcaagaccaatttctctatgaaattctccctgtcttctttggtctcatggctacttcctgggaggaaaaagtagtaatcagctccctccccccagctaaatgtgcatggtattagcaaattctaacccaagatgttaaaactatctgagaagaggcatgattctgcttcttgtctgtaccctcctaaagtcaaggtgcagcaaggagagagacatttgcatgtggcccctgagaaagaagagatttgtctgcctcaccccctgctggtgcaaacttgcacctctctcagcctcagttttcttatatgtatcaagtttcaatgatcgcaatagtacttatctcatgtgactactgtgggattgaaacgagatagttcatgtgaagtaccgagcacagagcctggcacacagtaggtactctattagtgttaatatcactggaaaacccagctgggggctcagcagtagaagctgccagagccttagtgttacagccacatccattaccccaccattcacatacatttcatgccccagggtgagaatccacatatcccaagcagagaggcacagctttggtaaactgagtcttagctaactcatgtcagaaaccaagtgttatcctggggtttgactcctggctcttgccacattcatagcaggatgctgagtggattgtactcagcctcacttgttgcatctgtgaaatgggggtgattttttgacttctcaaggtatagcatctattaaggcacatagactacaatctgacacaaattagcagctccatacattgcagaatcttttctttttcacttaaggagatgctaaaagaggcaagaggaaagaaaatcaaatttggagatgccgtgggctgtgtgttgaagttgggctctggtggaattggtggtgaccttttgcttctctccatctggatggctgtatcttcaaagacaacaagtcttaactgcagtttttgattgtataaatctggccaagtccactatttacccagcccagtctccttagagtaggattggaaactcaaactttgctatctcctctgcagagtgagcaagggacaatctttatgaaaaactttaagttgcaagatatttgtgttcttaataatgaagggaagaatacaaaaatgataatactaagcctggctcatggatagcatttttgcacaatatatttcatttgggctgcagcctttgagctgtactaattgctctgagcatctgtttgtatgtccgttgcatgggatgatttaccctcctaggtttccaaatgctttggagcccctggtttattgcaggacttactaagtggtggccatcgtcactttgattggcccctaccacagtattttccagacttttccaccaaggctcttagggctttgtggtgggtgccagaacaattgatggggtagggtgggtgctggaagagaatgagcatctggtagattgagtctctgggtctgcccttccaccctcactccagcccccattagctcagcttgattttcaaccacttgaaatactgtggttgtgcctaagacatcatgtcagggagagaaagaaacatctgaaaaccatcaatcttctctctgaatgcttccactggtcccatttgcctgttgacaacccaagttgaaaaggcagcaccagaggggaatggggaaaattagcagaactggaaaatctgagttgagatctgggtttaccaaactctccgtaagactttgagtctgtgaaacttatgtccattagtttcttcaccttttaaatgggtctgtagtacctaccctctgggcctcacaggctgcttttgggtgtgaaagtgctttataattggtgaaggaaactgctacgtggcaagaatagcaaagcctgatgtactttaatccattcggttctgctgagggtggagccccaatgtgtcttaattcatatgaggtttctgagaagctttttgagattttaatactgtcccaggtatgcacatcaaccttctcacttttatcccccaagctccaaaatttcataactttttatttcatcttgggtggcaggaaggcaaggtgtgcctgggggagctacagggagttattcaaggtcacataattagcttataattaacagagtttaggctagaaccagtgcatcccactcccagatgggggcccccggcttatctcagcatgtcagcaacccatgaatcagccctgaaatatagatattacctatgagtaacagtttctcatcctacctcaactgttacgaaagtcttccctcaaactaaagctaagcagttccacaaaatgccagctatagacattagcagaaactgtatattgattaggtgatgtatcagtcattgtaactacccagaaaaaaaaatacaatgacaaaaccaagtggcccaaccttattttctacttgcaagaggaaaaaccctatttgggccccaagatgcttttttcatttcatttaccacatcctgggtttgtgctagtcaatctgctaaatcaataagatccgaaaaagcagaaaacaaagatcgtgaggccagaggatttcctgatcaccatggcaacacacaggggtgggtactgtggtttctctgcctgaagacgcactcgtcaaagactacttggtgttacagaattctggtgcagtgaagcaacagttctgggacatatactttcttttgccagaaagactctgttggatccaggaccaggagtggggggttaaacagttctccataccctcacctccaagtccccatcatcccattaggagacagggacagtactgttctccaaactctcaaaacaacccaagagctttctaggctgtgcattgggttgatcatttggtggccttggctgaagggccagggtaacagctaggagaacccttgggattcttctccaatgtgacaggcccctccatgttggttcagcgttgactgccatgacaggctccaggctccacggaaaaaaggcagagaaatcagggggtccagccaggcgccaagacgttggggtgccttgcatttctaagtgccaagtgatgaatagctcagttgaaagcaacccagggcacattctggaggaaattctctgggtatgattgtgcatgactgttttctctgctcattaaaccctcatctgcctccagggcaattccgggagagactgagtcactcaagactcatggtctgcactgggcagccaaaggcgattcggccaccaagtgtgattctggcctcattcagaagtggatgctaaacaatacaccctttcaccaggagcccatcacatgggcatcaggagatgggggcgagtgatgtgccagccttctagactggcaggcctggggggcagcagagggcacaatagctagaaagactcccagatgaaaacttctgggctttgaagccttcgaacaaatgaagaagaaaatgacttcttcgtgtcctattaagacagtgagttgtggcttttttgagagcagcttgctcagacctcttatgaaagatagatcagtagcaacagcactggtgtaggagtcagaaatctgcaattatgaaccactgagttttgtgtgtgtgtgtgtgtgtttttgtttttgttttttgtttgttttgttttgttttttaacttgctggaggaccatactcggctatccttgattttattttctcctgtgtcacaagagaaattggttagaagcttcccattgtgcctcctggctttaaaaatagataatccaattaacaataatgctttaaaacaacaaaaccttgtccttttcccttcctacttctgatcagaaccagctcagtaagatttattagttgtgcaatctgttttggacatgagctcagcaaatcagaggacagaaatagaatcctggctttttaatgataaacactgtaaaaataaaaaatttggagagcttaccagtgcttctggctgcccaagtggtttgtgtgtggttgactcccaggagctcaatcactttgggtgcagtccacccagagagctatgttccagctacatcaacctggagccttagcttggtcagtctagatttttgggtttggctgcagacatctcgtaatgtcacaaggacagcctgtgtccttggtgacccaaccctgggccaaccccaagtcctggagtcctctcctaagagccctgcctaattgtagagagagcattcaggctgtaaagggcaggaggcctgggggctacgactaggtttgggctttctaaattcccaagagtatgatgggaagaccaacaggcagaatcagagagaagcagtcagcccactgctggggaaagccagtcaaggtcaagacttcagaatctcctctctggagagagagtgaaaattccattagtgaagtttgttccactgaagccttaccaggccttggtaaaggcccctatcttgtggtccagaatcaagggacttctgatcttaaaataatattcaataagctcaaattcttctctctagggctctcttttcatgatcacctctccacactttattaaaaaatcacatgaagggtaagtgggcttcctgtcatttcagtgtctgacctgtgcataagttggaatttaacactggaaaatgatcagccagattgcccagtctgaaacccaggtcccccagtgactagcacaagttacttacatcttctcaatgaatcagttacctcttgtgtaaaatggggataataaaaatgcctgccacacaggattgttaggaaaattaagtgaaatattaggtgtaaagtgctgaataccttgaacccagactaggcactcagtgagtgctcactgtggttatggaccaggagctgcaggaattagaacaccattgagtagcaggaactggctttattctcatcttcatgataaagcaacttctccttacatatagcttaatctggaaccaaaaatctaattctgcctcatccctcctgaggagatgacaaatagggatcaggcacacctgggtggctcaagttagaaaacaaattaactcattttgcagaatctggagacgtctggtctggagaactgacagtgccctctctttgggcatagtatgactgtaggttgtctttgggtggtcttcatatggaatgtactgtgtttgccatgttccctaggagatctggcctcagaaatggccctgtgatggtatgtgaacatactgtcctgtaactgagatgatagcttgcacattcagacagacaaagccagttacaaaactaaaagttggtctctgaaacatttgctttcggggaaaacagcaaatgttcacagaagcaaagttctgggttaaagacattttaagtatccaataaggaattctcagcaaacaccagctggtgattcctcagatatgatgtgggaaaggaacctgataggtgatctttttgcaccctataagactgcagcctgtcgggggttgggggcagaaagagagcatttattaattcattatttcattcaacatttgcctaccatgggaggctgtactaggtactgggaatataattgtgaagaagggagacaccatttctgttgtcaacgaagcccacagagaagttccaaaatttcagaatgctggaatttctggttactagagaccttgaagataataatttcttgtaattctttacctggttgtgtcacagactttgaaaaccaatgaaaaccagagatgttgccctacctaaacacacacacacacacacacacacacacatccatacacacaatcttgcatataatctcacaggtccatggatgtattgaccagctcctggattccatattgaaaatcccttgcagcccagctccaatactagtaccaggccactcacctctcaggaaagtttgggaagacgtagataatggcaacttgggtgaaaattacacagtgctctcttcccagcacatgttgtgattttctacaacttcagaaataactggggtggaccaagaagctattattcctcgcaggccctacaatctaggcaaagctttgaaatgtgctcggacaattttatcagagatctattttccttgatctgaggcttagggggcagtatagatgagattaatggcatttgggatcagtgatggtttatccaggagagaatgcatagtacctgtaaccaggagcctgaataggaggcaacatagcatagaggttagaatcctgactttcccacttggatgacattgggcaaaggacttcaccactttgtgcctcagtttcctcatctctaaaatgggtttagcaatagtgcctacctcatagcatttttatgagaattaaattagctgaagtacataaggcacctaataagtgtgcaatgctcattggctctgattattaagtgtcaaacaccatatcaagtgtttgacataccttatttcatgtaatagtcccataaaccctgacaggttcgcattgtcatcccatcaaggaagaggtggagagtcagagaggttaagtaattaacaacctgtgtcacctaaagtgagtggcagggtcaggaattgaaccaggtttgaggaggtcctaactaggttgaactactgaccttcataaaagtttggcactacagaccagctttataggacaaaaaaaccttctttcagagctcctttttctcgccttcctgacagctccctagcagacctcttcccatgtgggtagggagataaggttcctagacactgggacactggtctccatgacccctctgtgctgcccacagccctatagtaatgagcgtgctaaaggcctggtggcatttctaccacgggaagtctcctctccaaatccaaaagtggcctcaaacagtcagtgttttcagttgagctcatttatcgctcagagggaggcacttgggacattttattcattacatgatgcaggagatttattggagaccagagggctcaacggaaaacattcttggtttatttccagccagaaaggcttgtttgagagatgcaatcagccatttagtattagcttcttgaatcaaagtggatcctgaatcacagagttctctgtttctcaggagagacacacagacatctgaggagtcttgcctctctatagtggtttgcagcatggctagcaccattgccagagacactggcactctgtcaagcaatgttctgtggtccatggctattcacatcttaaccttgccttaattctacttcattgtgagtttgggcatgtttctttatttcttcccctctctgtgtgttagtttctccatctggaaaatgaggatactaatattacccacctcataggaatgttttaaggataaaatgagtaaataattctaaagtgcctaaaatagagcctggcatatacacaatgaatgcacaataaatattagccactgctcttgctgttggcattattaatatcctcccgggtaataatttgggtttgcgttagtatcaaggaaacctgatgaaatgtcttcataaattatcagggtttgaatgacacacagccttgaaaatgttggctccttttaagtcaagagggacctagagtagaaggattgtgaacattcacaggatagttgaccagaaatgaagtatttgacaccattcttgcaactcctaagtagctaaatagcgtcagggttaggagttggactttctcatgagatcaagataaatgtaagctgtggaatttttactttgcataggatttcttcatccaatcagcagccctttgcagatacctacaatgtgtcagaacctgcttaagccttcacatctaggaaggctaaaggttgagtttgtctgtttcatcctgtcttggctgatcacatgcacatacaaccacacactcacttgcatacaaacatataagtatgaggagaattcaaaatgttcatggaaaaatgagattaaaagataaaagtttaaagatgtaaactttacttctcaacataagcaccatcacattcaagatactgttataagctatgatagcggccatttagtccatccctaaagaactgagggtcctgggaatttaatcacatcaatgcaatctttcttacattgttaactaaagaaaaatgggtgccctttgaagatttttaaagattaagtaacaaaaaaaaaaaagtcagaaggagtcaaatttggactataaggtggatgcctaatggcttctccatagaaattctcaaaaaaattgcctttgtttgatgagaataatgagcaggagcattgtcatgtcatgatggaggaagactctctggtgaagcttttcgatacattttttcttcaaaagcttgggctacctttctgaaaacactctcataattagcagatgttatcgttctttgaccttccagaaagttaacaaacaaaatgccttgagcatctcagacaacggctgccatgaccttggctctacactggtccacctgctttgacttgtccacttttgctttgactggaccacttccacctcttggtagctattcctttgattgtgctttgtcttcaggatcacacacataaggccatgtttcatctcctgttataattctcaaagaaatgcttcaggatcttgatcccacttgtttaaaatttccattgaaagctcagctcttggttgcagctgatctgggcacaatggttttggcaaccactgagtggaaagtttgctcaactttaatttttcagtcagatttgtgtaagctgaaccagttgagatgtctatgatgctggccattgtttctgctgttaatcattggtcctcttcatttaagtcacaaataagattaatttttttctcccaaattgatgtggatggcatatcgctgcaggcttcatcttcaacatcatcttgtcccttcttcaaacaagttatctgtttgtaagctgctgatttctttgggacattgtcctgatgaacttttcataaagcatcaatgattttttcattcttccacctaagcttcaccaaaaattttggtgtgtgttcttgcttcaattttagcagaattcatgttgctctgagagaggatcttttcaaacatgtcttatccttgttagtgcctcaaactagatcctgttcagatatatcaagttagtgagagtttattttggtgcaaaaaaaaaaatttgaaatctatgtatagttttttcatagcacgtatttttcatggaacttttggaagacccgtcatatagacacactcacacaatggatgcatgtattgtcagtgaagttatgttggcttctgaaactcaagggattttgctgaaactcatgaaactcaagggattttactgaaaagtctcagcctcaattggttcctcttacatttgcatattctgtctgccaggtggcaaggtagaattgactgtaataagaaagaaactaccattgagctccaattattgtccatgcctcagagttgatttttaacctgagagtgacagcagccacctgggccaggggcagacaggtagtttgcctcacctggaatcagaggctcccctatcagccttatcttcaagaagctgataggaatgctttgtttttcttttgtgtgctggacaaggagaggccccggaaggtctgtcatgtagattgacagtttccttttgtaagactggccaactgaggccaaagttgaaaatgtcagtaaaaacaaatagtattgcaaaagggccttatgcatttccttctctatcctctcattgccccatcagccgagtgctgcatgagtggcttaagagaacaccattaggcttgaaaaagagtgaactgcaaaaacacattttctccatttcacctagttgttattttccccccatgtgctaatgatgcaaacaaaagaaaataaaaataatagacattggcttatgtcttttcaagttccatttcttgtttcttcttttactattttcagaatcaaggaagataatacagaattttaacagttttcttacctcattttgcatttgttagacattgtttcctcgtggttgagacctgcttcctgctcaggaaagagaaagcagtggttgcccatacaattcaataataatgactctttgtcattatttaacagttgtttaggtgtgcctctctcctttcttcagttgcactaatgatagaaaaggatccttgggcacatagtaaagtggttcaaatcatgggtttgggtggtaaacaggtctgagatagatttcctgctctgccacttaagagctgggtgacgttggggagtcatttaatttttctgagcttcacccataaataatacatacatacataaaactcacctttcaggtttctgaagatgatgcaacacagaatctcaaaggtactgggtacccagggacactgcagtaataggtcccctctcctattgctgtcagctcagaaatacagaacagagcaactgggattcagaaaggagactataggctctagatagaggtactcactcacttccttgggcaactcacttccctgagcctcaactttcttgttggtaaataagtggaatcttcctacccaccactagaactgtgcaaggaagagatggagctggttaatgccagttctgtctgattccagacctggttcttaactaacaacaaggagtggtgcctggccaggcacttggggcattgtcccaagaggatgtcaacatgtcttcttagagaaggacagtcattgaggcctgaggaagtgttcaggaggaataagcttcaccaggatagtttcaatgacttaaccctttgcatgcagtttcctcaagtgtaaaccgggggtcatatagtcccaggagttttcaattacagcctttgaagtcttttgagattgttacacaggatcaagtagaagaggatgatttctagctctctattggaatttcagattaatgtctacaaaactcactaaagtccttgtattgaataattctttacccaactgatagcagttaggcttcattttcaatgccattaactctgagagcaaacgacaggcttttggtctgccaatatattaaaagtgtgtttctgaggaaatttcaatgagtcattcgtttatataacaaatacttgttgagcatctactttctattgggtactgttatagggattagagataacagctgcaagcaagtaaaaggcccttgctttctcagagctttcattccaggaaggagagaaagagagtaaccacacacatcaatagatgaccaggctgttgtgaagacacaaaagccaaatgagttgagggagagactgggggttagacaagggtgtttagggaagcactctaaagtgaggtgacgtggagttaaaattctgaatgataaaaaaaatgaaccacctatgtgaccatttgaggatggaacattccagacagagaggaaggcagatacaaatattctaggatgggaaggagctcagaatgtctgagagaattgaagacaagctttgtgcttagagcagagcaagctactttgaggttagagagggagccaggagccagattatgttggttttagccataataagaacatttatactgggtatgaacataaactcttggaggttgtaagccagggagagatcacttgattgtgaaaaaatgctcataacataagattaagtggaaaaatgactcttaaatctagaactgtatattcagtaccatttcaattatgcaagcatatgtgtgagtatgtatatttgtgtgtatgtgtgtatgtgtatatagatacatactttatgtatatatgcataaagtacgtgtgtgcatgtgtgcacgtgtgaatgtgtgtattcagtaaacaaactggaagaagatatagaaaagtgtttgctgtagtttttgtagtggtggacttattttccttcattgctttcctgtgttttgtaagttttctgtaagtttgtatgacatcaataatcaaaattaaatcatttgctttttaaaaactttgttgcagagcaatcaatggagagaatgtaagagtgatattattttaccatgtcttttctcagatttgagcttaatatcatggtgctttggaatgctggagtgaattttgaaggctctggctagcagagaagtttatttggctttttgtttgtttgttctttttttttttttttttttgagatagagtctcgctctgtcacccaggctggagtgtagtggcatgatctcggctcactgtaacctctgcctcctggttcaagtgattcttctgcctcagcctcccaagtagctgggactacaggcatgtgccaccacacctgactaatttttgtatttttttttttttttttttttgaaacggagtcttgctctgtcgcccaggctggagtgcagtggcgcgatctcagctcactgtaagctccgcctcccaggttcatgccattctcctgcctcagcctccggagcagctgggactacaggcgcccgccaccacgcccagctaattttttatatttttagtagagacggggtttcaccgtgttagccaggatggtctcgatctcctgaccttgtgatccgcccgcctcggcctcccaaagtgctgggattacaggcttgagccaccgcgcccggcctaatttttgtatttttagtagagacggggtttcgccatgttaaccaggctggtcttgagctcctgacctcaggtgatccacccacctcggcctcccaaagtgctgggattgtaggcatgagccaccgcgcccggccttatttgactttttaaggagtctgtcctaaactgaacttattactgtctccaaattatttatgcaaaagaatctaacatttctatttcttcccatagatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtaagagaccagcacccgaccactggggaaagctggcggcctgggaccaggcagctgggcttagaactggaaggctcctttcccacagctgaatggattattgcctaaggagtcaaccccacgtattaatttggccaagtcaatctgcaacctgtatgacaactggagtttaaagtcagctaaagacacctttgtgaatcatagagcgggaacccagaggaagccattaggggtcctctcggctggaatcctcttgtctaacctgcttccacagagctctcctggctttgaagaagctgcagtatcattgtcagaaccacaagaaaacataaaccaaataacagtgtttgaaataaatatgtggctgttagagtcttggccctgcagacttggatcaaagcagacttttcaaactactctctcttactctctcttaaaaaaaattttttttggtttctcttctatgtttctctggtttgaaaaagtaaataaaaaggcatgaaagttattaagctatattatattaagatatattatttttgggagccctgagagggctcctaccagttattctagagctgcatagagccttcctcaaactatggctccaagcaagataatcacaacaagcaaggactttattttttgaatttccaatggccttgcggtaagcggtgcacaagaagagcaagccacggtggcaatcacagtgaattgttgtggttcgatttgttttcactagaagaggactgagtaacctctgcaactgctctgaagtttctaccccagcctgtagctgtgcttttgcagtgtctttaggtaatatgattcccctttctctgcaacacacactcacatgcacacagactgcttttgaaaagtcaagctgcagaactctacggaaaccatgaagtgtaagttaagtgcttctatcctccaacactgggtacagtcatgcacccacattatgagtgatggctgagactcttgctgaaagggaaaaggaaagtcttttgcctaaaattgccctgtctgatatggtagccactaaccacatgtggtgacttacacttaaactaattaaaatactaaaattaaaactttagttcttcactagcactaactacattttaagtgctcggttagtcaccgatggccagtggctactgtactggatgacccaggttagagaacatttccatcattgcagaaagttctattgaggagcactgctctaaaataaagagcagatgtacatagacatctgtatgtgttcagagctaggtctgggggaatatgaaaggagcagagagagggagaaagctctggtggctactgaacttgcactgtaggatgcaatgaaaaaaggccatttagcaaatccattattctattcccaaggctaattgtttaattatggccctgactaggccactggcctaagaaagtgaatttagtaagctgaactttgattgtgaaatacaaacaaggcatacttgcaaaatatagatatgctgccatgtgctgaggaccaggggagttcttacaactgccactggccaatcatcaagcacttagatgctgggagccctactgcccacctggccaaacccctcacttaatcctcaaactgcagtattggtcaatattatcacctcattttatggatgaagcagccgaggcttagcgaatttgcacacacagcctgcctatggaggagttaggattctggttctgcttagcctcagcccaggacaggattttaatgaccaagtcctcctcaggggcttaaaaggggaggaaagtatgcttcctggatttgctgaatattctttcctccttgtgaacagtaacttactcatgccacatacacacatataaactttaatatccccaatttacagttagcatgacccataaaaccggtaggcaacatgaggtggcaaaaactcagtaatagcttacaaagagaatgcaatagattctagaatgttggtgttatccatacttgatgacatgatgtgatgggggtgagttggtgggtaggttcaccaagaagtattatttagaaaaactgtgccaaagaaatctatcatttcacccataactggtattaagtattgcaaaactcatttccataatttctctcaggtagctatgaatcagctttctgccacaggacagatggcagagtctcatgggttaggataaaaccttagcagctactctcttttgtctgccccaccctgattggtagcaactcttagatatatgaaaacttattaccatttaattgtgcccacaccccctgccaagctaaggaggctttggggaaaccagtttgtctgttcagatgagaaattagtcatgcgagctacaattgccacataggtaggagttctgtgtgcttggaaacttcagactcacagacatttccatgggtcgtgcagggtgatgcactccatgctgttgcccctggcaggaaagatgaaaagcatcaatgtgcattttagccagaattgcattttgaaaaacctgctggatttagcttcctcctctctgccctcctgctgcaccacagcttcccttgcacatggcattttctcagcccacatctcattttttgaggcattttatattcaaaaaaaattgtgtttttagcacaattaaaaaataagcaagtttttagccaccaggatgctgctagaagaggctgggctgtgtatgttgtatctgtatgtcgtatccagctgtaacacactcccagagataccttggtggggagagaggggctatgcatttctctggctgtgctacttctggaaagttcctgagctacatgagccgttgctatctgcttacttaattgctatgactcccattgtaatgatggttaatttattcccactggcaatagaattatgcctgcaatgctcaggaggcagtgtgctgtgctgtgtacttggcatataaacaaggcttcatgtttagggcaatggagtatggagtaaggggactcacaggaaaagttgtggctgagaaagaagtgggggaatgggacatgaggcaggtctggaatgtgtgcactgaaataaagaagcaccccttcctatctatggaagctggccattttgtgtattttctggaaaacatgaaggtattccagagccagcatgaatcttacatcaaaacttctctcttctgtgactcaggcttccttctgtttgttcaaatagactcaacactgctgaacacaaattttaactgaaactaattattcctttcatgatttttttttaaagctctttataggtctctaaataaaatcactttgtttctatcagtcttgttgatctctttccctctctatgctgttatttttggatttcaaataactcggttgttgaaacctccgatatccctaggggtgaactgaatgaagtgttgcacggcattaaatgtcattgaatgggatattatgaaattcccatcttagccatttaggtcaatatcctgttgtttttctcttacaggtatgggttcatagaagggcacgtggtgattccccggatccaccccaactccatctgtgcagcaaacaacacaggggtgtacatcctcacatccaacacctcccagtatgacacatattgcttcaatgcttcaggttggttctcaggggggtgtctgttggcgtgaaaggctgtgggagcctggtctttggagctcagcttaagtggggattcatgtagcctccatttacataacaaatgctcactgaatatctgtacagcagagccaacattcctgtctccatggagcttacatgctaaattggggaggcaaacaataaacaaataaatattaaataccattcaggactgtccaatcttttggcttccctaggtcacattgggagaagaattgtcttgggccccacataaattacactaaaactaagagtagctgataagctaaaacacaaacaaaaatcacacaaaaaaaatctcataatgttttaagaaagtttacgggtttgtgttggaccacattcaaagtcatcctggaccacacaaggcctgtgagccgcaggttggacaagcttgccctatatgaagtctgaaagtgataaaagtgctataaaaaagaaagcaaaatacgaggctaatgagtgctagggatgcttttattttctgagaaggtggtcagggaaagtgcctcctggactgttctgagaatatcagtgctcagaagggagaatgccaaggaataaagtcagagagctaagcaagggccagctaacggggtgattcattctcagtgtgatgggaagtcattacaggttttgaataagggagtgacatgaatctaatgatagctttggggtgtaagtcaaatgtcttagctgagaggtatttattatatgagagggctggaaaaaagccttggagagtatatggtatgcctttgaccttcttaaatatcccttacccaacagttgaaagaaccagagaagaagaaacctaagttaagatgtagatgctaggacacaggccagcctttctctatgtctttgtgactttctcccaaccattaacctagaaaatcaggcttatgagccttattcaagtcctagcaaaattaaagaattctatgcatcatgaattttcagaattttttgagaaggatcaaaatataaatgtcaaatatctcgatgccaactatcaaaagtcttacctcttaaactgggccttctgttcccatggaaggtttgaagttgggtgaagggaaagatgaagccttgaggtaaacttggtacatcttgctggagtgtcagttttccctaaagatgtgaaggggatgttaaattagctggaaagggacttaagacattatcagcctgagacaaacacagatatatacatatacatatatatatatttatatatatatttatttatatatatttataaatatttatttatatttatatatttatattcatttatataaatttatatttatatatttatatttatttatataaatttatatataaattatatttatatatttaaatatatattataaatatataaaaattatatttatatataaatttatatatatatattatatataattctatatataatataatatataatatatattatatattatattatatataaattatatataatatatataaattttatatatataaatattatatattatatataaatttatatttatatatatgtatatatgtatatataaatatatacacatttatatatataaaatcaagatatcacagatatatataccatatacatcaaatataaatatacatataccatatatatggtagtaaaatataaaaagctgcatggatttttaaactataaaaaggacatcaacttaattatgagatctttcttctactcactactaaaaaaaacccaaaaattaaaattaattgtgagattacatcagtggctttagtctacaccacctaccctttgttgtgtgaacagtagggatcagagtggaaattcagagaagaaatctagagtttaggacaaagtatcagggctggctagttgaaatggagtgcgtgaagccagtagattttgacaaaaatttacaggtcactgaatctatcgagagacatacgaaacaggaacagaaaactgtagaatgtttactcctccctgttatatgagtgaagaacacaaatggagtttgactaaagggaagggagtccaattaacactaagtagtacacgactcatacatactcagttcccatacccatgtctagcatgtcgttctaatgatattataatgagaaaaccacatataaaaaagtaagaaatagacatagagcaacatgtggtctagctagctccatctcagtgcaacaggtcagagggagacattgggaaaagcttgtgctttagatgaagaggttgactcattgggaaagggctggcatgaggctatacactcctgagtctctgggcactgcttattgcatctcccattgagtcttgctgagtgaatgtatgcaataaattatgtagttgcatacccacattgtcttacctgttttgcaagttggtttcacttgctaaaaggaacctcaactcagatagaagctcacactgttttattgcctggcatcgaagccatctaggcaggctgcgactgagacttgtttctatccttaattttgttcatgaggttgggcccatacctggagttgggagcaagagcattgattaattttcttctctttggagggttagttcagttgaaaagcttgagaagtacagggggtatgttccttactaaaatggatgaattaaataataaagctagaagtaatatttttccttttgtctattttccaaattgactcgatattgatggctacttttgtaagtttttatttaagtttaaagggaatatttattgatcacctctatgtgctcagtactgcactaggcagagatggagtaagaaagaactggaggctacatttcttgtcttaaaggagttaacaatcttgttgaagcaatgagacaaaaaaaaaaaaagaaagaaactggagaagaggataaatgtgtttaaggataaataaattctgaatgtcttggattagagtcagatgataggggtattaagtgagctaaagattttgataaactgccctatgcaaagatttcattgcaaggatccctgaatctaatttagcctgaaagctgctagcaggtggtcatgtcccagtgctgtgatcccccccataaaacggctacagggataaaagtcagcttgatcttagtagatagcttccataagcttaagttttagcagtatttttagaaaacatggcctgtggctaacaaatgaaaataaggcagaacttgaaaaggcctttgtgattttttttccctcattttcagtggttgaggcccaacgtgagcctggtgacttctgtgtgaacacagaactgacttgaattgattcatttattaagcttgctttcagtcaagtgcctcattttcttttgagggtagaattaaagggaagattctacatgtacttgtttatccatttcctcctttattcaacaactatttgagaatatttatgagatacctaaaatgtatcaagcattgaagagggtgcctttctatctggcaaccagagattagtggttagactgaataattaatgtttctcttggttattttggtgtgttgaagccaaggtttatgagaaagcccacctcagagaatttctaacaagtcctcagattcaggaacacctcaccaggtctagctttccaagcagtacagagctcattaaatggaaagaaaggctatctaataaggccctggaatccgacatgagagcatgagtctgttaattgcacatttgggtcaatccactaagcatatttgccagatttgatgttctttataaaagttaaggtgaattggagcatgaagggggtccatgtgaacaaatgctctaataatttacaaaactgtcttagggtttgtgacatcatgctccattctattacaacttgctgcctggaaattcccagtgtactgttacttgcagttatatttgaagttaggggagattgtttcatccctggcatcaagaagccataatccaaagcctggttccaggtatgcacaacatacaaatatcagaagcatctcataggttgcgtcagtttctgctgatatttccaagagaaacaagatagatactcccctaaatctcccaggttggctatatgcccttattttcaagtgtaataattttggaaaatatttttgaaaactgtaaaaagctaaattaatattaattattacagtcccccatgaccttgtgagtttatcagaagcagggacagaaacatgctcatcttcttttctccttttatatggtctggcatataagtgttgagtagatgcttaaaaataataaatgaagagttatatctgtaacttcctttaattatttcttatggcattaccatttaaggataatctaaatgcgtgacctgtacatatttggagatgcatttagggggctaacatcttaggtgtgtttactggaagaatagacccttgggaaattatatcggtacttttttcttttttcatccattcaacacatttttattgcatgtttctctgtccccatcacacataaatgttctggccaagacagataaagttattactcatctgtggagcttatacatttctagggagggaggcaggtagcagaaggcagagattgagagaagtgccatgaacagccatcaagtaagatgaacaagataagtttatatggtggtaaacatgaagaagaaatgagagcaagatgctatgtgatggtgacaggtgtgggggagtgatgaagcagtttagattggatggtaaggaatggcctcgccaaggaggtgatacttctctttaaagaaatctgagaaatcttttaggacaggctttgcaagaatggtgtttcctaaaactttctgtttttttccaattgaatgtataaaactgccagttagttccactaactgcccaaagaaatgggcaggttaaggttatcctttttatctgtgggaaaagatgctcccaggtactaggaagcaaacaaaacctgttttgttcaacttgtgtttctatccacttttataagtacacaaaaattatagcaggacacttaaaatacttgtgataacagcctttcttgtgatagcagtctgtctgtctgcctgcctgtcttcctccctccctctctccatccatctatccatccatctccatccatccatctccttcttcctctttgccaggagcaattctgggagaaactaacctaacaaataaatttccattttaatttaagtatgcacacacacacagaataaaagctgtaatgcacaaatggacttaacctttctataaaggcaaaaccagtttaaagctctctgaggttttagagctcaatacaaggtatagtcacagaataaagcactttggcatgaatagaaggttgcttcagctacactgcagtctgcttttaagacacaaggaatggaatgcagggtggaagtttcagggcctgttatcagaccgcttgagacagtgctgctcagagggctaccagtaacatctgtggatgatcagtcaggcccaagattcaggcagaaatctttattcctaaagcaagggatgaaagagtagaggataaaacgagaacaagagaaaaaaaaaaccagaaatgcccatgatgagatatgccaaaacagtaaccttgaaaaatattctgggcacctaggccaaaggtggtcaacctcagaagcaacatgctgagaagcagtctatacagagtaagcacctaaaagatcagctaaattaataaatacattattacattaatgaaagactagagattcatttggtttttaatatttcaactgagtaaattctttgttgtgattatgttattttaaccttcagattgtcatgctgttcatgttgataaacatttgattgtgtgtctgccatgttttctcatcatttctgtggacttcccagattataaatgattttctcatgatagttcatactttacttttaaatttttttacaatgttcctgcattacttttgtaatcacaaattttaaaaatcctccctaatgtgtttgcattagagaaggagccgtgtctatcttatttaaaattgtacccccaggcttccacagtgcctgatatagaatgtatatttattaatgaatgaattcactgtggtgggaaaatttccggaaacttcataagttccagaaatttatgaaatcaggtaaaaacggaaaatccatcaggaaaggcagagaaattcctagccaacttaggagtttcggaaaaagaaagttatttggaataagttatagtaaaactccattctaactgactaataaaaatgagggtagattttcctcatgtttttaaagggttctcatcctttttttcctacctcatagctccacctgaagaagattgtacatcagtcacagacctgcccaatgcctttgatggaccaattaccataagtatgtctctcttctaatcttaattaaattttcctattttggggaaagggctcaggtgtgttctctgtggtatatttgaatagaatattaggccaggtgtggtggctcactcctgtaatcccagcactttgggaggctgaggtgggtggatcacttgaggtcagaagtttgagaccagcctgaacaatatggcgaaaccttatctctactaaaaatacaaaaaattagctgggcatagtggcaggtgcctgtaatcccagctgctcaggaggctgaggcaggagaattgcttgaacccaggaggcagaggttgtaatgagctgagatcgtgccactgcactccagcctgggcaacagagtgagactccatttccaaaaaaaaagaaaaaaaaatattagtcatttccctaagactaagtaaggacagttggctttaattcagtgtcccttcctttttttctgcaatgacttgaaactgctctctggtttacactcatgcatcgttcctcaaacttcagtcatttgaaaaccactttcacattttttttggcatctctatatgtacaatgctctcatttacttgatatttttatttaaatgatccactgttttctaattaaaatacacttatttttaaaaagaaattgcacatggaaaaccaacatcacatcgtaaatagaaggcaaccttaataataaacttaaatgtaagaaaaattaaataatgttcttaatttgcagctgctgaaagctctgggtctgagtcatgttctctcttataaagagggattaataagtgtcaggtgtaggggcattttggccctaattagcaattttctgtttgatataactgaagtattgaaagataatcatgaaggatataaacttcctgatacgtgttttgacattgtttataccacatccatcttaaatcatcctgatatatgattatccacagatgtatatattcgggcactttttaaaaatagacatgggggtctcactatgttgtccaggctggtcttgaactcctgggctcaagcaatcctccttcctcagcctcccaaagtgccaggattacaggcatgagccaccatgcctggcctattccagcactttagaaatcagaaaatctcaaccagaactttcaaataggctaactgctaaccctgatcttacggcctctgagcttcatttaatgggaaacagtacagtgttgagaggtctgatttctgcttcctcacagctggatactgacagtgtgcacaggcatgatgttggcagtggcagagggatgagaatcttcgtagaccatacaaacccagccccacattgttatgtaaggaattgtccctgacctgtgccttgcaataggaaggggaggcttcacaccatgatggctacgacatgagatgtgctgtctcagcaggcctggtatgaaatcctagttccctcaccatgtgtgagattttagaggagtgactgatcctcagttttctcattcatataatggaacaacctatgagaatattcaggaaatttgtaaaagacactatgtctaatgtatgtccagcccatagtagaggtttaataaatgccctgtttctttgatgcccacagttctcttttgaagtccagacatgtaagagtgtggtcaacaatatttccttgtcaaatcctcacctgcagagattaccagggtgactgagaccttgattttttttttcatttatgtattattaatagttccacttgaggcttgccacagtggctcactcctgtaatctcagcactttgggaggctgaggcaggcagatcacctgaggtcaggagttcaagaccagcctggccaacacggtaaaaccccgtgtcaactaaaaatacaaaaattagctgggtgtggtggcatgcacctgtagtcccagctgcttgggaggctgaggcaggagagttgcttgaacccaggaggcggaggctgctgcacactgagattgcaccactgcaccccagcctgggcaacagagtgagactccatctcgaaaaaaaaaaaaagtttcatttgagcaagctaaatatgtggccaaaaagaacctttagtcccatcaatgcaatacagcagaaaataatttcatctaaatgcacacctgcatagtgagtggcccagacttgagagcagcaaatacttctagggaggaataatgaatgaatgcattcaggctttttcttctccaattcattctagtcatttgttgaaaccacagatgttgatcttcatgtatatctgtgcttgttaatttccaggttgaatttcacagagaacggcaaatgctcttctgtatttagacctgctggtttcctagccagaagtgggtgtttgcacaagtggacaaaacttgccccttaaaaaagaaaatcaaaatcttcatcattttgcagatgtatcttccctgctgaggctattagtctgctacttcaaatccttttcggaggaatatatggaattaatagcaacacattttatatgtacttcagaagggagagtagggaaacaagtgggagaatgattatttattgagcatccactgtattttgaatactgtgctgagcactttacttacaatgtatcacataatccccattttacaaatgaggaaactgaagctcagagttgccttgtccagagctctatgaagctaggattcaaacacagggatgggactctccagtacttccttgtttcctgcctcatccccagggtgtgtgggggatgggagggtgcactttcttagtgcatctgccactctctcccaccactggatagataggtgtttctcattacaaaggaaaatagctttgaagtcactatgttaaacgctaatccacatactcaaaatatgagctgtgaagttctgtaagtaccttttctctctcccagctattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtaaggagaataaatcactgtgcttcccaatagcaattccctggcaaaatgtctctgaccttcctgagcattgcacactcacgtgctgattttctcgtctctagacagctggaagctggtgatgccattcagggaggtgggctcttgtggttgtcagtaaactgcctgcattgactactactgcctaccttttttcctcatctataactgtttttcttaccttagcataagaagtgccatattggaagttttattttggggagagccctccttattctcttatccccaggtatacagtaacaattcaagcctgatatgaaaactgttttcattttttcatgtttccttcttgttcttatccacctatggataagattgttttcataaagttgggatcatagagtttgcataccactccactagcaccttttaaaaaacccacttatgcctgaggttgcaattttttgaatttttgcaatcagaccttggtgatgacaatgagcagtaggatataaataactcccacatgcttagctttccaataatggaacagtaggcatacgtgggtcaactgtggctttttatgttttaacttgatttacattcatactattgatagtgtaatattcagtgattttcaccaacgataatttactcaacaattcctttgtttttagtccaaggaagcatatctggaagagttttctggtgaaattaaatcagcttaagagctctataatccagcctgttggggaatgttctcaatacttacttggtgtgtgggggtaattcattacttagggttgcaagagtggaagtatgtaaacattgcgttccattcctttggagtttgcccctcgcgcttcagctccactggaaagtgtttacatctctcttgtctcctgtttccctctttgcttttcttctatggtttgttttgaaatgggctcccagatgggccatgttcctcctgtggaggattaatcaaactcaaatagggcatctgcctctggagcggttttcctagtatggtgtggatgttctcttttcctggctatagctcctgaggggtgaaacttgggcctccaaagagtgtggcagaaatgcgctggcttgtgaatactcaagacagggcccttctctattccttgtcacccagaagccagggaaacccccacagtactgtgatttcatttaaggtcacttgcgcaatagtgttttaaatttctgtcagtctctggctgagggcatgatacaaataggcttggggttcccatcactccctgcacattctttgaagctttttaaaaagcagagttttcaagctgcccatactttcttgggttattggccctcttgagtttgcatcggcttattgttggtagtcccgtgggcaacccttcttgagagaggcttctgcaaaccaagcgggccgtgctgctagctactcactgcttcttgggttccctgtctttttaaagtaaccatgtcgaaggtgcttatcattatggtaggcaattttgtcggatgttagcgaacacaataattagtggtctcagcaggaaggagaataggtctaccctaaagtaccacttcccaccaaagaagaaaatcctgataaaacataacttgggactatatgtagttaacattcaaaccactaatagcctatataaaatagtatttcatgtgtgttttaaaaacacacatttcattaacccctatagaatatctcttaagaactgtatcttcccttcctaagttagtcagcaaacgtattttgagaacctactacgtaccaggcctattagaatgcttgggatcgaaggataaacatagttaggaagtaatattgaagagaggcaaggattactgagatatttattcattcaatcaatatctgaggtcttctgtatgccagacactgctctaggatgctaggaattcagagttggacttaccttcatggagactacatattattggtttagaaatcagggaaaaggagtgtttatgagatttaactaaaacatagttcaggatttgagctgagaaatgaattgtgcctttctcctcccagataaattagttaagtttccttcagcagctaaaaaagaaagagactaatgagtctaccaaatgagtccagggctaacctgagagtcactgaagtactataggacccaatgggaccagtagcagctccaagtggatcacttcatgcaaagaaacataccaaggcaaacaacctggtggaaacttgaacgtagcataatggcatgccaggaaaagtcagcactgttaggttcctgagtagaatcgtatttctaaagtccagtgaggagatttgcaaaaccttatcactgttggactgagagctgggacagagtgacagggagtgattgcaaagcctccctcatgcattgcaggagggcaggggtcaagaggagtgctggctgagagcacagaagaagcggtctttggctcggctggctcattccttcctgaagggcctgtagtgggtggcaatagggacagctagtaagaataaccatctgggtagctttaggcttccagcaggctgtttatcttgagtgtcatcagcctcttcctattggtgacctggaactctctgggatcaagaaacctaaactaattcaggaagcagactcctgccttggaacactgtatttccttgtcttctgggtgtcaaaggaattctttcttttttttttttttttttttcagatctggtatggcctatttgggtggggaaaattagaaattctgctggctaggcagtagctttttccatttttccccctcataccactcctttcaggaagacaaaaataacgcctatttctatcttgttcttgtaggtttgtttcctctggtactattttttcctgttgtactattgggtgagggtggtgggaattatgcatctttaataaagtttctgaggtgagaatgtggtgtctgtggattttcccggggatgctcaggtttgtctggaggcttcatgggtaaaattggctcctatttctctactctctgttctgaactaatgtgtcctttgcagcaggggtgtccagtcttttggcttccctgggccacattggaagaagaattgtcctgggccacacataaaatacactaacactagccatagctgatgggataacaacaacaaaaaaagcttataatgttttaagaaagtttatgaatttttgttgggccacattcaaagccatcctgcatcacaggtggcccacaggctacgggttggacaagcttgatttagaggacagaacatactgtgccagctgttggcattttatatagatagagtcaaagtttttaacctagggttcatggaccttcagtaggttcaatggtagaccataaggcattctagaactatctgaaataatatgcaaaattttgagtgtgtatatgtagcatcacttttttgaggaaggaggacataacgtagattttcaaagggatatataatttaaagtggctttttaaaatctcagctggcttaaattagatatttatcctgatggtttttgccattccatttcaataagaaaacatgctggactcaagtcaaacttgagagtcgaatgagagattttaaattgcaaaatgttactgatgatattttctctaatttgagaaaagtctggaatttctctaactttggcaactctagtttttggtagaaacacatattgaattagaataaaaagtgacagaaatgatagatggatacctgaggaagttttatctgatttcgacactttgaacacattttctttgcaaagttcctgctcaagtatgaagtttgacctgaggctgatgcgtgtgggcggagctttgaaatgccagttgtcatcacaaactacctgggtacaatgctagacagatgtgaaaaatacacactagcaacccaaagataatccaaagataaatgcatgaaagcagtcgtttgaaatgctgcttcgaaaacctccagctcatggctcagtcgcccaatcaagtaaatagaaaatctctttccttcacaggttattaaattgctgcttgattttgctttgatcatgaattcaggggattcagtttgaagaatgagtagcatgaaatttatacccatgaggaatttgcatttctgatgttgtcctaagattgtgggagacattaggagtctggaaagataaaaccaggcctagattttcttttctaattatcattcaataatagatacagacatcatatataggcagaactgaaagtaaagatttgtagagggaatatcactaagtgatactttcataattgatccagttacttcaactgtgcactcaaacagccacgcaacagctcaggagcaaaataactagatatggtcctggtttggtaattcacagcctaagactcaggatctcacaacaacagcaacgacaggtaaactgctttgtcttttgcttatcagctctcctggatgtcagaccttttagtgttaggggagaggacgtccattatcacgtcaaatctccttcatcattcttagtgagaatagggtcttgtaccacttcatatatcagaaaggcctgtggatctggggatatgattgatattcttaaatgtcctgtatgttttccttttggcaatgtgtatatagaatcagaatgatttttccatcagaggaaggaaaaactatgaatcaatagttttgaatgaatgaatgaaattatgaaaaactacaaatgaatgaattgactgtgtgattcaatgagaaaatgtcctttagaaagaagtctgccggaaagtgcaggcttctcctttctgctgatctgattctcacagccagtaataagagaaggaaatgcagatttctctcatcaaagtgtaggccctgaacccttctttggacacttaaaatctcaactgtaaagtgtaggaaatgacctgttgctccatatcagaatctaggcctctaaccagctccctgggtgtgtggctcttagctctatatccctgcaaagtgtattgttacaggagctttggggaaaaacgattcaaggcctgtaaatatgggagattacaaggacaccctcatttattaactttcattgatggagttaatggccatatttcaaaataactaggcattctttctgcagagggggataataaacatggaaaaattattctttacatttgtttgccttatatgacattggataaattatattctttacttctataaataatcgtgaggaaaatagtgctcatgttatgttatggttgccatatcacaatgtctaagatcatgcaggggtggggaggggggatacagagattgcagaataaagacaatgctatttttaaatgttgacaatgtttatcttcataggacaaagaatgtgaaggaaaaggtctttttggcagtgtttcatcttcttggttcatttttgggctttcttgatagctgaaaaaaaaatctaactcaccttactattttgtttggggatgatggtttcagcctctctgcttgaacttgttctcagttttttgtctactgttagctcatattcttccaatgcacatttttgggcattattggttatagaaatggcagtctttggagatttttaaatcaagactcttgcttctggtcttattagcaagatcattggggtcacttcatctctgtctgtctttcctgattgattatcctattttcaaagaatgagactcaaaatgtcctgttctgctttgcaaaatatagtttcacataagaaattaccttgggcaaggttgtgagaggatttggaatctaaatggagaaaagtgtagaggcatatttttcaatcttctacttctatgtcattttccctgtgtgttggattgctaagattatgtatctattgctggcagaaatatcatatcctaaattcttggagaatgatattggttgcccaagattgtatagaagattaaggagctaggactctgaagagctgggttttagaatcataaactctcaggtttggaaaggatgttaaatggtctggttcaatcaacacttctaataatttaatctcttacacaactttcttgccaagtgatcttcctgactatgggaaacataatactttatgaagaagttcattgttggatagttcagattattggttttttaaatccaacatttggaagaacattcctcttcctgaaattttcaccacagatcctaatttggcctcatggatccagaggcaaaaaagtttaatccctcttttacattatatagactttcaaaattcaaagacggctgtcatgcgttcctggagccctcactcttgctaattaggcttctgacttcagacaggtcagaagctctgtccagcaaaatttttaaatctttaatataaggagcatgaaccagatgacatttaagatccttccctctctgacattctataaacttcagtttgagtctctgaaaaaaatggaacttttttgctttttccctttcttttcaccatctatatcaaatatagatgattctcttgagtagtaaaagagtacaagcatattcaatgctatttcttaggaaccgttaattaatctttcaacaatcaattcaatcatgattacaacagctttgatgagcactagtgctacagcaactgagacagcaaccaagaggcaagaaacctgggattggttttcatggttgtttctaccatcagagtcaaagaatcatcttcacacaacaacacaaatggctggtaatgagttattattatctcatagcgtatgttttcttgacagccttgaataattttgattgacctctgggatgttattaaagcctaacgttccttctattctcacaaattttcgttatgacttcagaaggatcattaactctggtatctgtttgtttgcttgtatggcaccaataagcagatttcttctttctaatctatggattagtatagaccaggagaaggctaatacagagactatgaaacgggaataagtttttttaacgatatggcaaaattgtgactctgaaagatcattcatgtatattctaaaattaccacagtcataaaaagtcttggactttcatgaggaaatagcatagctagatatgaaaaaatatagaaaatcttcatcaatggaactattcttggggtagacactaatcatatgaaaagacaaatgctcattccctaagatagcctgaatctcatttaaaatgtagaaaacccctttttagtaaagagacatcttctacagtaaccactgagaagaagtggaagtttttcatctcctttttttattcaaaaagaaaaagaatttctcaatttctgaaccacagttcactttagttaacccctttgattgcctaataatgccaaaaatgatttctctgttaattggcttcacatttttgctctatgctgaagtagtattgggaactgcagtgtagcttccatctctgtttggaggtacactgatctgatctgatactagagaagataaaaaatgaattagcaaattgtgaacacaatgaaatgactgacgtaggtgtagattccaacatttttctgaaggtgtcttgaccaaaaaaaaaaaaaaaaaaggcacgtgtgaaacctttccattctgttcttgatggcttggctttaatggcatatggttaatgagttaataataaacatatctgaaagtgtgggggagttttcattagcctttaaaaacttatatggtgagattatgtccacacttattctttcagctttcttaaagagaatattcagttttaaagatcatagccacttgttttgagatttatgtattagcttcggagatcagaacataagaatttggggtatgcaagtcaactccctcactttcttttaaaaatcctgggaaatccattataccttctgtgcctgattttcttcctttgcaagtgggttgcttggcgtccagctcagccactaatgcaagtcaccacaacaggtacgtcttcaaataccatctcagcaggctgggagccaaatgaagaaaatgaagatgaaagagacagacacctcagtttttctggatcaggcattgatgatgatgaagattttatctccagcaccagtaagaataatcaattacagtacagccatttatgcaaggcttattgattaatctgagtgataccaaattgtatctctcttgagaagtagttaatgtgaaaaatgggtgaacctatgatcataccttagttatatcttgatgagattatggaagaagaaatagaatgttttgagaagtggggaaaatatctcacaaaatttctcttgtctcatgttcttcctgttttatttatctatgggatctactgctacagattgtctttgaatgatcaggctttatcagagaatgacattaaaacagtacaaaaaatgtacattgtgtacttactgtgctaggtgctggaaacacgaagatgaaaagagccagagcctttgcttttcagaagctcatggtctgttggagcaatagacttgaagaatgtgatgaggagggtattaattaaaagttgtaggccaggcgtggtggctcacacctgtaatcccagcaccctgggaggccgaggcgggcagatgacgaggtcaggagatcgagaccatcctggctaacacagtgaaaccccatctctactaaaaaatacaaaaaattaaccaggcgtagtggcgggtgcctgtagtcctagctattcgggaggctgaggcaggagaatggtgtgaacccaggaggagatcgcgccactgcactccagcactctaacctgggtgacagagccagactccatctcaaaaaaaaaaaaaaaaagttgtggaagttcctaaattgaaggccctaaaggcttaaatgatgggagctagaactcaagaattatcttagttaatcaaagcccagctgaggtcaaaggaacaaatccagagttttaacaaatgagctggacaccaatatagcagaaagaccttgaagggaagggcaaatgtcaggttagctttagcaagacattgccacttattaaaagcaaataatgaaaccactattggtacataatagtatccaaatttttgacaattataaaactttttgagaacaaagagatggaaattgagctttaaagatatccttaaaaagttaaaaacatgcaaaggttggtctaatattctgccagattactgagttttccacacatacctgtaatgacttaagattttgctgaacagagctgagaatcctgaacctgactccatcacagttctgcttttccttagaaaaaaggcttttggggtgctgtgtgagctctcccaattcactgaagttctatccattccattaaaatctgagaatttcatcctcaaatggacagagaagaaagggtccagaaaaaaaaatagcttaggccttgaaggcatctgagtatataacattgatatgacaaatactcaaaaggaactagaattttctatctaaacttttaagtgattttttttttagacccgacacccctccagagcttaatctatggaataagaaaattccttttggtaacttcagaacaaaaaccaaataatcaaaaacactggagttttacattatactgtctcctgtgttcagcatgtggcccagctttgcagatgggcccatcagtaaatacgtggtcttgatactgaagaaattaaattcccttgggtggtaacccaaacagatctacctgtaaatgaattgtatggtcaggcttcagggaaaaatttcccatggtgttgtttttttttttttttttttttttttttaattttttaaatctctatggcatatttttccaatttctgcttttctttttttttcttttctgcttagcacctatggacataattcaacatgatgccctctttcttctggaggggtgtgataactgcttgataataagcactttttcaggcctattgagaatgtggttaatgattctaaacttgatttttcataacttgtaaaatagagctgacagtattatagttctgaaaacagttttgcgttatttgggtatcaaaataaagtttgaaacaattaggatggatttgcaaataacctttcacaaaacatgttgactcagattttgtcatgatccttctgttaggtgcatctcttattccagccctaacagattgggtgacaatatcagggtgctggtggatgtacgcctctttctttccagtgtgctgctatgatggtggctggttacctgtggtgtcttattttctttcactggctatgaatggcttgctcatgacatattttgtatttgatgagaataccatagtgtttgataaatattcagaaatgtatcgctaaaacatatggctattctaggtattctttttcagaatcatctataggaaagctctagctgctcaggcattcctttccccactgaaattactaacaacataaagtgattatcatggtataactttcagttatctgcctcttcacccggaggatctacaaacagcacacagtgactaagtccctgggctttcaagtgcagagggatactacagactgcatggatgggcaaaatggcgcctttggttatcctcggtggagggctggtgttttcaaagctgtccttcctactgctgcagcttctttgactgttttatctggaagatctcatgttctgaaccccaaggtattctatgacagaatgcaaaggacactgagatgcttaccaatatggctgaattaagctgaagtcaccctccgctttccctccatttccatgcagccatctatacaacctggtatagatgattcattgcatagcctacagaagcaagactatgtgcgggacaagtggcgaaggctcaagaaataacatttttctaattgcttcaatcatcgttatcacagtttcaaccacaccacgggcttttgaccacacaaaacagaaccaggactggacccagtggaacccaagccattcaaatccggaagtgctacttcagacaaccacaaggatgactggtaatgggttctgcatatttaatgaaagatttttttcccctcaaagcccatgatgctgcaaaggtcaatcatcgaggcacagtgggaaatttagttaatatctgatcaagaaattcttagtggacttttatgaggatacttaattccatttaggagtcatttatcaattataccatgtgggcacaggattttttatgttgcttcatgataaaaatgaatatgtttgaatggtttgtggttctgcctttgacaaactgatcatagtggaataataagggaacatgaagaaattccaagcccattgattttctcttgagaccaattaggtaaagtcactcaaaatttttgagagtggatgctcagaggtaacactttggcatagaattgttaaatagcatgcactttaatggaagaatagaatcattaaagattggttgataacaagtcacagtgtatttaaccatcatcacagcagatgtagacagaaatggcaccactgcttatgaaggaaactggaacccagaagcacaccctcccctcattcaccatgagcatcatgaggaagaagagaccccacattctacaagcacaagtaagcaagatggcggtcggcagttctgggttagatgaattagtaaagacattccagcaatagggaagattttgtttagaaattggccgcatcttctatttccactcggtaatttcttttattcttagagcctgaaaagctgctaaacccgcacacaaattttaaaaattggaaggaaaatgataactcatcaggttgcccaaaggccaaaatgttttaagaagtagatctagatacaatttttgtgttaaaggttcctagaggttccatttgggtaacttgtgtgtgttcattgaaatgtgtggcaaagagtgtgttcttttggtgcttagtagtggaatctggaaagaaagtttgtcaagtgaattgatctttggaatccttattttctatgaagatctttgatgaatacagtgtcttttttgcattctgtccctgactgttctatagaaagacatcccttgtactctttagagcaaagttggtagctcttatggtcttcatttgaattctaccactgcttctttttctgtttttaagcccatggtaacttggggaaggctttgatgctcttactgttatttctactattatgaaaactcaggttttccaaaacaatctcaagttgcggcagtggactgtgagaatagggggccccctcactccccaaacataagaagtatgtgcttttcttcttttatctatcccgctgagatatgtctatcttatttggaataaaagtatttattttggaaaacagctttttagcatttttaaaatgatgacccaactgtcattctcacagccctagatacacctaatggggaaatgtgagccacttaaaagccacttaaaaaccaaagggctttgggaatctatggcttgaggggtgccttcagataacaaaagaaaagtttcaggtatcagttaggatagaggttagacattgtactgaatatatccagcagatcttacatcccattacaaaccccagtaggtgtgttgtatacatacggcttaggggttaagttaacaaagaagtctgataagaaaaggaaatacagaggaagcataaatctctttggaataggattttgttccactcccttagagccctaacagtataccttagaaattattttagacagtttgtacttaaagaccagaaagctactttagagacttggaaataatgagcctattgtcaaaaggtggtgcttgcggggcattaggactagagggttggtgaaaattcagacagaatgtaacttgacaaagagaagacagcaacaactgtaacaattatcttatgaatatttgcgaaactcaaagggatctgattggtgacctctgggctttatcaaattaacatcacaacttctagaagaaagtcaaccttcatcttttacaatagaaatcatatgttttgctaacccattcctatttaggctgaaaacaattaagagttatgggtacttaaaaaaatcattatgtttataaaattagtgatagaaggagcatagtgttctatacagtcacacacatacacttccttatttcttttatttaaactttgagtaacatagcagtctatgtttgggtcagttttcccttttttgtaattacattcagtggtttttgtaacttcattatttattgggaattagtgatttagtcagtgggagttttgtaaaacttaagattttggcttttttccccctcctcctggataaccagttaacccaataatggcttggccgatggaagggtaaaatgaggacagttatattttttaaatgtcattactgtcaccaaatcacacatatcattttctaagataaggaaatacaaccatttttacaagttgcaaaaaagtactctggcttggcaagtttatagactctcattttcttgataaactaaaaaaaaaaaagaaattgctacaagctgctatagacaaaaatgttggtgtctttctgacttttcctgaagacaccttgatggaattatattctcttgattttgtcctttttaaaatgatggttgaaattttaagcctgtcacacactattatttatataatgcctcaaactggcttggatagttttcgtcaactgaattaattttgttaaaaagtgattttagcaattttaggtgccatgtggacatcaccaaatactgtgttagtggaatagcatccaagccatcccaccatctttcctgctgggcaaatccactgctggtgcatttccagtgtgtgcgattatgggttacatgaccaccatttgagaaggtctcctaatgtgctgatcttgttattagctgttatacagtgttttcctttcgtcaaaatgactggagcaaagaggttattctttgaatggttttctcagacagggtatgtgaagccattcactacagtaaaataaaaataataataactcatagaactatgagaattcatcagctatggtctgcttagtcctatgattttgaacaaatcaaaacttctttggaccacaattttcctagctgaaaaattaaacatttggatcatttgatttctcatatcccttttagaatatcagtggcctgtttccttggtgcctttcttttctaccttccctccccatgtgtatctgcccttaaagtagaaagatatgttgacagctattggtgaggaaaatagacaattatgtctcccaactgatattcttctcacagtccaggcaactcctagtagtacaacggaagaaacagctacccagaaggaacagtggtttggcaacagatggcatgagggatatcgccaaacacccaaagaagactcccattcgacaacagggacagctggtaatggatggtttaacaagtaaatttggatggaaacttccttttgggttaaacggtagacattgaggacattgaacaaaaggacactggaggaattgtcacgagatgttaggttacttaataaattatgctgcagttcacacagagccaaaccttaaaggctcataacaagtcacctgaacaggaatggatacaagccagttatgaataagaacaggaaacacagagaaaatgcccttgaacatgtctctttcacatcgagttttgggcatcatctagtgagattgtagcagaggccctgataaaatatcgctgtctgttgtataaaggaatctactctataatgtgggtccagactttacaatatgattctgcaaagtctggctgtgagaaagcattttgtcagaactccagtgtttgaagaaatagagccagacattatgtgaaaagtgacacctgtctgatgtcatttggccttttggccatgcctgttcagtaatttgtttttgagtataaaaaaggtatcttctctattcttgaattgtgagattgtggaaattggaatccagtcttatcatcatctctaagtgataccagataacttggctttgcaagctcccatgcaggattcttttgtctgtgtgacataagtattaaaatgtgtcctgccttataaagaatgtgaattccatattctcacttggtatcagtgagaaatattcccatatttctatttgcaacatagaagataatgcatcatgtccttctggggcatggcaagttctaaatgaattcctggcagagcaatggattctgtgattgtctatgtggtgtagttgttgctaagaggatgctattgtaatcttttctacctatacttcttcattggctcagaatgaagcaaggcatgtgctgctttcttatatgtcatttatgccataaatcccattgttagaaggtaatgcttctaacggattccattcatgcttttgagataaatggcattgactttcatattgatcacatggaaagctgttacctgattcctttcctgagatcacttccagcctaatgtgcatttggctggaatatggttgtctcagaataacatcatgcactcgggcttttatacttctgcctttaggggactgtggcagcatggcatgggtcaagaagtacttctccttcatcttcctttgatgtcggtaactcatcctttctgcactgcgggagttgttaatgcttttgtgtcctccagttcacatgctgattgctaagaagaaaatgagcatgagtgaacccaaagctgctgaaacattctgcgtttatgcaacttccttgccctctatacaaggaagatggtttcattgtcttgtctagagaataaagtcttttttaaaaataaaatcggtgtatccctgaccaagcgtccattaacactttgacaattgctcaaactgcatggtcacagcagcctcagctcataccagccatccaatgcaaggaaggacaacaccaagcccagaggacagttcctggactgatttcttcaacccaatctcacaccccatgggacgaggtcatcaagcaggaagaaggatgggtaatagcctctgagatttttatatattatgttttttgaaatccactgagtgactgctgactatttttctagaaatatgcccttggttttagaccaaactactttcctgaaggacctgaggttcttcaaaaattagttttcttggtaggagtgatactcatattcacctgaatatgaagttctgagctgaaagtaaggaatttagcaggagggttggcaaaagaaaaaacttattgtcaaaatatatctgtgtgaggcagtaagtaatagatatgaaatgaatgttgccaacaataaacgctaaagaaattctgagaacccctccctgcccaccacagcatcacagaaaggtgaattggacttggtttatgaaaaataaaaaaaccctggatagtcagagaaaggaagtgggtggtgggggttggtggggggggcagttttcctaagaaggagactcctgtaaggagaaacgtgaaggaagaaaagccaaggaatgaatatgtcagtgagtggatccatttttcacaagggaagatgtgtttgaatggctaggcaggggccattatgttgagtgactgaagtaccacaggcagacccagcacacatgagtttgcacatggcagctggagctctgaggacacccatgggggaaaaccaagccaggcaaagatcttcagaatcaatattaattctatgtactgatgaagagaaagagattccattaaattaatgaacatgtcaaggacaatacaattggcttcaactacacaatggtatgatgactcttgaaggactctacttataagagggaagatgaacaagagtctagagcccatcatcaagtgggactttttctgggagaatgtccatttgtggttttgattcaggttagcacttgctcttgtttgaaatctgggataacagggtcaccacatttttgtcctacaaagatctttaatattttagtgttgaatatttagtgttgaatcttgaatatttagtgttgaaaggctgcagtgcagacctgggtacccagtattctggtgcttcactgggactgattaaatctcccccagaggcagtgatgtggatagactttgactgaattgacagccagaaatatcgatggggtttatgaattgtttggcctctgtttcactcaagacttcttatttcagcagagtagatctgtgataactgttaaaaacaacatttacaagtatttcagtgaaatttctgcactactcaacattgtacatgttaaattttaaagaccgcttatacttgggtttttgggaagaataattcaatgacgtccactgcttcttatttcttgcccctgtatactttctgtaactccacctaggtggtcttggatgacgattctgtttatttgcatattcactttgtgaagaaaaaaagactaaaggggggaagagggctatttttaaaagtccctttggttggtaagggggaggggataaaatggtgcctgagccagcacactttgtcttttctccatgtgtcagattgcatgtttctataaaaaaggcaatgtttctgtctctctgcaagatttgggtgttccatcatgcactcatgtggagtccttccagactcagcaaaaacaaacacacagcatagctttcatataactcggcccttcaaggaaagccagttacttgttgtggtgctctttgatgaaacaataatctatctcagttcgggagatatagtcagtatgtgctttctttcctcttggccagatgtgaatatttaaaaaaatcagctgtagaccataagccaccttcaggtagtggtttgggaaatcaagcaataacactaatattgattccttcagatatggactccagtcatagtataacgcttcagcctactgcaaatccaaacacaggtttggtggaagatttggacaggacaggacctctttcaatgacaacgcgtaagaataacgatgctcagccactttattgacttgtattcctgcttcatctcttactcgctattggccaagatgcagagctttggtggtggaatggtgctatgtggcttacttcagcccagagtgtgaaactgtcttcattgtctgtatttcttgtggaggtctctcaacctgattttcccttcatttctttgtgccttccagatttaatgactttgtgttttaagaaaaagtaggactctattcaactccattttcattctctaagtagttatgtcagtgaaacacatgcccacttccaggatagtgatttctctatgttttaactgaccatttcctttcaatgtccatctttcctccagccagtgcagaagaggggtaggattgcttgcatggttgtaaaaagacatttttggggccagataatcctagagatcacatcagttctcagaggagaggcaaggcatgttattgacaatcaacaaaggtggcgggatccctggaacaacaacaacaacaaaacattgctagtatctctttctatcactaagaaatgttcaaattctagtagccttaatttctactctatgtgcagggatgtcctagagatcagcctaaagtcgttcataatttctttgaggaatacaaaagaaatctagaattaagaaggtcccattttactgcttgccacacataatgggcagagtccttcatatgagccctttaggcaaaggaaaaaaatcagcaagcatgtattgatggtcagcaatgtaaatagcacagcgttaagcatcaaaggagatgcaaataagcctatgaatggtccttgccaaagaaggacttatatttccgttttatgtcactgttggcttttgttctgacattgggtttgggatttagtgactgtctttctcctggttgtaatatttattcggtggtgggcatggcttatgggtgtgctttatgaagtttttgcacctgcaactcaggtcagtacctttcttaaaagaacacaaaagaaataaacttgaaacagtccaagtgattttagatatgggcaatgggtcaacctccagttgatatatgtcactgagggccctgtgtttgcccaggcaagcgtttccttggtgcagtgatgaaaatcccaatgcacaggtgaaattaagaaataacttaataatggagtaaaatggtaactttaatttaatgacctttacaaggtagctaagtatttccttgtataaatttgatctgtgttacttgagtaggctattctagataggcttctttttcttttgtggttacaactagactacaggctatcatagtgttcattttccctgccgtcacatttcttgacacacagttaggtgcttttggttactgataggagcattgggattcaaatattcttttttccatgtctctgtgttctctggttttctggagtgactgggagcaatgctgcaattgagcctggacaatccaggataggcaaagttttggctcagtcttcaccttgccactttacctttgatgattatactgagaaataaagggtcttcagaaccaaataggggcaaaatagaattcttctgtatatttctatcaatcagaggagaattgtgtgcacaaaccttggtcttcctatgcacctatccatctgactctactctagctagattttccttgctagcagataacaggatttgtaccgtagcttcaaattaacactggattcattcctcattgaaacagagcagagtaattctcagagcttctctacatcacatgaaggcttggaagaagataaagaccatccaacaacttctactctgacatcaagcagtaaggattataaaacctagttggcttcagctattgataagaatcaatcaattatgggtacttttgcagtgtctttggtggaggtgcatccattagctgccgttacactgttacttttaatcaaaaggtgcgtctggtggtggttctctgatttttctgttttatatacctcttcgtacattaagtgcaaactacatttcttcatcttaaaagttgggtttctttcactctagagttagtgatttgttttaacaataatggattgcttatatatgatttattttatttatttatttttgttaacttgagatctttctaacttttttatgtgggcgtttaaatttagtgctataaatttccctcttactactgccttagctgtgtcccagagattctgatatgttgtatctttgttcttattagtttcaaagaacttcttgatttctgcattaatttcattatttacccagaagtcattcaggagcaggttatttaatttccatgtaattgtatggttttgagtgagtttcttagtcttgatttcaaatttgattgcgctgtggtccaatagactgtttgctatgatttcagttcttttgcagtgtgatttataattggcgtaaatgtctgattatatcactttacattcctcacaataatattgttttgccttttgtcctctggacctccatggtgctgatgactaaaaagcagtcccttctggaaaagaaaagaataattaaattagtagcctcaggcctttgaaaccatgcatttgctattttaattgcaggcagcaaaattttatctttcaatccaatgatatgtttcctccactacatcaaagatgaatccaattgagaaagaactcaagattatctagtacctcagctgacttcaagatcacagttgtagtgacatagccttacctaataacccaagcagatgttgcaacaaatgccaattctgggtattaagatcaccaaaatctcttctgttgagtgatgtccaagtagtgtctattgcaaaatatttattctgttcaatagtatgacaaacttcactctatttctccctatttatggataacaagtggaaagcttttgcagcaattgtgtgttctggagacaagcacatggtgggtggtgatcttacaaatacgggttcatcactgattccacctccacacagataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggtaatttggcatttattatctagtttgctttctctatatagagaaacaatatatagtttcatattacagaggacattttctgtgtagtctgggattggactagtttgtgatatggaaatatctttcattattggttatcaattctagtgcaaataaacttgggtatattttagataaaagaatgcttccttttgccagtgttttttccatttgtctgtgtttgcatgtgtgtgtgtgtgtgtgtgtgtgtgtgtgttgtgtgtacaagttggctgttatgatggaattgctttctttgtcttatcttgtgatatatgaagttgaaccacatgaaactgatatttttgcaggtgaaagtagtcgaattttagcaattccgtttaattcgactaatatactctacttattttgtaaggttttatcctacaggtgaataatttctatatactagtatctttgctctgaaattattatcttgttttggtaatagattgatcagttttacttttggtgatggataaacctcttctagttctgatgcacacttaaaatgttcatgatttaatctagtattaatgaatagggaccacttctcttattgtaatagtgaagagaggaacgaagataatttattcaatgaagtttgacacggacctagaataagtctttttttttctcaaataagtagtcatctctgcttctgcttttctttgcttctccatttgtattaagaaattaacagtgaagaaaggggaaatggaaaacgcccactgtagtgaagaaataaaaaacagattctgtcttcctagtactagtttttcaattgctttgtaacacaatcactaggcatattcaagattagagactttagatacataattttggagcagagatcttctctcctccccccaaaaaagaaaaagaagaattcatatgtgtgcatatatatataatttttttttttgagacggagtttcactcttgttgcccaggctggagtccaatggtgcgatcttggctcacctcaacctccgcctcctgagttcaagcaattctcctgcctcagcctccatgagaatccaatatgtaaaacagatgacggttgtgatgcagggacagaaaattcagaatgccacatgcttggcctcatttctctgggtggcctacccaagagcttcaagaaaaacagtttaagaaaatgctaacttcagcaatattggcaagacaaagccccttacactccttagttctttattcagcattgttctgctctcatttattaaaaattccaagtaccattgtcagtattcttcagaaaatcttatagtgctgtctcatttctcttggcaaaagaaagcctgttgtgcaacccaatgaatttaattttttttttttaaagagtcttgccctgtcacccacactgtagtacagtggcgcgatctcggctcactgcaacctctgcctcccgggttcaagcgattctcttgcctcagcctcctgagtagctgggattacagatgtgtgccaccacgcccggctaatttttttatttttagtagaaatggggtttcaccatgttggccaggctggtctcgaactcctgacctcaagtgatccaccagcctcagcctcccaaagtgctaggattacagacgtgagccaccacgcccagccatgaatttaaagtttaaatggcaattttaatagtcacagtaccctagaatgcttatagcctaatgttagtaaatcaaatgctttttacaagactgatattcacagacactgattctttctgatttccacagtggtacggacagattttccataattctccatggattagacaattaagtcacccaattctcatccttggttttcttcaaaaacactcacccacataaatctcatttatgtctatacatttttctcagtctttacgcttaatgttaagaactaaagcatttgttgaagcaagcggatcacttgaggtcaggagtctgagaccagcctggccaacatggcgaaacctcgtctctactaaaaatacaaaatattagccaggcatggtggcaggtgcctgtagtctcacctactcaggagactaaggcatgaaaatcacttgaacccaggaattggaggttgcagtgagccgagatcgtgccactgcactccagcctgggcgacagaacgaggctccgtcccccaaaaaagaactgaagcatttagaatcatagtggcagtggtggtggtggtgatggtgatggtgatggtgataatgatggtgatgggatggtgacggtcatggtgattttggtagtgggagtattggtgtggcatttcagcaaatgttgttttcatttgttttaaccatcagccaaggaacaaagcaatctgtctcttcaatatagttacacaggtgactaagtgtcacccgcttccaccttctctaatcaaggaaatggtgacgatcaggttactatagattccttataaggtgccttcataatggataactgtagccattttatgtaagcattgtcctgtgattaaaaaaaaaaaaagattccagtatgcttttgaaaaatgtgggtgggggagagagttttaatatgctgcattcaagatttgacctatggatttagattctagcaattcatgaggttgtcttaatctaaagctttctggtgatagatgtttgagaagctaggattatattaactagtcatgttgaaactacagatttaactttaaaaaattattttaaacttactataatacccatattccaatacacattattaatgttagctatcatctcaccatttccttttttacttattttcaattttttttgaaaataagtagttgacctttctctttgaatctttacatcattcaatcccaagattccttattgcatactaatttcctgccgccaagaaatctctgtttcatgccctaagccagagtatgcccatttgcagtgattatgtttctcataatccaattcatattgtccttatttaaaatgtacaatgtctagtctcaacctcatacctgcaaagatatcacaatatttttgttagcatgttccttaccacagttcttggatttctaccaaaacaaagtttctacaaaacttcctgtggtcatccttcttagcctttgctgccccagtttccttaattcttattaaagttctagctcatttatcagtggattaagcaatgaacggtaattaacattgtggacccattcaaggctgttttgccatcattttttggaataccttaaaaagactaaactttgtgataggctgtataagaatgcaaaggtaaagaaatgcagatgggagtgtaagtgaaaacatgcagtactgaccttcctgattgctcattacaggagaccaagacacattccaccccagtggggggtcccataccactcatggatctgaatcagatggtgagttcaaaactgctttagtcatttactgttataatcattgagcctaatgatgactaccaacgaagtatgagtcagtgtctccagagaagtggttctcaaaccttcttagcatacatcacaattgcagggagggcttattaaaccacaatgctggaccccacccttaaggttcctgattcagtaggtctggggtggagcccaagcatttgcatttctaatcagttccctggtaatactgacactgctgggacagggattgcactttgagagctactgctctggaggaaagccttgcatctgaaagcctcaggaagaattcaagcagtgtcccaatttaaccttgcactacaccagagtgattaagagcttgagctttgtagcaaaaatggcctgagttcgattccagccctccgcatattaactgagcaagatgctttaaagggtctgagacaacatttctcaactaataaacttggaataataacaattgtcacaggacattgtttcaaagactaaatgatagaatacatgtaaagcatttagcataatcctggcacatgatatcatcactggtatttgttgggaatttactgtgtgccagcagcatctttctaaacactttacatgtattaggttgggccaaatggaactgccattattgtaggtcaagaacaggtcaatatcggccaggcacggtggctcacacctgtaatcccagcactttaggaggccgaggcaggtggatcacgaggtcaggagttcgagaccagcctggccaaccctgtctctactaaaaatacaaaaattagccgggcgtggtcctgcgcacctgtaatcccagctactcaggaggctgaggcaggagaattgctcggacctggcaggcagagtttgcagtgagccaagattgcaccactgcactccagcctgggtgacagagcaagactctgtctcaaaaaaaaccaaaaaacaaaaaacaaaaaaacaggttaatatcagcaaattcatagagtttatctagtatgaactcattcagtcatcctataaactctgtgacataggtaagtactattattatccccatgttacagatgaggaaactaaggctcagagaaggtaagtaacttggcagagttgacaggaccagagagtgatggagccacctttcaagcctggagggccttgtattacttctcatagcacagtctggagaaggcattccataatgaccataattactcccaggcatgaattcttaaatagactcctgtttgttgtgattcagatcacacccctacaaaccttaccccagactgcaaaagtctgacatgaggtaggtttactaattacttctactgctgggctactgggaggttctgccagtgctgccttactgtggtctccctgaacatcataaatccaggtgaccccatgtaaatgatttaagccatatcaattattgtctcccctttttatgcccaagtttgagtgaggctcaccatcagatttaaatgtttacacattgaaaacaaatatgaagatggatatttacatggtggcttccacaataactctctatggaggagcactaggaggtagggattcattagaaatgcttctgaaatagagacagaagtcacaggttcactggggactttaggcagggcacttaacctttcccagactcagtttccttgttagtaaaaaggagatcaaatcatctgcctcagttgcttcctagagttattgtgaggaagacagggtaccagaagtgtgaaagtactctgaaaaagtagggagttattattaaggggcatgatctctaaaaccaagagaccccagccactctctaagtatgattctttaaccatcagagtggacatcacctaggaacttgttggaaatgcagaatccttggccaacccagacctactgaatcaggatctgcattttaactacactctcccacccaggtggtttatatgcacattaaaatttggaagcttagactgtgctagactgcttttctcaccattgaagccaattgaacaatctctgtgcatatgtctcagattacatgtcatctcccaacaggaatatcaagtgctcctctttgtggaacttgctactgtggccagtcctaccctggctggatttgtagacatctagggcacaaggcaagacctgctatctcacatccatcttctgtggcttttgcttgaagtgagaatcaagcagacaggagccagtctcttttgtttggcttctgagcaggtgtctattgttcaaacaggaggtttcatcttgctgcacgcacacccagatcttttcttgctgggagcacttcttctttttttttttttttaaatcaaaataaagtgattatgatccgttaatggcctctttttaaatatcaaaggcttctatgagtcagaaaagaaaaaaaaaaaaaagaacagtgagagtgactgtacctcctggggagttttcacggccaaagatcttcagtttaggtggccagtgtcccatgagttgggcaggtgaaaacctgccaaccaccaaggacactggaaggcatgtagggaaagggccttggactgttttggagatttgtaaagtcaaaggccactgtcaacataggataggggatgttgaaacacccagatgtctggtaggaactggttttgctcccttttaagttttaacaaaagcatcaaattgcataaacaagagccatcctgtccccatataaccattgtaatcaagatttcagtgtgcacagcctaaagtttggctccatgaggaaagctctcatttaagaccccaccattttcatccattgatcagccttcaggattctacagtgggcttccatttggtaggaaaaaaaaagttcattttggtggaacactttcaaattttgttttgaagcaatggaggaagaatttttaaaaattcatgaagctttcattttgatgaggctcttcacaagatgtcttagaagtttcttttttaaaaaaattgtttatttatttattatttttatttttaacagggacaggatctccctatgtttcccaggctggtctcaaagtcctggactcaagagatcctcctgtctcagcctcccaaagtgctgggattacaggtgtgagccaccatgcccggcttcttagaagtttcttttagaaccattgtgtctccctcatttcgataggcctccagttctgacttgaggattgtctgtcttgcgatacttcctcccagtttaaggcattttgttcatctccttattttgctttttagcagtagaaaatgttgattcttctaacaaggtgtgtttcagtaatatattagcagggactctaatagggtgatttttcatagtcagaaagggccactgccgctaaactccttatttatttattgtgaggtggagtctcgctctgttgccaagctgtaatgcagaggcacaatctcagctcactgcaacctctgcttcctgggttcaagcaattctcctgcctcagcctcccgagtagctgggactacaggcacatgccactatgcctggctaatttttgtatttttagtagagacggggtttcaccatgttgactaggttgatctcaatctcttgaccttgtgatccgcctgcttcagcctcccaaagtactgggattacaggcgtgagcaaactccttattttatagtgtttatgttggctcctatgatgctattggatgagattttcaggttccctttgggctttctggagcgtgtgagtcccctgggggtcttgttaaaatgaagattctgatttggtagctttgagatgaggcataagattctgcatttctagcgatctccccaggtatgcctgtcctgatggtctgagagccacactttgagtagcaaggtcctaaattaaaaatagaaaataacaaccacacacaactaccaataccgtgtatttcttcaaatctctgcaaaattatgatgaacagcattctgttatccccatcttacgagtgtgaaaagggagacttggagaaggtagattgacccagcacacatggctagttagcaagggacagcggtgagacttaaatccagggttgtccagctctagacaccaaagtcctgaacactgtgcaacactgctgctgagaattctcatgttccttgacacaaaataacattactaagccttagccttaatcaaatgaggtgggggggaaatcttttgtgtaatgctttataaacatctgcagcttgaatccataaatggcttctcagtgattcagaatgtggagagctgccctttatgcagctccacaaggaactcatggttacacatttcaaactttggttgagagatgttgtttttccccttaggacactcacatgggagtcaagaaggtggagcaaacacaacctctggtcctataaggacaccccaaattccaggtgagtttcaaactttgaggcagaaaaacacactgaaagcagctttctcagaatgtcccagcaaggacgaagagactcatttgaaagcacattctccacaatgcccaacatatgaatccaattgctcctctttacaagttaaaggatgaatgagaatactacaccctcttggtaggaaaagatggaatagtcttttcttcctgggttctgcaaactagctgagctcatactcagatctgtccctggcctgtcccagagaagtgccatgttagttactaaagcttccttcctaaatgaatgatcaccaagaggaccccatgtcatacctaggtcctttctatcccaatccaatttccacttatttctggggtccaaggtgaagcatgtaattttccttttacgattacagacagggaggagctacaagaggcatttatgttagatggagtgaaaactttcttttggttccccaactaatttttttttggtcgagggaccgcctgctgatgtggacagaataaacttttcagaaagtatgcatgtgcagtgaggaggctgggacacctggttctcctgagcatcaagacaaggcatttgttgcaaattctttatttgacttggaattaaaattgatttgtcatagagaattactaaagggaagggttctcctaaggttgtaaattacccttttaattctctcctcttcagaggtctccagactgagcctctcttggggaaagagaagaatgtggcatgcaccgttctcctttgccccagcttgcctaagcacacctgaagacagaccagacagagacaggggtgggctgtcccaagggagagcacaggggaagccttagctgtcatcaggcagcaagattcttcccagctccagtgacagtgcaggtgggatatctcagggctggaaaccagggccacagtgggcaggagtagaaaggaagaacagaaatcgggccctcctgtcagtctcccccacttctgactctacctccctctccaaactcatctaaaccaggaaaaggtgaggcaaaggtagtgctgagcaggaaatcagagataaaccaaaatttccaagaagaaaacagataatgagactttccatgcctcttctttctcaagccctggttcattgcacacatatacaacccactttgcaactgaatttagtggagttgtcaagtcatattttagtcctaaaagagcctgatttcaaaatgtgtagaatattaatccacaagtgatatataattattgaaaacatttgaaaaaatacaactaaataaaataatggaaatataaatcaattattatcaatctcaccatccagaaataccatggttaccattttaatatacgtctttttttttttttttttttttgagatggagttttgctttgttgcccaggctggagtgcagtggcgcgacctcggcccactgcaacctctgcttcctgagttcaagcgattctcctgcctcagcctcctgagtagctgagattacagcatgccaccatgcccagctaatttttgtagttttagagatggggtttcaccatgttggtcaggctggtctcaaactcctgacctcgtgattcacccacttcagcctcctaaagtgctgggattacaggcgtgagccaccgcacccggcctttcctgtcattttaaaatgtaaaatatataccaaaatgtgattacaccttacacggtgtttagcaaacattgcctactggttaaccatggcttccatgtcattgaatatttcctcctcatattgtagtgcgtaatgcaatagatgtaccctaatttatttaaccaatcctttattgcctccatttttgttttttaatacaatgtaaggtggataggtggatgctcttatacaggaaaaaaatgttcctttcaaaagaagcctacatttccttttatatgtttaataatattataccaaaggcatctacaagattcaacaagtcatcctgtccttttttagaaacatagttctcctgaagggacttgaaaatcctgactgatgataaaagattaaagcaagaaggctgttggacaaataccttcagcaaattgctcttccagaattacctgcctattggctggacctattggccagacccccctgcagcgctgactgtggtgcttgtttcaactaggtcaattataaagtgcatttttgtttttacaaagtgtgtctctgaagctcacgcatgtcatttaatttactcataccagaatggctgatcatcttggcatccctcttggccttggctttgattcttgcagtttgcattgcagtcaacagtcgaagaaggtaaggggctgtcctgggggctttcaacttggaaagggcatcatttaaacctgggctttatatccttgctgctcagagcgtagtccctggaaccagcagcctgggtaccctgggagtttgttggaaatgcacaatctcagacccaaccccagacctcctatggcagagtctgcatcttaacaagtttccagggattcatgtgcatggtgcagcttaagacatctttctctgccccggtttttagagacaggagacacctgtgattgtttggctcatcacttttaggtagtggttgaatcctttgtgattttacatgttttttagggttaaacctcatgcagactctgtctgatgaaagttatgaagtatctcaccaggaaggcacacaaaagtatatactcattcattgatttgttaaatatttattaaatacattcacaatgcacaaatatcgtataaagattcagtgattcatcatcccctgtagcctctctgaggcccagggaacctttaagaacttttaccagaaggaagtattggccttgtgcttttgtttgtcgtttgtttttttattggccttgtgcttttgtttgttgtttggtttttgtaatgatatcattttctattttctgggaactgtagttgaagagattcaggttatagcataagaagagcactgtttcatcgtcttcttgctgttaggaggtctatgaagcagagaagaactttcctttggaaaacaactaaatgaagacagtcacctcgctagaactgacacatgggctgtttttatattcttgaaggccactctctccctacctgaaccaagacctataggtttacatgttatttacattttatatataatatatatatatatatatacacatacattatatatacacaatagtaattctagcaacagaggaaatgacctttaacaggggtataaatctaaatttataaaagtataaatctaaatttcttacccaagacactttaaagatacattatttttctccaggacgtaattcataggaatattaagccttttgtaaatgtccctttagatggtttctcataaggtaaaagaaacttatttccaagcaggaccacctttattgtgtccccagatcacctcacagggcagaaaaatgcccctcagtctgggagaagacctagagagaattatggactccttactggtttttggaaagcaaccaacagctaattccaacaccatgggcagcccatacagtctctaattatctgagaaaatcaaatgatgctgttacaataattacgctggtacaagttaataaaagtgccatgttacagtcaaacagctatgttgctatctataccattgagggcatagttttaaaaagtagttatgctacctgattgtataaggaacaaaactgagagaaaaaatctaaaaggccgcctatgattgaatggaaagattttttttagttgaatttaaataatgtgacttgggggagcctttacaaagagtctttatacctcccttcagcttcctcattttcccttggattacttttgctcaattaaatatgaatttcctattgtgtgcaatcagccctttattgccaagccctagaatgcaccacttttgctcacatacacagtccataagctttgcacatgtcaccatagaaacgctggcatggatgctgtcgacatttagggagacctcggagaagcatctcagctgtccctaagagcagctggagtccatacattggggctgggtatctcccccatcgtctgtgtcttgtcagcagcagacagcagagaaggggcctcattgctgccctctccctcctcccaagaccagcagtcaccctggcaaccggcaaacagggacacacagggtccggcacagcgagtatctcaccaggaaagtagctgcttggatgccataaattactatgtcctgatttgataattgaaaacagatttgccacgcagctaaaaggtggtgaacagctgtacgggccccttaatgggctctgtgattctaaagctgtcaacccatttctaatccccttcaaaggctgaggcttttctgctttgagtgtcacatttaagagaaagagatacagaatcctattttcatcagagaaagtttggttgaaaatggggcctccaataggtgttcatttattcagcaaacatcttttgagtggctcctgtgactaccagccctggcaaggagaaagagaaggtaaaaaacaaaaagagtaccaccccttttctaaaagaatcttgaggtttagtggcagtattggcctcttgaatttgaattggctaatatttattgagaacattccctgtgccagacactgttatataaattatggttaaaagacaaaagtggaaaatcattagtctctgaagttgacatacaaggatgggtcatgggcttgcatgatgaagtgatctgtgagtcacgttgtcttaaagatgctgggttgggggttctattacttctttaggtttttccacccctgccatcatccaaaacagctttctttgctgttcctcatgtcacctgactccttgagttacagctctccaagagaaatcatattttattcccttttcatgagagcacataattattttaggagtcagttgggttgatagatactgcgtgaggctccagagaagattttcctttaaagaatctatctgggccaggtgcagtggctcactccatgtgcagtggctcactttgggaggccgaggcagtggattagttgagcctaggagttcaagaccagcctgggcaacatggcgaaaccccatctctacaaaaaacacaaaaattagccgggcatagtggcgcatgcctgtggtctcagctgctcgggaggttgaggtagaagaatcgcttgagccccgggaggtggaggcagcagtgagccatgatagtgccactacagcctgggcaacagagtgagaccctgtctcaaacaaacaagcaaacaaacaaacaaacaaaaacctatcttatttgtctaaagaggagaaaaaaacatgagaactttactatgttgcttgtacataaaagctgttcatcagccttcactttaatgggaataatcgtcttttctataaaccccagcaggcagtcacccacactccaatcagtaggtcttctctacgcatcgccataatttagaaatattttccttctcttatgctacagtctagctcctgcaatctgagctcacccaacctcgtcctgctgtctagaacagtgctatgcaatagaactttctgtgatgatggaaatattctatacctccactgtccaatatataactactagccacaactgagcacttgaactatggctagttcaactgaggaagtgaatttttaatttcatttcattgtaattagtttaaattcaaatagccaaatgtggctggtggctaccatattggatggcacagctctaaaacagtgcaaaataaatccctaaatatcgttaaggattgtcaggtagaagagtcatgagatcagttgccaagttacccacctaaatcttttaagataaattctgccatgccataaaagtatgttacctggcttctaaaccccagccagcctgccctctctttcctggtgaggtctcagtctgcctccttccacactgtgtgattgctgtgtgctcagctaatgcctgagatttaagggaagaggagataaaggtaagacacagatccatgaggatctctgatcttcagagtcagaagatccaagctgtggctgggcgcgggggctcacacctgtaatcccagcactttgggaggctgaggcaggcagatcatttgaggtcaggagtttgagaccagcgtggccaacatggagaaaccctacctctactaaaaacacaaaaattagccaggtgtggtggcgggtgcctgtaatcccagctacttgggtggctgaggcaggagaatttcttgaacccaggaggcagaggttgcagtgagccgagatagtgccattgcaccccagcctggttgatgaagtgagactttgtaaaaaacaaaacaaaacaaacaaacaaacaaacaaacaaaaacagaaaatccaagctgtgattcttgcagtgcagtgccataacaagctgtgaaactttggacaatacttcttggacttggtgtccagtttacataatgaagaagctgggctagatgatctctgaagccccttaaggtctagtgctccttcttaaattcttataactaggaataacttaaaaattagaatttgtctcttaaaagcacttattagacgcctagagcactgaatattggaatgagttatttatgagaatcatcctaccctcctgaaactactcagacagatagaaacacataaatccaaagggaaatgcaggccaaccaaaaaccaagcacaatattcctgtgtcctataggtcaaatgttatccactgtcaagatcagcttcgtttagattaacaacattaatccccacccactcccatgcacagacatattttttatgctcataaatcactttcccacaatatttcattccatccctcaaccacccattggttagggaaatgggaattactttaactagacaactttcctccaaagaacacaggggccagggaattggaagtaacacaagcagtattctaccttgagccttttaaatcctcttcatagtaaataataacgaggtaggtggaggcagccaggagaaacaagcaaaattcatttcatatggcttttgttatattaacaattatagatagcacttgaaagcttactgtgctccagatactgttctaagtgttaacccaaaccttagtttccttaccccgcataagagcaagaataacaattatttccttacccctcataagagcaagaataataacaatagactcatttatttagtgacagtctctgtttcaagggcttttcacaatcctatgatattgctactcttagtaacctggtattattgatgcaaaactgaggctcagagaggttaagtgagttgccccaggtcacatagcagtaagttctcaaaaccaggccttccgagccccttttcttctttcttttttccttttttttttttttttttttttgagacggagtcttactgtgtcacccaggctggagtgcggtgatgcaatctcagcttactgcaacctccacctcccaggttcaagcaattctcctgcttcagtctcctgagtagttgggattcagccacgcaccaccatgcccccatgaccggctaatttttgtatttttggtagagatggggtttcaccatgttggccagctggtctcgaactcctgacctcaagtgatccttctgcctcagcctcccaagtgttgggattacaggcatgagccattgtgcctggtctctttttcttttttgaaacagggtctcactctgtcacccaggctggaatgcagtggcacaaacacagctcactgcagcctcgacttcctgggctcaagtaattctcccacctcagcccccaaagtaactaagactacaggcacatgccaccacagccggcttatctttgtattttgaatacagactgggttttaccatgttgcccaggctggtcacaatctcctgggctcaagtgatccacccgccttggcctcccaaagtgctgggattacaggagtgaaccactgcacctggcctccaaggcccttttcttgaccatgcatcctgctggactccatctgtattcctggtccccatgaatctgtttcacagttcaagcatccttcccccaacccctcatcaagccttatgctagaggagacaggatctacctcctgttgaggaggtataatttttatttccccaaacaagagcttaaagtttatggccttggcagtcctacagggaatggtccatgatcatgaataatagaggctttgtcactattactccaaatatccagaggcaaagtgaacaattctgacttcatactgtttccaaatctccagagggctggcagcattgacagagccaggcagagcccaggctttggtcataaaggcctggatttgaatattggctctgtcattcttactttctgtgtgacctcgagcaagttattaaacctcttttggcctcagtttccattgctgtattatgggaacaatagctgctttgaaagagtgttgtaagaattacagaaaattacatgtaaaatgtctggtattcaggaggtaatctgcttccctgaatccccatcttgcttgtagttgtgaagctatgcaactttccttcctctaagcatagtctgactcgtatatgtgtagtagtgatatgttacaggaaagaggaagcattgcattaggctgggtggggtgaagcaatggacagtaaccagggaaaagatcaaggtcgtactcttccatagcaactttcttttgcgtttgggtcttaagtaatgtttgagaaaccttaaattaacgagaataatttgtcttatgttattaaacttcctatatcagggttgtatgagttagccaatgttaggaaaacatcactatggccttatacctctagaaaaatgttgttttattcttctcgatacattcagtaataatgctgacaaggccgacaaagtgttgactgggagaggaagttatgggactttctggaatatacaaatcagaatgatttacaatcatcatgttgatggtttatctaaatctgcagaaactgctaaaatgcttaaaagaggcaaacatttccattgtgaagtaagatagaaagagaatcagaacttgagagtcagacagaccagggtttgaatcctctttcttacttgctgagttacttgggggaagttactgaattttctgatccccaaggtttcttcacttggaatatagagaatataataataacaccggcttcctggagtcttagttgctggtttgcaaacttgactgtgcagagaagcccctgaggggttgcaaatttgactgtgcagagaagccacagatcctgggctccaactctagagttttctgattcagcaggtttggggtggggctgagaatttgtatttctaacaggttccaagatgatgcttttgctgctggtccagggacctcactttgaggagtgctggttgttatgagtctggttgttaagtgctggttgttagttgttaaagtagagaaaacccctagcacagtgcttggcacacactaaagccatcataaaccatagtgatcatcaatgatggtgctcagtaaggatgatgatctgatgcctgagtcactgcaatctttctgatatggtacattttttaaattattaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagactcagaagtctctaatttaaaagaatgggaggctgagagggacagaactatgcttatctggcaccgtctgggtaatttagaggaacaaagtcaaaggtatctgaggtggctgaagcctcacactcattttattttttaaaaaagcaaaaacaaaatgggtttccatcaacttgaaagtcttcttttggagaaaatctggttttctatgagtgatgtgtggttcacatgtttcaaactaagtgagatacagtgaagtgttagttcttttaaagccaagaactactcctggacttccagttaaagagaggagagtgtacataccttcattccctcatgtaagcctctaaaaagaaaataaagagatatttccagacggaatcaaccagtggagttaaagagattggaagaagagacaagagcaacaaaaacttgaagctgaaaagtgatagctgattggtaactgaatgaacaagtctggaaaagctgactcctaagcctgcagtgtggaaaattgagaaacaaccagacttatgtgacagaaccatcaaaaggctcaatagctattctggaaatgaatgggaagatgaggctaagattagggggacaagcttaaagtctatgtaagaagcagttagaactccaggtccccttccttactctgtgtaactgaacaccgtcctttcccaatctcagcaaaagaccagaagtttattttctggagacagggaaatagagagtctctggttgaagtccaacagcacgtacacagttgacattagaaataccacactgagagccgggcatggtgatgcatgcctgtaatcctagcactttgggaggttgaggagggcggattgcttgagctcaggagcttagagaatagcctgggcaacatggcaaacccttgtctctataaaaaatataaaaattagccaggtatggtggtgtgtacctgtggtcccagctactcgggaggctgagttgggaggatcatgtttgagcctgggaggtcaaagctgcagtgagttgagattgctccactgcgcagcagcctgggtgaagagtgagaccctgaaaaagaaaagaaagataagaaaagaaaagaaacaagaaaagaaaagaaacaaaaaaagaaaagaaaggccatactgaaaaagtgaaaccatgcttaaagagtgttgagattccctatcctcctctcccagcttggctctcagaatgctgggagctaggcatatgttctccaggcagaagctcagtgttgctggggaatcttatgagcctgagagaaaattctaaaaatattaacatggtagttccccaaggaaatggcccaaaaaaagcgatctgcaatgaagatggcatctcaagccccaccaggcacccagaaagctcagtcagctttctgtagcttactctcacacatgagctgttaccaaggagcaccagacatttggagaaagcatctaatattaaagtcagggactacaaaaaacaggaaaaagtaccttgacagaaaagaaactgcttagagaaggaaactttttctaataaaggtcaccaatactctcagtaagataagaggagatggtatatctataaaacaaaaacacaatgccaggataaaaaggaacatatagagaacacctaaaaaagaagctttaaaaatgtaaacttgagagcacaaatttaaaaataaacctcacagaaggtttgcaagataaagttaaagaaataccctcagaaatacagcaaaagcaaataaatggaaacaggggggaatacattgggaagactggcacccagtccaggaaatttaacatgcaaatgctgtaatcaaagtcacaggaagagaaaacaaataggaagaactcatccaagaaaaaaatcaagaaaacttcccagaactttaaaacatgaatatcttgactaaggacaaggtgagtacttagtaaaatgaataaaaacagacccacactaatgcatattatcttaaaaattcatgacacctggggcaaagaaatgatcctatgaacatctagaaaggaaaaatacatacatggaggatcaacaatcagaatagaatcagatttctcaatggccacattggaagatagaagaccatgaaacagggcctcaaaatactgaaagaattatttccaagctagaattctaacttagttaagctgcaaattaagtataaggatggaataaagagattttaggtaatcatagtctccaaacctgctcacccattcacaggcaactcccaaaggatgtactccatcaaaacaagggagttaccaagagaggagaggacatgagtttcagaaaacaaagtagagggagttcttaaaatgatgataaagggagatcccaagatgacagctgtacagcaggtctagagaacacttaaagttggagtactgactaataattaaaacaatcaatgttttgcttttattgacctctaattaaaaagaaaattattttttgttgtattcattaactactgatgcattaaaaactgttccaaaattagtcgcttaaaataacaagcatgtatttatttcttatgcatccaccagttaactgagtacttctgctgatcttggcagggctcacttgagcatgacgggactcatgcatttgtgtgtgtgattaacaaacaggtcagctagaagctgtctgatttcggacagcttcatctgggatgattggggtctttttccatctgactcttacatgcctccagctggctggtccaggcctgacagggttccaagtaagagcacatgctcacaggtcctcttgaggcctaggctcagaactggtgctctgtcattccaccatattctattgaccaatcaagttacgagagcagcccagattttaaaagaagggaaatagattctatctcctaatgggagaagctgcaaagtcacactgcaaaaaatatggttacaaaaaagccaattatcagggccattagtgtgatcaagatctacgatagacatgttgaaagattcttgtgctcaagggcacctctcatgtttatgcttaaaatacactcaccatttgagccatattggcaatggcattaacttagaaaaccatgaacaactttataaaccccatgcttattggaaaaggaaggagcaaagtcatgtgtaaatgtgtttgggagattgcttggtatggtagaaacagcatgagctttgggatcagacaaattttgggttttaatactgattctaccacttacttaactgtgaaactctgttcacacatcttaaatattttgagtcagtaaagagacagtaaaaccttcatagggtggctatgaggattaaatttaacaagtacgtgtcagtgctggggtatattaggtcctcaaaaatattaattcctacctgccatcacccacatatgcacagtaggtacttaacttcttccttcaccatttcctccaatgttctgaactctaaccaacttttaagtgtgaattgctattaacttacagtggctggagacagattatttcagaatctgaagctccccatgaagaaagcccttcaattttagttgaaaggtttttgctttcaaagcaaggctaacaagcagggagtccaggaagctaataactggcattcgttgattaaatcttggccatctaggttgtggctgtaggttaaccaaagttgggcatccacccaaggctttgatcgtcacctccaggaagttgtcttgccccacccctatccaggatgagctcattttcccctctgtgggtataactcttaccttgtccatatgtcattgtagttcttactttgcaatttcattaatccgcccatgaacctgtctgttctactatatgatgaggtgtgagggtacggagaaattcattatggtcccccaaaccaggtaagtagaaagtggtagaaccagggatagagctcagctctctccaaagtctctggcttaacatgcctgaattgtctattgtcagaagtttggtaaactgaatttgctgaagttaagacatcatctccaaatgttgcaaaccaggtcagtattccagagctccctgtgcctggtggagccaaaggaggctttcagaaaccactgaaaagatttggggatgagtacactcaccatttagaccacattggcaatggaattaatttaggaaaccataaacaacttcatagatgctgtgcttattggaaagggaagaatcagtcatgtgtaaatgtgatttttgctgtgatgcccggggcaaaggctcagtggagaagaaagtctggctgggcatcctggcctcaagccccatttcttgcctgtgttgacacctggtcttgaacaccagtagtttgcctgtcagggccgcccataacccggctcctcaatcctgccccattaggcttccagactgctgatctcattacgtggtgactactgttttccagaagtcttgtctaaaccacttcctccttcctctctcccgaaagaggaataataaacctcagaagaggaggctaaggtttagcttttaaaaggtgatatttaaaacaagactctcagttcaaattcaacctctgccatttacttatgtataaccttacacgaattattgaacagttctgtgcctcggtttcctcatcggtaaagcaggaataataatctctaccggaaagaatgctggggggttaaatgagataatatctgtaaaatgatggaatatagtagacgcatataggtttccttccctcatttctgctatcttaatcacttttgtgtgaatacacagtaggggtctagaaagaatatgaaccatgatttgggagaagtcagaggtgttccaaaaatttctgaacctctcccaaacccttttaagcactggggtctgaaaagcctaccctctcccaccctaagatttccaaatagtatcaaaaagaagaagagattcccactcctgttttctggggaagggtggaatatgcaggtttattattgccaacatctataacacaaaggctctgccagagccaaccttcaaggtgacccctagatagggagagagaagaaatgagattgaaatttcaagggcctagctctggagattctgaagatccttgaccttgggaactcacccatgcagaagtggagagacaggttttcaataataaaggctaagggcttcaaatttcagcttgggttactagagttcagtgagagatttactttttattttcgcctcttctaggattctttaaatctcattaagaaatgaagagagaaatgtgaagaaaagctgtcagaggggtaaactgtcagagggatgcaaagaagagtaagatttcaaacaattgttctgaaagaaagttagtagctatttaataaggactgtctatgcatatagcagatatttaaatcataataagtataaagtaaactcaaaagcgtctcaataaggacagcatctctcttccaaacctcaatgggttttgctggctgcacttccagggcaagttgtcttggccacactttacttctcttccactctctcaatccctttcactgggcttggaggcacagcaactcagaactacaaagtctggtctgggcagcagagtcattggctgcgctgtactctccctcagggcagtggcaagctgggacctctctcaataggcaagggacctccgactccctgttttagatcacttcccccttggacaaaatttagacctttgtgtaaaagctgactgagaaaagtgcaatgtgttcatctgtcaagccaaggatgagagtaatgaaaattttcccatcaaggttcacgtcctttgcagaaacttcgttttcaaccatcttgttggccttctctgccctgttgataatgcgccccctagtggatgctttacaacatgccctttgtcttcgtagaaactgagtccttccgcctgacttccgttctcgaatcctcaaggtaaaaccagaaagaagagggtgaaggtgggcatccttgcactcaaggcttagtggggagtgggaatgggaatggaactgggttgcctgagttgggacaaacggttggggaataactgatggtccacgttttctttttaaactacattttgtgttttgaaaaggatttatagatcatgaaaagaaggaaacattcattagttgcaatttaaacgtcatttactgaatatctactatatgccaggcattgcgccattgctgcgctacagatccttgtctgaaggacacagataattgtagccaagaacctgctatgacagagggatagatagaatattgatctataatggctgaaattgagcatttgctatctacttgggcactgtcttaagcatgttgcatgtgttaactaaattaagttatttaacctctctgtggtttaacaggtaatcgtagaacatagcttacagagttatcagaactaaacaagataatacctgaaagatcttaaaacagtgcctggtacagacatgctaaaataagaaaacggaaatgatactctgcacaaccttgtgagatgaagtaccatattatgttgcatctacagatggggaaactaaggcagaggaagcatagtcactctgctagtaactggcagagcagtctgccaatgtaaacagcccagacctagaacatgctctcttaactcctatgccacactgcttctgcctgaacatactgactcttttaacaggaatagttttcatttcagttcttaaagaaggctggcatcaaaattagtgagctattaaacaagtgtcaaaattattggggactgtaaatcactttatgtctattagttgattctaagtgtggcacagattacttgttcatttgatgtttgaggaaaagtttaataatatgccaaactttggttctcagttttcatttacaaagaagctcttggctaaagaaatttcctaaaagaatctaggactactcaaacaagagactggcttattttctgccttttattgttccttaaaaagaattcaacattaaaaatacaaaagtaattgtctacttcatttctgtagaaaggtagacaataagacatccattttctagaaaattctttattcccagaaattttatgctagaaatgttttctgttccaaaaaatatcatctaatctcgttgatgaaccacacaaagggattacattttaagtcttatcattgtgactgaatgaactgagacttcccctctgcctccagggtttagggaagtacgacttggacaagatattctttattgtcaaataacaatgaggtgtctgataaactatctcagaggcaaggtgggagaatgctcttttagcataataagtccagggtatttaattctgctagtaagagtgtcaaaatgagtaggagaaaatggtttatgtcatacaggttagaacagagagtttctgaaagaaattaatcctggaggtggtgagatgtgcttgattttaggtaacccaggggaaacccagtgtggtagtatctttttgatgctgcccaccactcccctctccacccccgcctccccaccgccaagctcccagagacaagctctcacccttgtggactcaagttatcccttctcccagtggagcaactatcacttgaaggaggacaaaagcagttggcatccaacgtggaaggctaggaaagctgaggggaccgaaaaagctgagacaggcatgagctggttacagaggctcttggacttacaatggggccatattcctataacacatcataagaagtcaagaatgcatttaatactggcataagcccatcataaagtcaaaaaaatttaagtcaaaccatcattaagttggaggctatctgtatttctgtgggaaggggttgtgattataaggagaaagggaaggttgtggggacgccagagatagatggggttaaaggaagaaagatgagggacaagaattaaaagaagggatggacacggcggctcacacctataatcccaacactctgggaggccgaggcaggtggattacttgaggcgaggagttcgagaccagcctggcaaacatggcaaaacaccatctccactaaatatacaaaaactagctaggcatggtggtgcacatctgtatttccagcgacttgggaggctgaggcacgagaattgcttgaagctggaatgcggagcttgcagtgagcgagatagcgccacttaactccagcctgggcaacagagcaagactgtctcaaaaaaaaaaaaaaaaaggagaggaatatctcttgcgaaggcatgcacatacacacaccagcttgtgtgattcaggggtaagaaaacctggtccctttcctcctatttcaccattactatcattatgcaaggctttaaaaaatcagtagctgaggctgtaattttcacattccttgtaatgtcctttgcatctagaagatcacctggcacatggatggtcagtcatgtatgttgaacaaatgcacaaataataatagtaacagacctcgtacgtgatcaaaaaaaaaaaaaaaagaggaattaactcacttgttgtattccaggggctcttccagggtatttgaatggagataaaatgtctgcttacttcctatctaagtcatagcctagaactagagctgagaatatattcctcaagccagctgctaaatagctagtagaatggcaccaaggtgccaatgtggacctagccagggtgtatatgagtttcttctaatgagaggggggtactggaggcagttaaacattgacctggagctgcttgctgggaagcagcgtgaagtgttgcttccatttgagaatgaatattccatcacagaattccagttaaagtcaacagattgaatatactcattatgtattctccttcctaacacttactcaaatgatcacaaatgcatcaaaataatgtagactcacaaagagattggaagaagggaccttagcagaaaaagatatcaagagattttggaaaacagtaaatggcagaggaattcatgatctagcaggtgtaggaagatgtcacctaagtgtgagcagagtgagagcctctgagtagagagccagttgctccagcagaaacttggagatgcttatgccttggaggcaccaagtggtcagagacggggatgaggatcacaaaggattctcctgtccaggactttgaatcttgagcaaatcacacacagacaagtgagagatgaagagagattcacagaggtagtgacacaatggctgtggtccagtggcatagctgctgagtggcatagctgctgaatggcagctgtggtggctgcatcctggcaaaactaatctgcctcctaacctctacatatctaagaaaaatagaggcaggccagcctttctgccctgatccttgcttacttactggacatcatgcctgagggcattgtacttgatatatttagacctcagtttcttcacttgtagaaatatatataaagttatgtaaatatatataaaaatacacatagaccaatgcctggcacctaatacatgttcaataactgttgaacaagagcatcctccactaggcatttccccattgcaagaacccagctggacaatggagatttccatctcttcaggggatagctagagattcatctcttcaggggataactggagatccatcccatgggggtggaaataaacatgtaacattagtttttggtcatttctaatctaccagtccattgtttaatttccaataacatagctatttaaaaacctcacttttaatttgaaataggtgcaaaaaagaaataatgttttgtcattctgaaactctctagcctcactcttagggaaactatcataacattatatcttcagagattgactttacctattctgtcatctccttcatcctgtgtttggaaagtcttctttaatgatcaaagtcttctctcttcaggac

SEQ ID NO: 1054 - DNA, 68676 bp, Homo sapiens
tacgtgtctcaagtaatgcttaggagaagaactaggtcggatattcaagatgctaagtttcagctctgagcaccatggttcttctctcccttctcaaagtgaggttcatgaacccctaaggatccctgaaaccctttcagtggtccacgagttcaaaattatttgcatataaacataaagatacaatttgcctttttcactgacataatttgcctggagcaaaagcaatgatgagtaaaaccacttgtgccttcacatgaatcaaagccttggcgccaggctgggcacggtggctcacgcctgtaatcccaacactttgggaggctgtggcaggcagttcatttgaggccaggagtttgagatcagtctggccaacatggctaaactctgtctctactaaatatacaaaaattagccaggcatggttgcacgtgcctgtaatcccagcttctcagaaagctgaggcaggagaatcattaaaacctgggaggtggaggtttcagtgagccaagatcacgccactgcactccagactgggctacagagtgacaccttgccaaaaaaaaaaaaaaaaaaaaaaaaaatagcagtggcatcaagctgcagtagtagctgttggagtttttcatcctgatgcattcagaggatgcgttcttttatttaagaatgtcctcaatgaagcagttaaaattattaatattattaaagcacaatctttattctatgtgacaaataagaagtaagcaaaaagcactcctgctgaatactacagtatgaaggtagctctgggaaaaaaagcacttgtgctatttttggatttgccagctgaactagacgttttcccccatggaacaccatttttacttgaaactatggttattcagacttaaaaatttggcagacaattgtttgaaaatgaataaagtgagcctgtcacttgaaagaaagagacagtatttgttgccattgatgaaatcagagcttttaagtaaaaattcaaatgttagaaaacccgtgtcatgatcttgacatctttccaatactcaaagttctctgatgggatcagagatgatatcaatgaatgtgatttttgatactgtgtaacgaaatatgtcaacatttggaagatctgaataacttctgcatctgtgaaccagtatgttctacaataactgaggcatgttattacaaaatcatgcctggataagagatccattcaaagtacaagatagaacaatggattttaaaaatggactgtagaacagtatgttccacaatgactgagacatatttttacaaaatcatgcacggataagagatccattcaaagtacaagatagaacaatggacttgaaaaatatataaaaggtctttgatatgatttcagatttcacattggagctaacctttggaaactatcacttgccaacttttcaatatcagaaaagaatatctacaattatttttaaaatcctattaaaatactcctccttttatctactccatattgtgagaccagattttttcccatatacttcaatctaaataacatatctccacaaattaaatgaagaagcagatatgaaaatccaggtggcttctacaaagctggatgttcaagacatttgcaaaaatataaaacaataatatcccaataattttattttatttttttagacggagcctcgctctgtcacccaggctagagtgcactggcaccatctcggctcaccgcaacttctgcagcctgggttcaagccattctcctgcctcagcctcccaagtaggtgggattacaggcacccaccaccacacctggctaatttttgtatttttagtagggaaggggtttcaccatattggccaggctggtcttgaactcctgacctcaggtgatcagctcccctcgacctcccaaattgttgggattacaggagtgagccaccatgcccggcccccaataattttgtggggtttgggatatacagtaatttttcacagaaagtgttacttatattgacatgtaatgagtttgctgtttatattttaaaatgtattaaataaatattttaaatgtctcagttttttgtttaaacttttttaatttttaatttttatgggtatatagtaggtgtgtgtatgtatacatacgtttatggagtatgtgagttttttttgtttttttttgttttttttgagacagagtctcactgtcacccaggctggagtgcagtggcactatttcggctcactgcaacctccacctcccaggttcaagtgattcttctgcctcagcctcccgagtagctggaattacaggtgcgcactattacgcctggataattttttttttgtatttttagtagagatggggtttcaccatgtcggtcaggcttgtcttgaacccctgagcttgggcaatccacccgcctcggcctcccaaagtgctgggattacaggcatgagccactgcccccggcctacatgagatattttgatacaagtatataatgtgtaataatcacatcagggtaaatggtgtgtccatcacctcaagcatttatcctttctttgtgttagaaactatccaattataagcttttagctgtttttaaatgtacaataaattattgtagactgtaattatcctgttgtgctatcaaatactaaatcttattcattctatatatttttgtacccattaaccatccccactcccccatccccactacccttcccagcctctggtacccatgattgtactctccatcttccggagttctcagttttaacttttaatacgataaatatcagtagatattacccacatgaacaaaagttctatggggtcctccataatttttaagaatataaaggggtcttctgaccaaaaaatttgagaactgctgccctctgtatgctaaaaggtaagaaataagctccaaaaagattttggtggctgccacattgggaaagattttaagggtcccaaggtctggggcatgttgggacattatctctagggtaaagaacaagcctttgtaacttgcatcccccatcagtaagaacaaggcacagcacagggtgggtacttctggattttaaagcatcctggggaattctgtcggaccatttatcatgtgacttgaggggctgctagtgccgagggaggcccagcacgagagaaggctctgtggcaggtccaggcaatggtgcaagctgctgtgacgccctacgacaatcgtgttcagtcatatcagagatgccacatggataaggatgccatatggagtctctggaaggctccaaaaaagagaattttgcagcacaaacctctagggtgctgaaccaaagccatggctcctgcagtagagaaatgcttgtcacttgaaaatcatatcctagggtgctactgggccctgatagagacttgtgcctgaagatgggtcaccaacaactaggggaccacaagaccccatcacacaccaggctataagatctggggagaggggcagcagctgtacaattgcttcaaacccaaacagaaccagaaggtacaagtaagttacatggacagatggcacctgcctcttttgcatccatatttctctctgtctctcttttttcctgagactgagtctcgttctgttgcccaagttggagtgcagtggtgtgatctcagctcactgcaacctctgcctcccgggttcaagcaattctctgcctcagcctcccaagtagctgggattacaggtgcctgccaccacacctggctaattttttttttttttttatttttagtagagacggggtttcaccatcttgccgaggctgatctcgaactcctgacctcatgatccacccacctcggcctcccaaagtgctgggatgacaggtgtgaacccccacgccggccccatatttctcttttaactcacatctatggccttgagaaagctctttctgatagaagtggaaaacttcagacctggttcacaaatggggcagcacaatcggttgttactagccagaaatggacagaagctatactataacctcactcagaggtggctctgaagaacaatggtaaagggaaatactggcagtaggcagagatgggatagtacctttggtcattcgtggactgtatatggaaacaagtggaggtatagatatacatggactcctgggcaggggcctggaaggaacaagactggaaaatcagaggcaaggatatctggggtagaggcatgtggatggacacgatgtatgttaatgtccagtagagaagctctaccacagggaggcctacgactatcaagaggacattagccagcttctctccattggccacatcagtgctggtgcaatgggtggtaggaatggagaccacacatggacagatagttatgagaaccatttcagaagtctgagatcgagtactagttgtccatagtgtggccaaatcaatgaggcatccttttattgactttccttcttttcctatttctcttctctttgttcctcaacctgttccctcggatcgcattcccaaataacctgtcgcaaacaagcccttgttccaggctccatttgagggggaagaggctaagttaagctactacccatttacaattgtaacccctgttcacactcctagcctctcttacacggctctgtttctttttttccatataacctatttattatgtctattgttgattatgtttctctcccactaaaatataagctctgtaaaaacagggatatttgtctgttttggtccgtgtagtgtccccagcacctagaacacagataaagttgtgttgaatgagtgactaagtgattagagctaatgtatgtacatttagatgctaaatatttagaacatggtagaaaattctgggcctcaggaaacacaaggtttggctgtagctggtttggagactgtggtcaggactgagaaatttcgggattcaagagactaaggagtgggtttggcttggcccaggagcagggctggtccaaaatttagagtctcgtagaaccagagcctttcctgcccgtggtgccatgtttcagccaaagcctttatgcttgtaccacaacccacccctgtggttaagagcccagggtcttcatccaaacagacctgagttcagagcctacccctactacttcttagttgtgggatcttgagcaaactacctctctaacttcagtgtcattatctgcaaggctgtgctaaggacacattctacttggttgagttgtaatgagaactgagggttaaggttccatataaagtgtctggcacaataggaagtgctcactaagtacccgtcagcattaaactttcccacgtgccacatggtgagggtggcggcctttcagttctaggtcctctcttccttctggtgggagagtcgggcttccctcagtaatgttgcttattccaatttgttgggtgaaggtcagaagagagatacagtctggatgaaaaactcctgagttctccacagggtgcagagccactgggtgtcccttgcaaattgagttcacaaggtcctgctccaagagttctaaataaaaatgagctcattgatttggacacccagctgggtgcacctttcagcttcatttttgaaacttcgagtctgtgaaacatgggctgcctggggtgtatcatgtcaatccagccccagcaacactcacatcatgctgtcttgcctctacttaccctgtgccctgtcaagagcacccttcccgccaccctacacctgagctacctgctgaaacctaccaacgcttctgtttgtcctattctccctttcatttctttcttttcgtttcctgccctctttggctttacagcaggcttctctccccaacaagttccattttattgttcaactagtttaacatgcatgtttaattgaacaaggtcaaatgctagtcaatattttgccctcccaccaaataatagacctttcccactctgatcactcctcaccaatttgttattgttttatggttctttagttttatctcattttttttttcttttttaatttttttttctttttttttttgagacagagtctcgctctgtcgcccaggctggagtgcagtggtgcagtcttggctcgctgcaacctccacctcccagtttcaagtgattctcctgcctcagcctcctgcatagctgggactacagatgcgagccaccacgcctggctaatttttgtatttttagtagagatggggtttagccgttttggccaagctgttctcaaactcatgacctcaagtgatccaaccacctcagcctcccaaagtgctgggattacaggcatgagccaccatgtccagcctatttcatttttttctaactccacaaagtggacatttttgtaattattttatgctatcagtgcttattaaatccacttctgtgtttacatatttctttgctcaccattcttacttgaatcttagacttttttttctgagattatttttcttgtttttgaagaacatcctttagaattcccttaggtgagagtctgttagctataaatgctctcaattttcatctgaaaatgtgtcttttaaaccttatacttgaaagatagtcaaggttgacagttatttttttattagtactttgagatgttgttccatcgccttctggctttagttattggtattgacatattagctgcccatctacttcatcattcatccatcttctgtctagtgatcagcagttttgctaccaaaaatgtttggtgtagatttctttttatttatcatgcttgggttgggggagcttccagaatctgaggattgtgtctttcatcaagtctagaaattttccattttcttctagaactctaattagacatatttaaatccttgttccttgtctatgtctcttagcctctttcatattttccaccactttgtcctcctgtgctccatcctgggtaaattcttcaaatctattgttcaccccagtagttgtctcttcagccatattaatctgctgtttatttttatgtatgtatttatttatttatttttgagacagagtctcactctcacccaggccggagtgcagtggcacaatctcgactcactgcaatctctgcctcctgggttcaagcaattcttgtgctacagcctcctgagtagctgggactacaggcatgtgccacctcacctggctaatttttgtatttttaatagagacagggtttcactgtgttagccaggctagtcttgaactcctggcctcaagccatcagactgccttagcttcccaaagtgctgagccttaatctactgtttaatctgtacactgggcttctattttcaaaaattatgtttttacataactgcttgctttttttccctcaatcttcctggtcactttaaatagtctcttgttccttatctatactttcaattaccaacttttaattcttgaagcatatgaaacatccttattttatattatatatactgcaattccaacatctgagatgtgttcgaaggtctgcatttttagtttattgcttggtgctcctctcacctaaagcaccttgtgtcctgtgttttatgatttttctgttttacaaacatgtgaactcatgttccatgggagtttttctgtgggatttctttgagtcatgaatataggatgagttactccagagacaatttttatcatttgtttctgccacgtgcctaaggagctattatttaccttactttaaattcttatcttatctttttgtttgtttgttttttgtgtggttgtttttgccacaaagtcaccatgagtttcacctccaggcctattagtgggtagacttgtggtgaggggcattcagggttgacatttatttttctcccactcagagtccatactgagttgggcaagctctgtgtcagctcgctttaaggaatttttctctccgagttctccactgtggatgttgtatttcagtgctctttgtttaaggcagaaattttggattttgtttttcacttcgattttgtttctcagctttaacttttgtccatgttcataagactgaagctcttggtcaactggatcaacagatacttctctgctggctgtgatctctttggatttttgttgtctttatatattaacatatacaaggtctcactctgttgcccaggctggagtacagcagtgcaatcttggcttattaaagccttgacctcctgggctcaagcgatcctcccacctcagcctcctgagtagctgagaccgcaggtgtgtgccaccaaacctggctaattttttgcaccttttgcagagagagggtttcaccatgttgcccaggcttattgtcgtttttgatctctgatgattttcttcatttctcaccacctcagctacacattttaaaagatggtttacaatatttttgtggtgttttgtattaggagaattcttcagcatctgctgtctaccatattgtcagaaatggagtctagccatccttcccggcccatttcaaacgggttcctcttaggaccaggagacctcacattatgtgtgtcctaccttggcctgtggtttggtcacttgtgtgtgtgtgaacttcatcctccttgagggcaggaatatggtttcctctctttcacttccacagagtcctgtccagagttctgcacaccaagactgtgtaaatgaatggaattgcatctgggagctcgaggcacccatgcaaacctgtgctgccagtgacttccaccagagggcagcggcagcaggtgccggcgctggggcaggactgggaggagtctcactctgggggcgcctggttccccgtggctctaatacttgccgcatcaaatgcatacacccacatttaggaccgaacccaatggaggaggaccgctcctcattccacatgttggggaaatgaagacaagcaaggatgcaggaagtggagggccaggagaggtggacctgggatgggaccaattgaggcagggccaggatttggaaccaaaccccttctggatttgaccacttccagggccctgcttggacaaccaaattatctattccttttctcattcaataaacatttattcacctcctaccatatgctccacagggagtaccatgggaattaaacacgcttggcccctgccttcttcctatagcgtcagtctgctgcagtgcaatggggcaactcggggtttctcaggcagccctgggcttccttccttcagccctttgctcctgctattccttctggcccagaggcctcccatgattgctgtttgtcaaaatcctgctcagccttgtagacccagctcccatgcctgactcccacggaggcatgcccagtctggtacctggagatgggatagctggccccactgtgccatctgacggggcggctcccacaaggccttggcacccttccctgtagaaggacttgtgggatggccatctctcaggcccttcccaatttatatttctctgaggggagacttaggctcttatctccaaaagtgcatcaagaccacaccctccttcccaaccaccattgcacctaaggttaagataaaactcaggatttaatccaagagagccaaattacacggaccgggacaggcaatgggtcattcactccctcttccaatatgtactgattgagcagctactacattatcaattttttcttctgggccaccagaaatgaggcatggctcttccacttcccttcttcttagaagaccctcggggaagtgtgtctgcatggatgcgtgtgcatgcgtgtgtctggctccgtgactcttggggtgcagcctggatgggtgggctcccagcacaggcagctggggctctccccaccagcccctgtaacagcagcccagcttcctgcagaccaaaaccacaagcagaacaagcaggcgtgagacactcacaggttgggtttgatcgcatgcgtgtcggagaggagagagcagagagagacacaggaacaagaacagcaaagggtagagcagacctgcgccaggggcgcacaacggccgtgtccacctcccggccccaagatggtgcttcccacaggcagccacgcgtagcagccagagacagctccagacatgtggctcttcttcgggatcactggattgctgacggcagccctctcaggtaggcccccttccctcatctcctgccactggtgctggaggagccgggtccggccctctcagtcccctttctggttgtttccttgtggtcacttttctaggatcttttagccaagactacactcaggtaccagggaggtccagcatctggggctaggagaggacacaggagcccctcgaggggctggggctgtgcctggaagcctcctggagtgacagaatgtgggaagcatgctttgtgccttaccaatgggtccctagggtgtgaggagggaggtgcctctcccatccttaagctcaggaactcccccatttcctatttcttgccaactcttaagaaggaaccgttcaccttccagagaggcaggaccactgatggtggtactttcaacgccaaagctgaggcttggggtccagcaggcgtaggccaatcacaggagagcacctcccgaaacaggactcagggaagccagggagagttctggacaaccaggcgctgatggcctcagcacaaccagctggggtagtctagggcataagcgagcatgaaggccacccccacgtctcaagctgcccccaagtgtcaaggcacctggccacctgggccagggaatcagatggccagaaggtttggggcactagactgtgctccccagatacttgctggcccctgttgagtgcagggtccaagctggccagagcggggcaggggcctggagatgcaagagatcctgaccccatcgagctctcacattttgggatttgggaagactggtatggaaacagaattcgggccaggggagtctgggtccaccttgcagccagagagccaagtgctttcattttgtgatggaggagacccaggaagacccagtcaggagggggcatcgagctggtttggaggactgggtacatgtcgcgagactctgggcagggagtgctctcctctctgccttgatctccaggcatgtgttccgagcctgtggcctcatactggttcagggaaagccattcggctctgggaactggagtttgtgtgccttcagctctgtgcatgtagctttgccctgctaactctaccaggagtttctggagcagcagctctggaatttcagctgccttctgcccctgagctgaaacagactgtccgagagtggccccctttcctcttccccatgaagccc[450 bp omitted]ccataagtgaaaggtaaagggaaacataaaaacaaatggtggcaaaacccaatttctattacgctttagcaaaaagtgaaaagatcgtgaagacccagagctcatcccctctgtgaaaggggtgatgaggaggggagaggagatggcctcctagctctagcaggtattttcttcttgactttgcagaaggactgaaaacaccgtgggcagggaataatttcctcactctgcgatttcagagcattaaacgcggcttctgtaaactctcctgagggttgccaggggtgtatgtcctactgctgaaaaatatggcctctccaggcaggaggaagactgcaccttcaagcagccccttgcccctctccggggctgatgcaagggacactgagctgctacactccaggcctccctgagcttttcttcctctgtgtccagctcagcaggcccaaatgctagcagaacctgacctcagagggcaaggttgacccacatctgcttgtggggagtttgtgttgggccgaccatattggggaaaggagactaggacctccaaggagaaaaagaaggagaaagaaaaatgatggcaaagagggaggaaatggagctgggataatgaagtgcgtgtggaagtttcaggcctttaccccaagaactatttcagggtggggctgcctggctctgccctgggaccacaggcaggtggaatcctgccctcctttgccctggcagacctggctgaaaccttgctgtgctcgggcagacctcccctctccttcttcccccttttattttttaagacagagtctcgctctgttgccaggcttgagtagctgggatgacaggcatgcgccacgacgcccagctaatttttgtatttttagtagagacgtggtttcgccacgttggccaggatggtctcaatctcctgacctcgtgatccacccacctcagcctcccaaagtgctgggattacaggagtgagccaccgcgcccagcctccttcttccctttctaaccctagcacgaggccctatctcctgggcctctgcccaggtggcccgggtgctgggcctggcttggtttgtgttgctgatttctgttgcttagagattcaagcctccagttctccgcctcagtttcctgatcagccaactaaggatgaaggaacagagagaatgaattaggagcccttgacaggggaggctggggtggcatcatgagaccccaggttctgccctggtcccgtctctaattcaccattgactgtgcttcttttcttctcagccatgttttctcatcagtggaaggggggtgctctgtcagacaatctataagaaagcttttgtccagatctgacactatgacgcagtaacaaagccccaggcctttcccgccagggcagtgctgagctccgtgactctaatgccagctgtgctctggctggcgaggtcctcgagggctgcctttgtgtatgaaaaggctgtttgtggctacttttgaaaaaaatagtaattctttaattaacaattttttaataatttgttttttcttaacttgtgagttcaacatactaatcatattttattttataagccctgtaattttgattaatgactttcgatgggcctttaatatttgagcaaatgaagttgaacagacctagcatccttaaataataaatacccttacaaatgtagctaatcaaactcccttggttctgtgctattccatagggtagcccctacaatcacgcatttaaaatgtgatgatagtccaaattgagatgtgtaaagtgtaaaatatgcaacaggttttgaagatgagtttcaagaaagaatgtaaaatatttcaacaaattttatgtgatttatatgtcgaacttataatatttttgatatgatgggctaaatgaattctattatcacaattaagtttacatattcctttttactttttaaaaatggggtttctggtctggtgtggtagttcacacctgtaatcccagcactttgggaggccaaggcaggaagatcgcttgaacctaggagttcaagaccagctggggaaacatggcaaaaccccgtatctccaaaaaatacaaaattagcctgaagtggtggtacaagcctgttgtcccagctactcggaaggctgaggtaggaggatggtttgagcccgggagtttgaggctgcaatgaatgagccattattgtgccacttcactccagtctgggcgatgaaggagaccctgtctcaataaaaaagtagggggagggttgtcctggaatatttaaaattacatgcgtaacttgcatcatatttatattggataacactgcttttgatattctaagcacatttataaatatgatgaattccatattttatagagcatgaaacaaaatgttcccaagaattttagaaaatgcttttagaactaaaaaactagcataagtgaagtgaatattaagttatttttaaaatttttatagatatgagggtagaagtgcagttttgttacacggatatattacgtagtggtgaagtctgggattatagtgtacccagcactggagtgttgtacattgtacccaataagtaattttcattcctcactcccctcccatcttcccaccttttggaatctctgatgtctgttactccattctgtatgtccatgtgtgcacgttgtttggctcctacttataagtgagaatgtggtgtttgactttctgtttctgagttattaaagcgaatatcaagttctcttaaatattctaatgtttacagatattgtcaaattctcttaaattttctacttcaaaattgaacctaagtcaattacctgctcacattcatgaggaactcaatggccaaatgtttttaaatatcacaaatataggactttatgcaactcacggagcttgacccaacttacatttaacaccattggatatatactatgagtgtttgtttatttaatcatctctattttctaaattctaatcttcctgggtttaaaagccacttaccaaggaggaaacaatggcgccattgcaggtaacttgggttatgccaagcaggttgaagtttttccatctcagtggactgagctgaggtcggtgtttttgttgttttgccaaaacataagatatggttcccctgtgttgctgatggatgcgcttgtgccctttttgatagtccgtgccctctaactgggctggctccttgacctatgaactctgaatccaagttatacaaacctaatcccctacatctgccgtgcatctggccttattgtttgattggactgaattaaacacacatgtttacttttctattctgacctcttttcacattcttcctgcctggcaagacttcatctcatagatacataaataatttatgacaggcttctgcatctttctcccggcttagcttggctctctggccacaggtcaatgactgatgacagttagcgtggccttcaccgtattggggccatggaacggggtagctcctagggtgctggagctcgaactttacagagggatctagaatgagtgagaaatgctgcccatggccctcctcattcagaccacatttattaaggctttatttattatatttatagaacactcaagaattaaattcagtacccagctgttagattctgagttaaggaatcagacttctccctggggcaaggaggaataaacaggtggccccaactgtcctttaggacaggagcttggagtgtagacctcccaggtgcgtggccatcctctccctgcctggaccacagatgggacaccatgagctttaacatccatgccatgtgctcaggcctgccctgagcagccccctggtagggctgggatccccaggctgtatctacttcctcagctagcaagacctccaggccctccatcctgtcctcggcactggcccttctccagactcagagcatggtaagttatccagcatagctcttcccggagcactttattccagcccaccttcccagtgttggccaaggtgtcatccacctgacaatttacttaacgtaatttccctcctttttctttctttcttttctttttttttagatggagtctcgctctgtcgcccaggctagaatgcagtggtgcagctcactgcagcttcaaactcctgggctcaagggatcctcccacctcagcctcccaaatagctgggattacaggcgcctgacaccatgcctggctactctttcttaattgatgttttaaaatgcaaatacatttattttgagaagaaactttatatatcactcccttaaatggaaagccattcattataaatcaccatcatgattataatggtgaaaataaacataatggaaataaaacaatgttactaaattctagccagatgcatttgctgctttccctttcctcaaaagggagggctgtagatgtcagagagactttaaagactaaccccatgggagatttcctcctccaagtctgtaattagaaaggctgaaagggaaataaagagtatgcataacttcctcatcatgtaatatagtggtatataatgccaagtcaatgaccacctaaatcaattttgcatagttttgtgtatgtgccctagactttgaaaacactgatccagagaaaggacaaagggggtgggcatggtgtcccctgacaagactgagcctggggacgctgactgctctgcagcctggggttacgtcctacacatgagacccccatttcaggggctccccagtaccctgagaagtccctggattttcccagtgagccctgaggttggggggcacccgagttcacctcccttgattccgctctgggaatctaggcccctgcagcctggggaggagaaggaaccttgaggaggggtgaggtgggtgtggactttgagaactagctctggtcctaacttgctggggaatcttggtcaagttccttcctttctctggccctagtttcctttctggaaaactgggtaaattgaacactaaggacccagcctaaacatgcttgtactttatgtatgttccttgaggctttacaggttatggagcagggcatctggctgtacgcagcagagacccagccactagacacttagccctaggaagggcactgtatcaaccccagccggcatcctgtcgtatagaatcatggaccccggagtcaggcagacgcgggttctgaattgcatctctgcatggccccagggtggtttctttgcctgcatgctagagataaaaatccccaactcaccaaagtgtacaagttaatgtagatgatgcatctgaaaatagccgaacaaaatgcagtgctcagaaatgttagcttataaatgctctacagcaagaccaaagataatcccttgcctatgtgaatacaggactcggtggttaacatagtgctgtttgcacaatgagctccatcacccacatggtgacctcattttatagatgaggaaactgaggtttagcgaggctaagagacttgtcaggacctgagcttgggtctcccagccagcaggctggtgctttttccattgtgtgggagttgcctggcttgtttccagccagctgtcctgtgggctctattctagcatagggtttctcccctaaatgcaaactcctagccttgcagcctcaccactgaatctaggaacagccctgagggacctctgaggtcctagggaccctggaagtcttcttagcaacagatggggtcaagtgtggctgcctccctcatcatggcacgccctcatggggtttgcctgggggttgccctgcaccttggggccaggaggaaggcaaaattaaagaggcaccatgagccaggggagagcttgctgggcagcaggctccatattttgttttgttttcttttttttttttttctttttgagacggagtctcagtctgttacccaagctggagtgcaatgctgcgatctcagctcactgcaacctccgcctcccaggttcaagcaattctcctgcctcagcctcccgagtaaggggaccataggcacccaccaccatgcccagctaatttttttgtatttttagtagagacggggtttcaccattttggcaaggctggtcttgaattcctgacctcaggtgatccacccgcccgcctcagcctcccaaagtgctgggattacaggtgtgagccactgtgcctggcctaggctccatattttcatattcattcagtacctgctgagtaccaggccctgtgctggcactgccataggacatgaaggtttgcccttgaacagtttatagtgttgtggtaagacacaccagcaccaccccgggataggtgtggcaacaggcacaatccagtgacagctgcaaccaccacccattaccagggacttaatattctccaagcaccagctatgcatatgctgttccaccctgacaacaccaggacaatcaccccttttttatgggtggagaaactgaggctcagaaagttatgtattttgtcccaggttggtggctaatgctgaatttaaatccatgtcatgatatgtcaccactgggggaagctgactgatgggtacacaggatttctcttcactattttggcaacttcttatgagtccatagtttgaaaataagaagttaagggggaaaaaaggatttcagccctttctggtgactcacacctgtaattcagcacgttgggaggccgaagtccaagagttccagagcagcataggcaacatagtgtgacccccacgtttacaaaaaattaaaaagttagccggatgtgagattcatgcctgtagtcccagctactcgggaggctgaggcagagaatgacttgagcccaggaggttgaggctgcagtgagccatgatctcaccactgcactccagcctggacaacggagcaagaccttgtctcaaaaaagaaaaaaaaaagtatttcagaaagaaggacccatttgaaggccgggtgcagtggctcacgcctgtaatcccaacactttgggaggtcaagtagggcggatcacttgaggtcaggagtccgagaccagcctggccaatatggcgaaaccccgtccctagtaaagaaatacaaaaattagccgggtgtggttcgggggatggggggcacctgtaatcccagctacccgcaaggctgagggaagagaatcgcttgaaaccgggaggcggaagttacagtgacccaagatcgcaccactgcacttcagcctatgcaacagagtgagactctgtttcaaaataattaattaattaattaaattgaaagaaagacccatttgagcagaaacctggaggtgggacagcctacgagggcccggctgaggggaggtgctgaccagccagtccggctggtcctgttgggtcatgttgggtaggcaggactgaaattcccaaaggagctgaggtccaggctcttttctgcctcctgacccagactggtgtgccatgaggattcaatgagcgccaagcacagggactggcccacggaaggtgcgccacaaaatgtacatttacaagtgttaggcaggcagtacaaggatcacgtcctccagtgcagcactctgcaaatacgtaaacctgccttctcctcgtcacagccctaaggaggtatgcgctactatttaatacttccattttactgagtaagtgacaggctcagagagataaagtgacttttcctagatcgcaccactaatagatgacagatacttggttttacctcatgactccaaatccgttgctttttcccagccctggaattgggtagggtttgggccggggacccctccccactcaagactcctgcaggaaaggtccgcccttcccccagggacttttcacctcacccaccatcagctgggccgtcatggaactttatggagcctgagctctcctccttcaggctgagtggccatgcccagccttcgtttccccggctgtaaagcagggccaacgggagctcagagctgtgtggggctccccagatgttggcggtgacatgcttggagaaatgccaggctccttagggtgttaggagagacctgtggccacagctgctgctccgactgggaccgggcaggcgctcccagggacaacagacggaggcagagggaagcccaggttcccaccctccattttgtaggctcctgcagcccgaacgccttctgcctgaaaatggcggctgagagaggccaggaggcaggatgcagggctgaggaggaagctccggggctgggtctctggtccctgggagatgctgagagatagggagatggccctgtcataggaatgtggtcccctgttttcccttgtatggaagggtgcccctgggtctccaccgtgtgctagggggtgggggcacactcaaaagtccggccaataagtgtccaggccacccccaatctccatcaggaccctgagctgggctgaggtctccgggaggtgccagcagatgccagggtggcgggggggggggttctgtgcatggggctggggacagcagatgcccgggtggggggcggtctgtgcatggggctggggaccagggtcatgtggggacacaggctgtaagagtgacgaggggccttggggctaggggcttcttgggggtcccatctgaggacctcacttctgacttggagtcatgtactgagccctgtggcagggagaaggcagaaatgaagtcactgtgtcctcggagtcagatgcaaagccaagcgtgactctgttcattttacagaaggacagactgaagcccaagagcttaagtaacgccgccagtggctgacagagctgggagcagagtcacttctggtcactggggtttggagggaggatgtttatctgcacttcagtaccctttttgctagggtgttcacctctttcaggaggggtgcctgggagcaggcgggcgcggggagacagagctgaggaagccccccaggcctggaggaggcccgttccccactccatttggtgtgctctcgttttgcctccctccctccttcaaccaaactaaaggatgcacagttgccaaatggattcagctccttggagaaatatgttgctttgccgggatgggattctagaagtatgacaatgtctgagctggaagaaaccccagcgagctgccagccatctcctgtttgtcagaggaggaaagcgaggtgcgaagtggggaacgacatgccccagggtcttggagcagggctgagaagcccagtctgcagggactctttccagggcctcttcccacgctgcccagcagggcatggcggggcctgtgtgaaccaggcacaggcttaactaactccccacccccacccctagagagaatgcgggggactgctatggcccagtgtggcctgacatggtctgacatgaacacaggtgaccctgggcagtgacatgctggcttcatgtagctactctgcccagcccctccaacggctcctccagtcctcaggctctgcctcctctttgtttttttacttcactttttttttttttttgacggagtctcactcttgttgcccaggttggagtgcagtgttgtgatctcggctcactgcaacctccacctcccaggttcaagcgagtctcgtgcctcagcctcccgagtagctgggactacagtcccgcaccaccacgctagtttttgtatttttagtagagacggggtttcaccatgttggtcaggctggtctttaactcctgacctcaagcgatcctcctgcctcagcttcccaaagtgctgggattacagacgcgagccactgcacctggcctgttttttcacttaacttttaatttcaggctaatttcagacttactgagaagttgcaagaacaatacaaagaatttccccatgctcttccctcagactctccaactgctaacaattttccacatttgctttattatttcctctcaatgtgtctgtttttctattgctttccccctaaactgtttgagagaaggttgtaatgtccctttctcctaaataccccaacgtgtgtttttgttgttgttttttttttttacatacggacattttcttacataaccacagtgtacttatcaaaaccagataattaatgctgatacaattctattggataatcgacagaatttattcagattttgccaatggttccaataatatcttctaagacaaaagaaattttgttcagtatgctgcgtttaattctcgtctctctattctccttgaatctggaatgatttctcagattttctttctctttcatgtcattgatctttttgaagcatagagcagttattctgtaaaatggccctcatctgggttgtctgatggttcttcatggttccatttaagtcatgcctgtttggcaggaatatcacagaagcacgttttgtccttcccagtgaatcatatcaggaggcacatgggctctccatgtcccctctccggtggtctaacttgcttggctaaggtgttgtctgctagatttctctgctgtaaagataatttcctcctttgtaattaacatgtatcttgtgggtagattctttgagaatatgtaaatatcttactcttcctcaaacctttgcccactagttgtaacattattgttgattcttgccggaatcagttattataaggatggttacctggtggtgatattataattccaccattccttcttcattaatagttgctgactcggctctctttgctgcctccgtgggagggaggcaggtggctcagtgcatggcaggctggtactaatgaggccaaggtttgagctccctttccactgtgcctctggtggctgctgtcttgccccgcctcggatattggagtccgggtcagcacctctccaccttagggctagttctccctccatctttacagttttgccattcatttgttgagctactagtatgtgttaggcactttttttcagccactgaggatacgggacaaagtcccggtcttcaagaagcttctattctaatagggaaaatagaccaaaaacataaacacatttttaaaatagtatcatttcagagagggatatgtgcaccaagggaaatcaggcaaagtaaggggactgagagcggttgcactggagacacaggcagaacctcggaggggatatagacctgagtgatgagatgagctgggaatgctgagatcagggagaggacattcccgtcagggggaggagcaggggcggaggccctgaggcaggaatgagattgatttcagactgatggaggagtgaaggagatggagttggagaggctggcagggcttgagggcatagataatagggtttggaattaatccaagggaaatgggagctcatcagagagttttaggtgtagaaggatgtgatttcatttgcccttcatgcatatacaattacttaagaattttgtacatcaactcctttttttctttttttaaacaaagatatagaacgcttcacgaattcacgtgtcatacctgtacaggggtcattctaatcttctctgtattgttccagttttcgtatatgtaccgccgaagcttgcacccactccttttttttttttttttttttttttttgagactgagtttcgctcttgtcgctcaggctggagtgcaatggtgccatcttggctcactgcaacctctgcctcccgggttcaagtgattctcctgcctcagcctcccaagtagctgggattacaggcatgcaccaccattgcctggctaatttttgtatttttagtagagacggggtttcgccatgttagccaggctggtctcaaactcctggcctcaggtgatctgcccgtctcagcctcccagagtgctgggattacaggtataagccaccgcacccggccaccctctccttttataaacttaagtttatttgaacttagaaatctgtcactatcatgtatctcaaaccaatactacttaagtaaatagaatatatatatataaacaaagaaaacactgaaaccaaaagtgtcattaaatagcctgccgtccaagcatgagctgtctctccattcattaagaagtgttaggtggccaggcacagtggctgatgcctgtcatgccagcactttgggaggccaagacaggcaggttgcttgagcccaggagttcaagagcatcctgggcaacattgcatgtccccatctctgcaaaaataaaatttaacaaaaagtgttaggtgttaaagactaagtagcagcacaatgagactttctccttaatgcagtcggacagaaaaattggaaaaggaataatttgtttactgcatgattcagttccatttaatcttatatgttaaactgtctttctgactcagacctgatttgagaagcattttgctaactggtggaaggatttgacaggcccagcccacccatttaaccatggagaaactgaggccttggaacggggcaaggacttacccaaggtcctggtaatagctgctctccattctactcaccctcggtatcactcccacccaatgctagctgaaaattcagatgtgatgtaaacattagtcatccttattgtaaaaacgttataacaaccacattagaaggaatgcaaagagagaaaagaagtctcagccagcaccttcacacaacccggctgtttgttcttgaaggaggaagtttttgagtctgtggagcgtcatgggccttcagtctcaccagcaggaaggtgggtggctgatgggtgccgggctggtgttgatccacacttgtcaggtggctctgagaccagccttgactccaggctccaccacttccgccatgaccttgggcaagttcccaaagctctctgaggtaaaatgggtgtggccatgtcactcttcagcttttgcgctctaggtagatgctaaagccttccctgaagatctctatggaacttttagtcacctgcatctgtgggggctgcctcagccctaaccatgtcaacatagtgttgaaattcagttccgagaaacacttgtgggtttgtagactctatggcatctggaagtgaaagagggacacatctctccctcttacgggttccttcccccgctctcaacgcccctaatccagaatgccctagaagctcttctcagctcccaccttctgccccggaggcagcttttgttgcaggtacacctgtggtttagtttactagagttgctgcaacaaactgagtggccagggcaacagaaatgtattgtctctccctggcgccgtggcgcacagctgtaatccctgcactttgggaggctgaggcgggcagatcacctgaggtcaggagttcaagaccagcctggccaacgtggtgaaaccccgtctctactaaaaatacaaaaactagttgggtgaggtggcacgcgcctgtaatcccggctactcaggaggctcaggcaagggaatcgcttgaacctgggaggcagaggttgcagtgagccgagatggcaccacagtgcgagactccatctcaaaaaaacaaaaacaaaaacaaaaaaaccagaaatgtattgtctcacagttctggaggctcaaagtccaagatcaaagagtcagtgggactggttccttctgagaagctgttctcttctgagcttctggtggcttgctggcaatcttgggcatttcttgacttatagaaacattgccccaatctccgccttatcttaaaatggtgttcttatgtgcatgtgcctgtgtccaaatttcccacttctgtgaggacaacagtcatattgaattggggcctgccctgatggcctcatgctaacttgattgcccctataaagaccctatttccaaataagctcacattctggggtactggaaattaggactgttttaagaggaggggaacaattcaacaactcgtagcaatgtatgtagtgtgtatagggtgtgtgtgtagggtgtgtgtgtgtacatgtatgtatgtgtgtgtggtgtgtgtgtatggtgggggggtatggagaaagaggtgggtcactgccctacttaatctctcctcctagcccactcatcctctggagagatgcaagttagatatctcaggttatttggcaaaggcctggaaagaggtatctttccatcgatttcttacccctgagaactcctactcatcctctaaaacccttcccaattgtcccctgtttcttggagtcagttattccctcctaactctgttttttttccagagtacttagttccaagcccaaggatagcatttataactgatcgtaatcaaccacgagtgcatctgtatcctccaccagggcatggggcctggcccagagcctagctgagagaatggaatgaatgagtggcatctccctgaccaagggttaagatagatgggaactcagaaggactttgagccgcctcagaagcatcctgtaagtgacttgtgaagaggagtaggggacagccgtgtgggctgagagctgagagtgtgagatcagattagagagactggaagtctggctccgcctcttagtaactgtggccttgggcaagtcatttcatgctgcggagcctcagttttctcatctggaacactgagccttcacaggctcctcatggagatgaataagacggtgcgtgctgtatacataaagctggggcacacagtgggcattcagatgttaccttccttccaaggaacccatatttttttcctgaatttgaattcctgaatccactggcactctgagccacgtagatccacatggccattggccgctgtcagcccccagctgttaaggacgcaaggtggccacaaagcattagtctgaacatccctggtgcctcccccaggttctctttgaatctggatttatttaaagagaggaggtgagtggtaggtgaggagggggctgttgttaggacatggatgggcacaggacatgtgtctggtgagcgtagctgccagggccggtccctgacaccccaaggagactttctggtcccagcccagcctacactcccacctgctctggagaggctgtgtttccttccaaggatggatgctgatgatgtctgatggcttctggatgtctgatctcaagggggccttctcttagggggctttaggccaccctggaaaggtctcagcatcaccccttggagcggggaggattttcaccccttgcccacacacaagctaaaactgcttctgctgcagctctgggagacctagaaccagggcccctcctgagagccagtgggtgggggcaggccccctggaaaatcgctgagagctcagcagtttcagccttcactcccctcctcactcccctcctccagcctgcagaaacctagcccagcctttgcacagagggtcttgctctggggaattctattcttgaatttaataccttgagtgtctagcctggcccaccagcttctgtcccacctccaggtgtttgctcgagctgtgccctctccctagaatgccttcttaactcttgctacttgttgagggcgcctgaagagtagaaagagtgaatctggggaacaaattcaaatttggatttgaattctggctctatcaatgccaggctatgtgaccgtgggctaggaacttaatttccctgagcctctttgtaaaatgggtttcataatagtgtctcctcacaaggtagccatgaggcaacgtctgtaaagcactcagcacagaggaagcactcggcacagaggaagtcctcgggaaatgtggatctgcttcccttgcctcagcgaaatgctccttgactttgaagtcctggcccaaagggcacctccccggcaataccttcctggactcactcaccagccccaccacttgcagagcagccctgtccctcctccaggttcctcaagcatgtctcctgcctctgcacctacctcagagagacaacattcgagtcagctcttaacatctggcctccaggctggaccacgggctctattacctttactttccacggcagagcgcagcatggctcaagaaatgctgcgggaggtgaagtgagttctagggacttccattaataataagagtaactagaatttgttgagcattcacagcacaccctgaggtgtttatcagagcccaggaaaccctctttctgggttcaaatccctgctctgcctcttaggggctctattgtcccagaaagttccttgtctcttgaatcctacatttccccgcctgcacgatagtgataataacagtgcttacttctgagcattgttaaggagattcaagaatttaaaactataaaaacccatggctttcttacccagagaagggcagaaaaatcgttggcagggtgcattgatatgactcggacaatttacaaaggtttttcatatatgcttttattttaaaatttttttgtttttattttgttttattttattttactaaaattttatttagtaaaaatagtacagaatttagaaaatacaaaaacagaaaaatttaaaaatttatcaatagctaccttcaaagataactgttgttactagcctcttgtagaatcttccagacatttcgttagagaggaatattgcaaacatacagaaatgcattgagaatgacatttgtttatttgtttatttgcttttgagatggtgtctcgcactgtcacccaggctggagtgcagtggtgcaatctcggctcactgcaacctttgcctcctgggttcaagtgattctcctgtctcagcctcccaagtagctgggactacaggcacacaccaccacacccggctaatttttgtatttcagtagagatggggtttcaccatgttggtcacactggtcttgaactcctgatctcaagtgatccacttgcctcggccttccaaagtgctgggattacaggcgtgagccaccgcgcctggcctgagaatgttttaatgaacccaatgcgtcctcaccacccagacttagaaaatgtttacacttttgccgtatttgctcagatctatattaataagaaagaaaaccatacagatactgttgaaataattcttatcctttcctccctagaacacacactccaaagtgtggtgtgtgtacccttttctcccacatttttatactcctattacacaaaaagtgtctccatacacaatggatggtattgagacatgtactatattttatataaattgtaccctactggacatattgttctgaaacttattatacttttctccttgttttcaaaatctaaccaagtggatagatatgcatctagttcattcctgcaatggaataatccagcctatgatacaatacagtctgtttatttccagctgatggatggttagagtacttctaattttcttctgttacaaacagttccgcagaaagtatccctgcacacatctgcatgtgaacaattttttctataatttatacaaaagggtatagctttcagatcaaggtatgagcctcttgaaatctatgaggtatcatcagccatttccttttctttctttctttcttttcttttctttttctttcttttttttttttttttttgagacggagtttcactcttgttgtccaggctggagtgcaatggctaaatctcggctcaccgcaacctccacctcctgggttcaagcgattctcctgcctcagcctctcgagtagctaggattgcaggcatgcgccaccatgcctggctaattgttttgtatttttagtagagacagggcttctccatgttggtcaggctgatcttgaactcccaacctcaggtgatacacccgcctcagcctcccaaagtgctgtgattacaggcgtgagccccgcgtttggcctcatcagccatttttctctgcacaatatccataaggctatgatcatcctgaatatgttgtttttcatctgttttttccatctacgatacatatatgcacacatattcatctttcacgtatttgcaggtatagtcattgattccacaagatcttgggcatttgccatgggccaggtattgggggtttttatggtaatctttccttagccctgtgaggtttttgtttcgttttcattttagaggtggaatctcaccctgttgcccaggctggagtgcagtgatgatcatagcttactgcaacctcgaactcctgggctcaagtgatcctcctgcctcagcctcctcagtagctagaattacaagcatgtgtccagctaatttacttatttatttattcatatatatctatatatatgtatatatatatgtatatatatctatagagagagagacaaaggatctcactctgttgcccaggctggagtgcagtggcaccatcttggctcactgcagcctcaaactcctcggcccaagtgatccaacctcagcctctcgactagctgggaccacaggtgcacaccaccatgtccagctaattttttgaattttggtagagacaaggttttgccttgttgcttaagctggtctcaaattcctgcgctcaagcaatccacccaccttggcctcccaaagtgctgggattacagcgtgagccacagcacccagcctcatttttttatttttaaatttattttgtagagatagggtctcactgtgttgcccaggctgttctcaaactcctggcctcaagcaatcctcctgcctcagccactgaaagtgctgggattacaagtgtgaaccactgtgcccagcttgtgaggctttttttttttatatataactatgaggtgagggaggcaaggggggcatgtgaagagattcgcccagggtcacactatagtaaggaggaagctgggtttctaacccaggcatgtttaatttcaatccagtgttctttctgatgcctatgatgtggtagatggttttttcccaaccaagacctactgaatgggaattctaaaagagggacctgagggccgggcgctgtggctcacacctgtaatcccagcactttgggaggccaaggtgagcagactacctgaggtcaggagttcaagaccagcctggccaacatggtgaaacccggtctctactaaaaatacaaaaattagccgagcatggtggcgtgcacctgtaatcccagctattagggagactgaggcaggagaatcactagaacttgggaggcagaggttgcagtgaaccaagatcgtgccactacactccagcctcggcgacagtgtgagactccgtctccaaaaataaaaaaaaataaaaaaattaaaattaaaataaataaataaataaaagaagcacctgaatattcttctcctcctctcagtggtctaaagtctggcgggggatcaagaagatggggctggtgacatgccagtgtttctggcctgctgtgctctcttggagccaaatccctactcttatcccttgggattttactgagctgcttgcaaccctccatgggaccttctcattttaccacctggtagctggaaagaaggcacggtctggcacgggagcctgagccagccttggagccaggaccccaggagacttttcttttagaggaactcctgttaccacagcaactacagcccacatctcctccctaggaacactggatgtttgcagagccggggaagggtgcagccaagttgagagtctgcagcagctcagataaggttcacaagaaaggcgaggagtgaggaggagagaatgcagccttcagagaaccagaatcacccccttgcagaaaagaaggctaaggagctgtcagagtcatctttctgcctggtatggaatgtagaatcaatagccagctgccgtcccatagctaccaagggccaaacgagagaaaagggatgaaagcctcaggttggaggataataacaaccacagctaccatataccgcgtcctaagcgttttacgaagatcacccacccgtgcactcttcttctgtttggctcatttatcatgcccagtgccaggttaaagatgaaacctagctgggctcagtgactttccctaggtcacacagccagtaatcagcagagatgggtttagatcactgttctatctgtccccagagtccctgtctaagtcatgaaagacgaatttcccgagaatggaggctgtttcccagatgaattggtgcctgggatctcctgctccctcgatcatcccgctcacactcatctccctcatatcatacctgccccagttcccagcatatgcaacaagttcagcagatgttcatggaactgaatgcaggctggcaacagactcatttctcagctttcaggagaacatggctcacgccctctcactttcttgggagaggagggggagtcccagcaattgaacgtacctcaaagcctgttaagtcatgttgatcttatcttttaagttttttacagaggcgagtaggaaacgttgtcttttacttccccttggatttggtgacagagaggaggggagatgaaacctgggcatgcatggaaggtatcacacaggtgaacatcatctgtcctgtgacataggggcaaaagaaaggtaaaaaggctgaatttctggccgggcgcggtggctcatgcctgtaatcccagcactttgggaggctgaggcagggggattgcttgagcttaggagtttgcgaccagcctgggcaacacggtgaaaccctgtctctagtaaaatacaaaaaattagccaggcgtggtggcacacacctgtagtcccagctactcaggaggctgaggcaggagaattgcttgaacctgggaggcggaggttgcagtaagccgagatcgtgccactgcagtccagcctgggcaacagagtgagactcatcccctccccaacacccccgccaaaaaaaaaaaaaagctgaatttctttgacctgagtgactgcagtcctctgggactgggactctttgagccttaacttccatccgtctctgtcaattgagtaaattgttttatttgtgtccccaagccctgctgtggtataactggggagtgtgaaaacaaaccaaaatcctgtaacataataccaaataatactcactctctttctctttctctctcaagaaaatgaaagcacatgagccaagttctcctgaaagctgagaaatgagtttattaccgatctatgttccgtttcattaacacttgctgaacttgttccacgtgctaggaactgggacaggtattcgggagataagtgtacatgtaaaataataccaaagcaccaaactgctgactttcctctgggcgccaggggagagaagtcactctagccttcctggccttggagagccaagtgggtataagctggtctagtcacagcagccagtcacctctgcaggctaggacagcactgtgtgactgagcctgtgacagcttcagtttcttgacaaagtaaactcagcccaaccgggtgtcacaggctcttcaagtccaagtcccctcaaaggttgaacacatttatcccctcccaattgaattatattacttgtatgagccagcgcatgcgtctttttttttttctttttctttctttcttttcttttttgaaatgaagtcttgctctgtcacccagcctagaatgcagtgctgcaatctcagcacactgcaacctccccctcccggattcaagcgattctcctacctcagcctcctgagtagctgggactacaggcatgcactaccacatccagctaatttttgtatttttagtagaggctggatttcgccatgttggccaggctgatctcgaactcccgacctcagctagtccacccacctcagcctctcaaagtgctgggattacagatgtgagccaccaggcccagcccgcatctttctaattttaatggaattacaggcgttcccttctttctagttgttttattaattgctcaccattaacaataccaagggcatttctaaaaagaaaatagttaggacagttccagcaccctctcactcagagcttcctcccctaaattcattggccctcctcttccaattggccgatgcatcctcaggccctagacagtgctggagtgagccccatatttgagagcaagtggggaaggggtgggggcagtgcgaggtgagactattaagtctcatcttttccctgctgtgaggtctgtgggatgacacatgccacccaggaccccctgccccggagaaggaaggtttcctagttgttgcttatctttggagtctgggatcttttgggaaatgagtccctggatcttgggttctgagttgtgtcaccattgcgggggaagggtgggttatcatttctaaactcagtgctggttgacacttgcagaggagaaaggagtttggaaagcctccagggttgtcaaaacttcctgcctctcgcccttggcatgatcaccaaagcagaaatcaggatgttggattccaacccgggggagtggtgtggttacgaatgtggcctctgcaagcagacagcctgggttcaattcccagcttggccattttctagccgtgtaatcttaggcaagatactaaaccgctctgtgcctcagtttccccatctcgtggtcttgctttgacaattaaatcatactgaataaatgtcagccattactgctgagctgtgccagatttgtgacgggtgctcgacgtgccttggggcctcccctttccctatcagagcagtgggaagcatcacaacatccttcccttatccccctgcactctggaccccagatgcccgagataagtagctgctcccatcagtgtgggttgggagtagaaaactaggagtccatctggctgcttcccaaacctgcaaaccaggaatcccagtccagcttcccggccactgggcaaggggcaggtgagtgtttccggacagctccctgaaccagtcctgctccacttgaatacctggagtctgagccagggcctcgggaggcgggcccaccagggttcacgtagcatttgtcatcactgctcgggacaaaaggccagtcttcatacacaagatgcacggtggtctgcaggttagcagggagcacgcctctcccaaggttcggggacactagtcacaagggcctggtgccagtcttgcagagaggcacaccctgccctgtcctggcagtgctccagagcagcagctggactatccgggagatcactgcgctgcactgggagcctgacctccccgtgggccttggggatactcttcctttgggccgcagattttgcaatatttctgacaaaatacttgctgacaaaaagccttctgagagaagcattattaactccagttcatggatgacagtctaaggctcagactggcaaagtgactggccaaaggtcactccactaataaggaacagagctggactccagcccaagcctttgaactcaaggccttgtaaggtacataggtaccttccccccatacagcactgtctgatgtcaatatgtgagtcacatttataattttaaatttttggctgggcatggtggctcatgcctgtaatcccagcactttgggaggccaaagcaggtggatcacctgaggtcagaagttcaagaccagcctggccaacgtggtgaaaccccatctctactaaaagtataaaaaaagtagccaggcatggtggtgcgtgcctatagtcccagctactcagggcgctgaggcaggagaatcgcttgaacctgggagatggaggttgcggtgagcccaagatcataccactgccctccagcctgggtgatagggcgagactccgtctcaaaaaaaaaaaaaataaaataaaataaaataaaaataataaataaataaatttttagcagctgcattttttcaaaaaagtaaaaagaaacagatgaaatttctttaataatatatgttatttaactgaatatatccaaaatatcatttctacacatcaataaaaaaattcttaataagatactttacattctttattcttaccaagtctttgacacacaacctgtacttcacacttaaagcatgtctcaatttggacactcaagtttcaccagaaacattcaatctgtatttagatttcatactagttacaattgaaaaaggagaatcacatatctcacttactctggccatttgaaaaggttttccaatgattgaattgattatgcctttaaaattaaatggaaaacattttgtaaattaaatagaaatgaattgaattaaataaaatgaaattttgagtttctcattggcacgaacccatttcaagtgctcagtagccacacgtggctggtggctattgtactggacaacacagcaccatatgattttccctccgagtggggctgagtgatctctaagcccttcaaatgtatgctcctcccctgcgtttatacagatgagtgctttgtgtaccatgggcccacttccgtgatgataaatggacggtgtaggacagatttcccatctatattgacagcatactgaaaacagtatgctgtagtagttaaaagggtgatttctagagccagactgtccaggttcaaattttgctttgattactgaccagctgggtggccttgggtgatttacttaagctctctatgtcccagttttctcagtgatgacactgggatgatgatattaatagtatgcacctcacagggtggttgtaaggatttgctagtacatgtaatgcacacagataaccgctatcatctatggggcatacagtaagtgctcaagagatgttgcctttcattacatattttatctaattataatcaaagaatgtaaggactggacaagatcaaaatctcatcaatctgtcattatgcaagtgacaaaacggggccagaaagtgaaagaactcattcaaggtcatgtagcaagttaatgatagaaatcaactgtcagctcctgacgcccaacccagtgaccctctccactgtgcccccaacaatgctgacattgccgagaagagacaccctgacctgccagccacatgagctcttcaattcttccctgggaatgagtatggctttagctggcgtggccacactgtctgcccaggtgctctctgcaggctcattggagcagggtgactgggtagtcagtatgaaagctcactgtattagtacttcaagctagcccacatgtccccccaggaaaaaagccctgtgtatttatttggggacttttaatttttatttgatatagaacatttgaaaaaattagaacaacacaaggcagaaaaaaaaaaaaaaaaaaaggaaaacaggccaggcacagtggcttatgcctgtaatcccagcattttgggaggccaaggcaggcggatcacctgaggtcaggagttcgagaccagcctggccaacatcgtgaaacccagtctctactaatatatataaattaggcgggcatggtggcacatgcctgtagtcccagctattcaggaggctgaggcaggagaattgcttgaactcgggaggcggaggttgcagtgagttgagatggcaccactgcactccagcctgggtgacagagcaagatagaaaggaaagaaagaaagagcaagaaggaaggaaggaaaacttattaataccatgtgggcatgtattttcttttcctatagtagagattaaatttaatttactgatattcttttagcatctctcctgggcaaggcactgcgcaaggtcctggatatatgggggtgatgcttagaatctagtgagccgatggttgtcagttcatgaccaggatagctatgtaattaaatgtggctgggcccacatgaaaaaaaatctcaggatgcagtgagaggacagaatgggagattgtactcgggctctctgtgggtcctggaaaaccttcagaagcttaaaacatggcggggggtgaggacggggactgaaggggagagtacaaccatacttataacataaccctgtattctgcttctgccacttaacattgtggcataaacttatccccacatcattaaatactccctgtaaatttttttttggcaaatatttttaatgtgctatatttttctaaccaaccccccaatcacttttagacaatccagttgtctccggtttgaatttttttttggtgggtttttatttgtttgtttttattatgctatcagaaacagcacagggtcgggttctgtggctcacgcctgtaatcccagcactttgggagcctgaggtgggcggatcacttgaagccaggcgttcgagatcagcatggccaacatagtgaaaccccatctctactaaaaatataaataaaaaaattagccaggcatggtggcaggcgcctgtaaccccagctactcagtagctgcggcaggagaatcgcttgaatcaggagggtggaggtggcagtgaaccgagatcgcatcactgcactccagcctgggcaacagagggagagtgagactctatggcaaaataaaaataaaaataaatataaatataaatataaaaaaccagcacatcacagcattctggggctccagtggatggaaaagggaatctagaaccatctagttccaaagcatggactttagtctccaggcagtatggtacttgagatagttttatttaggataagttcccagatgtggaattactggattgaaagagcttggtttgctgttgttgttaaggctgttggcatctgtgtttgcaaacactttctgttgatttttttttttaactatacttctagcaggtgacacatgcacctggctgcaccacttgtagattccacctccatgtttccatcgtccctttccaccctgcctctggctctgtacagcatctcttcatccatcatccactcaacgagcattcaggatgcaaccgtgttttcctcagcacctctgacagtgccggaggacagaaagtaacctcaggtgtagctggtgttgacctgacactggtcactgggcacggccagggcggcattctggggagtgccttgtttccccaccaggcttgctctgacactgggctggccagcgggaggctcagctttccctcgatgtctatgcctcctttctccacaagtccctcacctctcagatgcccatgggacatctcaggagcctgggtgacacaacaggagtatcagtgtcccgttccgttttctcaaattccaggcaacaaggctctttcgtgccttcattcttcctgtgcttacagtctcctccgcagcccgttccactggagtcttcttcccactaccccattggaggttctgtcccactcggggacttctgcatgggactggcctgaaaaagccgcctccttcctgggctggggtcggcactcccaacctctttcttctcctattctgaaaccagccgctcccctccatcccttccctgtcttgttccatcactttccagaatttgggacacaactagagatgattttcaggggcacacagtataacttcaggtggtaaatgaacttagcattaaataacactgaatcatgtggcaataaaagtttaaataattattatttttcaatgttttgtcattccttctgattctatcagatagtctgatgatgatgtgtcttttttttttttttttttttgagacggagtcttgctctgtcgcccaggctagagcgtagtagtggcgtgatctcagctcactgcaacctctgcctcctgggttcaagcgattctctgcctcagcctcccgagtagctggaactacaggcacctgccaccacgcctggctaacttttgtatttttagtagagacagggtttcaccatattggccaggctggtctcgaactctggaccttgtgatccacccaccttggcctcccaaagtgctgggattacaggcgtgagccaccgtgcctggccgatgatgtgtcttttaacatctctaacatggctttatttttagtatgcttgtttttacaattaccttctattttaagcaagtcatataaatcgtccctttaggttttaatatcttcttatttttttcatatcaacatacatacctaattttacatacatagaatcatatcatacatgatttttaaagtacagccttttaccttcattgcttgcttttcctccccctatcttccatggctgtgactgtgtcccacgaccagctgcatagtttgcagggcccagtgcaaaacggagatgcagggcctttggttcaacaaatgatgaggaatttcaagatggcaacagcagaggattcaagcaaaggccgggtccttctaagcacggggccctgtgcacagtccaccagcctgtggagctggccctgcttggccccttcccctgaagcccactcttaatttttccattttgattatctgctgtgtgttctcccacacttatcttcatgttcctgcaatcataccagttcacagagggggttttttggccttgcttcacaaaaaatgtatcatattatattctcttctctgcatcttgcttttcctactcaacacagcttggaaatcctgccaacccatctgggtctatttcattctttataaaggctgcataagatgccatgctgtaaatggaccgtaattgattcagccgtttcccctgtgaatgggcattcactctgtttctaacattttgccattcaaaaatctgcagtggactgggtgcggtggctcacacctgtatgcccagcagtttgggaggctgaggcaggcagatcacttgaggtcaggtgttcaagacccaacctggccaacatggagaaaccccatctctaccaaaaatacaaaaaaatttagcagggtgtggtggtgggtgcctgtaatcccagcaacttgggaggctgaggcaggagaattgcttgaacccaggaggtgaaggttgcaatgagccgagatcacgccactgcactccagcctgggtgacagagcaagacactgtttcaaaaaaaaaaatctgcagtgaacatttttatgatcaggtgtctttaatgatgtaaaaaagcaaattcacaggaaagggtaaaagtttgctcttactctgttttgtgttgctataacaaagtaccacagagtgagtaatttaaaacaaaaagaaatttatttcttatagttctgcaggctggaaagcccaagatctaggggccacatctgatgagggccttctctctgcatcataacacaatggaaggcgtcacatggccagagagtgcacgagagacagagcgagggacggtggaactctcacttttacgacaaaaccacttctgcaataaccaacacacccctgtgataacagcattaatccgttcatgaaggcagactcctcatgacctaatcaactcttttcttttcttttcttttcttttttgagacacagtctcgctctgttggccaggctggagggcagtggcgcaatctcagctcactgcaacctccacctcccaggctcaagcaattctcctgcctcagcctccggagtagctgggattacaggcatgtgccaccacacccgactaatttttgtatttgtagtagagacagggtttcaccatgttggccaggctggtctcggactcctgacctcaggtaatccacacgccttggcctcccaaagtgttgggcttacaggcgtgagccaccacgcccagccctaatcaattcttaaacatccaacttctcaacacaggtcattgggggattaaatttccaacacatgaaccttggaacacattcaaaccatagcaggctccttttcaaataaatttattgcagcaaaaaagtgaaccaatttaaagaaaagtgtgaggcacagggccaggcaaaagtggtaacaatgggccgggtgtggtggctcacgcctgtaatcccaacaatttgggaggctgaggtgggcagatcacttgagctcaggaatttgagaccagcctgggcaacatgggaaaaccccgtctctacaaaaaatatacaaaaattagccagcatcgtggcaagcgcctgtagtcctagctactcgggaaactgaggcacgagaatcgcttgaacccaggaggtggaggttgcagtgagccgagattgtgccactgcactccagcctgggcgacagagcgagacactgtctcaaaacaaaaaaggtgataatgatgtctgagaaacgctgatcttccattcggccctctgtgaaatgaggcctggatggaaagacggttccaggtaatttctgcttttgttcctgtagcacagaagtcagagaacagagaagccaggttcccttcttgggataggggatgggagaatgcttgacacaaaaataaagccctcgaggttatccgctttcaaccagctgccttggagctggcagctgctgctcattcattcagtcaatcaacaaacattgccttggacactgtgggggacacagggctgacccagccatgggccctgccctctagggttttctgatctaggagaacacatttttgtctttatgcatgagaaagtggttttccagacccagagagagagatgatacagagcagagctaaagcccccctgccccacacacatcacattcacacacacagtcgtaatcacatatgcacacagtccctcacacacactcatatgcacacacctcacagtcatacacactgcagccatcattcaatccccctcccccaccccatgtagtaacattgaaaactacgcaggagcactgggacggttgctgtgggaaccgggattctgaaatcctaacttgtgggcatctgaattcttgcgctgaacattctaatacatcagccacagagtttatgctctgaatttggagtcatttctcctccaggggctcaggctgggcagccagccagggagttagcgaggacggcaattagagggctgaagactttctgcctgatgatgaagaggcccacacggtttcctggagagggctgtctgccagggtgtgcacgcgcacatgcacaagctcaggctcagggggtatgtccgtggaatctgctcaggtgaagctccaggaatgtgtagtggtcatgtccgagtcttcaggctctgtatcggtcaggccggactaggcaaggctgtagcaacaaggacacccccaaatcttcatggtttaacatgataagggcttactccttactcacacaaaatccaagctgggtcaacatccccttccctcttgcagttcctccgcaacccagggcctctaatatccttcaacagggaagacgtaaatggaaatggctcactgcctcttccctgctttggctcaaaagcaggcagacgtcttctgcctaggcttcaaccagcccaacctaagtgcaagagaaaccaggaaatgcagaggagttcataggcaaccacaacagtccctgccccagagcctccctttgtgctttgcaagcccaaacatcccagcccagaggggaggcaagtccttggagacagtttaaatccgggctctgcagcttgctcactgggtggcctcaggcccacgcatcagttgggttcccaccaggaaacctagaataggaatttaaaggggacttatttacagaagaactatttacaaagggtaatgcagtaagtagaatctaagagcaacttctggccaaaggagacacaaccagggagtggtcagtgagtccgagtaggagacagtcaaggagaggtcaccttgaataagcaatgtccttcacatgagggacacagcctacccgagggacctcacagggggggccagaggaataagtgtcacatcttcgctctcctcacttctgcctagctctgctaaggctccccattggctgaatctgacagaagccataaggcccaggaagacaggggttaatccaaacagatcagcctcccagggcagaatggatagtagctctggtggaataaatggaccctatctggcagggacaactgatttttgcttttggagcctccttttcctaatctgtaaaataagaatgctaacacctgcctcattgcattgttgaaagtaaatggaataggctggatgtagtggctcatgcctgtaatcccggcactttgggaggctgaggcaggcagatcacctgaggtcaggagttcgagaccagcctgaccaacatggagaaaccccgtctctactaaaaatacaaaattagccaggcgtggtggcgcatgcctgtaatcccagctactcaggaggctgagacaggagaatcgcttgaatctgggaggtggaggttgcggtgagccgagatcaagccattgcactccagcctgggcaacaagagcgaaactctgtctcaaaaaaaaaaaaagaaagaaagaaagaaagtaaatggaacaatatatgcaaatatgcaaatacctgtccttcatgaatgctagtttcttagtgtctgaaggcactttgcaatccagtggttcccagtccaggatgtgtcaattattctaaagtctgatatgaaattctcaaacaaattctataaacaaaattttctttttctaaatcactcccactttcgagctttttctatatgtcaagtatttcataggctgtctcatttcagtctcacaatattttcctaagaatcatagctgaaaaattgggactggcacagaaagattaagtcacccattcatggtcacgaagccactttgtgtgtctggccccagtgcccactgcctttcctccctgttctactccgatttctgaagctgtgtgtgcaatgaataggtaaagcggaggatcctgaaatgccaatgtttgagaactttccctaccttgaagggaggccaatgcacccaaagttgaggaccacgtcttttccaaaggcctcatgtagccaccacaggctccaggaagtgccccctgctcatcagggtgtctctgtggtctccaggcctgagctcactcacccaccatgctgctgctggttcatttcaggtcatccatctccagccccacctgaccagctcaacaccagcagtgcagagagtgagctctgggagccaggtgagcaaacattccctctgggggtccatgatcagctttctgtaggtggtcccccagggtaataaagaagggaaatggacatttaggataccagggaggctccctgacttcagacaacacttcttcctgacccatcacctgaagttccactatcaattcactttgaggtcgtagaactaccatttttgagaggacactgataagtcacatacaggtgggcaggtatgcctggagcattttaaggggatttgttgagaacaggctagagttcttggtgggggaggcagggtccttgatttactcagcagacgtttattaaggacctactgtatgcaaagatgcatgctagcactgggggtacaatcctgggctaaaaggggcaggtggttcccatagaaggggttctggggaagtgaggaccaccatcagctgaagcagcccatcatcaaccccatggccagccgcttcacaatcctccaaggttccctagtcactgtgacagcctctaggacagtaccctcagaggagcagaggggccttcaggggaagcatgcgcccactggaccagggcccctgaactcacaactctgcctttctttcacaaacgggtgcccctggagacaggagcaagtgaggagggtttctagggggctggacccctagttgtctgtcacccatcttaacctctagagtcactcccaagccccaccttcggctgactctaaggagaaccacagggtcaggcctcaaggtgggctcagggatgagccagcccggctccattttgcagactggaaagctgagacccctagccaggcagggcgttgtcaaagttcacgcacagagtcagtggcagagcctgggcaaccctctgcccaggccccaccggtctcagctctctggtctgacacttccaggggagcggcttccggtccgtctgacaaacgggagcagcagctgcagcgggacggtggaggtgcggctcgaggcgtcctgggagcccgcgtgcggggcgctctgggacagccgcgccgccgaggccgtgtgccgagcactgggctgcggcggggcggaggccgcctctcagctcgccccgccgacccctgagctgccgcccccgcctgcagccgggaacaccagcgtagcagctaatgccactctggccggggcgcccgccctcctgtgcagcggcgccgagtggcggctctgcgaggtggtggagcacgcgtgccgcagcgacgggaggcgggcccgtgtcacctgtgcaggtacgagcgcaccccctacacgggcccccacctgccccactccccaggccttcagccactgcccctggctccagaccctggacgcaagcctcgccctccagacctccacccccaccgcctaccagtgcaaacgcaccgggttcccacaccggaggacgacctcgagtcatttccagatctgagcgtttccttggatctggcctccagactccacccccacacttggttcctagtcccacccctgggttcccaaagctaacccggtctctaaccccacttactgggcccgccgcttccctgtccccgcccgctctgggtctctcctcccctttcgccatatacataaacatgccaggttcacagggtccctaagcgctgtggctcccaggctcccaaacctgccctccaggccccgcccaccaggtctctggtccctcccaccagcctgcggctctacctaacccatctgcagtcctggggggattcccagtcttgcctaccgggctacagccctctcactgggtccacaacacgctcacaactctccggccagtccaaccatcaccccaaccctcccttcctggtcgggtgccccagcatccacaaccccctcccacccctagagaaccgcgcgctgcgcctggtggacggtggcggcgcctgcgccggccgcgtggagatgctggagcatggcgagtggggatcagtgtgcgatgacacttgggacctggaggacgcccacgtggtgtgcaggcaactgggctgcggctgggcagtccaggccctgcccggcttgcacttcacgcccggccgcgggcctatccaccgggaccaggtgaactgctcgggggccgaagcttacctgtgggactgcccggggctgccaggacagcactactgcggccacaaagaggacgcgggcgcggtgtgctcaggtcagtgggcggagtcactgaagcccggtcactaccaacactcaccataggcctactgggcgccaagcctggagttagtgccggagaggtggtccctgcccttgagatgtcacagttcaggaggggagatgagactgagacaaacataattcaggagagaaagtggtaaatgcccccaagaaaggcagtcaggtggagtctagaggcagcagaccatgcggagctgtaggctaaggctgaccacctcccggaagaggtgacattaaaagtgagactcttcccgagtgggagttggccacctgcattcaagcagcaaggggagactgaagggagggaggcctctgaggaggctgttggtctgtccaggtggggccagaaggttctggaccagccagtgcctctctttgataagcaggagatgggggaggtgggggtgttaaaatgtagattctgattcagtaggtctgaggcagagctccagagtctgcgtttctaacaagatcccaggcaatgccgatgctgctgctccacagaccacacttatcacagcagggttggccagagcaaatggggcaggtgacagggggacacagacacaggagggagaagacacaagatctggagaccaaatggctgcattggtgcctgcactggtgggtctgggctggcgggaatttctgcccaaaggattctgacctgactctgtcccctgccccttccctgcagagcaccagtcctggcgcctgacagggggcgctgaccgctgcgaggggcaggtggaggtacacttccgaggggtctggaacacagtgtgtgacagtgagtggtacccatcggaggccaaggtgctctgccagtccttgggctgtggaactgcggttgagaggcccaaggggctgccccactccttgtccggcaggatgtactactcatgcaatggggaggagctcaccctctccaactgctcctggcggttcaacaactccaacctctgcagccagtcgctggcagccagggtcctctgctcaggtaccccatcctactccacccccccagatttgagccagaattctacctgaatccatgtcctaaaaacttacagtccaaggaccacaataggcaccagatcggcaatggcacatatggcataagaaggactgttgtccttacggtgcccaggcagacagtgctaattcatcgaggtattttcagatgctccactcagccccagaatgatgaatcatatatgaagacattatatgctaagcaatggttcctcttgactgggattgactcaagagttgacaccaatttgccatcccaggcctggtgatgatagtaaaaataatattagcaggccctagtaataatatcggtgacagcttctggaaccctgatcatatgctaggcattgttaagcactaagtagctcttatttcagctgagcctcatacccactctatgagttgggttccaccatatctcgccaaatctaagatggcattgtttatgtcacaccattattattttatgtaccataaagaagaacgaacactgccaaaataaaccaccaaacgtaatgactgaggccattatcccaatttcagacgtgttaaagtttgaaaaaacgtgagtgttagatagatctgaagaaacatggtatttgcattcttacggcattcagacaccagattacaaattccagctctgccatttacgagcaaggaggcttccgacagtcccttaacctccatgtgtggatgctgatactaggcacttcgcaggatagctgggaaacctgatagtatctgctgagggacttctaagctcatttctttgtgagcctacctgcccaacgggaatgccgattatgataatgaagataatgtccgctcttcatctccctaggctgattaagaacaaactgaaactgaatggaaaacggatttgtggtctgtagcagcttacacagaaagaagggataattctattagccctttattttaaccaaagagccttcccagcatttaatccatgagttcctccttactgtggggggtggggtaggggagggaggtaagtttccttagccacgtgtccctgatgggagcacaaccctagttctgggtcacttgtctgtcccattcagtttctaacccaaggcctggcacacagtaggtgctcagtaacatgcattgagtgactgggcggtgctttctgacagcttcccggagtttgcacaatctgtccactcccgaagtccctgcaagtgttcagacagtcactataggtaagtgttgctgggtactacgcggtttctcagaagcttggacgtgtgtgtgtgtgtgtgtgtgtgtgttcctgtgcacacctgtgttggggtggaggatggtttggtcctcatcctccacctccagccaatggacttgcctccccggggctctctgggtggcatttctgctccttctacatcccctccttgccaagtcagcccatagatcactgagtcctgatacttcctggacagaagtccattcccccactttcctgtgagctgctggagggcagaaggaaagagctggagagagctgataccacctcaagcaggggtcagggtcggggcagcagggggagggtgatcttggcccagctgggtagcgggaatgccagcacacagccctgtgttcataaccggccagacactgggcctagggctttatagccattatttcccaaccctttaatcctcttggtagccaaatgggagaggtcttattataacccttacatcaagaaaggagctgaggctccgaggctgaagtcacagctagagattgctggccagaactgacaaccaaggctctgaattccagatccattcttggtctacccaccagctgcgtgtagcttggctggcatcagagcagactcccaggactcaactcccagctgtgcctcttgctagctgtgccctgttgggcaactcggaacctctctgagcctcagacacctcaattataaaatgggggtgataagcatatagtactttctcctagcattgctgtgaggctccagtgaattaatttttgtaaagcacttagaacagagcctcaaagacagtaagaactgtccgaaagtctgctgttgctatgagtatttagttcaggcattgagcccctttgcagtcctgggatacccacaggactcccttgctctgcctcctagctctctgtcatcttctctcagacacccagaagcagtgaacaggggtttggggagagggcacagaggccttagccatagatgacagcacagagaggaaatgaaatgtacaactgcacaggctgccgggcaagctcctgccaggccccgcaggcaacctgcacacgctttctcttcctgaggttggagtggggatccacgccatcctggaagggcaaagagtgaagcacaaagagagatccagggaccacaccccggcccttggtccatcagcccctccctcggccacggccctctgtacccacattcacgggtctccccatggccgcaacacccagcctcactctcacatctgcttcctgctgccagatccagctcccatcctggcccaaacttccccatttgcagacagagaggggagaggagaaaatgaagacggggagaggagaaaatgaagacagggagagggttctctcccaggggaagcagactctgcccccagcaaagaggtctggatgatctcatctccctccccgttgctgtcactactagtcatctagccctgtggtctgctcactccaggaaccctcctcactgacccctgtatccattcttgtgcttcacattcttttaagcagaggggaggctgagggagggggagggcaagaagtcacccctgagtggggctgcagaggtgggagaccctgaatcccagaccccactcccgtcctcatggaggggatgtctggtgggaaggaggggggactcaggcacagctcttctgatggtctgttcactgccagaggtggctcagagtcactgtctctgggaagtcagcgttggtcttccctcacagagaatgaagtgccttttgtagggcctcatgcccccagtgtcgctgttcaaacctccatcacagcgggtgcctcatcatactggactgggttacttattgatctctccgctagacaaagcccctcaaggcctgtgatactgttgtcttatgtgtagccccagggtctagggccaggcacacagcgggtactcaatagttgtctattgaacaaagactacatactgaagagctagcagacagatagatctctgcagcctggtggccagagttctatttcaggcagtaattcatttaatcaattgctcatgcattcaatatgcatttattgagcgcctaatatacaccacacacttaaaagcaatgagaaaattggaaaaaggaagcaaggaggaagataacataaaaagggaagcaggtcagctttacagagaatggaaaggcaagaagaagggtgagtgcccattcctctttcttcctgaattggaattcttgtttccagaatcttctgtgacagtgaaaatagagaacaaggaatctcgggagctaatgctcctcatcccctccatcgttctgggaattctcctccttggctccctcatcttcatagccttcatcctcttgagaattaaaggaaaatatggtaagtgcaaggttctgggagccatggccatcccagggggatgtgagccttggcagaaccccagcagcagtggcgtggtccagcaatgaccacccggccctggccctggggagatccccaaggtggaaaggattttcccagcatgcccagcagtcatggacgcaccagcggggagaaccagactgtgcatgtgtgtgtgtgcctgtgtttgtgtgtgtgtttgtgcgcgcgcacatgtgcctgcaagtgttgggggaatgaggagggtggtgtgtcgatgagaacagaacggaaccaggtagactgggagagggcaaaaaaatgacttgtagaatttctgcctcccctccctcagccctccccgtaatggtgaaccaccagcacctacccaccaccatcccggcagggagcaatagctatcaaccggtccccatcaccatccccaaagaaggtaggatgtcccccatcctgggtgtgggagggctggggaggacaagaagggtgagctttctggaaggtcagcaccacttaggtccaagacgtacacacagctggagatgagatctgggccagcccactcccggccctgggaccttgagcaggctcaagtcgtccctggacattgaagggcagatgaccttccagttcagtcatgctaggactctatagagttttgagttctggacaaatacaggcaaagcacgttttagatcttggttctcagaggaaagctctgttctgctttgctctgctagttggctagtaggcttgtgatatcatcatccctatcaatgtcctgcccaattggccttgcgaagccccatcaagattctcctagaatgtggttttatttcatagttcatattttctaaacaaaaaaacaaattggggctgggtacagtggctcacgcctgtaatcccagcactttgggaacctgaggtgggcagatcacttgaggtcaggagttggagaccagcctggccaacatggtgaaaccctgtctctacaaaaaatgcaaaaattagacaggtgtggtggcgtgcacctgtaatcccagctacttgggaagctgaggcaggagaatcgcttgaacctgggaggcggaggttgcagtgagccgagatcacgccactgcactccagcctgggcgacagagcaagactctgtctcaaaaaaaaaaaaaaagaaaaggttcagtcattcatcctttatgatatatggatttatacctcttgcagaggaatttgagcttaatcaccttgcattatgaatgtattcaatcacctttatcggaaagagttcaatgacataaaaaccaatacaaaactcagccaaatattataaatatcctttgcacagagagtccatatatatgaaaagagaatgtgaatacagcatctagcataaggcttagcataaggcagctgctcactgaatagcacagtctagaggtttagagccagactgccggctctgggccaggtaagaacctgtctgtgcctcagttccctccaaggcaaaatggggataataatgtacccacttcacagagttatcatgagggttaaatgaggtaatacttgtaagtgttagaatagtgcctcacatatagtaagtgctgtgttaagcgtttgctaaataaatgtttagttctccatattggaaatgaacgaaggcagcctagaaacttcagactgggtggcttgtacaagatgggctacccaggttgggcacactggtggatgcctgtagtccccgcattttgggaggccgagggggatggatcgcttgagcccaggagtttgagaacagcctgggcaacatggtgaaaacctgtctctacaaaaaattcaaaaattagctgggcgtgatggtgcatgcctgtggtcccagctactcgggaggctgaggtgggaggatcgcctgagcccaggaggtcaatgctgcagtgagctgtgatggcaccactgtactccagcctggacaacagagtgagaccctgtcccagaaaagaaagaaaaaaaaagggggctacttggtgctcccctgctactctgcctctcacctctgccgttcatactctaccatccctccctacacctttccgcccaccactttgccatgccctcgactctgttctctccccagttttcatgctgcccatccaggtccaggccccgccccctgaggactcagactctggctcggactcagactatgagcactatgacttcagcgcccagcctcctgtggccctgaccaccttctacagtgagtgcctggccgggctcccgagggcccacctacctgaatctgggagggggccccgaggggaccgtcaggtcagtagtcccacctagtaacccctgcatgatgcagacagaatccccctggttacccactggattgactgtaaatggtcctacactgacgtttgcaccgtgctttgtgaccctggggtcatctcgatgtctcaggacatctccactctgacctctgtctctcccatgtttgtctctggccacgtaaggtcttaagaccaggcctttgacattcacctgaagatggctctctgtgtgagagcgggggagtgcggatgagagacacagttggcaggggttctcgcatgccatatccctccgtgtcccatcctgccctgtctgaccccatcagccccactcacttcctcacctccacgctcttgccagcttgtgcctcatagccagctcttttcattgccttctggggataggaagaggaaagataacgctgaaggcagttccctggcaatgctgggaggttggaatagaccagagcgtcccacaccttattgtggaatcacttgggagcttgtcaaaaattcctgagcccctccccacacctaatgttatcagtcaggatgagaatttggctgtgtgtgacagaaagctccaaatgacagtgtcttgagaggttggcaggggcccaggccccttctttcttgctgctgtgcagtccctaagatgttgccttcatctacatggtccagaatggctcacctccatgtccacattccaggcaagggcaagggaacgatgggatgctggagatggccacagattcccgctcacaacccagcacccagaacgaaaacccactagctgcaagagaggcagggaaacgaaggctctgtcctgggcagctgtgtccagataaaagccagaatggatattggggaacagacagccgtccctgccccgcctgctaacccagggcttctgggggtgggacacggatgattccacttcttctggcctgtggaccagtgtttgggcgccacagggatgaagtgtctgtcgaacctgagattccgagcccaggcatataagatgcaagactgagagtccacagtgctataacattgaaattaaaagtcagtggtacccggttcaaaagagctgactccaagatcccagacactcatatcctcaagactctataaatctctgattctgaaacgtgaaggtgccacagagcctgtgatgcagtgattccagaccatctgggtttcactctaggaaggcttcttgaaggagcaaacatctgtccttctcctgcccagagctgccaggtcacaaggacagaaccaagactcttgatacctctctaagtagcaggagggacagctggggctgggggctggggggttgtagggcactagagtttctgtccccaggctagattaaggcgaaggctctgctggattgggatatgaacctggaatttgatgggaaatgctaagccctctctgcctccggagttgtcctcccaccctattcagcctacccaggccccgggaaatccagcctcttctccaggctcctaaatgatgaggttgagccttcacccctccccaccaccgcctctgcttgcagattcccagcggcatcgggtcacagatgaggaggtccagcaaagcaggttccagatgccacccttggaggaaggtgagtcaggatgggaaggggtgtgaatggcagtcccacctccagagagtagctcagctcagcttgagaccttccagcaggaacctccctcaatgagtctttcctgactttcacaaatcctataggcagtaagtgctttctgaagtctgacttaaagccctcttgctgcactgcttctttcgtcaccattctccctttcctgccttaggacttgaagagttgcatgcctcccacatcccaactgccaaccctggacactgcattacagacccgccatccctgggccctcagtatcacccgaggagcaacagtgagtcgagcacctcttcaggggaggattactgcaatagtcccaaaagcaagctgcctccatggaacccccaggtgttttcttcagagaggagttccttcctggagcagcccccaaacttggagctggccggcacccagccagccttttcaggtaagctgtgcctcccccaaacccccatcccatagccagcctggctggaggaggcataaagctgggagccctgagtcaggctgaggtcaggattctacccagttccgcagccattcgctgtgtgcccttggacacatctcccatctctgggccttcactttgtcatttgccaagctagggacttggctctcgtgagtcacgtgggccccccagctctggcaacttgagaagtggctgtgtgctggcagagggtgactggttctgggggtttccagcagggcccccggctgatgacagctccagcacctcatccggggagtggtaccagaacttccagccaccaccccagcccccttcggaggagcagtttggctgtccaggtgccaatatctggggaagggatgtgggagggggacagagagggactggggagtaaatgagtggggaactattggatgcattcgctcaaggggaaaaggagaaaggaagggtaaaagaagagagggaaagtaactttttaaaaaacaaagcaaggccaggcatggtagctcaagcctgtaatcccagcacaaggcaggaggattgcttgaggccaggaatttacgactagccccgggaacatagcaagaccagtctctacaaaactaaaaactaaatattagccaagggtagcacgtgcctatagtcccagctcctcaggaggctgaggtgggaggatcgtgtgagcccaggagatccaggctgcagtgagctatgatcgtatcactgtgtatcatgcccctgcagggtcagagcaagaccctctttctacaagaaaacaaacacaagcacaacaagaatatgaagaggtggggaaaatggatgtggacgggatggagaaatagtcaaacaggttgctttgataagaagtgagctccctgtcagtggaggcattcaagcagaagcagctggttggctccttgggggagactgtggtagcagaggggcttccaacattcaatcgtccaccgtgtcgtgcagtgtgccattgtggagaccatagccctgaaccagacagacgaggctattccctcagtgctgatgttctagtcagggacatggccggaagcaagatgatcagatggcttcatgcagcatcccacggggatagtgatgtggagccagaaccactcagctccgtcctgtggggcagcagggcaatgactgggtctcccactaatctgggcctctctgcccacagggtcccccagccctcagcctgactccaccgacaacgatgactacgatgacatcagcgcagcctaggccggggccagccgaggctcctggggtggctctgaccctctggcctcctgctctacctactccctttcccctttcccaccctcccagctcacctccccatggagctgagaggcctcccttggagagatggaaggaaacgttataccttgtacccctcggtctccatccatcaagccaaacctgctgccacagccctcccccggccccagatagcagccccagggaggatgctgcctccaagaggtgtgagccctctgtctcggggatgaacaagcagagtctgggctacctcttgacagctggtggaggggagttggggagctggactggatgactctggaggccccttccaaacctcaagtgtccggcgctttgattgcctgagtttctgacacttcagggcccagaggtcctgcgaggggcagaactggacccccatgccagtgctgctgcaggagggcccatatactagggtctgctgagctgttgtcactgatcggtgggcgctgggggggtagggtagcacaccagctgtcccaggctttgctccgggcggtaactgcacttgggcagggaatatagccttcctgggcacaactagctgacaatgacaggttgactgtgtacccccaaccaaggagctggggcccaaggccagtcctgccccagagacactccaagtccgccaggggcacagaccagttctgcagtgactgtccctggacaatgggtctttattctgagtttcctatggtttacaaagagggccccagcccagccccaccacagatcccagagataggggcccagtctccatgggggcaaggagcatagagatgttttccaggaaggggctcagaagctgcactaggccccgagtccccatgtgtctccttgaattgatgaggatgctcctgggagggatgcgtgactatgtggtgttgcacccggggctgcaaacgtctccgtgcagcccccagagagaggcccatgggctcagaccaggctttgttgtcctgctctgagtatcctgagattaaactgaattgctgaatgaaaccagggcgtggaatgacaatttcttaaacctcatagaacccaggctgcatgtgtgtgtgcacgtgtgtgtggcatgtatgtgcatgtgtgtgtgtgtgtgtgtgtggcatatgttggatacaaatgagacaaagagttgagctcaaatcttttatttgggaagtaatcccagggagcagcagtaagaaaatgaggaagaaagagggggaaggaaggaagacaatgttcatgaacaggttgctattatgggcagccagagctcaatggtgctggggacctctgggagacacacctcagaattgtcccaccaagggggcagggagctgggatattgacccaccctctctgcctgtcattggttgaggagacattaacccccagccccagcactaccgagcggcctgtgagtgagctgggcacacgctgtgtcgggagaagccacaggcagagggtcagaggcacatgctataaggaaccatcttccatgggaatggtccaggaaaagcaccaacagcaactgctccatgttcagagtgtgtgtgtgtgtgtgtgcatgtgtgtgtgtgcgtgtcagggagaagtcaggttgtggcaatggtgggggcaactctatctgtttaggaggaaatgctagggaactggaaaacccacggtggctcagcaccataaaaaacactggggaggccgggcaccgtggctcacgcctgtaatctcagcattttgggaggccaaggcaggaggatcactttagcccagaagttcaagaccagcctggacaacatagtgagaccctgtctctaccgaaaaaaaaaattgaaaatcatccaggtatggtggtgcacacctgtagtcccagctacttgggaggctgaagcagggaggtcgcttgagcccaggaatttgaggctgcagtgagccatgaatgatcacatcactgcactccagcctgggtgagagtgagactctatctcaaaaacatttttttaacactggggataggaaaacagaacctgacagactgagaggcagggtctatgagaactcaacctcactgcctccctgggctgctccacagcagccctgggctcagcggcaggggttactgcactgaatgagttcccgcctgagcccccaaatcttcaaaggtagtataattccagggagttttatgcttagagttgcctggaaaaggattgcaccaccccagaaggaagtggggatgaggctggtggcgctggaggggactggagcggatccgcactgagaaatcggcattgcctccagtcctctgcccattcagggctatgactttatccctgctgccatggccagtgcccagctctgcctgcggggtgagggttggggctcaggttttctccgagccgtctcgggaggggcggatcatgaaggaggtggggctgtgtggtgggcggggcctgctttccattcacctgtcccagaggtggagagaaagccgcgctccccagggcaaccgtcacaggatgtggttggcagtgttgggccccctcctcgggccctctgaaccctccccagggtggcgggggattcctaggggaggagccacttctggggtaggtggggcagactcagcggcagggggcttgtgaaagcctgtgttcaactccccactccacccctcctggcagtgtggcctcaggcaaatcactcaacatctctgagactttgtttgctgtaagttggtctgtagaatgtgtgggcagtagtgggtaactcacaggtggtggtgagggttagagggttggtagtaaatgaccccgtcattggtagattaatcactgcaggtgagagcgctccttaaaaggagaaaggggaagccaggaggcactcagcagtgcctggggtcttcagtgcgttagtgctgggggcagggcggggcaagggttgggggaacatggagaatgtcttgtcccactctcattttacaggtgaggacactgagacctagggtgggaaaggacctgtccaaggtcactgagagttagtaacagagtcacaattcaatccttccccacctcgtgcccgccccagctcacacagggagatggcaatgccttctgagtcacccccatttccccaacctccccggagctgcctctctcaccccagctctcccacccagggccccccacagtctctgagaaattgggaagctctgccctagccctgggcagtctgaagaaacagcaccacacacagtaggagggctgatcccagctggcccctgtctctatgtctcccagggactcagacctgggacctgcaccttattgagccgacatgggccaggcctgtgctgagactgggaaagctgagatgaatgacagccaggctctgacctgaaggagcaccagcctggcagggaagtcacaaacataagcaggtggcttcccctccactcctgggagacctcattataatacgcctcaaggatctgggacaggaaacacaaagaggctcaatggacttggcagcggaacccagtggttccagaaacattggcgtggggggaaaggctgtgtcccagaacggaagcacccagcaatttgactgacagctctgcaagctcaggcagagagtgatgcacagggaattcctgggaagctgatgcctgatctgggttgtagaggatgaataggagtgaaccaccgacgtggagagggaaaagcattccaggccaagggaatgacacgagcgaagacacagcaagaaactgcacggctcgcgaggtcaagggaggtccagtttgagaggagatgaggctggggatggtcaagtctcacaccaaccccatttcatgggtgagaaaattgaggcccagagaggttaagtaaaaagccaaggtcacacagctaaataatgacagtgctgggacttaaatacagcctagcttcagagtctgagtgttaatcatggctcttccagtgtccctgtgccaccacagccacacggctgggcattattaccagagccccagcctagaatctggagacaccggcctatctgcccaccaacagcacaggcaccggctgcattctgggatacggggttcgggaatgtagaatcatcactaccaggcacccttatagagccagctctgtgctgagctctgggaggcacagaaaggaatggagcctggcccttgccgctggggagtttacaggacctggggcagagagagaccagtaactgccgttcatcaacatggtgatgatgacggtgggtagcatttactatgtgccaggtatgtgttgtttcatacaatcctcataagggcactctgagaaggtattattctccctaattcgtaaatagggcaactgaaaccccgagagattagatgactagccagaagccacacagcttggcaggtagcacaacttttccacctcactgcaaagccccagtgtgaaaacaccacgccgcacagcgagggctcatgataagcatgtttaacccacatgaacttaagtgtgtgctcagcagcaaacagaaagacaaggggcaacccagcccaatatttcccttggttgaacaaacacccaggaggagacagacaggagctgtggagcctccgttccctcagatcctggaagccgttcatcctgtgggtaccttgccatgctgggtgagattttagctgttggggattcatttttcatacacggtgggcctgaaacaaagcccaccatttcaacgagctgctctaatgctgcagggaaaacacctggtttggagccagagcagggcagactcacatgcaggcgtcttcctaagggagtgttctttcctttccctcactccctccctccctgtctgccctcctccctccctttctccctccttccctccctccctccctccctccttccctaccctccctccctccatcccttccttccttcttctttccttccttcctcccttccttctctttctctctcttttctttttttttttcttttctttttttttttgggatggagtctttctctgtcacccaggctggagtgcagtggcagagtctcatctcactgcaacctccgcctcccaggttcaagcaattctcctgcctctgcctcccgagtagctgggattacaggcacacatcaccacgcccagctaatttttgtatttttagtggagatggggtttcgtcatgttggccaggctagtcttgaactcctgacctcaagtgatcgtcctgcctcagcctccgaaagtgctgggattataggcatgagccactgggcccagccctttctttttttaaaatgggaaataccttaaccgtattaaaactccaacaacatgaattcataccattaaaatcttgccccctccaccctgccccttcctccccacccggcccacccaaggtaaacacaattgtgtctctgatgtagaaagaagcagatgtgaacccctcttgctgcctaccccttcttatacagaaatgacgtccgggcaccctcttgggctccttgcttctttttacttctctggtatcccagataacgttcctaagggaagagtgatgctacccatatttgagtttctcccacatgctgtccaagcagataacttttgcctcatgtagggctccaccacaccactacagaggctgtgtggacagagaggaagaagccactaactgccagggtttagtgggaaaagcatgacaaaagagggaacaatcaagtcggccattgaaggttgtgtaggagtttgctggatggatgagtgaaggatgttctcagtagcaacacgtgcaagtatggtgcatgccgcctgaaggccaggggaaaagggggtgcgcaggtgggaaagaccatggggagcatctccaagggtcttgtgtaacttgacccttgtcattgtcttagacctgctgggagttgcgagcagtttctaaggcagggaagtgatccgatgagacggatgctctagaaaggttgccgctatgaagcggagggaggtttgatggggctggggcctggaggaagggaggccagctggggggtggtcagcactgggagatggagaagagggaacgagttggagacggattcaggacttggagagtgatcacagacatgggagatgattttccaacacagcagcctccagccatgatgacaatatgacggtgacattaatgatagcttcgattcctgagggcacactcagaacctgtgtgtcgggcactgttctgagcacactgcaggtactgactcatgtatgctctcaacagccccatgaagaaccagcatcatccccatcttatgactgagggaacaggctcaagaatgttcagtttttcccagggctatcagctgaacatggtgtggctgggccctggctgccactgcccctgccctcctcctttccatgtgaaggtacaatccacaccaaaggctcacttctgtgcctcccaatgcccagctggagccacacacagctcttcaggccccacaattaattggcatcctccagacatctgagagagcccaaggggaccaggtcaggagcacgctctggcaggattatcccaccagggcccacatggatgtggctctcaggctccgaggctgctcccagggagcacaggtactggctttccttccttggcagggcatcacctgcgggtccctaaccttgtcccctggaaacctcacctccgacgtacacctgtccatcccccacccctccctatcgccccatctgcggtttccacttccgcccctctcaaagaccctcttcatggttctggtgaacggacagagcggctggagcccgtgtggccacctggcgtggacctctcttggccgccgtccccggccccccgtcctcgcttcgtgaggatgggatggagtctccagagtggggaggtgcaggggagccccagggaagggatgggttgaaagaagcttcagtggaaagttcatctcccgccacatccttcagctgtttaccagtttgacggagttctggcatcctgacatgaaaagaggctcacctctcaccaacatcattgaggaaggaccgaaatagcaacaaagggagacaaaggaggggggcggggggtggggagagagagtcatgagacagagaggaaaagaggaagacagagggagggagcggtgtgcctgagcagacagtggaaggcaggagcagccagacaaagcctttgtcttccctggccccgaaccccgcacttgctggaccccttacattgtggcctcacttaattctcaaaacctcccagagccttaaggtctcctaacgtctgttaccttccctgtgggaaaagtgaagcccagagaagtcatgggactagttcaaggtcacccagctaggaccaggggagccaggttcacagccagtcagtgcagctaccacggggcaagcaggagggcggggaggagagaagatggaaaggtgataggctggagggggagagggtgggtgggaggccgggagaccatgacacgttctgtcctggggaaggatcccccaccccctccgcagaggacccgggccctatcctggctgagggcaggtgccccctccctggctcccttcccccagctcgtcccacttgcccagccacccaccaagtgcagaaggagggggaggggagggagtggtccccagggccatgggctctggctgagattcattttccttcaagccccctgctcacaaagagtccctctacctgcgaggtctcctgcctcccctccctacgcttagcccgaccaggcccacaatcactgcctcctcttcattcttccacacagtggggagacaaaatgatcctcgtccagacactcacagacacattcccctccatggcctccaggtcacacacacggctctccctagaaacaacagcactgggtccatggggctccgcttccttcccatggcctcccctctggggtgaccatccctccctccaggcctcactctctgccctggtttcaaggcaggtgaaggctgtttcttatctgaggatgagatactaaaataactggggtcagtagcccccctcaacttttctgcatagccaagacacagcaatacccttcatcgcatcactccgatagtcaccctcttttcccccttctgtggccggtgccgtgacttcctgcagtctgctctgcgtttgctgcccttgcctgcagtcctcccaccttcttggcaacctgaagactaggtgggtgcatcctgcgtgcagcaggagagactcggtacatgctagagatgtacagccccagacgcatgtctgtccctgcaggaccctctcagctcatgcccacgctcaccctctagcaagaacaacccatcctgtaagagagcccttctgtggtccagggccaggcaaggccacccaccgcagcctttcgtccccaggccacctaccctggggatagctagtgtagggctggaagcagccaagtcctcctgctaacatcaaagcccctctggctgtggggacccctctgaagtacatgggtgatggcagtagcattaaccctggagctctgcccagtaaaaaccccaagatcccctccctcccttcctgttccaggaaactcacctcttctgcccatactcaagtcttcctactgctttgtcaagctctcttctcctttcctgattttatggcttgttctttctttctttttctttttttttttctgagccagggtcttgccctgttgcccagactggagtgcagtgatatgatcatagctcactgcagccttgacctcccaagctcaatcaatcctcctaccccagcctcccaagtacctgggactacaggcacacgccaccactcctagctaattctttctttccattctttcttttcttcctttatctcgctctctttctctctctctttctttttctctttctccttccttccttccctcctctcctctctctctctttctttcttttgacacgaggtctcaccatgttactctcaaatgcctaggcacaagcgatcctcccacctcagcctcccatagtgctgggattacaggcatgagtcactgtgcccggcctgcctgttctttcactgagacatgtttgagatttgtatgcaccttgcacgcacccaaaagcacactttcctcccagcccctcactagtatctggcagagagcccagaaccctgactctgcccccgagagtgagctccctgcacacaggctggcacagccttgtgtcaccactttattgactgttcttaactcactgacccaaggcctgaccatcccagtgggatgaagccccaggggcagaaggaagttgatttaaggcaacatttgtcaaaactgtaatccatgtacatcttcacagtttttgctttatctgtagaccatttgttctttgggtcacttgatagtttttctttaagtggactcacttatttaaaacttaaatttatttaaaaaggaatttttagacatcttaaaaaatatctggcaggtacttttcaaaaatgccaatgtcatagaatacaaagactcaaaaactgtttcagatgaaaagagtcaaagaggcatcccgagtgaaggcaaggcatgacctgacgttttcttttgccataaaggacattacaaggacaggcagtgaaacaggaaggaggtctagtgactacagggttatatcagtgttagttccctgattttgaaaagtgtactatacttatgtaataaaatagtcttgcttttaggaaatacacactggagtactgacacatttagaggtaaaagaggcctggtgcggtggctcacacctgtaatcccagcactttgggaggccgaggcaggcggatcacctgaggtcaggagttcaagaccagcctggccaacatggtgaaaccccatctctactaaaaatacaaaaaattagccgggcgtggtggtgggtgcctgtaatcccagcacttcgggaggctgagacaggagaatcgcttgaacccgggaggcagaggttgcagtgagccgagaccacgccattgcactccagcctgggtgacaagaatgaaactctatggcaaaaaaaggaaaaaaaaagagggatcccaactgaacgcaaggcatggcctggggttttcttttgccataaaggacattaccaggactggcagtgaaagaacagcatgcttttaaataattcagaaaaaaagtgtgtgtgtgtgtgtgtgtgtgtgtgtgtgtgtgtgtaggtaggtaggtaggtaggtagtttggtggggaaggtagggggagacacagagagagagattgggagaaaatattaacactaagggaatctgggtgaaaggcatccaggaactctactatgctcgcaacttttccgtatgtctgaaattgaattaaaatttaaaacaaactcaagggaagctacattgccattataaatggaaaaccagtatcacttggtatacgttgaagataattgtaaaataaagtaatgctgttacttttgctggacacattcgtccactagagtctgagtctaggacccgcctgttcttggttctgtgtcgagacgggcaacgatgagaggggttaaagacatcctcgaaccaacccgagacactctcctttctgtcatgagaaggactggtgcagagctgaaaagggcatcattttctcactgtgtgattctgtgatcttcagagtcctgtcctatggcttcaagttcaggaacatttgtttcgtgaaagtttaactgacactgtcagggccagttccaacatgcagccctggctctgagagagaaaacatggtccctgccctcagaagctcaacagcgtgggcagtcatgggtcctgggatggaagagctcgcttctctggatcccaaagttcctggagtcccaggaatccagaggggtgattcagggccagcaggtaccccaggagcagacaccc

SEQ ID NO: 1055 - DNA, 22625 bp, Homo sapiens
aaaagtgggagaggaacaggttgggggaggaaaatgaagagttcttttctcttctggtttccctgccctcccattcaaaggccaggaaatttctacagctaggcaggatgattggctccggcattccttaatttcagtcctcaaaatcaagagcttacaccctcagggatcttcttgcagtagagggaagggtggtgacgtacagtgaaaaacatgttggccttcttcatactgagtttgagtcccacttctgccatttctttctttcatgaccttgtgcaagtcacgactttccaagctgcaatttcctcatctgttaggttgaatgttgagaacttcccggtaggattgttatgagcattaactgcgtgtttactttgtgctgtgtcttgttctaagtgtattatggatagtcactagtttaatcctcatatcaaatggatgaggtgtaggtactactatttacactctctgacagataaggaaactgaggtatagaaggttattaagtaggttgcccactgtcataagccagtaaatggaggagctgtatttgaattctggcaggctccagaatcctgggcctgggttcttagctgctaagtgcttctccctttaaagtgtgaaaagcgcctgcccatcatgggttctccagtgttcgttctgatgtctcctccattgtctgaccttcctcccttaccccgaagaaccgaaacatgcagatcctgagcttgcccacaatctaggccttgggtcttctgttctttcacttggttcccttacctgtgtctctgttcctctctagaaccttcatggcaaaaggcaagacttctgtttgttgtacctgacctgtggcactatctctttaggtggacatcttcaataaggagctactgctaatccccatccacctggaggtgcattggtccctcatctctgttgatgtgaggcgacgcaccatcacctattttgactcgcagcgtaccctaaaccgccgctgccctaaggtttgagggggtaggagagagatgggcaaaatgtggggcggtgcagtggcaaggcattgcaggaagaagggtgggctttgggtctttgaggggcgacctgggcatggtgtctgccagcactgtacccaccatactgtgttcaattgagaaacttagggcatcactttcttttcccccatccacatagcatattgccaagtatctacaggcagaggcggtaaagaaagaccgactggatttccaccagggctggaaaggttacttcaaaatggtgagtttcctgagggaggggtatagggtgttggtggggacagtggtagaaggcagaaattgaagtcctacccctgggagtctccatgtgaagggcctgctttctttctcttctctagaatgtggccaggcagaataatgacagtgactgtggtgcttttgtgttgcaggtaagcagatgatggggccacctcccctagctctgaagtcagttgggttaaagggtcgggaggctgttatgcatcccctcatttggctcatagtcagttgtggagcaggaagtaatctgttttagaacaccaaaacactggcttcactggttctcttctggacttctccatcccacattgggactgggtctctagtcttgggcctctggccttcatagagctccctgctaacctccaactcagtgtattttctccatctaaaacattctatcaagtaagaacactagctttagagtcaggctgtttttgaaccccaggctgtgggaccctggctccctttggggatgttctctgaaggatggagacacatctcatatgaaatgtgtagcacaggtcctgacacggggggtttctcatggcttgctttgttaacacccagtactgcaagcatctggccctgtctcagccattcagcttcacccagcaggacatgcccaaacttcgtcggcagatctacaaggagctgtgtcactgcaaactcactgtgtgagcctcgtaccccagaccccaagcccataaatgggaagggagacatgggagtcccttcccaagaaactccagttcctttcctctcttgcctcttcccactcacttccctttggtttttcatatttaaatgtttcaatttctgtatttttttttctttgagagaatacttgttgatttctgatgtgcagggggtggctacagaaaagcccctttcttcctctgtttgcaggggagtgtggccctgtggcctgggtggagcagtcatcctcccccttccccgtgcagggagcaggaaatcagtgctgggggtggtgggcggacaataggatcactgcctgccagatcttcaaacttttatatatatatatatatatatatatatatatatatatatatatatatatatatatatatatatatatatataaaaatatataaatgccacggtcctgctctggtcaataaaggatcctttgttgatacgtaagtggtggtcttccttaaggggcttcaaattagtggatatgcttagctcagaccttccagccagtctcttgagactaaagggttcagctttccatccctggctcaggcactgccaacaccttgtcttcacccaaacaaatccccgagatgggagcagagagcaggaaggagggaaagtagataagcctcaagaataagggcatccgagagggaagctggggaactggacacaagggactggggaggggaccaaccaggattcatgatagtaccccaaagccctttacagttttcttccatccctccaccatccagccaggggaatcctcccatccctacgatatcgctgttgattccttcatccctggcacacgtccaggcagtgtcgaatccatctctgctacaggggaaaacaaataacatttgagtccagtggagaccgggagcagaagtaaagggaagtgataacccccagagcccggaagcctctggaggctgagacctcgccccccttgcgtgatagggcctacggagccacatgaccaaggcactgtcgcctccgcacgtgtgagagtgcagggccccaagatggctgccaggcctcgaggcctgactcttctatgtcacttccgtaccggcgagaaaggcgggccctccagccaatgaggctgcggggcgggccttcaccttgataggcactcgagttatccaatggtgcctgcgggccggagcgactaggaactaacgtcatgccgagttgctgagcgccggcaggcggggccggggcggccaaaccaatgcgatggccggggcggagtcgggcgctctataagttgtcgataggcgggcactccgccctagtttctaaggatcatgtctgcgagccaggattcccggtaagaaaggcatttgcaagagattgtggctgcttattttgccgcccccttccgacgggcccgccgggggtagctgagaggcccaccagggttgcgggagaaaccgaaccgggtggggggagggtccgacttggaggggcgagggggaagacccacggccgacgcggccaccaggtcgaggcggagggtagggacagcccggctagggtcaggcgtgcgaggtctgttacgaggcctcgacccgaggcggtgccatgcgcgaagccccggcgctgagtggcgagacggggtcgcgacctggcgtgggaaagaaaggtggaggcggccgccactatgtgtggcccagagccggcaggtccggttgcctccctgtgccgggggagggacggcgcgcggggttccggagcattctgacggtaccactcgcgagaggcgggggtgcctggtccttagatccagtcacttcgtcgcggctaaaacacgggtcggggagaagaaaccggccgttcagtgtgctggttttcttgacggccaggactgagcctaaccccgaggagcggccgcgtgaggcaccaggagcccacccggcgccgggcgggcgggtccattttgccgcacaagccgggctattggcaaactgcggatgggcaggtccaccttccttcgggggtgagcggcctgaggtatgggagggcgacgctacttcgcgacgggggcgggcgggatgtggattgttcatggaggggtgggagacgccgccgggtggtcgagggagcgagcacatggtggcctgaggcgttcccctcccccagtctgcttcgcttctaagtgttgtgcaatctccccctttgctagctcggcttgggctcattgtgcgcgaggccgccaccgcccgcggcctcccacatccgggcaacgcgaggggggggcttcggctggagggagtgggggagggcgcgggcgggatgacgtggggggaaggggatgtcctaccctccgatctgggaggtgaagggcgggacttccagcgcgctggtgctgcggtgggaggtgcacgcgcttgggctttaagcggctgggtcgggcccacgtggacccggcggcaagcaccacctctgggcaccgtgagcgcggcggcacgcctgccggcctgtcttcagaaagggtcacccccttatgtcgggggtggcctggcctgagccgctgcctgcatggggcaaatgcctcagttttatagaaactcctcctttgggtattttttgggagctggtgggagttggatctgggacagcagattgatggcatcatgcaggccactcctgacagagcccggctgtcaggatttctgagtgcttcggtcgggcaggggacaaaacttatgctttaaaccaacagatccagagacaatggccccgatgggatggagcccgaaggcgtcatcgaggtgagactggagaaatggaattctgtcctcccccattacaactttcagccgtatagagttagagtggcctcttgattgatttcccagatcatctagaagcagctggtttccctaaagggaggagggttgtaagctctgaggcttttgttagtaggcaccagattctgtttgctcggagactacagctcagctccaccttttccatgactcaagctttaatttctttgcatcccctagagtaactggaatgagattgttgacagctttgatgacatgaacctctcggagtcccttctccgtggcatctacgcgtatggttttgagaagccctctgccatccagcagcgagccattctaccttgtatcaagggtgagacctctcagtcccagaagacattgtggactgtccctgacctgggtagagtggcatctggttggtgatgcccatctcatatcagccagggacaaagcaactccttgttcatcccagcttggcttttgatccgtgcccatgcctggttcatgccttggacacataggtttcctttaaagaggtggtattgtagccagcttatatttgcatctacagccatgtttctagtccagcttggtgtgcaatactagatgagttaataactggtccttgtttctgatctggttcccattgtgtaactgtgttgattgggaaggtagtttgtgagccatgaaatgcttggttcattggttgcttattgacctcattaacctaggacttgaatatcccaaagggtatgctctttaccacattcaactcctaatttatttgtttaggttatgatgtgattgctcaagcccaatctgggactgggaaaacggccacatttgccatatcgattctgcagcagattgaattagatctaaaagccacccaggccttggtcctagcacccactcgagaattggctcagcaggtaagagtggcttctattccctccttcagggctgatttagggatgatgagtataatccaaggaccagagaagtcttctctgatcaccaccttgggaggaagacatgggtgccctaacactctcgagacctgctgggttaattaaaagctatttcttacccaaacgtaaccattgcttcctccacccatttcctgagtcaaatgggaaagctgttgggtgaagcctggctggctgggcaagtttgactgtgttctgaataagcaccttcactatgggctaagagatcccttggtgtgggggtgatcttacagtagtcagagcagatggacagtccttttcacccttgcttaatagccagagctgtttcatgcctggggcacacacaattctaatgctggactttttcctgggtcatgctgcaacactgatgtcagagcatgtttttaaatgttctgtggcaggggcagtgattattctgggtgtggataatgtaagaagttacagcagagctccattctaaggcacttggctctcagttttctcagagtgaacatgcctcgtagcttgggtcctatggcaggagtgcaataggacatggatatgcatcacctgttctataaaactggttgctggctgggtgtggtggctcaactcgtataatcccaacactttgggaggccaaggcaggcagatctcttgagatcaggagttggagaccagcctggccaacatagtgaaaccccgcttctactaaaaatacaaaaattagccaggcatggtggcgtgtgccttttatcccagctactcgggaagctcaggcaggagaatttaacccaggaggtggaggttgcagtgagctgagattgtgccattgcactccagcctgggcaacgagcaaagctctgtctcaaaaaaagaaaaaaaaaatggttgctgcgtgatgaggcagttggtcaaattagttttcagaaggttaagggttctaaatatctagagtaaagaaactgaattaattatctgagcggcctcattgtgaatcactgtacactcaggaaccagactgagttgaaatcctgtctttgccacctattgacagcacgatcttaagtggattttagcctctgcctgtttctcagctgaatgtgagtttaataatagtgcatgccccaaagttgttggttaggaatcaatacatgaaaaacatttaagaatggtgccgggcacagtggtaactgacatatgagcacctgcctctctctgctcagatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtgtgagtaattcggttctccaatcccctgggtcactttgctcttgtgcacgctttccagtctttcagcgtaagccagagtcattcccaaggatgctggtttctctctgggggaagagctgctctgtgatggagcccatgcgtgtcatctgagcctctggcttccctgccagtgcagccctggcagtgtcctacttcccagggctgttgtctgcctggcgggaaggtcctgggcaaaggatcagtctttgtactctgagagcagactacttggctcctctctgttttttatcagcgaagttggatatatctctcccacatttccctaatcatatgctatatattggctttttttttcttctctagcccccaaatacatcaagatgtttgtactggatgaagctgacgaaatgttaagccgtggattcaaggaccagatctatgacatattccaaaagctcaacagcaacacccaggtgagggcagtcttgcttgaatagctaatgattcttgaaaaatagtaagtgccaggggaaccatatactggattcttgagcctttttatgcatctgcttcagttttaggtgtggctagggaagggagcaggcctcaggaaggaaccagcactctaagactggcctttttttccactaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggtggggcccagtgcaggaggcgggcctggtagtgagttgttgggtatagcccctgactgatttttgtcccccaacctccaggagtggaagctggacacactatgtgacttgtatgaaaccctgaccatcacccaggcagtcatcttcatcaacacccggaggaaggtggactggctcaccgagaagatgcatgctcgagatttcactgtatccgccatggtgtgtttgcccgctgccagcctgttgtgggtctgcccgtcagaagtgtcctacttgaagccagggttcctggaacccaggtgcctacctggtctgctgcatatttgttttctcttccagcatggagatatggaccaaaaggaacgagacgtgattatgagggagtttcgttctggctctagcagagttttgattaccactgacctgctggtgagtagagggaactgatagcaaaggcagaagggaggatccaaggtgattccctctccaaggggacatcagtgcctctcaggaaagtagcagcttggaatagaatctggcatgcctaaggcctttggggaactgggatgcttatttcctctgccttccttggctgcccacatggatgcctaagtgtcttccctccgggatagagtgtcctccgtgcacatgctgaagagttgtctttcttgacgtaggccagaggcattgatgtgcagcaggtttctttagtcatcaactatgaccttcccaccaacagggaaaactatatccacaggtaagcgtagatctggaacactcccctaccccttcacacctggccctccctgggcttaaagctcctgatattcctcatccccttccttgttttccagaatcggtcgaggtggacggtttggccgtaaaggtgtggctattaacatggtgacagaagaagacaagaggactcttcgagacattgagaccttctacaacacctccattgaggaaatgcccctcaatgttgctgacctcatctgaggggctgtcctgccacccagccccagccagggctcaatctctgggggctgaggagcagcaggaggggggagggaagggagccaagggatggacatcttgtcattttttttctttgaataaatgtcactttttgaggcaaaagaaggaaccgtgaacattttagacacccttttctttggggtaggctcttgccccaggcgccggctcttctcccaaaaaaaaaaaaaaaacactaatccatttccctaacctagtaacctccagatcccagaggctctcctcacctcagctgagctcctttgaaagtgattcaagggactatgtcactcagcctcatttgctggaccaaatctggagggagaacccctaaaacccctaagtgaggttgcccagggggttgtccccaggtggggggaagcaggggagagaaaatggtagccatttttacattgttttgtatagtatttattgattcaggaaacaaacacaaaattctgaataaaatgacttggaaactgcctgtttgggcttctcatttcttacctccccttccctctcccacctgctactgggtgcatctctgctccccccttccccagcagatggttacctttgggctgttgctttcttgtcaccatctgagttctcagacgctggaaagccatgttctcggctctgtgaatgacaatgctgactggagtgctgcccctctgtaaagggctgggtgtggatggtcacaagcccctcacatgcctcagccaagaggaagtagtacaggggtcagcccagaggtccaggggaaaggagtggaaaccgatttccccaccaagggaggggcctgtacctcagctgttcccatagctacttgccacaactgccaagcaagtttcgctgagtttgacacatggatccctgtggatcaactgccctaggactccgtttgcacccatgtgacactgttgactttgccctgatgaagcagggccaacagtcccctaacttaattacaaaaactaatgactaagagagaggtggctagagctgaggcccctgagtcaggctgtgggtgggatcatctccagtacaggaagtgagactttcatttcctcctttccaagagagggctgagggagcagggttgagcaactggtgcagacagcctagctggactttgggtgaggcggttcagccatgaggctggctgtgcttttctcgggggccctgctggggctactggcaggtaaggaggaaggaggctgaggggagggggcccctgggagggagcctgccctgggttgctaaccatctcctctctgccaaaagcccaggggacagggaatgactgtcctcacaaaaaatcagctactttgctgccatccttcacggtgacacccacggttacagagagcactggaacaaccagccacaggactaccaagagccacaaaaccaccactcacaggacaaccaccacaggcaccaccagccacggacccacgactgccactcacaaccccaccaccaccagccatggaaacgtcacagttcatccaacaagcaatagcactgccaccagccagggaccctcaactgccactcacagtcctgccaccactagtcatggaaatgccacggttcatccaacaagcaacagcactgccaccagcccaggattcaccagttctgcccacccagaaccacctccaccctctccgagtcctagcccaacctccaaggagaccattggagactacacgtggaccaatggttcccagccctgtgtccacctccaagcccagattcagattcgagtcatgtacacaacccagggtggaggagaggtaaagctaaaactgggggatgagaggggagggaggcaggactggatataggctcagagggaagaaggaagaggggacagggaaccttggccggcatcgcatgcagtcttgtgaccttccagtctttaacttccgcaggcctggggcatctctgtactgaaccccaacaaaaccaaggtccagggaagctgtgagggtgcccatccccacctgcttctctcattcccctatggacacctcagctttggattcatgcaggtatagccatgacctcagtctcacccctcactcagcctcccggcgcccctcccctcccaatcccacacgctactccttcctctgtggagagggataccacctgcgccttcctcttcgccccacaggacctccagcagaaggttgtctacctgagctacatggcggtggagtacaatgtgtccttcccccacgcagcacgtaagtaacctccttccctttctcattgctaccactagacgccagggttcctgaaaggactaagctggggccagggaggtggataggatctgacccttcctcactcctccagagtggacattctcggctcagaatgcatcccttcgagatctccaagcacccctggggcagagcttcagttgcagcaactcgagcatcattctttcaccagctgtccacctcgacctgctctccctgaggctccaggctgctcagctgccccacacaggggtctttgggcaaagtaagacctacctactccttccctcctagaatcctcccactgcactgaaaaccccttccccaggcccataagccactcatctctcttcttaaccccccaaatctcgctctcccagcttgtcatggctacagggcagctttctttccatcctctacaagactctgccagtttcccccttttatcactgctgagtcactgcggtgagctcctcaccaatctcctactccccagcatccccccattccctcctcccacctttatcccaaccagcacgtcactgcaaatacctacctgccctatccttccgccaggtttctcctgccccagtgaccggtccatcttgctgcctctcatcatcggcctgatccttcttggcctcctcgccctggtgcttattgctttctgcatcatccggagacgcccatccgcctaccaggccctctgagcatttgcttcaaaccccagggcactgagggggttggggtgtggtgggggggtacccttatttcctcgacacgcaactggctcaaagacaatgttattttccttccctttcttgaagaacaaaaagaaagccgggcatgacggctcatgcctgtaatcccagcactttgggaggctgaggcaggtggatcactggaggtcaggagtttgagaccagcctggccaacatggtgaaaccctgtctctactaaaaatacaattagccaggtgtggcggcgtaatcccagctggcctgtaatcccagctacttgggaggctgaggcagaactgcttgaacccaggaggtggaggttgcagtgagccgtcatcgcgccactaagccaagatcgcgccactgcactccagcctgggcgacagagccagactgtctcaaataaataaatatgagataatgcagtcgggagaagggagggagagaattttattaaatgtgacgaactgccccccccccccccccagcaggagagcagcaaaatttatgcaaatctttgacggggttttccttgtcctgccaggattaaaagccatgagtttcttgtcacatgcctttctatgccttccatggctgggtctcagggagccggaagcagctgctgaggagggatgaaaatgtcagtgtgtgacgatgcctcatgggttcaccccccaaagcctggcacagctggtgttgggtctgccgtgcctcccttccttcctcctcttggggccactggctgctccagttccccatccgtggcaagccggtagagccattcatccccgcagccttcttcctgaccctcgtacagtttcaaatgcagcagacagccaaagcaatgagtggggggctgtggaacttcattcccaaaggcagcgccagtggctcctgagcaatgagaatgtcctgtcctgtccaccatattcaaggccagcagaagagcccgattaaaccctcgcagcacctggcatgctcctatcccacctacaaggggttgaatcaagaaggagcagtgggtactctgacctccactgggggctcctgggaacagcatgccccccacacggggccacctgccaagcctaacttcatgcccccagtacttgagatgaggagtgtcactctcaggacagccaaggtccagattccagaaaggacctcccagatggccacagcctgcaccagcagtgagcgccagtcccacccattacagctggctacggcgcaatccctgggagccaggatgagcagcaccccccagccgtaggagccccaggaggcttccggcctccaaggcccagagactgccccacaagggcagccctcacctggcagggccccagcagccccacctctgcctgcagacatccgtgtgaccttgtagactttggaggggggccgccaaagggctgatccacagcggaatgacgcacgggtgggcaccgtgggttggcgtcccggcggtcggtaacgaagcacaacgcccccaccaggtagtccaaggtgccctttcccaagcagcgctgcagggtccactcggcctcgccgaagtctctgcccagcacgtggtgcgccctcgggccagcggggagggggcgaatcccgggactgcctcgccaggcctcggctccccggagactcttgggggtctgggccccaagggtgattcaggtgctgcccttccccgacctgggctcgcctcccccacctcctcctctgcttcactgtcccgggcccagcagttgccggcgcactcatgctccgaggcctgagccaaccggaggcgagacaagcacagggccctgcgcgcaacccggcacctaaggaggcctgcccggtgcagactctcctgctcccaccggcgcccttccctctagagacgctgagagaacgggagctagtagcgcccccacccaacgccacctcggagactccggctccttctctctcaacttcgaacaatacaaagtgtgctaggagaagacaagatggcgcccagcaggaggagcggagaaaggcaggggtgtaaatctggcttccaaactggaagcgtcaacaaaggcgtgggaggtctaaccgcgcaggcgtgcagcttcggcaagctttacaattccaacagcgcgtccaaaacgtggtccctgactgagacttattttacgccactagagtgagggtgggtagcgtcagaaagagcggggcacggggcgggccagcttcgccgcgggaaaagaacgggaggcggagtgtccgcagcgcgcacgcgcaacgaaagtcaatggcggtctggagagactggcggaagctagctttgcaatatggcggccgaggcggacggaccgcttaaacggctgctcgtgccgattcttttacctgagaaatgctacgaccaacttttcgttcagtgggacttgcttcacggtgagttttattcagcatccgatccaagtcctactcgagtgaccgtgggcccttagtccaagccttgatcggcgactaagtgacggcagtgactgccgccatgccgagctggacggaagtcacttctgagaagggcggaagtgtctcgggctccttagagggaggacaccatattagtgccagtggggaagtcaccgggtggaattacttctttgtggagtttgtgctgtagcgacaatgaaaaacgaagagtcaacttttataaaacaaaataaaaattaagtcaaatcatgccaacctttattagatcgctagcagggttaaacttaattcaaagcccctgatgaatcgggccttcattgcacccccaaaggctccgccaccctgattgctttctttccagcctccaggtttgctcatagtctgatttcggaataatttgcctcccttcctttttctgattgcgagacagctccacaagggtcaccgtcagaccgtttggggagcgtcagtctgcccctgtcagttcatggtacctctcttgagctcgtggggcactttgttttagccgcattcatgacccgtgagagtcagactcccactagaccaagttccttgaggggaaggcttcaaggctagagaagttgtggatggccagggcataaaagcaagccttgaaagggtaaggtttagtccctgagtaggggccagggacagtcagagtgttcaagaaagagtggtatggggcgggcacggtggctcacgcctgtaatcccagcactttgggaggccgaagcgggtggatcacctgaggtcaggcgttcgagaccagcctggccaatagggcgaaaccccgcctctactaaaaatacaaaaaattagccgggcgttgtggcaggcgcctgtaatcccagctactcgggaggctgaggcaggagaatcgcttaaacccgggagacagaggttacagtgagccaagatcgtgccattgcactccagcctgggcaacaagagtgaaactccgtctcaaaattaaaataagaaaaaaaaaatggtatgaagacttgtctttggagagagaagacatgtgaaatggggcacccattggcccagagaagggaaataaaggatcagagagctcttgggcatttctcagctttatatggggaagcaatggagagccgtggaggtcaagccaagtttgggtgttaatttatagggaatggaagattggatgtggggggtggtaggcatcggagaaaagctgttttggaaagtaacagtctggggcccggtgcggtagctcgagcttataatcccagcactttaaggaggctgaggcaggtggatcatctgaggtcaggagttcgagaccagcctggccaacatggtgaaaccctgtctctactaaaaacacaaaaattaaccgggcatggtggtgtgtgcctgtaattctagctacttgggaggctgagacaagagaattgcttgaacccaagaggcagaggctgcagtgggctgagattgggccactgcactccagcctgggtgacagagcaagactctgtctccaaaaaaaaaaaaaagtgtggtggtttggagcaggaaggaccaggactttctcactgccctccgcctctcctccccccaagacaatgcaagaccctggtgtgggtaagggggctcggggagagcccacaggagcttcaagccctggcctgggtttcagacatctcctgtctgcttacccttttttctctcctcagtcccctgcctcaagattctcctcagcaaaggcctggggctgggcattgtggctggctcacttctaggtatgtctcttatctttctttccagctgttgggttggggtggaggtgctgagaggccatcaactgtgtgggtgttcgttctatagctgttgtgttgcatcccaaagaatggagagtcctcagtcctacttttctcatctttcccctagtaaagctgccccaggtgtttaaaatcctgggagccaagagtgctgaagggttgagtctccagtctgtaatgctggagctagtggcattgactgggaccatggtctacagcatcactaacaacttcccattcaggtgaggggcccacccttccaccccaagggtaatacccacaactctaatggggattaaggtgaaggaggttacaaggcagcaaagtggccgggcccagtggcttgcacctgtaaccccagcactttgggaggccgaggcgggtggatcacctgaggtcaggagttcgaactggccaacatggtgaaaccccgtctctactaaaaatacaaaattagctgggtgtggtgatgggcacctgtaatcccagctacttgggaggctgaggcaggagaatcacttgaacctgggaggcagaggttgcagtgagccaagattgcgccactgcactccagcctgggcaacaagagcgaaactcagtcttaaaaaaaaaaaaaagggacaaggggctaggaaagttttaagcccttttagaaacctaatcatcaccagtggaggtgatcttgagaaggggtgagcatcccgagaatggccacgattcagaatgagccagtcccgtgtgggggctgtagagaagcgtgatcagagcatagtgtccctggatggatgggctatggaggctttccctgcctctttctaggcccgcctttcttcctcccaactcttgactctgcagctcttggggtgaagccttattcctgatgctccagacgatcaccatctgcttcctggtcatgcactacagaggacagactgtgaaaggtgctggggacttacccaagagcaggctgtgtggttcctgggaaccctgctgggaactcaggtctgggaaagccaaatgatgtggagagattgacaaggactcctgtctccccacccctaggtgtcgctttcctcgcttgctacggcctggtcctgctggtgcttctctcacctctgacgcccttgactgtagtcaccctgctccaggcctccaatgtgcctgctgtggtggtggggagggtgggtaccaggagcaagggacaagatgttgtgggggcagggtgggggggaagagtagaagatcaaagtgtgggggtgttgtacttgggggagcatgggaagagctcaggtgacagagccaaaggtctcaactcctcccctagcttctccaggcagccaccaactaccacaacgggcacacaggccagctctcagccatcacagtcttcctgctgtttgggggctccctggcccgaatcttcacttccattcaggtgagtgcaacatcttccttctagaaggcactaaaacctcgtcttacttctcccagctaagggccaaagctgccccgtgaggaacctttgtccataagggaacctttcttgagctatgctgaagggtaaccctggctctgtctcttgcaaccaggaaaccggagatcccctgatggctgggacctttgtggtctcctctctctgcaacggcctcatcgccgcccagctgctcttctactggaatgcaaagcctccccacaagcagaaaaaggcgcagtagagccagctactggagtcattccgtttccactcattcacccaacctcagggttctccccatctgagccagcctgctggtgtgacttactcatcctccattcctctgcacttgcagactttctgagccagggttttcttttagtggaaacaaatggttgatggatccagatccttagaaaaggagaggatgggggtagagtctcccaagccaaaattttgacatttgagtgctttcgtaagccctgtacatgtactattaattcagtcattcagccaagcctcctcctctagcagcaatttccagctgtgtaacactatcctgggcaaatgttttaccctgtcctccagcctccctgcttcccttctggccctggaagactgagtctggacggcagagtggagggactgggaggctgtggctgcctccctccctcagcccggctgggactgtctcccggaccccagtgctggggtgggggaagggggacggagaatgactcaggcagggccccagggtggggtgaggaggttcctgctctggcaggtctaggcggaagggagtggagatggggctggttcctgctgcagtgaggggaacagatgggacaataaagactggagactcagttgaataatacaaaactgtttaatactaccaaaaatataattgtatgttgtgcggctctccctggctatcatgggaggactgcaggctgcctctgaactgtagtccaacaggagaaagggttgacagcctggggtaggggatgctgctggattaaaaaaggaggatgaggcccgtcccgtgaggtctgcgtccatgagggttagaggtgggttaggggcatgggggcaccagcaaggggagggttgtatggagtgggagagccagggggcaggtagtgggtataggtgggcagcagttccccctggagcctagggtcactctgagggagggagcacggtgagggggcttccagtttgcagtgggaagagctgcagagagaaacaagaggttagagggcacttccctgggttggaggtgagtctggccagttctgggcagacagggtagagcgtgccacccacccagccctggctacccagcccgctgggcgcagcaggcatggaagccgaccccgggatggagagcccgcggccctgttggggcacgctcgggagcgggcttgcgtgctgcacggctgttttcctcttggggagtcaggccaggaaagggcagaatgagctcggcctctccttgccctgggggctgggagaggaagctgggtcacacacaggccagaagcaggggggaaacggggcatctaactaggacacagtcgcatccaggggtcagtcacctgaccctacagggcccaccaccttcagactgagatggaaacgccctctgggagaaccctgatccgccccaccctacacaggccccggaggtactgggcctgcgcccgccacaccttggccgcgagtggcctctgcttgggtgggctcccgtcctccggcatccgcccccaccaaggctccagaagaggggcgcatgggcctccgtcttcggcccgcttcccaggcactcacccatagctgccaggcaggtaggctgtcgagtagctggggggtctgtacccaaagcctctgctcggttgggtggtcgcgtaccccggcccccagagcgggccgccgctggccaggttgcctcttccctgtccgcagcgggaaggtccggcgcccgagctcttggccttgcgccgaggccggtacttgtagtcggggtagtcgcgcaggtgtcgggcgcggagccgcttggcctcctccacgaagggccgcttctcgtcctcgtccagcagcttccactgcgcgcccaggcgcttggagatctcggagttgtgcatcttggggttctgctgcgccatctggcggcgctgagcggagctccacaccatgaacgcgttcatcggccgcttcaccttctccaggggcagcgtcccgggggccgcggggctcccagcgccctcccgctcctggggtcccgaagatgaggaggcagcagccgtggcagccggaggctccaggctccaggcctggtcctgtgaggagcctggtagcgccatgggttgggagaagccttaagagggcgtcctgaatgccctcccctcaacgtgaagcgtcgatcctgaaaatggaaaggtcttcccagtctggagtcgttgccgaggaacttgggtccttaaaaagtgtattttatccccaagcccagagcttaaaccggagcctttgcttccaacctgttcggcacactttggggagagtcgaatgcaaaatccgctgtctggtgccccggcactgaagaggtgttctgaggcctactgactgggggacccccggtccctctccccgacccgcagctgcgatcagaccgaccttccgtggagggggtaaaccataaacccctttgtggtctccggagttccgacagctgccaggcgcggataggccagacctctcccacctgggctcagcgtttgtggcaggcgggccagacctgggaacagcttttaaagactgactccgcccctgtccctcccataagactgcacctccttaagggcgccaacatcctcagcccgtaggtaaacccaggtgtcctgtttgtcccagcccccaacaccctcagggtgccacgccccccgccccccccacccaagacctgatgtcaggccttccagcccgttgctgattgcctcccctccctgaagcacaggcaatttaaagccaattctttccacaatgggatcaaacacagggggatgaagtgccctcagggcccgagttgtgctgagaggagcttgggagcatcccggaccaccaccccaacccctttcctggtgcctgttgctcctcaaatcccagaactgcccctggggcaagaaaggccgaggagggagaccatttttgtttcctgagtcattccagcaggtgcttgggccgtgattcaacccctttcccaagtgagaaaacttaagccctcccaactccagtccctaaacctatatttctccactgctattgaattatggcaagttttagcttcagtcgtccaagtcatgaggggggagccaggaaacccaggacaactccccaagttaagaggtctgtgatgcgcatgccggagaaaaagcctggagccagaacagaacaccaccaagaaggccggaccccgggctccagaggctgctgtgagggaaccctgctccccactctgcccaacggcccagcccaagccccaggcctcaggtaatcggattaagcagcctgccttggctctcagcttctacaggaacagctccagctctgagcagccctgcctagcctgtgctgtgactcagggtataggagtggcccaactccctctaccagcaaacttgggggaggggagaagcaacaaggcacaagcccccctcctctgaaccaggagggagaacctgggcctggggagtttaggaatgtcaggaattcccagaagtaagaccatctttgggacaagagacaatgaagagaagtcagatgtggaggaacagaaaacaagagccaggggccagggcaggtcagtcctagagaaacaaatggaccaaactggggacaaagaaggcacaggagccagacagccatttggatttttttattctctttttaaatactgtacagtgaaaaataaatacgccttctcatccaccagacaaggttggtcccctccccagggggaccttgtcaccccccttcatacacacccctggttctactccaaaaccttccccgtgcctcccacccacttatctcttactatccccgtcttccacagtgatgaggccccagaaatggggggtacaggatgggaggagggatagcaggggaggccccctgaacggtcaaatctgggtgggtcgaggagcaccccccaccaacaggtggagaatgggggtgttcagagagagattggggcattagaggataaaggcacatccagtctgatggggaaggagagaggctccccttaccctgggggtagggtggacaagagggagggggtatgaccctgttacacacccctccactagctcctggaggttggggggtacccaagctgctgtgccacccccctcccccctagataagagcagctccagcgcaggtcagttgggcctgtgagggccatggtgttgggcagcaagcgagatggagaagggaggggtgcaggttggaggttttatgaaaccccattccaccatactacccaactccaagggggcggagagctccccattctccgaggggcccttaggaagcttgctgacagagtcaccctgaggggaaagtgggaaagaaaacagaaaagcaagaagcggtgagtagaaattcaggtgggagacattccctaccatccaagccctcctggcatttggtgatccagaggttggttccctgatctcatgatccagtctctcttacttgggatccagaaaatgtgaaccacactttcttctctatc

SEQ ID NO: 1056 - DNA, 61221 bp, Homo sapiens
tttacacttgtaatagtcatttaaaataagtaatttaaaaaataccttgaacttcacattcttcttttgatacaattcaatgcagtgattataccctagaaataatttgggccctgcttgcctttctttccctaaacctctttaggacagcaattctcaaagtgaggtcttcagaccagcagtatcagcatcacccaggaacttttgttagaaatgcaaattctcgggcctcaccccagacctattgaatcagaaactctaaattagatggcatttaacactacagatgagaagacggtgggatgattaattttaaactatgttttattaagcacctattctgggccaagttctggttaggcacttcatatacagtaattctaatccttacaacaactctgcaaggtagattttactgcctttataaaggaggaaactaagctttaaagtgtcaataaaggaatgtgttggggaaagaggtatataaaaactgtctgtactttttggtcaatttcactatgaacctaaaactgctgtaaaaaataaagtctttaaaaaatagtcaataaagcagatgcagcagtgctaatacacagttaggtctacttgctctaaaactccagttttttccaataataccataagaacaataatggttcttaagatggaaaagctcctatttggagataggcctttgctcaaacaatgctcagatcagaagtccccttgggttaactatcatgcctatttgagatatgtctaagtgatcatagctgtaggaacagaaactctgtctgagctaaagggaggctcgtaggcaaagagaaagcttaccttgttccacaaggcacatttttaacttcatcagtttgtagtgttgtctagggaggaaaagatatctcatcaacactcaagacacacattgtcaaaaaactactggtaccagaggcaaatctctggaaagctgctgacagtaagtacagcagagatccatcacaatttcagttcccaaagattagctctcagaacagtcatttctttttgtattctagtagaaatgaaagacttgagacagaaaatattttacagcaatttttttttttttttggagacagagtcttgctttgtcacccaggctggaatgcagtggtgcaatcttggctcactgcaacctctgcctcctgggttcaggcggttcttgtgccccagcctcccaagtagctgggattacaggtatgcaccactacgctcagctaatttttgtatttttagtaaagatgaggtttcaccatgttggccaggctggtcttgaactcctggcctcaagtgatccacccaccttggcctcccaaagtgctgggattacaggcgtgagccactgtgcctggcctacagcgaatgtttgaattaagattcactgggaaaggttcaatgttcagtctgctaataagtagaaaactcttccagagtcccttacctgcctggagctggccaggggttgtaaacaacacagcttgctcacatagatactctggctacaacttgcactctgaactttgattccactgctaatattactatttatgttgaagataaaagagattttatgcatacaagtactctaagactcaaagctgcccttgaatccaacagcaacctttcttctctaaagctgtggtcaacattttagtttaatacctagtgatctctcacatgtcctattcagtttcctttttaatagaagtgctaccaccagtactgcttcctcctggtgaaccaacaatctggtacttaattgctttgcccttgtcacacctttgttcagatccagaatgaatgacttcctgctgtactctaaggcctcaaataggtcagcacctaatgagtacattctagacatactgcatcttatcaagcacaaagcaaaggaaaaaggaatcacagtccctgtttccaaagagttcacaatccagcacaggagacaaaatgttacaatgcaatcaatccatcaacaggtacaaaacaaaacaaaacaaaaccaaaaacacaaattataaactgaactgttaagtggtaaattacagaaagtgaaaaaaatagtagtttgaaaagctctctgaggtgaaggatttataagccaggtctagagtgggagaaataagaacagatgaggcagaggaacatcttaagctcaataaatatcctactgaaatacacacagttgaagacaacatgtgtataggcgaacgaaagtagataggcttgcctggagcagaagggacaatttggatgaaagatgaaattctgacaagagaccatggtaatactagacagagggccctgaatgctggctggggagtttgggatctctctagttcaccttatatacagtcacaaaacgaaccattcaaaaatatgtttacttaattccttttctcacatgtgatgtagttctcattctccatcttatagggaggtaagaaaaccagctgggaggctaaataattaatttatttagattaattcagtaaaggccatgaaagctgtcaatccagacataatagaggaggtatctgatacttggttgatataaaattccaggaggggaaagaataaaaaataactcttaggttgagacattagaatgacagtaaacattggtggcagttctaggttaaggggattgatgaagagacaaattatatttatttcctttataacattaattcagtttccatattccacaccaactttaaatacacgttcctatttaaaccaaaaggatattctctagccaattttcaaactcagaagaactaggaaagggttcaaatgttaaatcttccatttaacaccctatctttatgtacttttatatttcttttatgtcctcttaaaaattactttcccagtatgacagaaaatttatttaaaaagtgaatctatggttactttatgaaggctgaaggttttcatataatttctccattgctttttctttttacatcatatatggaatttcacatttatatacattcctttcaattgccaagtttgttaaaccatttgtttatctggactatgtcttctaatatgttccaaaaattcctaaaaataaatttatgtcttactctcttaagaacactctttttttttttttttttttgagacggagtcttcctctgttgcccaggctggagtgcaagggtacgatctcggctcactgcaacctcggtctcccaggttcaagcgattctcctgcctcagcctcccaaatagctgggattacaggcacgcacaaccacgcccagctaatttttgtatttttgtagacacagcgtttgaccaggttggccaggctggtcttgaactcctgacctcaagtgatctgcctgcctcggcctcccaaagtgctgggattacaggcgtgagccgccacgcccggccaagaacactttttaaatatggttttattaatataattatttcctagaatgttaccgttttacacataaagaacattcctatttagtcacactggctggctctagcccatgtaaaacttttttgtagatgcgaagtattttagtttacactgaagtctctgtactaatttcatttacatctcttatgatagtttattattaaatatatacacacactatatttgttatatatatacacaattaaactccaaaatctgtttactattatctatatctcctttatttatatttttgcatcagtatgacttaacatactaagcatgaaggcagagacagatctacctggttttgaacaagatctatttgttagagccttgatttttttttttttttttttttaagagacggagtttccccatgttgcccaggctggtctcaaactcctaggctcaagtgatccacctgcttcagcctcccaaagtgctcggattacaggcatgagccactgcgccgggccttagagtcttgatttttaagggtctaatgctgccattgctaacattattatagattgtttcggctgttgatgaggttatgtaattaaaattcctcctttcacagaagactaactgaagtctatgacagttaagcaatttttccaaagtcatgccaccaactggcggtaacgctgggtccccatgttcattacaccacattgcttcctgagaaatcagctcaatttaacaacttccaccataaatagaaagccagaaatataaatgtgttacaactcctgcctttaagaaaactggagcctttctggaaagaaaacacataaaaaaacttagcaaacaatgcaagacaacaatattaaagaaaataagacaaagggccaaaatttacaatatagactttaagagctatagatcagaagaggaagaatctgggatgagcctttaaaagcctggcaagatttagacaggagaaaaggaatggagagtgagatggcagataaagaagtgatggcatgaactaaggaaagaatgggtaaaataaatatggaacaacatatggaaatcagtctgattaggggaagaatacatttcacttcagtagacacaattctttccctaagccatctaaaaggggacaggaagaaaacctaggggatttaagaatttataattaaactctcacttagcaggaagcctagacataagattacaagattaaataacacagaattttcctgagtcctgaaaaattagcagcagatggcagacaaacttctgaatccaaagatttatgatcacactgggcttgcgaaagtggtcacagcctaatcctggttttgtcatcttgttacattgaaagatacttattttattgtctcccatggccaagacacttttcgaggattagacacttatttcaaatatcccgggatgccatcaaaatataacattcactaaggttccacataaaattgtgcttaatataccaggcaaaaaaacatgaggcagaaaggctgtgtataaaaattttgatcctccatgttaacagtagcccaggagcctgcctctatggaaactaaacactgttctaaaccacataatcactggtttgtatgtctagttgtgtttctaattcttacttttattgtgacagcagcaacagaaaatttgctatataccacgatatagatggtagaagtcagtccttccaagcttcctggttcatacctttaattcatttcaagtaagtgaggtggtttaacatcataacttgtgttgtaacaactgtactctgaacgttaacttctgcatttaagtaaataccaccatctgcttaagcaataaggaaatctatctccacccacaagtgtggtaactcctgtcatgcctgtctatctggtatggaggcttcccctaggaatcactcacctgcacagatctgaacgtagtaatgaaaggcaacatgatatgatagcctggtccactggggctagttagtaaagctcctcccctgcaaaaagatgtttcaatttgacaaaattataaaaagaaaaattatctttccaaatctaaaatgctataataaatactcactcttgctcatgctgctgacctactaaagcctcactaatatgaattgctcataatgaacaactgcttaaaatacctccacacctaaaaagggaaaaagatcaaattaaactgccaatgttacaccttgtttcataagctcaaccaaccgtacctctgggtctccagcactgctctaaggttcaaaggattctcctcggtctttaaccttctgagaaatatttgtttaaaaaattctaatggctttcagtagaggtacattaatagtacataacaagagccaaatcaaaatatataatacatttaatcaccaggttgaaaaaaagacaatgcaaactttgaagtaaagagaaaatttctgaggcttataattctttcgatctatctacaaggtaattaaaatactgggaacataaaatttctatataaaaacaaaaaattagcatgaaaagatgaagggtgacaagactatacaaataaatagcataagggcttgttaaccaaatcctggaatgtgaaaactatgaaagcaagccctggaaattataaaaaggaggcatttggggagcaaagaaaacaaagtcctattttgcaccttgtaaattcatagaacttagctaccggtcttgaaaatataaacacatttgcaaggtcataataacaaggaaagatgaactgtttgaggttcattactaattctttgagtcattccttgaaatgtcctttctctggttttactgtcagaaagacaatgcttttaaactggaaggaaatctggactaatctgtaatttcttatgtagagctccatctgctaagatataccattaaaattgctctttttctaggattcaggatggatttgaaagtagaaatatcagttttgagggatagtggaaacaagcaaaaagttgacgctctttttgaatacaccattatcccaatttctccacaaactggcctctcttactagtctgtatcaaaaggaacttgtggtaattaggctgaaggaaaagctaagcgagctcaacaagagagcaacagctcccacaccactcctgtccccaacttgaacagcaacagtaaggagggaggagcatggcccatcagtgttgtgcttatgtccctggaggtccagggacataagcaccatcacagtcatcatggtgttacaagacgtaaccagacactggaagcttttaaatgaaaaagtctaagaaacaaccataaacatacagcatctacagcggcaaactaaagcctgtacagttgaacgaactataatttatccatctcttcagttagaggtagagtgactacttcctttcttccttcttcatttttctacaaataattgagtttgctgtgtataggaataaccgtagggagacttaatctctgcaacaaaacgaacatagcactaaaactgtccaacatctggagggtgctccgcaaaagcccgcttcgacccccgtgctctccctagagatgggacatgcgcccccgaacgttgcagagggaacaacttcccagactccactctggagtacccttttaatctgctctagagccctaactgactgcacatgccgctcacctgtagtacacagccagatggccctcctcaatcttgtggatggaggcgtagagcaggacagccaccaaccccaccactgcagccaccagaacccgggcttgagtcatattcattctcgttcctcctgggagcgggagaaaaggaccctcagtcccgtgagtgacaggtccaccccctccagtttctaccctctccctccggaaacttggcgctctctcgcaggctgagccggggagtccagtacccctgtcccctcattcttcccttctggctgagcccgctgaccccttgccaactcctccgcccccggaggccagtgggccgcccctgctcggtgagcttcctgaaactccctctcccaagggtcgctcccgggtggaaggcactaactgagaagaagcccagccgcaggctcgcgaggaaagccgacccctcggccgcgcctcaccgatcagtgacgcatcgcccccgcccgcacgtgcagccgactcccgcgccgagccaaccgccgccaacagccggccccgcccactcgcccagcactgcggctgcgcggggacgcacacggcgtagccccggcccgcggctagtgagacggggagcgcatgggacaaaattctcctagccgcgggccgcgcaggctcctttggaggcaagtcgctttctgtacactgctggttaactgcttcggaagaggacagcccgcagtctggagtgagcagcgaagcagagaaaaggagacgccctttcggacaagggactggttggtttgttcttgtgcagagaacccactcgctcactctcaaacggtagctgttcggtttatttgtccttttgcagtgtatgcggagccccactgtgtggcacgcacttgcttccggcagagatcctgcccttcaggagcaactaaacttgttgcaaataaagtgctgtgaaagttcagaagaggaagatattagatataacggcatcattctctcgttttttaagtgttcctattatgtgccagaatgctggtccagtgagggctttatgaaggccatccagactacaggaacagaattgctaagcacatggggcgggaggcggagggaatcctccagggagaccaaagtaagtacttcagtttccttgaaggcttgtgtgatgggaaggagtgctatggtaggcgtcactacatattctgttcgttttaaattaaaaaaccatgggcacatattgccaaaaataaaaaagggaaggaaaaaggtatagttgggagatagatgaatacaagagaaattaaggacattaatggtttaagccttgaaaggctagaggtggaactataactggacaaggtggactagggttgtaaagtcctctaacccagcggacggggtgggggtgtgtgtgggttggggatgaaactgttccacttcagatcatcaggcattagattctcacagggagccggcaaacctcacatgtgcagttcacaatagggttcgcgtgcctatgagaatctgatgccactcgctaatctgacagcaggcagagctcaaggcgataatgctcactcgcccgccgctcacctcctgctatccggcttggttcctaacaggccactgtctggttccggtccgcggcccagggcttggggacccctgccctcttgggtagggaagtatgggaaagcagtgctttagggccaatgaatctataaaacggctgaaagtggagacagactgttggcaaggaagtcaagtggttaggaaactgcaggcccagggttacttagtagtggaagtaagaagaggtaaatagaatcaatccgtcttcattaaagcaagacttcccagaccactctacccacacccttcaataaatacacttacctgtatcattcatttgatttttattatctaggaatgtctgggaccttatctgttccaaataaatgatatttgcagagcttagctattttaacttccaaaaagcaaaaagaatggaaaataacttgctccataccctgttttctgtagacattctctgaagtttttcataatattgcttaaagaatgaaatgtatacaattcacaactgccattcccctctgaaaagttgttacccaccaaaaaatagtggtccaactcatgcatcaaaagcaagtttggggatcccactataatagtctgttctgactcacaccatctgcccaaattatatagatcaggctgccctgacataaccccagccacacaccagcagcggcccccacgctataacaaatctttaaccaattattaaaatattagaaaatgcatgaccattgaaaataatccttaacaataattgcaatgcttggatggcttgtaatgttcagactcccagataagcacttttactatactgcctatgttgtttcagatcttgccatctagcttaataccctccaagtaacaggtacccaataaatgtttattactaaaatcttctaaaaccagggaaacaagagagagactgcctattataatagatgacgaacagtgatatgtgatgactaaaaaatttggttgactaggaaaatgataccactagcaaaaatggggatggtggggctgtgacatcagtttatagggcaagaatcgagcatgttttttagatgtagatagtggtgataggacatctcagaggaaaacactcttaaagaagttgcccaatactacctttaccataagtcctattattcctaaggaaagtacagttattctatgctcttaattccacttcatggaaccttcatattttcctaagccatattcaactgttttattataatctgatttttataatgaatagagatcaagaaagtaatttaaaaaccatttaatacacaaagtgaaaaactattagaatataaaagcatttcacattttttaagacaaataatatcttctaaattacttagcagatgatagaggtccacagtcctttctctgaaacccttggggcaagttgtttcagaattatgaaattttagattttagaaaagtagttttgtgcatataccatactacattaaccagccctcaccacagtctgtggcagcagccctccctctcatcatcaagcagcaaaataaaggaatattcacactaaatgggataaaaagattcaaggtcagttcagattagattgcaagcaaatgaattttgtcaccaagcttatggaaaccttgttttcagagctttttggattttggaattacaattacagataaaggagtgcagacctttataaatttgtatgacaagacatgaaagattgtttaaacaaatgactcatttttacaaatgaaaaaacatgtaattttcaaatacattataaattaacaggcatcttctctttgatattattaaatgtacatcttaaatacatatacacacaacaacatgatttatgaaagccaactaatattagaagcacagatacacaatcccttcgatgagaaggggatactgttaaattttcagtggaatttaaaatgattacaccaactccttatgatgccaggaagagaacctgttcagtgcaacacaaggaggtagaatttattcttcaagaaatagaacttgtgagcagcctttttagaaaaaaacacaggtagacttttacttaaaatgcctattacttgaggttttcttctctgtatacaaaactacatttggtcttacgcccaaaagttaaaagttgacactaatacatagaaggtatttttaatcagttaaataagtaatgttttaccaagactgaaggcaaatgtgtcgtgatgatgcttctaaatagctgtggtattaaaacaaatattcaaacaagtacattgactttttctaaattcctgtctgtttagaggcttgaattactcaaaactgttatacttgtaaaatcatgttcttctgatcatagtagaaatgtagtttctgttcatagccatttcttccattgactgatgtctgaagaatggtttcatgggggaaaaacacatttccaacatgtatagcaacaacttccataggtttggggacagtgaacaagtgacaactcattctgttaaccaactccaatcaagattctaaaaccaggcatgaaaaagttacaattagatgttgactataagttataagtatatgggtgttcatttttgcaagttttctgtttggacatttcataatcaaaagttgaaaaatcatttcatttaccttatttcctgatttaaaaaaatttcagagtttttttcataaatatttgaagtaaacaattattctttccttttcttttcttttttttttttttcttaagagagcaggatcttgctatgttgccaagctggagtacagtggctattcacaagtccaatcataatgcactgcagccttgaactcctgggctcatgcaatccttctgcctcagcctccctagtaactcggactacaggtacatgtcatatggctggccaccattatcctttttttttttttttttccccgagacaaagtctcactctgtcacaggctggagtgcaatggcaggattacggctcactgcagcctgaaactcttgaactcaagcgatcttcctgcctcagcctcccaagtagctgggaccacaggtgtgtgccaccacacctggccaatttttatattttttataaagacagggtttcccatgttggccaggctagtctcaaactcctgggctcaagcaatccacctgccttggcctcccaaagtgctaggattacaggcgtgagccaccatgcctggccactgctatttttcttaatgaaagaggaaatgtacagaattgacattaagactaaatgcaggaaaaattgattcagtagacattttatggtaatttcctcaagttttaacaaatcagtagtttatagtaaccaaatcttaacacacacttattattacaactatattaacataatttattttctattcgggaggtaccatatctgaattaaagtacaagtcccatcttaatggagaaaattgattgctgaagcaaaaaggtacagaacaaaccattcaatttcaatggtcacattgtgaagaagcttaccactcatttaatttgaccaaaaatgctattattgaagataattgatgacataatcctagtatatccctgagtaacggcagataaggatttaaggttgaggatattccccaaatgctctttcctcttgagttcttctatttcccatatgcatcccaaatgccagataaggctagcatggaaagttaaaccttttgcacccaacatagccaaagcaggcacccatatccacacaaaacttaccatcatactattgccctgttcctcatttgcctcatgaataatagtgcttaaatggccaaggcagttcaaattttcttctatcatttgtgctgaagtctccctgtgagatgaaagaacaaagccttttcaaactcaggaaaagggcatatgaatttcctctactttctagtcttctaggttagcaagatcactagccttcctgtaacccagtaccccagtgcagttgactcctgtagtctttagtttcctcatccctccctacagaggcagagtcctgttaagaccaggctgctgcctctacctctacctaactaatgataagaagtccactataactccagtctgactttcctctgaaatgtaagatgcacttatgtacaacttgtttttcccgtgaaaatgtaactagggaggaaaaaatccttgtggcaaagacagatgaaatacgtttttgtttctaaatacttctctttccttaaaagtagtaaaaacaccagcatgcatacttcacagacacaaatgtaggggagaagagagaaaagtaaaatctgttctgtagagatcacagaaagtgaaaaactcattagaaactacagatgatagcaatgaaacgaaacaagcaagctgattcctgaggacagcaaaagaaaacagtgtggtgggggagctacccagaaccaagaagtatccctggaagttcatatttgaaggcagtcctgattgtggtttctaccttcatgctttcctcttctatatggcctctagcttctccctttgccaatcttcagtcccctaacaagagtccgttttaggtcatggatgatagccactattagcttagaatgacattctgattcagctcttatccaacagatggaaaaattatggtcaaacagttcccaatccttggtagttaagtaccacaggtacattataattgaaatcaattttcttatacaatgtattctggctggacatggtggctcatgcctgtaattccagcacttttggaggccgaggcaggtggattacttgaggtcaggagttcgagaccagcctggccaacatggtgaaactccgtctttactaaaatacaaaaattagccaggtatggtggcacgcacctgaaatcccagctactcgggaagctgaagcaggagaactgcttgaatctgggaggcggaggttgcaatgagccaagactgtgccactgcactccagcctgggcgacagaatgagactccgtctcaaaacaaaatataatgtgttccttctagaaaatacattgaaaatgtctgtcagatatacttttgcaagcaactacacttcaaattggaaattacctgtattgtggtgacatttgtaaacattaacatccgctaaaaaacttaaatgcctttaataaaggcaaaaaagtaagtaaagtattaaattttacttccttcaactctgattactggagtattttgtaaagtctatatatttaattatagcctgtgctacagttgtaggtgtactgcattgggccacatgtataatgaccccaagatatataccctggaacttgctttctttaaaaaaataaaatacctgatatcagcttgccttcctgccatgtgcttttctctcataaaagtagagtacagaatgtgcaactgcatgacctcctgagcagtgatgtaacatggctgcacttctgcaaaactaattatgggcagagcttccaggaaatgctggtgctgtagaggtctccatgagttgtgagaaaagcgacaatacacaagctagcaaagagccactggctttggatacggcacatcttaagctgagaaaataacagaaatggatagtcattcagcttttagcaaaagagtaggaattaataaaatatagggcttggaatctgagttcttgcaaaactgatttaaaacactgaaaaaagtctaatcttagaaatacaaagttataaaatagatctcaaaaatttattagaagggtaatcaaggatccccaaaatgataaatgcaaaatgatagcataatttctcataaactgttaatgaaggagtaaggtttgagtaaaagaaagtaataagccaataaaagaaaggacttagaacttggacttagctaataataagcaacatttgagctaataatacgcaacatttgctgaacatttatttcccaagcactttatatacattgtctaatcaaatttccacagcagttctatgagacattcctgttttacaggtgaggaaatatgaacatcaaaaaagtcaagtaagttgcctaagattattacaaagggatagtcaggactcaaccctggtctgaaggcacagaagactaccttaacaactactgcctcattcctataccactgctatgaaaacacagctatctattgttacaaagtaaacccacccatcttgaggagttaccacacatgacagagaatgatcatgttctgctgaagtcgggggcagccatgctgatgtctgaggggttactgcaccttctagactggatcctacaagggaccgggcagaactctgtgtctgaaggaaaagaaaaaaacatcaaaagattacaggcaagcatctctgttgattcacacaatttcttatcatattcctaagacttacatttccgttactacttatatgcacaaccagagtatttcagtacaaaactattcccacctttacacaccattagtaacctgtccttggaccctttcttcattgactaaaaccaaatatatccactcatcttataccattttagttgaagaaagaaaaaaaaaacccagttgaatagatggtcaatttcattatctaggcaggtacatctatccccaagttaggttggaataccacagtagtcaagggctaagaggagtataacaacagagaaattggaaaggagagatgataataagtcctgcatctcaattgctagtctggacaccaagcaaggaacatggatgtcatcccaatgcaaaatatacatgtcttcaagagggcccacctcatgctgataaaaatcccctttgcaaggaataatagcaactcaatgtcacattaaataattcattaataattacttacacaggcaattttaaggagatgccatatttctttctgcctttttccctgcatgaacatgacagtattgtcagcttctttgatattactgagggccacttccaccttagggagtagatcaataatcttctgcttacagcccaacaacttgctggagagattaaatcagtgtcagacactttcacatgccccaagactgtacaccatattcccaaaacccagctgaggaaatgaaccacaatcagcatcagatttaatgacttatctccaaagtaatgcatacaaaaggacacataaatgcagatagctatggccaagctacccaaggtaccttcagaattcttcctgggtaagtatactttaccaaagagggcttttgtactttgagaggaacaagataaacgtatcctggtttttcagtaggaaatgaagcaattttcctacctcaaatgaccaaacagctccttgagcacacggtcctgactctgcacagtgtgcacaatgattttcaccatctctgtgctgtcactgtaggagtgatctataaaagacatcagtcagtggatataacctttcttctgtaacatatcagcctccaaacaaaaaattcctcaaaaatccctgaaactctgaaactaattttaattaataaacatctccatttaaattaaaaattgggttaagataaaagatataaagattacctataaataaaatctagttatatataaaaaataaagtttgcaggtgtataatgtatatataaatttatcagtaagagaccttagttgcctgtgcttgagaacaatagtcttggctatctttaacccatactaacccaagccctagacacaaatgcagcctctggccaagggaacaatttttcttggatgattaaccacatatttagaaacagtaggacaattcatcaaactttcattacctaaaggaaggaggcccttgaactaggttgcttggaatttcatgtttatccgtctgtttacaacccagaaaaactttgaaaaaagctcattgaaaccaactagtaaagggacctgtagacatcctgaaagttccatttgagggcagtatgacatcttaaagccaactggcagcagccagataccctcaaatgggatggctgttggtcacaatgggttctacagtttaaaatgtgacctcgattttaaaaaaaaatcattaattgttatatttcagaaaatggctaaaggagttgaaagttgcttatgcatcatgctggtatattctttggacaataattaagcctaaatgcaataataataatatttgctactctctgcttataattttcccatttaatcctcacagcagtcatgtgagaagactacttttgttacccccattttaccaaaaaggaaatgatgagcatcaaaggaggtttaaaaaacgttgtgtcctttgttatctatcactccaaatacttcccccatagcccaactttattccccacacatctctgttgtctcctcctcaccaacaatcaaatgcaaggctccaaaaaggttcttctccaaacagcattccttcctaaataccatggaccaagccaagagctttctcatataactagctccttaagacagtgaaagccctcagaactttagccttctccaggataatgaagaaagctggttttaaccatttcagatgaacaagagattcaagtcaactctaagctagaaaagacaatagaggccacaaatcaagtgtgattatataataggccccaatgacagacacaatcttgttacagtttgtcactcaaggtgacactcaaagaagctacctgggtagcagtttatttctgagcttcatggtatgttgacagggctgcctcaaagttttaaaaaatataacctaaacaaatgctatcactgtgtatctgtggtatctgattcattagccagaaaactgggagtcagaattttttttttgaaatggagtctagctctgtcacccaggctagagtgcagtggcacagtcttggttcactgcaacctctgcctccctggttcaagcaattctcctgcctcagcctccaaagtggctgggattacaggcatgtgccacgacgcctggcccagaaatattgattaaagaaaaagaattggacttgctctatttgaaatcttagattttaatattttactctagctacaacttctatcacttaaatcactatttgttaacatcttcaacctttttatcctcttattccatcagcaaaatcctaaccttggattaatccaaccatctgctctatcagttcctgtatccaagctactaaattatcaacaaaaaattaatattactgttcactatttgtcactgctaattcacaggtttttcatttctgctctgggttttttttttttttttttttaagaaagtcttgctctgtcaacccaggctgaagtgcagtagtgtaatcttggctcactgcagcctcgacctcctgggcctcaagcgatcctgctacttcagcctcctgagtagctgggactacaggcatacactaccacacccagctttttaaaaattttattgatttatttttttgtagagacagggtctcactatgttgcccagactggtctcaaactgttggcctcaaacgatcctcctgtctcagcctcccaaagcgctagtatcacaggtatgagccacctggcctggattcttaatgaatgttttgggtcaacaacatcttccactgcacacagtggcttttagaagtctttagcactctattcaaatctatgaggtcgtcacctcttccatttcagttaacctcacttaccactgcaggataagaggccataaggcagtaagaccctgatcttccaacctctactcccaaaaaagtatctgtatccacactcattctctttccaatatcaatagtatcaaggctaatccctcctactgttctttggagccaatctctcaacttgttcagggacctccctctccacaggcttttttggccctgagcatatgttctgagaagtgcatcattgggcactttcgtcactgtgtgaatacttatacaaaccctgatggtacagcctgctatacacttaagctgtatggtatagccttttgacaataggctacatacctgttcagcaagtgactgtactgaatactgtaggcaactgtaacacaatggtaagtatttgtgcatgtaaacatagaaaatacatagtaaaaatacagtagtataatcttatgggactaccatagtatacacaatttgttgttaaccaaaacatcatcatgtggcacctcatgtttaagtcttccttctgagaagtgacctcccttgactctacatcaacttttagctactcacccacctctcttctttcctgagcagccaagcttctgagaatagtctagataagcagttctcaaactttttggtctcaggacccctttacactagaaaattcttgagaaccccaaagggtttttcaggaattaaacagaaatttaaaaatactcgtgtcttaattcatttaaaaataacaaacctattgcccattaacatgtttttattaaaaacaaacaaaaaaacctatatttacgttttctctctctcctatatttaggttttctctctcctgaaactctacactccagtcatactgcatttcctcagacatgctaagtgctatacatacatgtgtctacacagtatactcatatctacgagagccacctcctttcactggttactgctacttgagatacttggaagcctgaagtggaaggatcacttgaacccagggagtccaaggccagcctggtcaacatagcaagagcccacctctaaaaacaaaaaccaaaaaacgatattttctaaaacaaaaaaatttgagtgagaacacttgcactgttttacatttttgcaaacctttctgatatcaccactaatctcatcagaaaagtttttaagtactgagaagctgtcattccagctggtaaatacaagttttctaaaattctttttgcttgaaacatggaattttatcattgacaacaaatactgcttttttcccttaaagtaataagtgtgctatactttttattttcatttaatttcttagaaattatctcacgtatgcaaatctgaataatcatagtttgcctgacagttgctcttccaagtaaaaatggtatcttccctgaaagaggccagacaactagcaacgtaaacaattactgaagtggttttccttaagacaaccatcatacttcactgtatagaagaaacactttatgagtacttcccatttcatcacacaaaatattaaaaacccatactcaagcgttgagatttaaataaaataatatttttactgctttatcaaggacatttgtaagtgaaactgtcattttttaaaaactgtgactgcatggtggtaaaaaatataacggctactagcatagtttggcgctagtgccttgattcatactaaggtgaaagccattttatgttgcaccatcaatgaaaatgtcaacatggtgaaaaatgcaaataacatcttattatgaaaatggttctaacctcacagactctctgacaaagtttcaaggattctcacaggtccatatgccacattttgagaactgctggtcagactaaactgaatacatttcagtaaaataaaagcagtataagaggagataatgttattttttaaatgtgaaaatagtatatgaaatacaatttcacatgtatattaatttgcatgtgttgctatgtgtctacaaattttaaagtgtaaaagtatatctttttttaacatgcatttaagtataatgcacattagggcacagactttatttcttctgttacccttcaaaacaaatttttaactaaatgataatatcttgcaagtacataatagtttatagttttcaaagcattttcacaaacatcctcttaaatacactgtcacaatatactcactgagtaggaaagctaggtttcaaccccattttgcagaagaaggaaatgggaaacgcagatttgcctgaggtaacggtcagtaaattactcaatctagaattcaagcctctgattccccatccagtactctttccagcagaccttgctcagtatttagcagatgttcaactggaattattttgccaacaaaacaagtcatcagtgaccagtgcagatgaaggcattattttcaaagcaatctgctttggcctagaacagcacaggccttccctctaaccattccatacctgaacccactgcctcaaattctttccaacctctataatatttttttgttttgttttgagacagaatctcgctctgtcacccaggctggagtgcagtggtgtgatcttggctcactgcaacctcctcttcccaggttcaagcgattctcctgcctcatcctcccaagtagctgggattacaggcacatgccaacatgcccagctaacttttctatttttagtagagatggggtttcaccatgttggccaagctggttttgaactcctgacctcaggtgatccacccaccttggcctcccaaagtgctgggattacaggcatgagccaccacaactggcccaacctctctaatcttaagcaacacttattttttccatctttctaaacattttcttgctgctttttcctctctgagttccttttttctgtcttccattctttcttttcacgtccccttctaaaatttttctacctcacgttctctgttactttctctttatcatctcctaaattctcacaatcttaaagcttattataccatgtctcaatggcaataccaaaactggaatttattctgcagctttaagaaaatttttaacttaaaaatattagatcccccacatttgttaggctagtgatagttacctaaaatgccttcaagcactgtggtagaagtgtcttacctgaaggtctgtgttttaactgcttatatagatcaatggcacgctgttccctataaaagagaaaacacgctctgataagtgaaggtaatttaatgacttcaataatctacaacttgaaacaatattttatttgaataatgaacccattttaaagcaagttcatattgccaacaagtatttcacagagcattgtattgagtaataagaactatacaagttcttaaaatgcaaagtttaatatagttcatatctattctgatctatcatggggacatctctgcaccacagacacttaaaaagacaaaaattatgacctataattcgagaaaatatctgaagtttttaatccagaactttaattcagaaaaaatttcaagttttagggcatttaagagtcaataccttggaccagaggtataatgagtagggaaatagtttgtaacttagttatacttggaaaattcttaacactcctatgaaataaatgcttttattaaaaaccaaaaaaggccaacccaaagaattatttccgaagtttcctgtgactgagaaaaagcttccattttaaatataatgccaatatatttggggaaaggaaaactatagaaaagaaccactagaggtttaatttgccagatgtaagcagaaagaatacaaaatattacagatgtcaagaccaacaacacaagtgcatccttacagagattccatcaagtctccctgacgtcttccataggggctcttctgtagctccatgatttcagcatgcaaagacataatctgatcctccaggtatccaatgacaccaacctaaaatatgatgaaaatacaaaggaaatgaaaggcttaccactacatcataggaaacaaaattcagatcttaaggatacagaatgacttgctgcttcattagagaactaaataatataatacgaaacactgattttgttaaagcctttctattcttcagattctgacacttaatctttcacataagaacatacttagtcttagtcttctctcttttctctcctgacaacagtaaactactagtatttgcttttacctccggagaagcaaaaagctacaacaggtatcaactaacaagaaagaaaaaggaccaccaaaaccattggtattacttgtatcttggctctatgattttgactgccccctggtccccactaccttgaatagggacacaaaaagataaagaacttggatttcccaccccaggacaccatgggtatccccacccacatcctcagggtaagtactgacattaaggagtgtaataacttaggaccgtggacaaatgtacaggataaggggaaaaaatctgccacctagagaatgagctatacctagggacaccatataatttattgtccaaaccggcataattttgagagtgaaagggactactactgataattatggcaagacattaagtataaactgggacagtcccaggtaaaccaggatgtgcagccatcctatctaaaccagtcacaaaaataatagtgacaactaccattactgactcccatttaatcttcataaccctactagaaaagaaattgtccctataatatggaaactagctggatgtggtggctcatgcctataatcccagctctatgggaggctgaggtgggaggattgcttaagcccaggagtttgatacaagcctggacaacatagtgagaccccgtctctacaaaaaatgtaaaagttagccaggcatggtggtgcacctcttgtcccagctacacaggaggctaagatgggaggactgcttgagcctgggaagtcgaggctgcagtgagctttgatcatgccactacactccaacctgggcaacagagtgagaccctgtttcaaaaaataaataaataaaggaaactgaagctcagtgaggcactaggtaattttcccaaagcccttgtttttaatcactatgatacatccctctttatatacaaagcatctactagaattttgtctgaatttcaggaatgacatgaaaaatgctctttatatatcaaaaccaaagatagtttctaatggagacatcaagaattaataagtatacagaatgacgtcaatgattttacctcagcatagtggatggccttttcttccatttctttccatgcttttagcattttttctgaagctaaaagaaaagtctaaattggttatctcagaaatagccatatctttaattactggctgcctgcctccttgccatatcaacatcaaagatgtgttatgagttgaattgtggtcccccaaaagatatgtggaattcctaacccctaatacctcagaatgtgacctatttggaaataaggtcattacagaagtaatcagataaattaatactcatactggaatggtctgggcccttagtccagtacgaccagtgtacttagaagagacacaggatacagatacacaggggagaatgctctgtgacaatggagacagattgaggtgctgcagctgtaagccaaggaatgccaatgatggctagcagaccataagaagctagagagaaacaaggaaagattcttctctacagatttcagagaaaacatggccctgccaacacctcaattttggacttttagcctccagggctgtgagacagtaagtttccattgcttaagccactcagtttatgggattttgttatggaacccttaggaaatgaatacagatgacttttttcttaaaaatatatatatttataccagtgtgcagatgggtggataaaggaaaaaacaacaaaaaaaatttttttttgaggtagagtctcactctgtcacccaggctggagtgcagtggcatgatctcagctcaccgcaacctctatctccagggctcaagcgatcctcccaccttagcctcctgaatagctgaggtgtgcaccaccatgcccggctaatttttacattttttgtagagatggcgttctaccccatgttgcccaggttagtcttgaattcctgagctcaagggatccacctgctttggcctcccaaagtgttgggattacaggcgtgagtcaccacctggccagaaaagaaatttaatacttgaatatgatttttaaaaattaaatactataaaaggatataaacagaaaagactctctcttctacccctctaccatccacctcaagggaccttactatgattatctgttacatagacacatagcctgctccctcacaagtgaaaacatctgtatactctttattttttcccacaatttaaaactgtcaactaaagacttaggtgatcttttaataaaagcacatatagatctacctcatttttctttaacaattgtataataagcctttgacaagtctaagatattttaatgaaataattataatgttttatcactcaccagaatgtcaataatatacaaatagaaataaaatatcaataatatataaatagaaataaaatatcaataatattaataaaaccagttctggagagtaaattcattcacccaactggacactattgattgtttactctgagatacacagagtttgctcaggacaagtatatgtttttaggaaacaagtatttgtttcctaaaaaggatttgttttataaaagaaaacagaaatgctggtagtatgactccttcaatttactcatattttaactctgtttttttacacttccttagtacatctgaaggagataagcttggagtcaaatatggaaaatttggagactgtgtacactaaaaaatagtaggactccacagtagatggtttgaaaaaaacatagccttagaatatttgtgtcattatttacagaaaagtaagcagtttaagactcccctggttgtcttagtccatttggactactataacaaaataccatagactaagtgccataaaaacaacagaaatttatttcttatagttctggaggctgggaagtccaagaacaaggcagatttgagggcctgctttctggttcctagatgaccatcttcttgctctgtcctcacatgcagaagggatgagggatctcattcaggtctcttttgtaagagcattaatcccaaacaggaaggctctactctcatgacctaatcacttcccaaaggctccacctaccaacaccttcaccttcagggtcagaatttcaacatatgtattttgggggggatacattcagtccacagcactggctaagaagtccagattttgtatttattttaaaatcaggtttgaaattcaagattattaaatcgcacctgtatttttttagagctaaataattttagcccaattgtgaagctaaattgctcaactaagcaaatttaaaaaaagaggtaacattcaaaacaaacatggtttatgttaatttaagttgtcctgtctcttgttctaatgtgaaggtaagtaaaacaactggctgagttaagaaggcaaaataacagatggcttcaagaaaccagatgctcctttcaaatacattacacagacacttacatatcccatacgtcatctgctcgctgtatctctccaagtcaagctgaatgcttttgtgaaaaaactccaatttagctttcagttgttgtgatgctgagatcaaagtgttcttcatttttgttaagttagcattatatctaagaagacttaacctaaaccacagcaagaaaaaaaagaaaaagaaaaaagatattatcagcattcagaaacattgaacaataatgtaaaaacataaactgccacaaggccaaagcctaagtttctattatcaatctatgagaaataactgagctctagaatctgatctctaaagacttcctgcctataatattttgtgataaacaatctttttatactaggaccgtatgggaattattaccctcaagccattacaatagaatggtctcagtccattagtaagaattctacaagtttatcagaacattacacttcaaattggcccagtatgttactattacatgcaatattgattagtgaaaaccggcaagattaattcttgagtatatgatgcacattgcattgtgcttataaacaacagaatccacttacattgctgccctttgtccctgaaagagcctgctatagtcttcttttagtccagacacatagtgcactgcttcagcccacactttacgcagctgtataattggaagctgtattttgctgtcctgtactatatacaagaagatgagaaaaagggcaagggaggttagttacttttgaggattttagagttgatttatcattctttgtgatttcctgtccacacaaacaggattcccatagatgctagaaactgatgctaaaagaaccacttgtttccatttaattcagttcaatatacatttacagagcacctgcaatacttaagccccgctccacatacaaggggggaaataaaaatgacacaatcgctacactcacagagcttgagattattcctgtatctgtcttttttgcttgcttttctgcaacctggaatactctttttctctctgctaatccaaattatttctttcaagttctaaatcaagtcccatctcctctgagtctttcctacctctgaataataaatttcatattctggaccaacaatccaggtttaagaatacacacaagagccaggtgtgatggctcacgcctgtaatcccagcactttgggaagccaaggcgggcagatcccttgaggtcaggagttcaagagcagcctggccaacacggtgaaaccctgtctctactaaaaatgcaaaaattagctgggcgtggtggtgtgcacctataatcccagctactcgggagactgagacaggagaatcgcttgtacccgggaggtgggggttgcagtgagccaagattgtgccattgcactccagcctgggcgacaagagtgaaactccatctcaaaaacaaaacaaaaacaaaaacaaaaagacaaatttcagcagagggacatcttacaaaatacttgactagtattcctcaggtcattgtcaaggtcatcaaaaacaaggactatttgaagtctgacaaaatgtcacagcaaagaggagctaaagagacatgacaaccaaatgtaatgtgttctaagatgagatcttagaacagaaaaaggatattaggtaaaaatgaaggaaatgtgaataaagtatgggcttcaattaataataaatgggttcattaaatgtaacaaatacatcatactaatgtaaaatagatttttttttactttttaatatttttaaatattttatgttttttatttatttttttgagaaaggtctcactctgttgcccaggctgaagtgcagtggtgtgacattggctcactgcaacctccgcctcccaggtaaaatgttaacaataggaaaaactacatgcgtgagtgaggggagttatatgagaactctgtactatctgcccaattttttggcaaatctaaaaccattcttaaaaaaaaaaagtccattagtaaaatagtaataaagtctggggcaaggggagttgactgaaaagagacatgagggaactttctaaggtgaaagaaatgttctacatgatgactgtggtgtggattacacaagtatctaaatttgtcaaaagttatcaaactatatgatctgtgaatttcactctatgtaaactgcctcaatttaaaagaaaaattcaaaagaaaactaataaaaagacttttaaaaaagtaagattacatacattttagcccctctgctcaattttgttcttgattttacaattttgtgctttactttatttggacagatatacagtgatcaaacacttaacttgttcaaaagaaaagaataattttcacaggataaattaaaacatttgaacatcaagcagtattcacaggaaaaatgaaataaatacttgaacatgcttagactatgaagagacaattaaaaagcaggttcaactaatagtgaagtttcattctcctgtgagagccctatcctcaagaaagtaaatcttctcttgaatgatctcatggagatttaatatctaccttttcaccttccaaactatataaatccatttttcagagttctcatataactccatatagaaacttcaagtatgagatacagaacacaacaccaaaagtccatttctactaatcatactgagagtcaaagttatattaattcatgtttaaagctcagccactaaatggactggacttaccaatataatttacacaatcagataaacttctggaagcaaatggcccttcatatacagttttacttttatcaaacaaataaaccatatagctatcacagcctctctgaaaaagaaacaaacagttaaaatcctgttcaaggatctttgaaaatcctaggttttctaaatacttatgcaccagatttcctactttgaaatgcaaatgaacaaaatcaatgtgtattaccatatctcttacagataacagagtccaaacttttgttgaggaaaaaagacccaaacttttgtatgggctaaagtgaacaatcaccaaaacccaaagaacaaatgcaaaaagatatatacagtgaaaaaactaatcggtaatcaaaacgaatgaagtactgatacatgctacaacatgcacgggcttcaaaaatacaaggcaagtaaaaaaagtcagacacaagactatatattacataattccatttatatggaatgttcagaaaaggcaaacttgtggagataaaaaatagattcctggtttcctggggtggacagaatggagattaacagttaatggactgttaatggaaatgtttttaagctgatttatggtgacagctgcaaaatttggtaaatttactttaaaaaaaaatcactgtaattgagcatcaagtcagtgacaagttaataaaaaagaaataaaaaatcactatattgtacaccttaaatgggaactaacatgataatatgcctcaataaagtcataaaaagaaaaatgggggaaaaagtcatgaccacagtcatattttaccacccatttatcctttggcaggacctatgagactgctgttctcacagtagtttcagagtactgggcttcaaatacaaaaagaaatttttttttttgagacagggtcttgctctgtcacccatgctggagtgcagcggcgtgatcatggctcattgcagcctcaacctccctgggctcaagtgattctcccacctcaatctcccaagtagctaggactacaggggtgcaccaccaaaccccgctaatttttgtagtttttgtagagacagggcttcaacatgttgctcaggcaggtctcgaactcttgaactcagcaatccacccaccttgggttcccaaagtcccgggattacaggcatgggccactgcaccaagccaagaaggaatattaactgggagtgtggcaggccaggtctcactaatgcaggcctaaataacaactgtttcagcacgactgagtggtgaagttaaatattaaaagctgaaagagtggccgggtgcagtggctcacgcctgtaatcccaacacttcaggaggccgaggtaggcagatcgcctgaggtcggtcaggagtggcaaaaccccgtctctactaaagatacaaaaaattagctaggcatggtggtgggcacctataatcccagctacttgggaggctgtggcagggagaatcacttgaacccaggaggcggaggttgcagtgagctgagattgtgccattgcacttcagcctgggcaacagagcaagactgtctaaaaaaaaaaaaaactggaagagccagtgcccttacacaaaggctgaaatgtagccaaagcctaccaagagttctgcccaggcctttcccaggcctaaaagcaaaataacaaaggaattcttaacaggacccgttcagaattaaataagttttattgggggtctgaagaaaccccaggcctccacaaacaagtttattgggggtctgaaggaactccttaaacctctgtgatttaataggagacaagataagggtaatcaccccagcacctggacccatttagagtaagtaaatttactgaggctccagaggaatgtcttcaagactcagacctcagctacagattaaaagaagttaatcacttatgtctttagatgaatgcaaacttacacatagacatatagcttagaagataaataaactacggaaaaactttgtaattttgagttggtctggcggtaatttccaggccttctacctgtaactggttacagaaataaaaactcccatctctcccaattcatctgcatctcgttattgggccgcgagagtaagcagcctgaccctcagtttggtctgggaacaggagcagaaaactggcaccaaagaaaaagtcttgcaaagttcaaaacaacaaatgtttcatttctatcctgttcaccttgcaaagcaatgataagagttgggagaaggacaaaaccaaaacaaaatgtgcggcctcccaaggaattccaagtatgcataaaaattgcagggcacgcaatccctctagatttcacatactctagggatattataattaattttcttacaactccatctagaacacattgagaggctggtttccgaggatccagagaaattcctgtctctgaaagaagttcttgagaaccagtatttattccagtttcacgctcaatacgagactgtagtgaatgaagactttcatcaggtggtaacagaaaagaaattatctttgcagaagtcatatttaggatgtgtactatctgtataaataagaaaaaaaggtaaagttattgattatttgttacataaaagattcgctgccagatactaaaaggtgaatatgggcaaaaggcattatttctacattaaacaaggctcactcattctccaaagtgagatctccttttataattataaaatgacattctgaaaactgaacaatttccttttctacaatagatgttagttccaacaataaaatttcaaagttaagaaattttcaaaattaagaaaaatcccaatttgaaagaacaagttatttatttatttatttatttatttattttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctaagttatttattttgaaaaaaacattatcatagaccgaaaaggaaacattccaattcatgaagtgcctaacagaagacaaccacaggcataaaccactttcacataacatccccaataattagatcttttaatctccattttaaacagagaaagaaaccagagttctaagttaaataacttgttagggatcacacagctaataactggtagagcttggatcttaactctttttgtgtctggctacttcatgctgccttaagaaatcatctgatagaagaactaggtctctctttaaacaggaaaaagcattgttatgcgtggtgagttacctttttataagacaacctaatcccagagcagcaacctgcttaagggccccaaatcaagtaagaaccgttttatcactctcacctaaagccccagtaaaagtagcctgatacatgccaagtgagtgtgaggctgagtcaggtggggctctgtccccacctgtcagcgcggacagccacagagttggacttcagtcttttgaaaagaacatgattttaaattctcttccttccagtatccttagaaaagccatacgaaattaatgcctacattctccatgccttacattgactagtatatgcaaatgattaaaattctctctgctgaaaatccttactacaaaggtaaggcattaatccaagtccactattatttttttccctttaaaacacaaatctgaattgatgttttcaaagacacaaaactatagacaacagtacaataagccccctcccaaccctgtgaatgcctcacctagtttcaaccatcatttacatagagcctatcttgtttcatctatcataaccccctctcctgatttattgctttatcttttacatattttattttgtgacaatttaatttgacatataaaaatgttatatatttgagttatacaacttgatgttttgatatacgttgtgaaattatcacatttcagctaattaatatatctgtcacctcttcatagttgtcatttttgtaccttttttttcttttgctgccgtaatttttggaccttttgataaacatctctacatacacccccgcacccgcatccctgcagcccctggcaactatgatgctatggtctgcttctattaaatttaactattatagattccacatgtaagtgagatcacgcagtatttctctttctgtgacttgcttattttacttaacatgtcctccaggttcatccacattgtcctaaatggcagaatttccttctttttcttaaggttgaatactattccactgtgtatatataccactttttccctatccattcatctgtcaaaggacatttaggctatttccagatcttgactattgtgaataatgctgcaatgaacatgggagtgcaaatatctcttcacaagcctgctttaaaatcctttggatatataccaagaaatgacattgttgaatcttacagttctattttttttttttttcttttgagacagagtcttgctgtgtcacgcaggctgatgtgcagtggcatgatctctcagctcactacaacttccacctcctgaattcaagcaattatcctgcctcagcctacggagtagctgggattacagatgtgcaccaccatgcccagctaatttttgtaattttagttgagatggggtttctgcatgttgcccagtctggtctcgaactcctggcctcatgtgatccacctgtctcaacctcccaaagtgctgggattacaggcatgagccaccatgcccggccagtagttctatttttaattttgaggaacctttgtactgtttcccacaatagctgtaataatttacattcccaccaacagtgtacaagggatttcttttctcccacatcctcactaacgcttatcttttttcttttggataatagccatcccaacaggtggggggtgatatcttagtgtggttttgatttgcatcgccctgatgctaagagttgttgagcaccttttcatatgtttgttgaccatctgaatttcttcttttgagaagtgtctaattcaggtcctttgcacatttttaaattgggttatttacatttttggtattgagttgcatgagtttcttataaatttaggatattaatttcttattggatgtatggtatgcaaatatcttttcccaatccatgggttgggttgctttttcgttttgttgattattttttctactgtacactttttagtttgaaggcccactattatttccacttacaaatcctaacacagatgcccaaataagtggtgctacagaaatactaaactgaggctgggcgtggtggctcacgcctgtaatcccagcactttgggattacaagacaagtagatcacttaaggtcaggagttcaagaccagcctggccaacatggtgaaaccttgtctctactaaaaacacaaaaattagctgggcttggtggcacaacgcctataatcccagctactcagaaggctgaggcaggagaatcgcctgaacctgggagatcaaggctgcagtgagccaagatcgcgccactgcactccaggcgacagagtgagactttgtctcaaaaaaaaaaaaaaagaaagaagaaaaagaaaaaaaaagaaaaaagaaagggatactgaatattcccaacacagagaaattatgttttagctgatggatatgctaattaccctaatctgatcactacacagtgcatgtattgaaacatcactatttaccccattaatttgtataattatttgtcaatttaaaaaattaggctgggcgcggtggctcacacctgtaatcccagccctttgggaggccaagacaggtagatcacttgaggacaggagtttgagaacatcctggccaacatggcaaaaccctgtctctactaaaaacacacaaaaaattagttggccatgatggcgcacacctgtaattccaactacgcgggaggctgaggcacgagagaatcacttgagtctgggaggtgaaagttgcagtgagtggagattgcaccatggtactctagcctgggtgatagaacaagactcttatctcaaaaaaaaaaaaaaaaattaaaagcgtattaacaattttgtttgtttgtttttgagacagagtctctctctgtcacccaggctggagtgcagtggtgcgatcttggttcaatgcagcctccacctcccaggttcaagcaactcttctgcctcagcctcccgtgtagctgggactacaggcatgcaccaccatccctggctaatttttgtattcttagtagagatggggtttcaccatgttggccaggctggtctcgaactccagacctcaagtgatctgcctgcctccacctcccaaagtgctgggattacaggcatgagccaccacacctgtatcaacaaaattttaaaaaagaaataccaaactgtttttataacctgaagctgatccttttcatgtgaattccaaatgtcataacacaattgccagtatttctcttattaagagacttttctttaatataaatctttatgtttaaaaggggagtagggaaatcttcaaaactgatacggatttgcaatacaattatactacctgagactttccatgccttcccaatttaggcagatttcacactatgacagctgccacttatagcaatagaaaatcctataatggacatctacttttacacaggatattagagtatgtcatcatggcatctcactaccaaagctccaggccagaaggaagcaaaagaaagaagaggaaatacaacctaaatttatctttttgctcactataatatttaatgagtacctactattggtaggtacatactattggtacatactattaagtgtgttgtggtggtagtagtgggtatacaaactgagtaccttatgatccttgccttccatacagttatagtcaaacagaagatattaagatatactaagagaactaaggtaccaggcaaaatgtgataggtgttataatcagtgtaaagtatcatacacttggcagtaggaagcaggcacttcataaaggaggcactacttgagctaaactttgaaatgaaagactgaaatgggaaaagactgaaaagagttcctttaggcagaaaacaaggtgagcagaagcagaaaagtagaaagggatgggcataatcagagaatacaattaatccagttcaaatgtacctaaaatgatggcctctcagggcattagtaagagataagtccaggagtgtaagttgatatgaaaccaagataggttttgagtaccaatgaaagggtctggactttattcaataagtgaaagaaaactatgcaagcctttctaaattgagaacctggcaagctcaaaattgttaagatattcaaaagataaatttgataaaataattggatatatcgattgaagagaaaggaagagtcaacacatccaaagtttcccacctgggtaactggaaaggtgacagtgcaaataagaagtgtaggaaatctatagaggtagatttaatgggccaggtgcagtggctcatgcctgtaatcccagcactttggaaggccgaggtgagcagatcacctgaggtcagggtgtcaagaccagcctggccaacatggtgaaaccccatttctaccaaaaatataaaaattagctggacacggtggcaggcacctgtaatcccagctactcgggaggctgaggcacgagaatcacttgaacccaggaggtgtaggttgcagtgagttgagatcgtgagacagagtgaggctccatatcaaaaaaaaaaaaaaaaaaaaaagaagtagatttaatggatagaacaaatatgttcagtttttaataaattaagttgtaagtgccagtggaacagccaggtagttatacagttatacagcagttataagtccttggcagaagagtcacagctacagagataaataactttaggagttagccatatgtagtttataagtaaagctatacagttgaagaggctgcctaataaaagaaaggaaatgtaatggaaaaagagagaaccaagaagagactcagaatatagttacatttaggggcgtgaaagaggaggcaaaaaaaaataataattaaatgctactgtttcatcattatttttagtggtaggttcagtacacttctttcaactcttctacatatctaaagatgttcataataaacagttggaaaatatgcatacaatcagacttgctaagctattttttcaaaagggaaatatttcagtaactgttttgttgcttccttttttaagtgaaaatcaaacagacatcattcctttcttgtacaatatatataaacattttgggaaaatgtcctacagtaacaccaagctgttttgcagttcatgcttctgtacttttgctcatgatgctctgctgcctataaatctctcccgccctcaccctttccctaaaaactctcattcttcaaaattcagtcctattatcatgtctaacaagcatccttgaagcttcttgaactactataactagtaccttatacataccttattctgcataacctcataataatattgatgctttgaggaagatattactgtccttgagatagagagacatttgctcaggttcacagataggtaaatagtggtgctgcaaactgaattaaagtctgtaaactataaactccataatgtggactctttccccgtgccctataacaagaggctcacagatgcccttcagagcagaaactatgctatgattcctatgacaagtatgaaacaaatgcgagatgtggttcattcacagctgaaatgtttcagaggcaacacagaactaaagccctgctttcctaacacactgagggataatttattctttggcacattagaaggaaaccaaatcaagaagaagccaggtatcttttcagtgttagccaagaatgacatccacatggcctcaagtttctatttaataaagtatgccaaggtcgggcacagtagcccacatctgtaatctcagcactttgggaagtcgaggtaggaggattacttgaggccaggagttcaaaaccaacctgctcaacacagtgagaccccatttctaccaaaaatttaaaaattaggcaggagaggtggcgcacacctgtagtcccatttactctggaggctgaagcaggagaatcacttgagctcaggggttgcagactaaagtgagctatctcgccatgtactccaacattacatgattataatttctcatttcaattttagaaacctgtatactacaaacaatcaatacaaatgtaaagactattgatgagagttgtttctgggtacactgcataatagaactatctatagctctcattcatatcaataaataatttactaagaacctgatacatgccctgctctgtacagaatgccatggttaggaagggtagggtgggtgattgttaataaaagaagtaaaacaatcccaacattgaagaagacaacagtctatatgaagatgcatgaatggaagacgagaaagagaatatagcctttaaatgacaaattttgtggcagagaccatttaaagaaaagctcttaaagatatgccagtgtaggtgagaagatacacagaaatggatatccaggcagaaggatagcatctgtcaaagcacaaaggtagataacgggtttgaggcataaggagcagtgacaagctggtcttgtatgaggtaaaggttaagagaagcaggtacaaggcaaaacttggttagggaaagcccccccaaaaaaccaagcagatcagtttacacttgacttgttaaaaaaaaaaaaaaaaagaactatgttagtttcttgggcagaagaataaaaaagcattttcagaagatgagataggtagtacatattgaatgaactataggttaaggagtaagtgcagagccatgaaaggcagataggaaccttccttaccaaatcaaatccagtatgactagacataaatgaatcgaggataatggcaacaacatgggaaaaggtaaataaaaaagttgcttcaaaggagtaattaacaaagaccacagagaagcaaactgagacagcttgctaaataaactttttaaaaaatcagctctaagaatataattttctttttcaaataagcatcagggctggacgcaatggctcacgcctgtaatcccactttgggaggtggaggcgggcagatcacctgaggtcaggagtgcgagaccagcctggacaacatagcgaaaccctacctctactaaaaatacaaaaattagctgggcatggtggtgcacacctttagtcccaactactcgggaggctgaggcaagagaatcgcttgaacctgggaggcgcaggttgcagtgagccaaaaacatgccactgcactccagcctaggtgacagagtgagaccctgtctcaaaataaataaataaataagcaacaggaaaagattattaaactgtatttatgctaattttccaaataaacttgttactttcaatgctggtcttatgcagtagacccattaagactaaccttcaaattcaaaatgtgatccattaatacaaaacatcttggctgcttcaaagtaaggtcaacaggtcctcctctctgctgagggtcccaattcaacatcaactgtagccagttttccatgggttctactactaaactagaaaacatacaaaatagggtgaaaatcaaatcattatgttccaatttccctttatactgttagaaaggtaattttgcaggttgtccattttctttcccacatcacttgtctgtaccatttcataaattactttcaaattcatgaaatgacaggggacaaacttttttccatcaaaaactactcaaaactccacatatgttagttactgacaactctgacggatgagtccaaatccattctgcaaataacccatttacttcattatcctaagagccttcttaggacatatgtcaaacagttaaatggcagttcttgtttccaccagacctgtgctgtccaaaatggtagccactagtcccaagtggctatttatatttactatttattcaaaattcgttctctagccaaactagctacatgtcaagtagtcaataacctcatgtggccaacagaaatatagaaggtttctacatcatcacagaaagttctactggataatgcaacttgaaacagacaactactctcctgctcctttacaactctggagaaactgaggcaaacttccttaactaaaatatacttacctacaaaggctatttggttgaggtaaatggctactaaaccgaacttctcctgacatctcttcacatgcaaatatacactttggatccttcttcttaatcttctcatgcctataaaatcaaaagctacctcagttgacaaagtgattctcacaaattaagatttcttgccatttaattatatttaattgtatatttcaaaggcaattaaacaattaaagaaagaaaaaaaaagacaaatgaaaaaatttccattcccattaagcatgcccaagttctcatccatttcttaccaggtaaatggctgcagatgatgcaaaaaaggcctatatccagcaatacattcaaataccatggtcccaaagctccaataatcaacagtggctgtgtaaggcttattctcaaagagctctggggccttcaaaagagaaaatgctttaaacaccaacactgtatgggaaaagctactttatttttgacctactatattcatgatcttcagaaataagagaatcctatacacacttaaattcaaagaaacaaaacaggtctcaccagatactgcagtgttcccacaaaagatgtacacagacttccttgatcaacatctttggcatatcccagatcaattattttatgtattatctgcaaaataataagacagattaagtattaaatggtagagaaatttaaaaaggaaagacaacaatatccttacgaggctgtagacagggtagtggtgaggaccttgggctctgtaataacacaaaaatatttcaagtctgagtgccaccacttaactaggcatgtgatctaccaagttatttaacctctctcagtaatctaattggatgactaacagtccctgcttcacagaattgttattaggatccaatgaaataacgaaagtaaagaaggtaacacagtgcttggtacatggtaaaaattgaatacaggtgggctattaatttttattttactatattcaaaataagctcaatccattaaactggaaagtaaaggcaagggtgacttccaaacttgaagaagcatcatacctccttatagtagattaaatgtgagtaaatacttagatctaacttcaggaatgtcctgaagtctttggattaaaaaaaaaaaaagcagagatatttggtgccaagcatacgtgaaaggttcctaagagaagaggcatcaccaaggttccaacacctccaagaggccaacaactattttcactaactaaagagacggcacacacaactcaacacaaggttcagactcttggcctttaagtctttattggaatgaaatttggatgctggaaacaagaaaactgcttaagttaccaatgaaatgaacattttaagagtcaattcacaatttctggttcttctccagatgactcatttaaattgggggaaggaaaataagttttaaaaatatatatactttcttttttttcttaaagtggacccaggatgtgcatgtatgtgttttggatgtgcttcataagaataaaataataagtgttaacatattatgtattcacagcctgtatctttgctagatactatgatggaaaaacagacttgaacaagacaggtgaagtctaggagctgggttaagtatgaaaaatgaaaaaaaagaaaaagaaaaaaaaagcaggtgctgttccttctctgatggaaccactgtttagcagaagggacaaaaaaactaaacacaaaactacagttcagtgtggtgaggtctgaaatggaaaaagtaagactgttatgggcatacagcaaagacaccaaagctcaaggactaactatatcagagagactatattcaataggcatgaaacattacttcaggtttcacctacctttccaccaacatcctgaagaactatgttttcaggttttagatctcgatgtataattttgttttcatgcaaatatcgaatcccagaccctaaataaagtttaaaatatactttaaagtaacagaaatcattgagttaaaagaaaaattcacctcacattttgtacaaatctactctgatgctcaagtttatatggatcatcgtaactacacaactaatactacagtgtccaggttttcttcacagaaaaaaaagtaacattaaacaaatactacaaaattatactatatgttcatttaactcattagaattaacaccaaatagaaatgcaacaagcaattgggaaaatccctgaaactcttataagcctctttctcccacctaaatcactcatttcaattggactttagccctcatgaccttggaaaagaggcaaaaccaaaatctatggggaaacaaatttttggtttttgaggttcctccaaaaggttaggtactggttattttaggaatttttctggagtcattctgattaagcagagatttttcaccctgaagagttgacttggctgggtgcggtggctcacgcttgtaatcccagcactttgggaggccgaggcgggcagatcacgaggtcaggagtttgagaccagcctggccaacacagtgaaaccccgtctctgttaaaaatacaaaaattagccaggtgtgatggcgggcacctgtaatcccagctactcgggaggctgaggcaggagaatcgcttgaacctgggaggcagaggttacagtaagctgagatcgcaccactgcactccagcctgggcaacagagctagactccgtctcaaaacaaacaaacaaaaaagagttgacttgaggacccatccctcaaggagatgtaattccactgtaaacaaaattactatgtcaatggtagggggggagagaaattgagtaaggtcatttcacatgatttttttgtcagctattggaacatctattagacaaaaaaaggactcttagccacaaataaataataaaatatcctagtttctttttgtgtgtgtgtgacaaagtctcactctgttgtccaagctggagtgcagtggtgcaatctcggctcactgcaacctctatctcctgggttcaagcgattctcctgcctcagcctcccgagtagctgggactacaggcatgcggcattgtgcccagctaatttttgtatttttagtagagatggggtttcactatgttggccaggctggtcttgaactcctgaccttgtgatccgcctaccttggcctcccaaagtgctgggattacaggcgtgagccaccgcacctagccaaaatatcctagttttaatttagcatcaatagtaatagatttttataacttcttatagatgttgaaattctatagactttgtatagtgtatcaacaattctcctgaattcccaaaaagatcttttatgggccaaagggacattacattacaatggtattttaatactgatacgtacctatatcacttagtaaagaaagtatctggctttctttaagtccacaacaattttctggtttgttgagcagctaaaaaaagaaagaaatctaaaaatctgttctgcaaattgctgggctgcaatagtgaccacacattaattactatactctaaaagaatattcaaatgagaaaataagtcataataaaatacaagggaataaaattaccaaatccatactgagggcatgtaaatttcatgataaggctcataaaagtaaaaagaggcaaaaagcatttgaaactggaaaaggctgacaaatctcatggatatatataaaaatggtcatatgggcacatttaaaattaggtagaaaaaaaagattgcaatacagaaaacaactttttataagcaccttaaccactgaaattttcatctaacaccattgctatagtcccatcaaacagcaacaacaaaaatgcattttctaaatcaggagtcaacattttctgtaaggaaccatatggtaaatactttaggttttgcaagtcacatagtctctgttaaaactactcacttctgcagccataagaaagcagccatagacaatgtgtaaagaaatgaatgtggctgtgttccaataaaactttatttacaaaacaggaagcagaccatagtttttccgattcttattctagtttattatatttaacatgattcaaacattgctaaagtttgtgatttactctctctcatctcaaaacatccacactacctttcggagatctcctccagaacagtattccattgctagaagaggcacatcatgaatcaaaatattcaattcttcaggaacatcacaggcctttacaacattggcatggttcaacctaataagaaagaaaaacattacaataaaaaaaattatttccaataaaaagggactggatttgaaatgctacttaattgtgggtggatgaacagagggggaaagatcagtattatttataatattctaatttctgatttgtataattaaaaattagtaattttttaaaagaaaacacacataaaaataccatcactattactactattacatttctaagtgccaagcagtaaacattttaaatatattaactcagttacttgtcacaataatcctattataggtagatttattaatactttcaccacacaggagaaaattgaagcacaaattggctaagtaacaagatcacacagtgagtaagtcaaatctggcgttctaggctgggtgtagttgtaactgtaatcccaacaatttgggaggctgaggtgggaggattgcttgaggccaggagttcgagatcagcatgggtaacacagtgagacctcatctctacaaaaaattaaaaattagccgggtgtggtggcgcatgcctatagtcccagctactccagaggctgaggtgggaggactgcttgagcccaggagttcaagtcaagcctgggtaacatagcaagaccacatctcttttaaaaaaaaaaagaaaaaaagaaaaagaagcaaacagaatttccatgtacatgtaggacctgataatttatactattaagctttcctggtgattctgccacataaccaagtttgagaatcaaaatggaattaagcacagatattagagtcagaaagtatttatttcaaatccacactttaccaaccaccagctatgtgattctataagcttcaacttcctcatttgcaaaataatacctaaatataagattgctgtgataactggaagaatgatctgtaaagtacttagcacactacctgtggaagttttaaaatatgtctacttctctttttaagagcttaactctcctccccttgaatgtaggctgtacttagtgactcactgtaacaaacagaatgtggtggaaaaggatggagtctcacttccaagtaaagatcataaaagatacgtcggttttcatcttgctcgctcgttcactctctctctctctctctctctctcagatcactcactctttctgaggaaaagatctttctggggaaagctagcttccatgtcatgaaaacattcaagcttccccatgaagaggcccacatggcgaagaactgatgcttttggccaacattcatataagtgagcatggaagcagatactccagccccagtcaagcctttggattactgcagctccgaccaatatcctgagatgtctcaggaaagactctaagctagaatcacccagctaagccactcccaaattcctaagtcacagaaactataagatactaaatgtttgctattttaagccactaaatgttggggtaatttattttttattatttatttatttatttagagacggagtcgcccaggctggagtgcagtggtatgatctcagcttaccgcaacctccgcctcccgggttcaagcaattctcctccctcggcctcccaagtagctgggattacaggcacccgccaccacacctggctaatttttgtatttttagtagagatggggttttgccatgttgaccgggctggtctcaaactcctgacctcaggtaatccatccgccttggcctcccaaagtgctgggattataggtgtgagccaccacgcccggccctagctgacttttgttaactgaaatgaaatagttttttgattgtggtaaaacacacatagcataaaatttaccaccttaaccatttttaagtgtacagtttagtggcatcaagatgctttccttttttttcagacagggtcttgctcttgtcacccaggctggagtacagtggtatgatctcagctcactgtagccttgacctcctgggctcaagcaatcttcccacctcagcctcccaagtaactgggactacgggcatgcaccaccacacatagctagtttttatattttttgtagagatggggttttgccatgttgcccaggctggtctcgaactcctgagctcaagcaatccacccacctcagcctctcaaagtgttggaattacagtgtgagccaacatgcccagcctggcatcaaatactttcacaatgttttgctactatcactatactgcacaaaactgtttaattctgcaaagctgaaactccgcacctattaaaaattattctctatttgctggtcccttcaccctctggcaaacaccattctactttctttcactgtgagtttgactactctaggtaccacacataagtggaatgacacagtatttgtctttttgtgactggcttatttcatttagcataatgtccacaagattcatccatgctgtggcatgtgtcagagtttcattcctttttaaggctgcatgatattccgtttcatgaatataccacattttgtttatacatgtctctgctggtagatactgggttgcttttacctttcagctattgtgaataataatgttatgaatatgagtgtacaaattactctttaagtccctgctttcaattcatttttgtatatacccagaaatggaattgctggatcatatggtaattctatttttaattttttaggaatcaccgtactgttttccgtaacagttgcacaattttacattcccaccaacagtgtgtaagtgtcctagctgattttaactaaaccttcttaatcttaatgtgatattattatttgaaatagaatatatttaatgagagaaaaaaatatatgttcccaaaaagatcctgagaagagtggattcctggcctctttccccatgatgacatctggttgggctgtagaaccagggaaatgtaagtcaaggaatacacttacttcttcataatctggatttcatggcaccatcgttctctgtttttggtacttagctctaggcgacaagacttaattgctattttgagatcaagttcctgccaaaatagaaaatcaacagaaaaaaaaaattaggttcttgtgaagatttatttgctaccaaagaaataacttaagacaacaaaactttttagctttactaattaaatatatttatccacagctctcttgaggcaatgctttttaaaaagataaaccatgagactattacaccaatgctttaaaactgaccttcaaacacacaacagcatacaagggaaaagtgcctgaaactgattttataacaggtcttttcagaactctctctcatatataatgttagaaaaaaaaagatcctgtctcctcagcaaacccctttcagagcttaatcaagacaactaatatgtgccccagcttctagcataactaaaatgaagaaggtaattcagggcttcctggactccaaacagcaagagaaagttttaatataaccaagcctaaagcaaaaaactccaatcctaatgtatgcatttcaaatgacatgaagaaaaaaaatcctaccaatgagtgtacttctgcttccatagctacataatgaacctaacatctcttgcctgtgactagtaatttagccaattctgactgaaattaaacccattctgatgcatattacaggaaatagccagaccccatcatattctggcaacattaataatgcagctcagaaatagcagtcagggctaaacaggctacactatgtttctgatatcacaaggagagttcaaaagaatttccaacatatgtaatctctgacacaaaccagagttgtaataaaggctgtgtatgaatacagagagaagagcccaggggccaggacagaaaaaatatattataggtggggaagcaagacatagcttggatagggtagtgtgaattggagggtgagaggaaaaaagaagctagagataagatgatacctggtgcatagagaagaaggaaactaggatagactgcatgctagcctacccacagttctcactcccttcaatcttccttttgttatgagcaggtgaccagttatatctatgtcccatgcaggcctttaccaccatggaaatgagaatcaggcacaaccatgaacaacactgagccctgaatgctcatgttaatggagcaataagttatctatttcaaaaatcccactttgtaagatccttcaactccttaatttatatttcatcaactctgtgaaattctaccttttcacaaagaatattctatgggaagtttatagatgtacaacaacaacaaaaaagtcggaatattctggagatagggttatggctgtacaacaacgtcaatgtacttaatgccacctaactgtacacttaaaaataaagtgataaatgttgtgttatgtatactttaccataataaaacaaaaagtgattaattcatccatccccacccagggaccaagaaaagaagtcacaaaagctgccagcatgcatcctttttccttatgaccaggcggataggcaggcttaggtaacacaggcaacatgccactggaagcacttggctcccacttttttttttttttagtgtgttatgttccctctgatggtgagaattattaaatttactacttatcctgctatcacaggacttaatgccttagtccttcaccttccattctctttctccaagattttctcctatgccctatctagaaacctggttcacaaaacttcctcagttctaacagtttcagttgtcattctaattaccctaaatatgcctattttcccaaggtagactcctatctcccctttctcccaccccaaattacgagctttctcactacacccatgttcctttagataacaaattattacttttcctcttgaattaacttctctattcacaagccaagcccaggcattttagtaagatcttacctgttcatcttgtcccatatgttgttccactcaaatttatcctttacaaaaccattttcctagaacaacactttttatcttgacatttccttaaggccaattaatgaggagcattatgatcatagcagcaacaacaacaaagtagcagcaggtgctaacagttgagggctttcatgggtcaggtaccgtatttagctttacacacattactattttatttaactctcaaatccatgatgcatgtaattattatactatacttactttacaggcaacaaaacaaagcctatattacaggaattattagtccagggtctatttacctaaaatgtcctttaggaaggcacgaacctctcaaatggcaatgcatggttgtgtgaatgtgcatctgtgcatttttctggggaaagggttcacagcttttatcggtatatcaaaaaatacatgtcccaggcctggtgccgtggctcacgcctataatctctgcactttgggagcctgagacaggtggatcgcctgaggtcaggagttcgagaccagcctggccaacatggtgaaaccccgtctctactaaaaatacaaaaaaattagccaggcacggtggcgggcgcctgtaatcccagctactcaggaggctgtggcaggagaatcgcttgaactcgggaggaggaggctgcagtgagccgagatcgcgccctgcattccagcctgggcgacagagtgagactccgtctcaaaaacaaaaacaaacaaacaagacccaaatatgattttttaactgctactacaatggttaaacattctctattaaatcaaagtaaaattcttgagtctgatgttaactgtcctccacctactagagcgccccccatctccatctactaatatagcctttcgtttgaagccatgctctgcaccaactcaccctcatactgtcccgacctggaatacatccccaattccaaagcccatccatgcttccaaaggcttaactctggacccatcatgaagccttccttgtctactccagtccccactgatatcatatggcctccaagcgcgcgcgcgcgcgcgcacacacacacacacacacacacacacacacacggacgcacacattcccaaaggcagtccccttcagccctcttctcacacattcgtgctcctacatacacactgtgacgtgcatctgcctcacacaccctgacactccacattcacagagacacacacgcactgtcacactcactaaacacctggtcacagcctgacagtcatacccaagttccccgcaacagctctatctatgcccagtacctcaaatacaactttggacacacaggcatagtatctttctctctaatacacacacacaagcccactggcccccaaatactgcccaaggtcccaccaaccatctatcccacactgtcagccctgtgttccacagacgctcaaacccaccgccgctccaacccaccgccgctccctctcacgccccgcctcacccgatgctggtacagacagacgttcccgaagccgccggtgcccagccgctcccgcatctcccagggcccgcccgcgcccggccgcagccccgggggccgctccatggggcgggagggcaagcggcctcaggttccacagttgttccaaggccggttccgggccgccgatgctcgcgcgtctttgttctcgcgagaatgaatgcgtcacttccggtaaccgctgcgagaaggcccttccctaagttctcccagggcgctgccagagccctgccggctaagggatggggaaacaaacaggtactcggtccgctctttaagtcccctacgtattttccgggagggctgaacggaaccacaatgtttttctagtcttggaaaacataagatctctccaaaccccacattcccgtcaaatccacttttcaaagcagcccagtctctcctgtatttttttctttttaattaagatggggtctcgctccgttgcccaggctggagtgcaatggcacgatcacggctcactgcagcctcgacctcccggaattaagcgatcttctcacctcccgagtagctgggattgcaggcgcgcaccacctcgcttggctaattttttattttttgtagagacatggtcttgctacgttgcccaggctggtcccgaactcctggtctcaagtagtcctcccaccttggcatcccagagtgctgggattatagacatgagccaccgcgtccagcaattagtcttttctaaacttcatattgtctctactcctatctacacttcacctttcttcagatccctgccatctatcctccaactccaccaccagctgatccggcacgctaaagaccaccaatgatttaaaggctgcgaaatcgttaaaatactacgctagcaggcccactaatgaattagccttcttgttcactgacttcccaatacacctgctccaggatatcccctgtcatcccaaatgactcaagaatgtgacgctattccggagtgaagagtgtttctcgggatttcgcgagcttttttcctagatgcctcacagagcttgctgtccggcagtccagttatgggtttgccagcacagtagttcattgtgagaagtgtttctaatgggtgctacagggctgcagaggcaagctttgggaatgctgttggtgcagcaagtgcttccgggtggcggattgccatagcataggggaaacaactcctggtcttccatttaagagggtcataccttcactgtacctgggggatctcaatactccaagtaaaggaatcagcatggaatcaaattattgataaatgtgatgctgcaaccagaatgttgagcactgcatgatacagacgaagtcgatgttgtaggtcattagtaacatgtggtatgggaggttctggtttctgtaagtgcatggtttccatggacttggagatgatgatgcctctgaggacatgtcatttagagctgggcagaccgcacagagaattgtggtacagattgttgtaacagtatgaagccctctcatttgctgtatgtacagcatggccagtgctaatgtgctcaatttccgtaggtggggctgtaatctcgtaattcccagtcaaaagaggtaggaagggatgctgaggacccagggatactgatgattgggctgacccagaagtggccatctttgtggaaaccaggttggttcccttggttaactttttaaatgcccccattcccagggccatgagtaatttgagttgttttttgttgttgttgttgttattgtttgagatggagtttcactcttgtcacccaggctggagtgcaatggtgtgatctcagctcactgcaacctccacctccagggttcaagcaattctactgcctcagcctcccgagtagctggcattacaggcgcatgcaaccacgcccagctaattttttgcatttttagtagagacggggtttcaccgtgttggctaggctggtctcaaactcctgatctcaggtcatctgcctgcctcagcctcccaaagtgctgcaatcacaggcatgagccacctggcctgttttttaaaaagcctaagcctgttgaccccaggctccacaatcttcaattttccgagtctcagtttttttttcatgagtaaaatagaggtaatacctacctcacagagattttgtgaagattaaatgaaacagtgtctggaccataagtgcccaatataaaggtaaaaatatttttctttttgcgcctaatatgtagcattctctttgctccttctctatgtaaatgttagatcactattttcaagcactccttaaatactgatatttctcaggtaatcatcttcagctcaggactgtatttaccctatcttaatttcacctatggcctataccctgatgatccccaaagccctgtaaccaacccaggtactgatgagtttagaactgcccagcagcacaacagacacatattagatatatcaagcacctaaaacaatatccaaaggagaattatcttttttttcttaaatctgtcccttctattccccattaaactgtaatctctgggacaacagggaccatattgggacatgactatggtcctggagcttagaaaaatgcctggcacataggagttaaatatccgaaggactaaatgggctcttatctatgaataagatgaatgcttaagagaaaaatagcaaaagccttggatcccttttccactttgggttgttcagggagaaactgccctgtgtgattttggagtaacagctgggcctaaagctctagcccctgctattacacatactacttcatttcaacggtcacaggcaacatgaacacaagacacttctcaaccatggaaaaacatctggatttcatttggtagtttaaaggtttttgaaaatgttgatatacacaagctgtacttggagctggataacagacataggagctggatgacagacatacttttattcttttatttttgagatggagtttcactgtcacccaggctggagtgcaatggagcgatcttggctcactgcaacctccacctcccaggctcaagcaattctcctgcctcagcctcctgagtagctgggattacaagtgcctggcaccacgcccagctaatttttgtagctttagtaaagacggggtttcaccatgttggccaggctggtctcaaactcctcacctcaggtgatccacctgcctcggcttcccaaagtactgggattacaggcgtgagccactgcgcccggccttaacataggattttcatcctagaatgacttttccccaaaaagattcaatcttaggcctcttgctgtaggcaagttccatgggactgcacaaaagaggcagggaaacagtccccatgggagattgtagtttctttaaaaataggcttctaggccaggaatggtgtctcatgcttgtaatcccagcaggttaagaagccaaggcagaggatcccttgagcctaggcattacagaccagcctgggcaacacagggagaccctcctgtctctataaaaaatcaaaaaagtttgccaggcatggtagcatgcgcctgtggtcccagctactcatgaggctgaggtgggaggaactctagagcccaggaggttgaggctacagtgagccacagttatgccactgcaatcctgcttgggtgacagagcgagactttgtctcaaaaaaaattcttttaattaaaaaaaaaaaaaagctttactacttcctgtggagttcataaaaagttcttccctttgttttagtcatccagagtaaagtcatagggctcaaagtctttccggaagcggcgagccagggtctcctcgtcttccttgctgatctgacactgcctccagtcagacttatcaggaacattaaggatggcttcactggccaggacctccctgcagaaatagcacaaagaagtcaaaatggaaactatcagcctgagctctcctcaacatcacccaaaggaggtatgcaaatttctctgactttgctctcctgccctgagtgccatctctgccatactattgatcaaaatcatacccgttttaaatgaccagctcaggtactatatatttcctgatccttcaaaccccacttgcttctccctctcttaaaaaacttggaactatattattggtacttagagaagcaacaccacatagaaaaagggcaggccctggtgtgagaaagatcagagactggatcccatttccagctttgccacttgctatctatgatctagacagatgatttcatctctgagtcttgatttcctcacctatgaaatgcaaataagaacacccaccatacagggtttttgtgaggtacagagataacacagtcaaagtgccatattagctgtgattacaacctgccttaaactgtagttttgtcacctcaactagacatgagtttgcagagtcaggagcctagtcatacccactctgatttaaaattcctctgcctctccttctaggggactcaggcccacgtaacagcagcacaagcccaatgtcaacaaaacaactatcttggctcttaggactaaagaataactacatacagacacactcacacacaagctgccttctaatcgccattgctttatatttttatttttacttattttgatatattagaaataattctattacacatttatatggttcattttccactttgaagttacagtaaatagaagagttagaaacaaatcatgaattctctataagtcaaagaacctaagctccctgggcaaactttgagcctatttcaaatataaaaggaaaatagaactacctttcttgtacagctgaaaaaaatatgccatttcaaatattttgttaactataaaatgctatataactataaattagtatcttgataattactcaatattgaaaatacatcataagcacaaaaccattcagagaatcttctttttgtgtgctttatacgcctatgtgtatctgcaatcgtgtgcttatgttgtcaatgttcataaccgcatctgttgctgaggcaacaacgaaaacatcacgtcagatgtctgaatctcgtagcacacttgttcccatttatctttttgaaaaatgtagacaactacatttactggacttatctaagggggcaatctcttggaggctttctgaattagtccaagacaggttcaaggctcactcaaagcccatttttaactaggggagaaaaaacagctgcaaatcacagacaccagcatcagatactctgttctacacattttccactccccttcaaactgtatcttcttgccagcaacttcccatcttcaatctttgcttaagttatgttactccctctatggttttgcagtcatgttttgcctgatacgaggaacagaactgaagcctcctctaggcctttaccatactgtagaacactgaggttaagacctcaagttttgaggtccaacaggcctgggtttgaacctaccactgtgtgactaggacaagctacctaagctctctacagcctgctatccagtggggtaaccattagccaggtatggctatttaaatttaaattctaattaattaaataaaatcaaaaatttagttcctcagtcacattagccacatttcagcactcagtggccacaagtggctagtcacaactgtattggacagtgcagatatttgagcatttccatcgttgtgaaaagtctaccgggcactgctctagagcctcattttccacactggtaaatcgggatgacagtacctaccttacagagttatgaagattaaatgagtcatgtatgtgtaaagttcttggtacagttcttggcacagagtatgtgctcaattaaagttccctagcacttctggctagaatgccctcacctcaatctttgccctctaaatatgcctctcaggttcaactttgccactttcatgaaggctttcaccaactagaaatgagctgtcccttttctgaatttctacagcacattgttctccaaaactctgtcatggtactcttcacattctacattacattactgtcatatatgtaaacatctgccctaagaccatgggtcctctggggcaaggactgtttacaatttagctttttatcaattgtcccatgtagcccaccactctgttcatagcaggtctagtgaaaatacattgaaaagaagaaaaacataccttccaaactgcaaaggaaaattctttttaattctgtggaaaagcttttctcctgtgtcaagttcaacataaaaatatgctgctcctggctgtgcaatctaaagtaaacagagttgtatgaggatgtccaataatgctttaaaaatctataatctgagttcatctctaggcaaataattcagtctaaatgcacaagaaaaaaagatatgtatgttgctatagatcccaagccacttagtggaactagggcttaaaaagtctaactggaagatactaacaatatcctcccagtggcgtctatccttctaagttcctaccttaggaaattctaatttcttgctcttcccaggaaagcactaaactttggagtaatgccctgttcatctccagtctagtcaatacccagtgctctagttccaaattgtccactgcctcttttttttttttttttttttagagacagggtcttgcgatgttgcccaggctgaagtacagtggtgcaatcatacctcactgcatcctcaaactcctaggcttaagtgatcctcctgactctcagcctcctgagtagctaagactacaggcacatgccaccatgccaagcttatttttttattttttgtagagacaaggtgtctcactttgttgcccaggctggtatcaaactcctggcttcaagtgctcctcccgcctcagcctcccaaagtgttggattacaggtgtgagctaccatgcccaacccattgcctatttaataacatttttggaatgccttgatagctcaacatgtcaaaaaccttaggctcaacatgtcaaaaaccagatcttgccaggcgtgggtggctcatgcctgtaataccttcgggaggccaaggcaggcagatcacaaggtcaggagttcgagaccagcctggccaatatggtgaaaccccgtctcgactaaaaatacaaaaagtagccaggtatggtggcgcatgcctgtagtcccagctactggggaggctgaggcaggagaatcacttgaacccggaaggcggaggttgcagtgagccaagatcatgccactgcactccaacctaggcaacagagcaagactctgtctcaaacaaacaaacaaacaacaaacaacaacaaaaaaaacagatatttactcttccctgaatatcaccatcccctgtttcacctgcttgatgtcagagtgctctgggatttccaacagctctatctgctgctcctgtgcctgggtaatgaaggcatctttaatgtcatcagtagtagagcagctgattgggacaggaatgacctgggggttggggagacaggagaaattccttgtgcaggtcccagagaagttgtgcctgcacagtctctgagaagtagcaaatccatcacaggggtggagaaacacccctcagcacagaatatcctcaggccagacaagcctgtgtcagcctgtctgtaaggacttaaacttatgagatagcctgacacatgtgggagccattctctgatgcaggaaaggcttaagagagatatctccgtcacaagcctttgccatctccgatattatatatgtggcagagttaggcccatttgaaaacttaacaaatgtgccaaaaagaaaaccaccacaactacaaatgatttacaatctgattttctgagctgctagccccatgcaggctttgagactatttcctaccactaagctttccctcatgctgggcctccacacaaaatactcactttcttccaaattcttatccagcaagccccacatcttccttggaacttcctcaactacccattccttttctaaacaaggaacttactatctatgctgtttacatgtactgaccacacacttccctgtgaagtctctggggttaccaccagatactctttaaaaactttttaaatgaatgttatttaaatattaatataaaaatattaaatattttacatattaaagctaaactttatataattttttttttaaagatggagtctcgctctgttgcccaggctggagtgcagtggcacaatctcggctcactgcaacctctgcctcccaggttcaagctattctcctgtctcagcctcccgagtagctgggattacaggcatgcaccaccacgcccagctaatttttttgtacttttagtagagacagggtttcaccgtgttgcccaggctggtcttgaactcctgagctcaggcaatccaaccgcttcggcctcccaaagtgctaggattacaggcgtgagccacctcgcccagcctatttaaatacttatttaccaatatcaaagtccccatagcgcccttccaagtttctatgaacagaccacctacctgtagctggaggtgatggctcttataatttctctcaaatacaacacaccatttccctcgactcttaaagaaccgtctcagagtggccttatacttctccacctcttctaccacctctgctgaaagctccaccactgactggtagtgtccaataggcaggatgaggacatggtcatcagataagcctcctttggccagggcaaggtagcactgaagaagcagcacacagaattgagacatcaatacagcatgtaggattctccagggagaaaaacctatacaaaaagtgagcctgagggtgtaggcgaaaagtacttgaggttattaataaaaattctttcttgaaaaaatctgattttagagattgtagcaacaatgttctcaggtatccgctgaagagtgagattcggcatgaaaatttctatgcaagtagcaaatgaactaggagcaaatgaattgggagaggcacacaagcaggcttttggcttcaaacacactgagctgagggagaccagaacaaatcgctgggttttccctcccatgctccaaacttgaaaacagtttttcagtttttatcaccctcaaccacaaaaagatacaacttctgatttcaaaatgaccactttcggctgggatagtggctcacgcttgtaatcccaaaactttgagaggccgaggcaggtggaccgcctgaggtcagaagttccagactaggctgaccaatatggtgaaacctcatttctactaaaaatacaaaaattagccaggcctgtgatggcatgtgcctgtagtcccagctactcgggaggctgagacaggagaattgcttgaacccgggaggcagaggttgcagtgagccgagatcgcgccactacactccagcctgggtgacagagcgagactccgtctccaaaaaaaaaaaaaaaaaaaaaatgacccctttctgcctccccagtaactttcattcccacccccacccccgaatatactccttgggctcacaaaaaaagctaagatggcatgattagcatctaatgttcctaagccttaagctgctgactaaattctacaaaacaaaagcaaacatacaacctaatggggtagaaggaaagtaaaacctcaaactcagatgcatccaaagaggcagaaaagaatgatttccaacaatggatgtcagcctttaatggcaactaaaaatatttctgtaaaaaccaaaacatgcaagaatggtctaccactcagatattctctgatgggaagatgccatgagtgagcacagaagggcccaatgagtaccagtacaggcaaatatagatacgttagaaaacaattatccagaccgggtgcgttggctcatgactgtaatcccagcactttgggaggccaaggcaaatggatcgcgaggtcaggagttcaagaccagcctggccaacaaggtgaaaccccgtctctactaaaaatacaaaaattagctgggcatggtggcacgtgcctataatcccagctacttgggagactgaagcaggtgaattgcttgaacctggaaggcggaggttacagtgagcc

SEQ ID NO: 1057 - DNA, 71471 bp, Homo sapiens
ctccagacattgccaaaacccatggggagaagagtggacaaaaccttccccaggtgagaaccactgatctagatgaccgatgacagtggcatgcactagagcagtagatgggcaggtggggagaagtggtgagattctgtatgtgttttgaaggcaaaacacacagaatttgttgatgcattatgcgtggatcctgtgaacaagataaggattaggaagattttaagatttttggcctgaggcactggaacaataaagctgctgcttaccaagatgggaaagactacaggaggagcaagttagaggaaatcaggagtctggttttggatgtgttgaatttgagatgcctgttaaatccacatggaggtgacaagtaggcagttggatatacaagtcaggagttcaggaatgaggtccaggctagagacagaaatgtgacagtcattagaacagaggtgttacttaaagccttgaggctgggagagcttgtctgtgcagggagtagagatagggaaggtgtgttaggcagcattttaagatggccatctgatatctgacctatgttatgtcctttgaaagtagacaggacgtagacttgcttctaactagtagaatatggtgaggtaaggggttgtccctcctacaagtacaccatgttacataagtctgtttttttgctgactggaatcagaggctttcctgctgactttgaagaagcaaagggcttcttgacaaccactgtggagaggtctcatggcagggaactgcaggagacctctaggagcagagggcagactccaacagatagccaaaaagaggctggggccctcagacatatgggtgcaagaaaatgaattctgccaaaaatctaaatgagtttggaaatagattcttccccagctgaacctgcagatgagaacatagcccagtcatgccttcatttttgccttgagggagattctgagttaagcaaaaacaggtctgagttcaggagcacattggtgctgaaaagttgaggtcaggacaagccaacaaagactggcagaaaacaaaggcagagtcagaagctaagtgaataaaatgaaacattttgagaaaaacagagggactactgtgtcaattgggactgacaggttgagtaatctgaggtctgagaatgacttatgggatttggcaaagtggtgattatgagtgaccttgaaatgaccttgaaaaacagctgtctccctagagtagcgggactgaaagcctgatggcagtaactgaggttaaaacacacacacacagacacacacacacacacgtcaggatttggattcatatgggaacagcaatcaagtctgcattctgttttggaggtaacatcaataggacttgctgacagacgggaataggggaagggagaagtcatcccaaaggtggaagccctagccactgggtaggaggcaatgccttttactaaaatgggagaaaaccaggagaggaacaggtagaggagggaaccagttaaagttatgttaaaaacctggtgtctcttaacatatccccacagagaaattccataggcagttggatatgagtctgagctcaataaacaggtcaggattagaacttcagagcgttccatttacagaaagtacttaaaccaatgatactgtctagaatcattgagaacagtggttctgaaactgagagatgagggtacataggaggtggcgatcttgcttccagggcacactgggcaatgtctggaggcattttttattgtcacaattcaggcagggagtgctactggcaactagtgtgtagaggccagggatactgccaaatatcctacaatacacaacaaagaataatatagcccaaaatgtcagttgtgccaaggttgacaaatcctggtctagaaagcacgttgctatagaaggagactcagaatcaagctctggggaatctgaaatgtggaggtcagataggaaagggtaatccttaagggagatttaggatataggtccagaatagcagggagaacacctacgtgactatgataaactaagaaaagaacaggaagtgagaaccgggagaccccgagcacaggttgctaggagtagacgtctttgctcacacacctcctgatagaatttatataccatcttgaacatttttaagttgacacctgaaatagttcatcataagtctatattttttaaaattatttataggctgaaaatatttagtattttaaaaatataacataggaaaagattgacttgattggaataaaacttgcctgatacaatttactgttttttaaatgctagctttcagttattctctttacttaaccatactgaatctgaaaaacccctgttaaaatgctgatttgtgtttctacccccattgtatctggacacttttggtagtccctcaaaccaatttagtttaatttaaaagaatcaatgtcactaacccaaagggattctgcttttctgatttcagagcatgctaacagtaacccaaagactctgtttctaatgataccctttgctcttaacaagaaagaaaggaagtcctaagtgttgatgtttctgttaaaaaattaagggagaccagttttttggggctgaggtcctgcgctaggcctcaatggaccagactaaactaaaatggagtcactcgtactgactgccatttaatcaaactgaaactttaaggaaggagatagatctccaaacagaccagttttttcctgaaaacaggagattccagtccacttgtgtcagcatcatacggacgtttcccctgctttaacccctacaagtcacctcctgaagtaacctgatgttaaccaatcagcttcttttttactattgttccgtttccttgttctcaccttacaaaccacccccgttctgcaatttcccagtgggacctcttgttctatttttttttttttttttttttttgagactgagtctcactctgtcgcccaggctggagcgcagtggcacaatctctgctcactgcaacctccgcctcccaggttcaagtggttctcctgcctcagcctcccgagtagctgggattacaggtgcccgccaccacacctggctaatttttgtatttttagtagagacggggtttcaccatgttggccaggctggtcatgaactcctgacctcaggtgatccgcccaccttggcctcccaaagtgctgggattataggcgtgagccaccgcatctggccttcttgttctattttgtaggatggtggctgccctgatccatgaatcataaataaaaggaagttagatttatcactaatgatatctgatgcattcttgggcatatcagttctactacagagtgtatatggaaggagaagacctggaaagggactctcttataatgatctgtgcacaagattgtatagagagttttcaggtatccccaggggaatggtaaccaagttgggcaaccagggtataaagaagtattttacaagctatactgtgaatgacggcagggcaggaaactcagaggttgctgacaggagtggtccatgagaaagtaggcattgaggccaggcgcagtggctcacgcctgtaatcccagcactttgggaggctgacaagggtggatcacttgaggccaggagttgaaaaccagcctggtcaatatggtgaaacccatctctactaaaaatacaaaaattagttgggcatggtggcgcatgcctgtaatctcagctactcgggaggctgagggaggagaattgcttgaatgggtacccgggaggtggaggctgcagtgagcagagatcctgccactgcactccagcctgggctacagagtgagactctgtctcaaaaaaaaaaaaaaaaaaaaaagaaagaaaaaaaaaaaaaaagaaaagaaaaagcaaaaagaaaagaaaggaggcattgagttacctcccagagtggagtcctggaaagggctggagagaatgagtcccaagcacccgaggagggaactgactgtgtgacagtggggatacttgctcccctatgacagtctctcaccgctcttctcactaactcggctttatctttagtgaacttttagtttttattagtttatcgtgcatctgttccattacaatggaaattccatgatgagagggacttttctgtattgttcattactgaattaccagtgctcagtgtattgcctaccatagagtaggtgtttaataaatgcgtgtggaataaatgataaaaaatgaaaatacctggacacagatatagtatagatgtgatctgatggtaagaacatgtgagaattgttgtgcaatttgcttctgtttccccaacaaaaggtgacagaagggcatgagctaagacagagggggcgttgtggggaagaagtaggggagaaagttgcggcaagtcttgaaggcatgaactagtcattttcattagagagaaagcaagcctgctggagatacaagggagttcgcagtcactgctgagtatcctgctggggctcagaaactggtgccctgacatatggcactttgacacgttgaactggagaagcagcctcaaggtctctaccaccccctcctcttctctggctccagttctttgtctctcctaaagcacaggatgaagttcttctctgaggttccctaatatacctggaaaccagacccccaaagaggaacacaattgccctccacccattccctgaaatctcattctgtatcacaggaaggaagactgaggagtacaaccacacctggatggacttttccacaagacactgtctgcctctagggctcatctaaattccaaagagaatcattttcaggttactttctgtctcctgggtccattcatttcccctgtaaattatttcagtcctacacccccatctccccacttcccaataaagagcatacttaagcatcaaccagctggctgttttggagttttcatgttttgtatgattccagtgcacatgtgtgcacttagtaaatttctgatgcttttctctgttaacctgtcttttgttataggagtgtcagccttgaccctttatgatggggaggaaggggatcaccccttttctgcctctgcacccatttgaggtttgtggttgagtattttaaagtgcaactggttggctcagttctgtgattgatttctaggtgtttggcttatgcagctggcatttggtggagccatttatcaagaaacaaaatgaaggaggataagaaagcctttcaggaaagataatgaatcaatttcgaacatgctgagtttgaggcatcagtgggacatcaaagtgaagtagtattatacatgggtctagtggaggggggaaagaagcacatggtgaagatgtgacgggagaattgtgagtatgtggaccagagctgaaaccctaagggcacagctgagatgactgtgggagagggtagcatggaagagaaaggttagcagaaccccgaggagcactaattgtgaaagagtcgcatacatttatcatgcttgaaggtcgtgtctctctaagcagattctgagctcttcagggtcaaaggctgggtcttgagcttcattcattcttagcccctgtcatagtgctggccacacagaagacaattctaaaattcactctgattttatttctctgcactttcatttatgaggatcctatcacggtttatgatttgaaatgctaagggataatttttttaaaatcataactttcatacgaatataaaaagaacacttgtaaagatttgaactcagtacttaacaagagaactagtaaaatgttatcaccacttcaagagacaatctaaagagcagacaaatatacagccaaggatgtgcgaatgaacttccctaagatatgcaaaactggctttttccaaaggaaattgaggcaagatgggtcaactttactttcacaggataaaatttatttgcatgtttatagacaaatgttactattatttgcattgctatcagttatgcacaacttacagagttgtaaaatagcttaaagtcaagaaaggcacaggatacaccatagagtcacatctggaatggcatgctagactgactctttttcctttgaagacaactgtaaccttcttggttcatttcaaagtcacaatttctcctgtaatgctaaaaaggaaaagatattatccctaccatttctatgagtggggtctattacaaaacatagatgaaagtatatttgggtattactataacatttcctagttgatgagggagatgaggctgaattggggaccccccctaacataatgtcttctaattggcatgggaaatgttcacgaatcaaaccaaaccacctcaaatccaccctggaatgaggcagagttataaacaaaatatagaagatgttgaaatagcccagttggttcattgagctttccaagtcagagtgcaggtcctgaaggtggtgactgtctcccctgtcccctgctgctccacccctaccgccatgtctgccctcctctaggaatgcaggaccgtctgactgtatcctcagccttcaggtcaagcacatgatctgtttaaaaatggaaaccctcctatccttcagtagtgaacaagggcgactctggttgcttttggaaaattcagctgctttagtccaacagttcaggagaggatcagcataagaacttggtgatgattactagagaaaatgctcctatgatttcctgagcataatatttccccttgcaatttttgagtgttctatagcaaacctgccaaaaatgtggagcctataaataggggagagtgggaagaaaaaaatgggacctctcacaatgccactgaaaacagggaactaaaaattttccagagatgcaaagtcaaagggggattaatatttacttagaaatgaagtagcaggtgcatgctttataaagaaaagccaagaaaggatgaaattaggggagagactgaaaaagatggaaaaatgtgccaactaaagtctcattttgaagaaagttacagatcaacaaagggggaaaaactcaggtaaaaagactccatattatgtcttgcattgattaggcaggtgctttatatgcacttttaaattttctcttcctgcaaatactatgaaataagtatcactaccagagatgacattcaaatatttaacagcagacaaatatttaacagcacagacactagccaatcagaagctggctagaggagccccgctaagccaggcagtaaccctctaatggctggatcatgaggccaaggtaggggtcagggcagcagcagattctgtacagaggccattcaccaacctttgagatgttgcaatatttaccaagtagcacagctgaaatactgtgtgccagttgaacatcagctctgagtggaaacccagggccatgtcctctgggcaggtgtaggctttctctcttgcgtttgtcctctgtagattatgatgctagcattgaagtctttcttgttgcgcctggctgtggtggtctgcaccactatctgtgtctccaagccgcagcccactccatggggtcctgatggttcccttctgaatctagggaggacagcaggcagcagggaccctccatcgctgttgccacttaatccctttagcatcctcaagataagcccagtctgtacaaattcaggttcattttatttctaaagtcccaggaacaatgtcagaagggaattacagtgaagaaagaaagagttcaagttccagcttacctagacttcctgcagagcctcgaaagagaaggcagggttgcagacatctttgtttcatctgtccagcatcctctcccgtgccttggtactgggctttgaagccaggctgcctgggtttgcaacttgccacttattaacagtgtgaccttgggataaaggcccacctttcagagccactatagattggttattggaattgctggttttgttaggtgttacaaaatgtcagggtttttttttcttcttttgatgcgtaaactgaggtattaggggataggaaatgatatggtgtttagaatttgctttaaaacatattccaataaaagggctggactcagtggttcatgcctgtaaacctagcactttgggaggctgaggcgggtggatcatctgaggtcaggggttcgagaccagcctgaccaacagggagaaacaccatctctactaaaagtacaaaattagccaggcatggtggcacatgcctgtaatcccagctactcgggaggctgaggcaggagaatcgcttgaacctgggaggtggaggttgcggtaagcagagatcatgccattgcactccagcatgtgtaacaacagtgaaactccgtctcaaaaaaatatatatatatatgtatatatatatatatataaaacaacaaaaaaagaaggtctcgatgcggtgggtggggaagggcagaggagacaggttgatgatggttgaagcgaggtgctaagtacatagggtggggttcttgtgctctccacacttctgtgtacttgaaaattttcataacaagagaaaacaaaaaattaaacagaaaatgaggttttcatttcctccagcaaaacaaacataacagggacttaggatgtacttttcccaatcgctcctctggcagaatattttgatcctccagctagcttccggctcttatcctgttcatctgttctgtagatactggcaggaaataggctcttcaacagggcctgctaggtccagtgctagggagtagagcgttttggattctacgcctacatttttttttaagtgaccagttttctagttgagatacttgaaatacaaagtctcatggtgaggtcttaccctctgctgtcccattcctttttacaggccatcatggcgttaatcttatctccaaggagaaaaattgggaagagaggcctagattcctcaacagaagcgggaaggaaaggtttgcagaatgaagagtgtgaagtgaggtttgtggtttgaatcatccgaatgtcaaggagaaaagaagaaaaatgaatcatcatcatttgaccacggtatttacagctagcggaagggacaagaggagaaaaaagcaagggaggagataaaggaagaacgtctcagaataaaattggggtgggtggggggaggaggaggaagacagtctaagaaattggtttggttgcaccagtactggccacaacacaaaaatttgtccattcctggttgaaattaaaaataaatgtgcatgcacatgtatttgtctgctgtgtttaatcagatagcgaggcactcctttaagcaccttgaagacccaaagttgcgctcagaggctgcccacctggaacggagaccgaggttgagcagggagctactcagaggacccaaagccgcctagctgaccaccttcttccctatgagttcccagtaacggagcccagtggaggagacgctacacttctctgtggggacagaggctaagggcgggggtctccatagaggcgttagcgcccaccagcggcagtgaccgcgcacagggaggtgaagaatgcgaccacggtgatacgtccaacctggaaaacgggcctgagaaccaaagggccaacttctggccatgcataacgaagcagagcagtctcagggtagaaggcactggaaaagcgttgtaggacaatttttcccagtagaaacggtgggggtgggagggagacccgctcaccccttttgacccacccctgcagctcagccacgcctcctagggaggtgggcagccttgcaggagcccgcgcgaggctgcagtaccgccctccgccacatgagggcagcacggcctacccgtgcagcagcggcggcccccgcgcccctcttggccagagccaggcgcaggccggcttgcggtgccgtcgttcattggccgcggcgcgggcgctgccatgttggcggaagcggacccccctgtgccgtggaaactggcggtggccgcggccgccgagtcggtctgcgcagcctcctgcgttttctcgcttggatcttggcactgagaggcggtggccggcgggatggagaaaagtaggatgaacctgcccaaggggccggacacgctctgcttcgacaaggacgagttcatgaaggtgcgcgcggcgtccgctccccggagccgggccatgagggtgcctctgccctgtgccctctgtggcggtctcttcggtcggctgctcctgcctgcgcacgctcagtgtcaggtcctccgccgagacctcgctgcacttcgcaatgagtcttttggcgtcaggtttggcgggtgcagcctggagaaagcacttctgtaaaatcgtgcgtgttacatggaaaggcctgaaagttctgggcaagtggttttgagctgcatgtcaaagccactgttacccgttcctgttaccatgcagtgcagtcagattgccagtccccttgtcggaaagaagcttgtggaccggggccttggagctcattaagtgtgtgttgaataaatctccaagcccacgtactttcctagggactcgggtcggaaagaaaaagaacttaatctgaagttttgcttaacattcagctaaagcttccagaatgggatatttagaagcttagaacattcttaccgactattgcagtacgacaaagcaaaccattactctttaaagaagttgctctactttttacgtgatgcatttgaagaagttggtagttgtaggtcataaacttagagaaaagaaatataaactgaaaacacttcactgatgataaagttcatcaggcacagccttgaaaatggccaggctttgagtgagagctgggaggagctttgctcctacttggtgtatccctctgggtctgcacttaagccattcaaaaaatgtttctatttaatttcctgaggactaggatttttgacaccttttagtagctgctttcagtgttaaaaagcgaaaagttttagctggttagtagacatctacaattttgagcaagtgagttgaaatcttactctgcctttcttggtgacataatgttttctagattaattagcctatctctttttgataatatttgcattcagattacatctccaaagctgtttttttttaaagtagatctgtatcttctccagtgtgaccatatcatttttcgtatgtaggacttatctatacccaggaataatgtaccttattcttgtaagtgatattcctattagaccactgtactaaaaggtgtaacttcattaggatgtctcaaagaatgtacagaatcaactcattgatccagaaacccttcgttttgcctactggctaagagctaccctgaaatgagggtagaaagaaacagctaagggtacatgctggggagaggtgccctggaagaggaaaggccatacacggagatcaggggccttgttgacgtcaagaatctcagagtacagaataatctcagtttgtccatctcttgacttcttaaggctcaacaccagcatcttctctgactcactagccccaccacctttcccactctgagttgacagaatgcctttggtaaatgcagcttcaggaagtgaaatcacagaaatacaagttctaaaatagaacttagagtgcaaactggggtggtggctggaatgccagcaattgcatatttcgtggctctgtgaatatgcggtacattttgtagtgcttataaaagtgacaacatacatagaagaaaatacatagaacagctgttctgtgtaaaattttgttgattttttaggtggagcttgaagataaaggttatttgcaatttgtgttgccttaaacatataaaactacatataagttgcacttccatggcagaaaggatggttggaacacttgtccaggctatatttctatgtttgtgtctcattcagcacattttgtaattggataggttttgtacgtgtgagaaagttgggatatgacatttgcattgggagatttgagattgcttgaaaatccagatttaaagttgcttgaaatccactctcttctgttattacctctcttctggtattacgtctcttctggtgttgatgggaaactgtgtttaggttgccatagatcatgagggcatgctagtgcagtggtagcaattgttcagtcagtgggcattccatgatcacctgctgtgtgcaggtttcaatgggccttgtatactgtactgacggatttgcacttgatttagtattcattgtggagttacagtcaggttaaaagcaggaaatgacatgatcatgtatgttgcagttggaactgactggtggcgggaggctacttaaaaagttatttcagtggtttttatgagatctgagaaatacaggaggggatagtttgtggaaaatattacgtaaatgatcaaaaagcaggagtggcagatgaacgaatcacttgaggggtcaaaggtggtaatggcatgatactgttgacttcgtcagcttaataaaatatacacactgagcaacatagtgagaatgcatttctacaaaatattgaaaaattagccaggtgtggtggcacatacctgtagtcccagctacttgggaggctgaggtgggaggattacctgagcctgtggaggtcaaggctgcagtgagccaggattgcagcactgcacttcagcctgggcaacagaaagagaccctgtcaaaaaaaaaaaaaaaaaaaaaaagaaaatgtacaaacactcttagagagggttgacaatcagtagatgaattaggatgtaagatactggtagtaggagagaggtggtaggctaacagggataacttaaacccacttaacctaggtatgctgtggcaatcatatccttctgtctcacgtatgacttcatgtgttttacagaaaaaatagaggccatcaagcggtagctccttcatcttgctgacagcaacctcgttcttgcatttgtacctgttctcactcccatcattaacctgttgtgtagggcaatggtccccaacctttttgacacttttggaagacaatttttccatggaccaggagtgcaggggatggttttggggtgattcaagcgcattacatttattgtacactttatttctataattattacattgtaatacataatgaaatagttataaaattcaccgtaatgtagaatcagtgggagctctgaccttgttttcttgcaactagacagtcctgtctggggggtgatgggagacactgacagatcattcagcattaggttttcataaggagtgcctaacctagatccctcgcatgtgcagttcacagtagggtccatgctcctatgagaatctagtgctgccactgatctgacaggaggcggagctccaatacagagtggctgtgaatacaggctgcgctcctcctgctgggccacccggttccccacaggtagttggggacgctggtgtaggggtctttccttcctcctgaggtctgcctcccatgcctggatccggtgccctctcccttctcaggaccctgttattcccaccctctccacacttcttcccattggctttcagacacactcctattttagtttcttctactggaccctccaacctccagttaaagcccatcgctctcttccatctcacagccaaatgctcacagccaaatgttgtctttactttctctcccttcactcttaaattcacttcactctggtttctggccccatcattccactaaagacttctcaccaaagttaactagatggaagtcgatccaccagaccttctctgcttccttccctgacctcagtagatcaaatgctcccttcatttgctttctgaaacctggtgctttctggttatcttttggcctctctggtctccttgtctcttttgcataatcattctcctcctagccattaattggtgggttatggactcagccacgtgtctgttccttttcacatgctgtgcactttccgcaggtgacccacttcatgcagcttcaatgaccacgtgtagacaggtgaaaggttcatacttctggcccaaataccttcttatctgcaaccccatgtgcacagcgccttgacatctcttcttggctatctctgtggcacctcaaactcggcatatttaaaactgaatttgttgggggaagatgaaaaaaaccaaccttctctcaaacttggctctcttctggtattacctatctcaggtaatactagacctgaggtaatccatccatctggttgtgagtcagatgttatcaaggagtcatccttgataacacctctctccttcacattcttgaaatccaacctgttactaagccttaggatttcacttcccaaatatctctgaaatttgtctacttctctccatctcctcttttcccactttctgactcatcattatctctggccattataatctagtggcttcttactgtagtcccctggcatccattcttgcctttttctagtccgtgttctacatcacaggcagggtgcccttttcaaaacgcatctcggtgcttgtatgtaacaggtgcttgtatgtaatcagactgccacctgtatacaccatgaaaacatgagaaagcattttccagaacacttggaagtattccagagcagcttattgcactgatggacagtttctattgattagtagctatcttggttatctgattgaaaaaacatagcgtatatagagttgggtactatctgtggtttcaggcattgactgggggtcttggaatatatctccctcagataaggggaccccttactgtagttctgaggctcatctgtattctaagtgtgtaaatagggaatattgaaacaggaggtgtgtccaagagaataatgcctggctgattgaatagcagtgacctggagatgtgggccccagtttcagctctgctgagcactcgtgtgattttgtgcaaatcgctggcctctgcgggcttcagtttcctcatttatgtcatggggtgatgcttatctcaatactctttgcagtgtttctggctcttgtcgttttatgtttctgtgaataaagaaacttacagttgcccctcagtatccgcagaggattgattccaggacacctcccaccccttcacagatagcaaaatctgcaaatgctcaagaccctcttgtaaatggtgtagtatttgcatataacctacttacatcctctggaatactttaaatcacctctagattacttatactacctaatacagtgaaattgttgttatactgtatttttatttgcattactttttatttttttaattatttttttaaagactcttttcaattaatgactgattgaattagagggtgtggaatgctcggatacagagggacaactgtagtagattcttccagtttgcagataaagaaactgaggtccagagatgttgtgacttcccccagagtcacacagctaactggggcaacccagggccattatctcatgactcccaggcttcagtactggaaaaataatcgtgtcatgctttcctttctagatggtagaaactttggaatgtgtgattttgaatactgagaacagcccaaaaatgtcacatagtccctatgctaaagcacatgcattttatcagtagggacaagattgagggccatcacttaatttaaaacaaattgtaacccatctagtgatctggactcttggcctgtagatgagatacaggaaagcggatgtaagtgtgaaggcaacagcccagtgttgctgagtgccgggcacagcatgtgccatcatttcacagcaactaaaatgctgaccttacaggttcatggtttcatttttggtcttcatgaaaagcttgaattctctttagcttcagtttgcaacacaaataaagaatatatttgagactgattgtcacagaattttctaattacccacatgtggagcgatttcctaatgtgaaatacttttcttgatggtatgagatcagtaccattggacatacacagtttattcagttggcctttggtaaaaagaagttctttggtatgcaaaaattttccaagtcacttcttgcaatattataaaatgtattacttgaataaaatgttgaactcatggtcccttgagtttttattacttgggatatttctttgttcaaagttagataagcatcatgtaaatagatctttgttgttcagtcatacagcatttaacatcaaatttctttgaggatttaactaaccaaattaatcacaaaatggggcttgggctttctcaggtgtccctaatacacccacagcagtaagcacttcagaatgagatcattctgcttaagagctcaagaaattaagttgagaaagtaagctagaagaccacatagattgtcattagtgttaaactggggtaaaaaggagagagaaagagaagaaatcagctgggacagagcacaaatatttgttaaatggaagtgacaggttataggttttctttgccttctcgtaaatacatcaaacacagatacggtattgaacagaggatttagacataaaattgattaatccatttaaacataataagttatttagaacttaagtgctactgtttcataaaacttctaatatcatctgtccatagatgctggaaaacactttagcatacatttttaatttctcaggcttcagtaatttggtaaccaaataaaggtttagaatgagccttggaagacacgagttccagactaactgggtcatgtgtcaatggagccaccctgcactggggacagcactaggtttgagggcaggggctggagggaagagctccagggacgtttttgcccatagcttgctgttgtgaggaagggttcccttcccacagtctttcccatggctgttgccttcatgacattcagatctcagctcagataccactttgtaagggtcttctatccccttttcatcactcgctttcatagggttccattttattttctttgtagcacttaccactattcataatgtttgtttacatgtttattttctcatttccccattagaatatatgctccttgagaacaggaatgttgtctttgcttttcattgctgtgccccctgtaattacagcagtgattatttatttatttattgggtatctcattgtggtttttcttttgttacttatttattttattttattttagattcaggaggtacatgtacaggtttattatgtggttatagtgtgtaatggtgaggtttgtgcttctagtgtgttcatcacccagacagtgaatgttgtacccaatagataatttttcagccctcatcttcctccagcacttcccctttcaagtccccagtgtctattaattccatctttatgtccacatatacccatcatttatgtcccacttagaagggagatgatgtggtatttgactttctgtttcggagttagttcatttaggataatgacctccagctccatccatgttgctgcaaaagacatgatttcatctttttaaggctgcatagtattctgtggtataaatgcaccacattttctttatccaatcctccgttgatagacacgttgattccatgactttgctattgtgaatagggcttcaataaacataggagtgcaggtgtctttttttatataatgatttcctttgggtggatgttccctattaggattactaggtcaaatggtagttctatttttagttctttgagaagtcgccatactgttttccatagaacctgtactaatttacattctcaccaacagtgtataagcattcctttttctcacatccagtgttgttttttgactttttaataaaagctgttctgattggtgttagatggtatctcattgtaattttaatttgcatttctctgatgattagttatgttggacattttttcatatgtttgttggatgcttgtatgtcttcttttgagaaatgtctgttcatgtcttttgcccactttttaatggggttacttgtttttttcttgttgatttaagttccttgtagactccggatattagtcttttgttgcatgtatgatttccaaatgttttctcccattctgtagattgcctgtttacactgctatttcttttgctctgcagagctttttggtttaacgaagtctcatttgtctatttttgtttttgttgcatctgctttgaggtcttagtcataaatcctttgcctaggccaatgtccagaagaatttttcctaggttttcttctaggatttttatagtttcaggtcttacacatttaagtttttaatccatcttgacttaatttttatatatggtgagaaataggggtccagtttcatttttctgcacgtagtgaatatttaatgtttatcgaatatgcaggggcatttattcttatctgttggccctttgtcttaaagaatggtttgaaacacacagacatacaggagcttatactaatcttttatgactttccacctatagtttatttagtccacagtttagcacataatattttgtattggtgtttatctcaatgagactgaacatgttttgagtgcagagatcatgtcttcagcttggtgttgcctcttggtagtacctcccatcattatgaatacagaatgatgatgtctgggggatttgggttctgtccctgctgcagtagccgatgatttgatagttttctatatttggggaacattttactttttgacgttcagcatggggcagcttggagaattttgctcttctgttaaaagttctgtgaaattttctcagtgttaaggatattgatatttgggtctcaggcgagctttaaatgattacttccccagttctcttgtgttagtcattgtttgccatccttgggtgcaactagttattaaagcagctaaactcttaaactttatttggttttaaaattgattgtcactgctattctagttaatggttcttaagttttccacagctggtttgttttgctgtcttattatcctgtatttgatttgttagtcaacttccagctgtttggggcatttgtactttacctgggtttaagtcagaaatatctctgagtataaagagaaatgatttttcttttaatttctgggctttcaggccataattcttgacttcttccagcttttcagacacaggcatatatattttaacaagaaaaaagtctacttttaaaaatattgctttttaactaaaacagcttattttcaaaaagtgggtgctattccattcaggaaaaaaaagtttatctaccttagtattttttaattaatagacttctttggagcagttttagttttatagaagaattgagcagaaagcacagaggtcccatctatcccctcctgcctcccccttcacagtttctcctagtaacatcttgaattagtatggtacctttgttacaattgatgaaccaatattgaggcattatttttaactgaagtgccatagtttttattagagttcattctttgtgttctacattcaatgggttttaataagtacatagtgtcatgtatccactattacagtatcatacagaacagtttcactgctttacaaatcccttgtgctctgcctgtccattcttcccctcctctcccggcaccttcagcaccaccaccctcccatccctaaccccaggcaactacggatctctttagtctccatagttttgccatttcctgaatatcatgtatgcagtaggaatcatacagtatatatagccttttcagattgacttctttcacttagaaatgtacgtttaagattcctccatgtctttgtggcttgatatagctcatctctttttattgctgagtaatgttccatgtatggatataccacagtttgttcatctatttacctattgaaagaaatcatatttgcttccaagttttggcagttagaataaggctgctataaacattcacgtgcaggtttttgtatggacatacattttcaacccatttggctaaatacggagcacaattggcaagactctgtttagttttgtaagaaactgccaagctgtcttccaaagtgacttccattttgcattcttaccaggaatgaatgagagttcctactgctccataacttcagaagcatttggtattgtcagtgttttggattttagtcattctcttcattggtgtcttgttttaatttgcagttccctaataataactcatgttgagcattttttcagatctttcgctcattttaaaattaggtttgatttcatactgcttgcccaccccagctttatttaggtatgattgtcaaataaaaattgtatgacaaataaaaattatatacagtgtgattatttggtaatgtgtatacattgtgaaataattaccataatcaaggtaatgtattcatcacctcacatagttaaccccctctttttatagtgagaacgcttaagatctactctcttagcacatttcaagaatacagtatattattaactatagtcatcatgctatacattagaactccagaatttatttgtcttataactgaaagtttatatcatttgacattactcccaacgccaatccccattctccagcacctagtcctctactttttgtttcaatgaatttgactttatttttcattttttgttttttttttttttggggagacagagtcttgctctgttgcccagggaggagtgcagtggcaccatcttggctcactgcaacctctgcctccaggcctcaagcaattctcatggctcagcctcccgagtaactgggagtacaggcacatgccaccacgccgggctaatttttgtatttttagtagagatggggtttcgccgtgttggccaggctggtcttgaactcccaacctcaagtgaaccccccacctcagcctctcaaagcgctggcattacagacgtgagccactgtgcccagccagagtttgattctactaaagaatcaaattctactagccagaattgattctactaaagaatcaattctactagccagagtgtttagattctactaaaacactccatattagtgggtatctaatgttgtgctgctaaaacagaatacttgggactggataatttataaactgtagaagtttatgtggctcacagttttggaggttgggaagttcaagatcaagaggccgcatctggtggaggctttcttgctgtgtcaaaatggggtgtagggcatcatgtggcagaagttggatggcaggagcatacaagagcaagagagggatgaactcacttttataaccctctctcaaaaatgaatccactagcatggtaaaagcatgaatacattcatgaggacaaagccctcatgaccacttcttaaaggtatcctctcaactcttgtattggagattaaattttcttgtatgtttaagttctttgtagactctggatattagccctttgtcaggtggacagattgcaaaaattttctcccattctgtaggttgcctgttcactctgatgatagtttcttttgctgtgcagaagctctttagtttaattagattccgtttgtcaattttggcttttgttgccattgcttttggtgttttagacatgaagtctgccctgcctatgtcctgaatggtattgtctaggttttcttataggatttttatggttttaggtcttacgtttaagtctttaatccatcttgagttgatttttgtacaaggtgtaaggaaggggtccagtttcagttttctgcatatggctagccagctttcccaacatcatttattaaatagggaatcttttccccattgtttgtgtcaggtttgtcaaagatcagatggttgtagatgtgtggtgttatttctgagtcctctgttctgttccaatggtctatatatatctgttttcataccagtaccatactgttttggttactgtagccttgtagtatagtttgaagtcaggtagtgtgatgcctccagctttgttccttttgcttaggattgtcttggctatgcgagctcttctttgagaagactttttccaattctgtgaaaaaagtcaatggtagcttgatggcgatagcattgaatctgtaaattactttgggcagtatggcaattttcatgatattgattcttcgtatccatgagcatggaatgtttttccatttgtttgtgtcctctcttatttccttgagcagcggtttgtagttctccttgaagaggtccttcacatcccttgtaagttgtattcctagttattttattatcttagtagcaattgtgaatgggagttcactcatgatttggctctctgtttgtctgttattggtgtataggaatgcttgtgatttttgcacattgattttgtatcctgagactttgctgaagttgcttatcagcttaaggagattttgggctgagatgatagggttttctaaatatacaatcatgtcatctgcaaacagagacaatttgacttcctctcttcctatttgaataccctttatttctttctcttgcctgattgccttggccagaacatccaatattatgttgaatagaagtggtgagaagagggcatccctgtcttatgccagttttcaaagggaatgcttccagtttttggccattcagtatgatattggctgtgggtttgtcataaatagctctcattattttgagatacgttccatcagtacctagtttattgagagtttttagcatgaaggggtgttgaattttgacaaaggccttttctgcatctattgagttaatcttgtggtttttatcattagttctgtttatgtgatggattacgtttattgatttgcgtgtgttgaaccagccttgcgttgcagggatgaagccaacttgattgtggtggataagctttttcatgtgctgctggatttggtttgccagtattttattgaggatttttgcattgatgttcatcagaaatattggcctgaaattttctttttttgttgtgtctttgccaggttttgatatcaggatgatgctggcctcataaaatgaattagggaagattccttctttttctattgtttggaatagtttcagaaggaatggtaccagctcctctttgtacctctggtagaattcagctgtgaatccgtctggtcctggactttttttggttggtaggctattaattgctgcctcaatttcagaacttgttattggtctattcagggattcaacttcttccaggtttggccttgggagggtgtatgtgtccaggaatttatccatttcttctagattttctagtttattcgcctagaggtgtttatagtgttctctgatggtagtctgtatttctgtggaatggggggtgatatccctttatcattttttattgcatctatttgattcttcttgcttttcttctttattagtctggctagaggtctatctattttgttgatcttttcaaaaaaccagctcctggtttcattggttcattgatttttttgaagggtttttcgtgtctctatctccttcagttctgctctgatcttagttatttctcgtcttctgctagcttttgaatttgtctgctgttgcttctccagttcttttaattttgatgttagggtgtcagttttagatctttcctcctttcacttgtgggcatttagtgctataaagttccctctacacactcctttacatgtgtcccggagattctggtacgttgtgtcttcgttctcattggtttcaaagaacatctttatttctgccttcatttcattatttacccagtagtcattcaggagcaggttgttcggtttcttaatcctgagttctaatttgattgcactgtggtttgcgagtctgtttattatgattttcattcttttgcatttgctgaggaatgttttacttccaattatgtggccaattttagaataagtgcgatgcagtgctgagaagaatgtatattctgttgatttggggtggagagttctgtagatgtctattaggtcctcttggtccagaactgagttcaagtcctgaatatccttgttaattttctgtcttgttgatctgtctaatattgacagtggggtgttcaaatctcccactattattgtgtgggagtctaagtctctttgtaggtctctaagaacttgctttatggatctgggtgctcctgtattgggtgcatatatatttaggataattagctcttgttgcattgatccctttaccattatgtaatgcccttctttgttttgatctttgttggtttaaagtctgtgttatcagagattaggattgcaactcctgcttctttttgctttccatttgcttggtaaatattcctccatccctttattttgagcctatgtgtgtctttgcacgtgagatgggtctcctaaatacagcacactgatgggtcttgactctatccaatttgccagtctgggtcttttaactggggcatttagtctgtttacacttaaggttaatattgttatgtggaatttgaccctatccttatgatgctaggtggtcattttgcctgttagttgatgcagtttcttcatagtgtcaatggtctttacaatttgcaatgtttttgaagtggctgactagtttttcctttctacgtttagtgcttccttcaggagctcttgtaaggcagacttggtggtgacaaaatctctcagcatttgcctgtctgtaaaggactttatttctcctttgcttatgaagcttagtttggctggatatgaaattctgggttgaaaattgttttcttaaagaatatttaatattggcccccagtctcttctggcttgtagggtttctgctgagagatccactgttattctgatgggcttccctttgtgggtaacctgacctttctctctgtctgcctttaacattttttccttcattttagccttggtgaatctgatgattatgtgtcttggggttgctcttctcgaggagcatctttgtggtgttttctatgtttcctgaatttgaatgttgacctgtcttgctaggttggggaagttctcccggataacattctgaatagtgttttcgaacttggttccattttccccgtcactttcgggtacaccagtcgaacgcagatttggtcttttcatctagtcccatatttcttgaagctttgttctttcctttttattcttttttctctaatcttgtcttctcacttcatttcattaagttggtcttcagtctctgatatcctttcttccgcttgattgattcggctattgatacttgtgtgtgctccacgaagttctcatgctgtgtttttcagctccgtcaggtcatttatattcttctccaaactggttattctagttagcaattcatctaaccttttttcaaggttcttagcttccttacattgggttagaacatgctcgtttagcttggaggagtttgttattacccaccttccaaagcctgcttctgtcaatttgtcaaactcattctccgtccagttttgttcccttgctggtgaggagttgtgatcctttggaggtgaagaggccttctggtttttggaattttcagcatttttgtgctggtttctccccatctttgtggattaatctacctttggtctttgatgttggtgacctttggatggagtctttgagtggacatgctattcctttctgtttgttagttttctttctgacagtcaggcccctctgctgcaggtctgctggaatttgttggaggtccactccagaccctgtttgcctggatttcatcagtggaggctgcagaacagcaaagattgctgcctgttctttcctctggaagcttcgtcccagaggggcacctgccagatgccagccagagctctcctgtgtgaagtgtctctcagcccatactgggaggtgtctcccagtcaggatacacgggggtcagggacccacttgaggaggcagtctgacccttaccagagctcatacactgtgctaggaggtccgctgctctctctagagccatcaagcagtgacgtttaagtctgctgaagctgcacccgcagccatcccttcccccaggtgctctgtcccacggggatgggggttttatctataagaccctgactggggctgctgccttttttttcagagatgccctgcccagagaggagaaatctggtagtctggccacagcggccttgctgagctgcagtgcactccgcaagctcctgaacatcttgttcaatagaatactcaacatccatataaaacatgagtgcaaatttacatggattatgaaaagacatccaagttgtattgttatatggggaaaagcagtttacataacagcatgaatattaagattctgtgtgtgcatgtgacacatagaaaaacatctggaaggatgtgaatcacaatgttaggtagagaaaaaaattaatagattaatagtgcttatctctacagcatgagaatttcagtgattttttttttactctgatggatatttttaatataattctttgttgtttgaaagttttacattgaacatttgttactttaaaattaaggggaaacgtttctgttttgagaagaacctgattgaattgtgttgttttgaaaaagaagttcacttttagaattttaggcaacagaagaggatgttctcagtcaggggccacccttcttggcacctttataaagcggacaaacaccttcatactgtcatgtataagccaagatactttcttcctgcagcagcatggccttgtaaatgacgggaatgggctttcttactctttcttccatttcatttgtatatgtcactgtgatatcattgctataattttttcttctctggttttatttttcaggaagatttcgatgtcgatcattttgtgtctgactgtaggaagcgggtccagctggaagaactgagagatgacctggagctctactataaacttcttaaaacagccatggtcgaactcatcaacaaggattatgcagattttgtcaatctttcaacaaacttggtaaactttaaatccacggtcccatttacatacatacaatttctttctcactcatacttattcttagaagtgttgtgtgtttttagaaaccttttagttgatgtcctcacagaaatttgaagagatccctaatgtcatcaataaaataaccaaactttcttgatatacaattttgcttttttacttaagactattctaaattaaatatttttttaatttgatattattagtgaaaaacaaaggctagcagtagcagactggttgttttcattagcagctgattaccatgaaatctctctggtttagaccaatttgcaagagcaaatatcaactgttcttaaggaagtgtttaatttactttcagatacatacgctagccacagctagattgagagaacattggccagtattgatctttaggaggcttggttttataaaatgtgagaatagtttgtcacgagcatatcagctgttcataaaagtaggttagaagtgcttatattttaatactcccaaagtttgccttttggtcatcctgttcctattttattttacttttaaaactctctccaaagaagtacagaaagtagccatctccatggaaattttaagaagcattaaaattaatgagccatatttgcatttgggaaatgtacatctaagataaatgttgtagtaggattagaaacctagaaaattatatttccattctatttcattttgatttttctcaagggttataatggttaggatagatatactccttgagactttcacatcaactggttgaatattgtaaattacagacagatagctctttatctccagttaaaatttctcaaattcattaaaatattttattcagaggcaaattgtgcctaaggaggcttttatttattatgacttctcttatttttatagttttcatgtacatcaaaggttttttcacattctatcagcaatatttattataaaataacatttgttatttagttacttaacaatatatggttgttcattttgttgtacagaaagaataacctaagtctagcactacattgatcattaaatggatacttagctgttactcttgattgtgaggtgtgtgtgccaacatgatttctgcctttaggttggcatggacaaagccctcaaccagctttctgtgcctttgggacaattacgagaagaggttctggtaagtttcccgaataacatcaaacagtttaccctaaagcatgatatgcttgtttgcccttccaaaaaaaaattcctttaatctgttaggttgttgatttttgttttttgaatgtttagtaattataatactcatcctcagaaaagttgtaaatccttctctattttttgcgtgtgatactataaccaaaaaaatgttatgtttgatttgaatatgacagattcttagagtagacagctttaaaatgttgggggaggagaagaaggctatttgaaaactcaacttgttactgtcagctcactcatatgtaggtagtcactaatttaagaatagcttctattttaaaaatttgtagttttacaaatattttcccaaataatattttatatattgttaggtttctagactagtccacagaagctctgtaaaccctaatgtaaccaaaggataatatacaattaatgtaataactaattgtatttattttaatgtttctgtaagataatgtctgctgtgagttgggactccccatgtctaagccattggagacagggactccatccggatgaacagtagagaagggagttttggcatcattttcaacagaaaagtgtgctaccctgtcctgtccctgctggtccaccccacagtctgtgtcaggcaccccgacttccatgctgtcttaggattgatgaactgtcataaacttcgttgattgcaccattattacctgtgtatgtcaccattagatcatgcgcagcttgagtagccttatgcacttagcccctaagacagtccctggcacatagtatgctcacagtaggtgacataagtaaacattcagtgcatgtgtagtgctgaaaaaaaaaatgcaaaataatagaaatgtcagtgtttagaagtccataagaatggcaggcaagaaataattcttaaaagagaggtctcaagttgtgccttgaactagcaaatattttcaaatgtttatgtcttgtttgattttttaaaaaagcttttaaagtacttcttcttggcatggaaggaaaatagtttttgtgatccactgttggattccacactctgggtggcttttacatggctcttgggtggctctcctgccttcttttcagtgtacctcttcctacccccacccttggagatagggtgttttccgagcctcagccctcagtcctcagccctctcctctccctcctctcctctcctcttctctcctctccaaattctctcccatggaggtggattcactctcccgaattctgctctgtcattgttaactgctgtctcacctgcaggctctagtcttttccttgccacctgccagcaccatatgctctccctccttccacagctgtctctatagccacctttttcctgattggtttagccgtagacctgttcttcctttttggcttccaactcatgaagctactctgtgagattctgcagtcgttgagaaatgagactatttctatcttgttcaccattgcatcctcattggcttgcacaatagctggcatttaataggtattttgtaacatttgtgggatgaatgaattcatttttctatagaatttttgtgatttctccagtttattctagtttttccattactttcattttggccctaatttctgattaattcattagcttctggacatgtttctccacttatgacctctccttttccttgcatcctgttcttgacttcttgattctgaattttcccaaaacaactttttcatgatatattagtacttaaaatgtgtagaatctggtctaaagtcttatctggtcatagccctcttgaattaacccttcctgttttatttctacttttgtccaaattgatgcctgcagtacccccggatgtattcctcactggtcctgaaatatgtcattactgttctatcttcctgccttgtcttctgataatcttttctctacgcttgtcagcatccacaaatttttagaatctacctcaagtctcatctcccccaccagacacccttatactttgactcaggttatcctttctttaccctgaccacctgtgatgctcattgtatatatattaattttcttttggcagccaatcttgcatgaccttggctttatatgtcattttcccctaaatcttgagacacaaacagcaattgtgtctaatattttgtaatttgtcaatatctgtgtaatactggcctgtaggtgttaagtcctgtggaattgaattaaatgtgtaaatttcataatgttacaaaacaatctctgcagtactttttttttttgtcttttaaagagccttagatcgtctgtcagtgaaggaattcgggcagttgatgaacgaatgtctaaacaagaggacattaggaaaaaaaaggtatactcaaatattacaatattaaatcgttgattcactgtagcaccttgtagtaacaagcactttcaggcatatggtctgatttactcttcttgatacctttgcagagaggagtgtgatgtgtctcttttatattaaagtgtttatattaaataaataaataaatgtatttattagatgtatttatgtatttatttttcttttgataactttagtacccaagcacacttattaaaatctcaagggagagaagcctgttttagagatcttctgtttaattctcctttagatcccttctcagcttttgtccaaagattcaagaatgtagtgcactgctagaaaagattgtccacttcatgagaaggggatttttgcctgttttatccacttatatccccaatgtgtagaagaatgtcttggttcatggtagatgctttgtaactatttatttaatgaatgacttaatttttgttattttaacaatgagtttttataatgttccttgataatatctgccttgtgtaataaatgtctttaatgaattggcacttaacgtttattggtatatcatgcacatgtaaatgaagaggacaaatatgatcagaaactaagaacataaaaaaaggaccttacgaacataaatgtagtaccaaaataaaggtttatataagataggggaaagaggccaggtgtggtggctcacacctgtaatctcagtagtttaagaggctgaggcaggcagatcgcttgagctcaggactttgagaacagcctgggcaacatagcaaaaccctgtctttacaaataatacaaaaaaattctccagatgtggtggtgtgtgcctatagtcccagctacttgggaggctgaggtgggaggatcacttgagcctgggaagttgaggctgcagtgagccaagatcacagcactgcactccagcctgggtgatagagtgagaccctgtcctaaaaaagatggggaaaagaaagaaggaataaggatataatataagaaaccaaaaaaaaaaagtttttttaaaaattctgaaattgtgatagaatattgaaatatgtttgttctagaaagccaaaagatttgcattcttgggaattttgtgttatgtagaaatactaaaaatatagaatgctataggtaattttacgttgacttttgactttgtattttcctgtacttaggatgatgaaataagaaaattaagattaaacatgacaataacttttttccttaatttttatttatagatgtgtgtattgaggcttatacaagttattcggtcagttgagaaaattgaaaaaatcttaaactctcaaagttctaaagaaacctctgcactagaagcaagcaggtaagtattttttattaaataactcgtaaattaatacttcacatccagagtaaaaacttttttagttagaactcatttctgataaagaagaaaatcccagtctatggcttagtgtttttaaatgtagctcaagcaaagcagagtgcatgaaatggtaaagcttatacatattattatatagccttgatggtcgtaggccactgttccaacacagcacctttcagggagtcagagaacgtgtactttctgtggaaggtttttatttttgaaattgccttacccatggactagtgaaatccctactgaccttcaaggtgtggaatagcagtcatcttatttagacaggcccagagtattccagttgatgtatcttgaggttcaaaatgcacgagtgttattaagaaatagtacaggacatatttcactgaaatttataaacagcaaagaaaaagcttgcaaaataagcaaaagatgactgtttcctttgttatactgtagtgtcttattaccttcccacactgaatttaaaatcagtcaggtagttgagtgactcagaaaatgaattgaatggatcattatgaacattaatgggaaactccatggtgcagtggaaagagcatgggcttatgttgcatgtaccagctgggtagcctgagtcaggttacttcactctgtgtcttggtgttgtcatctctcatataaggctaataggaactccacttgcaggattggtagccatagactagaccctcatacatgtctagtttgagcctaacacaagcatctctgaaagtcacattgatagccatcatacttttccttgactaatatgggataagctacaggaaaaccaaccaggaccaaatggaatatacctgcagttcaaagtcctgatcgtattatcaagacaagttggatttcttaattttaggaatcagaattttagatttggagagactgtagagacagtatgctgtgtttctctcattttatagatgaggagatgaggcatccgaaaaggaaattattctcatgtcctaggtctctactttctttcctgatcgagatgtataaataagtggtcaatcgctgccatcttttttcttcagcctgtagtacttctgcttctgtccgttctgttccccttcatctgcgctcatcagagtccccatcagtgtcagttctgagagcccagcagagccctgttccactaactgctctgcttctgtcttccactcaacagcattgacagcccctcccaactatgtcctcacttggcatctgtgatacctgcctcctcattttcttttcctccttccccattcctactctgttcctttgatggactccactgccctttttcatgccagctttctccagggcactgttcttgggactgtgctcttgatcagcactttctgggtaacctcatccaaccccatggttttaatggcctcctggatgctgatctctttatctgcagacgaacttctgtagtcctcagactcatcagtctgctgactgcggggagtttagtggacgttctccaggcacttcacattcatcatgttgaaaactgagctctcatcttctttccctgcctctctccaccagcaaaaacattttactcctcccttttattccttgtcttaggaaacggtgcctttatttccttcactaacgaggctagacatcttgggggagtcattttctccttttttaaacttcatctccttctggcgttcactaggcaagccctggagactctgctgctctagtgtctctgagattgagagatgtctgcctccccctctcagttctcccattgcctcgtttcaggcagtggcctcctgactgacctctcattttctctaggacaactaaccctagctgccaaatggatcttttagatttgtctaatcacatcttactatgtgattgggaaacaatggtttcctagtgtttttaaggtaaatcttaaactcccaagctgctccttgccacttctgtattcttcactaaagctattcagaactacttttggttccctgactgccctgaacattgctgacttacgcttccttaattttactatgtatggccatttgttgtactaaaagcccttcctttaacttccacctccctttcacctgcccgatttctctttattccatccaaatctagctcaaaacatgcttaaagtatagaaagtttaaaaatactgtgctaagtggaaaaaaagcaggttataaaacgatatggatttgttttgtaaaatttattcttctcttttgtgtgggatactgttgatcccttctgctttctttaaaactgtctcactcagttctgtgagagaaagtacaaacaagacactacaagagttcccttccataaagctcaattacaagaccacctcttttagcaagtcttccctgacctttcagatttagatgctccatctccatgcattcatcgggcctccgggtcatcccctagacaacttaacggtgagactggaactgttgattggcttgcatgccttctcagtctataaggcccctgacatctttacaccacagtgtctggaactagtaggtacctaagaaaagataaccaaacgtctcccactagtggggaacgggcttctgatgacctcagtgatgtctgtttctagacatactcttatattattgtattatattatattcagtatgttatattcagtataatagacactgcagtcttccttgctccgaatcatctttgaggagcttttctgatgacctcagtgatgtctgtttctagagatactcttatattattgtattatattatattcagtatgttatattcagtataatagacactgcactcttccttgctccgaatcgtctttgaggagcttttcttaaattcagatctgcaaatttgagctgtagtgaaggtaaaaccagggcaatattactgaatagtagatataccatgcttgttaagccaagaaacatttagataatttataaataattaattcacacgagattattcaggaaacagttagggatattcaagacagagtttccctttttggttggtcacactgggcagttcctgttcctctaaactagtttggatgctacaaatacagaactgggtggaccactgatggtctcagtgcagcattttatatgtcctcatgatagggacatttttcctccctaactggtgatgagccatcagtgtacacaggatgcctcagtatacacagcaagtgattatgcctttatacttctcctctgctattttacttccttttgagtgatattgacattttataatatgtttggggggaaaaagtgcatttattatattttgtgccaggtacgtaaagaatgccctctcactaggacccacagcatgtaggttgactgctcttgctgtttggtaaatgtaattttaaagtaagttattactatttaaatttaaaataagatattttgagatatttattgctgctggagagtcagtttcattcattgaggagacaaatatatttggtattttagaaatatctagaggtattttagcaaggagagtgaggcaggcagagaagtagaaaggatccagctataagaaatgagatggaaagaaaaagaaaagataaggagggagaaggggaaaggggagagggggaagagggaaatagaagggaggttaaagctgaaaaagaaggtcatgaatgggagagcttggagtcggtggcagaaacacataattgcatgtccacaggcctagccagccctgctgctgtctggtccctgtgggtcaaggccaggcagcatcagcagcttgtactcaacagattccccggtgcacttagaacatgctgtgcatatggcgtctggggaacattgactgatggcacaaaagacgctttagctttcaccttgtaacaaggtggccacataaaacactctgacaaaagtcaaaatacagtgggtatgaaagtctctcactgccaggcgtgtgatgtattctcgtggaaatagagaccttaggggttacacttctataactgttttctctactagcccccttttgactggacaaattttggagagaattgccacagaatttaatcagttacagtttcatgctgttcaaagcaaaggcatgcctcttttggacaaagtaagaccggtaagtgttgttttggatttccacagtttggtgtttagggacttgctaaataattctggtttaaactagtaatattgttgatctacagggttttgaagctaaccttgcattttttttcaatttttaattttttgggcgccagcttcctaagtgtcacacattatagattttgtgtaaagactcagtcacattctccagatgataagagtaaaattaattctgaatttcatggaattggacatcttatatgatgtagacaattaatttatccaaagcccttaattggattttaaatccatgatgtttcctcaagattgacttcgtagcttaagaggaaggtaacttttttctcattctgtaattctgtctaaattcttctttgatgaagcagagatttacttataaagtgattggagtgaggggttcattgttattctccaggaaaagttattattttgattttatatatgtcattatctgttggtgtaagaggcttgttatatatctacttgcagtttcagaaactgttacaactagagctttttttttatttacccaccttttcttgcagcgtatagctggcattacagccatgttacagcagtcactggaaggtctcctattagaaggccttcagacgtctgacgtcgatataatacggcactgcttgcggacttacgccacgattgacaagacacgggacgcggaggccttagttggccaagtactagtgaaaccatacatagacgaggtctgtgtacctccttcaacaaacattcatgagcttctgttctgtctttgactctttactgggtgtgaggaagataagaagagagaacagagatctttctggaaagattctcagttcctacagtaccagctataaggaaggattggtctccatgggttatagttgggaagtaatgttacgatgccaggaattgggcgtgccgtctcaggtgtcctaggaatgctgcggctcaggcttcaagggcgagattcaagggcatccacgtgcttttaggtcaattttatgggaggcgatggttcctcagtaattgttaaaagaatgttttcaaatcactggtcttgtgggtggactaaggcaattaagcagtgacaacactgcagtgtacgaggaaggtgcagggagtgctgtgagtgtggaaaggtgtgtgagtggggtagacagtggtaccctcaagtcttcagggaataaatgacatttggcccaagtcttgaaaaatacagaggagtttgctggacgaggaaggtgagaggaggaatattcaaagatcaagggcttttatagcaaattagccaagtaataccttaaatctagaacttggctatgcagtatccttcacctagtaggatatagttaaaatgtaggaaacaagtatatcccacttctgagcagccagagtatagattgtgccatataaagttgctgatattcaacagtttctgacatacaaaaacagcagctttgtctgcttcaaactgagagaagtcactgagcccgtcctcggtgtttggggactttcctccagtgtcctgtcagtatgaatgttctgactgttagtaaatacaaagattatactcacatgatttcagggtgaaagtcttttattttttaaagtggaaagttgagactcccaatgataaaaatgaaatgtagggactcattttaataattattttggccttgttaagattactaaaaataaatgatatttcagttctctctgtttatatcatgttatattccatagctgtctctatgggggtgaaaaaattacatacattatttctttgtcaataagtgaaaaaatttttttgtgctttgggggacagggtctcactctgtcacgcaggctggggtgcagaggcatgatcatggctcactgtagcctcaacctcctgggctcaagcagtcctcctacctcagcctcccaattagctggaactacaggtacacaccaccatgcctggctaatgttttttttgtagagatgaggttttgccatgttgtccaaactaatcttgaactcctgagcgcaagtgatctgcctgccttggtctcccaaagtgctgggattacaggcgtgatccactgcgcccaaccgatgaaaatattttagtcactaatctattcctttttcacggaactgaatctagtgtgctaaattaaagaactatttgaactttcagtggcatattaaattcagtagccacattgtgttttatttaaactcagcttatcttgtcatatcattcttgtctcccaattttatcacaaaaaataaaataatgaactaatatattttcttctgtctttctctgcctcaaacccttccctaatctgaatgatggtagaaaaaaaggccaggatgaagacagtgaggagttgtggtggcgaatcatgtgctctgctttaaatctttttttaaaagttgttattttattttcagactcccagggaagcagatgagagtgcatggtttgtcagcccatgtctcccccacagttgtatctgtacagcctaatccaaggaagtagttttgaatgtgacctgttatttacttcactgtttagaaaatgtgtcacagggaggagggtgagtgtgaggaagcagatttgtaaagttttctttattgttttctctgaaatagatcgtttgtacttcccttttaaatgcttttttaaaaaatgatttttcttttaataggtgattatagagcagtttgttgaatctcatcccaatggccttcaggtcatgtataataaactcctggagtttgttcctcaccattgccgccttcttcgagaagtcacaggaggtgccatctccaggtaatttaaacaaccctgtgtggacccccacctccctttcagtgaccgcacctgctaattgcaggtgcacgatggacgatgactgtcttgtatgaactgtcttgtatgaatccattatgaatcttgttatttcattgtttctactggtgatactgtgaggcagattccattagcctcatttcaaagttgtggaaactgagatgaagctgagactgaagaccacatttccgaatccaaagcctagcctttcttcttctctgcactttttcctaaatttagtttgaagtcagaattgctttccttccatgattctaatatgtcataatctgtctataaatattaattcagtttatttcaacaggttttatactaattgtgaactcatcttcaatttttcctccttttgttcagtttccatgacttcctgattctctttcataaatatcccattacttttcaccattgccattgtcccagtccaggccttgtcatctgctgtccacaataatagaatcttcccaccctgtctccctgcttccagtctctccctctctagtctaggcttctgactgtcacatttacccagaaatctgagattcatagatttcttcatgaatctttagtggcttctcagtgcgcatggaggaagatccaggcttctcgaagcagggcatgaggccctttttgttcttgcctggtagctctccactgtagaaactttccctccatagccctggatgctccagccacacagtgctagctgcctttccccagctcccttgtactcacgtgcttctgcgtttttcctctgcctgccctccccttcctgtgccctttgttttcctgtcaaactgcctctccacatgaagctccagctcagataccacctccttcaagagaccatccttgaccgggcgtagtggctcacacctgtgatcccagcactttgggaggccaaggcaggtgaatcgcttgaggccaggagttcaagaccagcctgggcaacatgacaaaaccccatcttaaaaaaaaaaaaaggccattttttctcctaatgttcagcattcatcatgtcctctggattgcaggatgtgttgctcttgggtctgctgagtactgatttccatgttgcattatgatcacctctccgctgctcacaccttcccctgcctcttgacacagtgtcttagagctagcagctgcccagttagtgcttgcaaaatgaaagaattaactatgtttaatgatcgaaaggcaaataaggtctctgttttcatggagcaagcaatgtatttggccttgagtttttgttctttgcagaaatatggggtaattaatatgctgcttggcctttgcagtaccctctctgtttcctctgtaccacctaagatgaagtctagttttgctacttttgtttagtaatcataaggatttagttggatttggggataagaacatagtagaaatcatgatgtaaaatgaagccatagatatgaaacaatcagccattagatttgacagggccagtctgggtccagagatgtcaagcttcaaagctttagtggatcttttccacagtttttagtgtgggggaattcatgtagaaggcttagagatttgaggaatctgaactgtaccttgcgagatcatcatctgccgctagcctgtcactgtgttgcaggttctgcatatccctttccttcccttgctcggctcctggcttcagatttccagcttggtgctccccttgtcactcctttcttttatcatgtgccacccttcatgagctttataactggcaacaccaacaacattcgtgatttctcctccagagaatacagatgagcttttctaatccatcaactgttaatcttgcaggttttacattctctctttggggatttgattagacattaactttgggaatgaggaaatgttgtcatttaatagtgattacattatgtatatctgtagtttggagtcctcaattttgtgctttctttctctagataccttaacagagcctgctcttcctattatttggaagtgtataatatgatgtgtggaattggatatatgggaggcagtcatcttctttccccttcctggccctcctccacccccaccagtaatttcctaacaatacttaggtgaaactataataacattatttgctagctcttcctggacagtgaagcaaagcttccttgataacttatctgtcttgataatttttgttaagcaggaaaattatgaaaactttaaaaaaatttattttaatacttaccagaatgttaagtcccgttttgacatggcaacttagctacaaaactcccagttttgctaaaatagaacatttattaaattgtttgccattttaaaaaattaccttgaaatagagcagaatacccaatatgaaacaaagtgggcagattagtgaaatggtgtttgcctagaatggatgtttatggatctttgagtttgtgagcgacttaaggaatctccgttatttaaccgttactaacatagggcttttactatatgttaggcactatcctaagtactttacaaatattaattcttataatgactttgtgaagttggtactatgatcatcaccattttaaagatgaagaaaccaagcacagagaagttaaatgatttgcccgccctccaatatctgaatcaggcacaccagctccaaagcgcatgctttctgtcagtgctgcctgtcatctacatttgggaatttggaatttaaaagtctggtgctaaaaaaagacaaaacaagacaggcacacacacaaaataaaacattaatctgttaacaggtttttgtgtcaagatttgtgataagatttcacatttgatagtcatagaattttagaactgaaagtaatcttagagatagcttagtaaatacaaagctgttagtaatttataaattagcataacttacaatgctgtgtggtttagtggtgttcagtaatgtgaaggttatttttcctgtggtattagactactgtactttttgtttccaagataggagtataaaggggttgggaagtattttagagggaaaagtgtaccaaggtgattttatgtggcttcccttagccttgacaccagctggaggagtcaggatctaggagatttgccaggtttgaggtgagactgaaattaaggagtgaaatagaaacttgagtctggaaacaaactaaattacaaatacggtttttttaaaaagttgaaataagttttagactgcggatcttttggcagaagcaacacagtggaaatttgctctttgtaagtagattatggtatattttactgatatgtgcccttattttacagtgaaaaaggcaatactgttcctggatatgactttttggtgaattctgtttggccacaaatagtacaaggattagaagaaaagttaccctcgctttttaatcctgggaatcccgatgcatttcatgaggtatctccccgcccgtcgtcttgattcttgaagatgttaaccggagactggagaaatatcatgttctcttctacttagtcttggttctgtggtttattaaaaataaaaatttgagttgctaagtgaacatttaaccttaaaacacacacatcgttttatccaagatatgatgtatgatacttttaggaataagaacattttcattttataatataaagtataattaaggctagatacaagtgtgagtagaaatgtacattattttctaactttcttaaaaacatcctgaggaccattaaaagccagtgtttttgcagttttctgtgaaaaattaagtttgtacatctctgccatataattttgaatgaaaacagaaagtattcactgaatgttttccagcagcaagtacaaaggaattggttggattttaaaatatactacataaatgtcctttatgatttaaaaagttagaaagccccaatatttatttgtttttttaatttatattttattttattattactattactatttttgaaacagggtcttactgtgttgcccagggtggagtgcagtggcacaattatagctcactgcagtcttcgactcctggactcaagcgatcctatgcctcaggctgcttcctgagtagctgggatttcaggcgcacaccaccatgcctggtcaatttttcttttctttttctttttctgtggagatgggtctcactatgttgcctaggctagtgttgaactcctagcctcatgcactccttccccctcaaccttccaaagtgctaggatttcagcccccatgtccagccctattccacccctgcttcccccgccctcttaaaaaagaaatcattatttaaaagatttcatggttaggatttcaaaaatcaatgtgtaagtttgctttccattctatcattttaaaggctcagcctcttggcacttttcttccttcttcttccctggatttcagtttttggtttcttatgcagtgagataatctttgtcttttaattaggtactttattaaatttacagtgattctaactgtcaatgcatttgactcttattttatactttctctttgttccagttttcttcccttatttccttcctcccatcttttcttcctcccttcttttttcaccttcttcgtattttagacttctggggatctgttttccatctttattccattttgtcccctctactaatttggaagttgtgccctttatttctgtacatattgagtaaccttactggttacttaatggaatctaaagttgatttatgttctcgagccttctcctggacaatacgcggaacttagaacacattaacaccaaccatcccttctcatagtatatatttttgtttcctcgctcgtacttctattacgttttttttaaaatcttaaaaactggtcatttttattgttttaaatcatcatcgtcctctgggaattaccctacatgtttgtcattgcttactgttcatttttgaatgtcagctcatccttcttgaatcattcttctgaaattcatgttagaagactttttagtcttctaactgttgatgataatttatttttttaataatttctcagtttgtgtttgtctgaaaataactgtattgcttctgtttgtaaggtcagtttgctggatgtattaacagaattctcagcactttgagtgttgtcttttgagttgcattattaagttagccgttaatttaattgttatttctttgtagttaatgccttttttctctggctgcttttaagatcttctgtgtgactttggtgtgctaagtaagttctgctatgatatgtccagtagaacttctttttttattattatccttaggatttgataggttttctgaatctgagaattggtatctttcatccattctggaacatttttatatattatttcttcaattgtgcttttctttcattcctctatcatctccatctagatctcttgtttagacaggctcaccctatcctctgtatttgctgcattctcgataatttcacagtctgtcttctaggtcactaattccttctttagttgtgtctaaactcttttccacctgcacattgagtttctggttaattatcatatttttttatttctagaagtcatatttgttgtttgtctagcctccctggcgaatttgtttattaattttttaagtgtagagaggcacaagataagcataaacagacagcctggggcccagcaggtttcccacagataagacaacacattgggaggtttaccattccagaaatgcaacttaccttatctgttggctgattgtcccatgttacagtgcattgaataacaggattgtgccattttcaataaattttatagcaacatttgtaattttaaaaagtagggctttttaaataagatagcataaggagagtgaaataatggctttaagcagaagcaattgtaagctttaagcactagcaaatgtgaagacgctttacaatttgctgtgtgctttagagactcgtattgaccatgtttgactcaggaaatgtttcagctcagaaatgaacctttctgatagaacttgactttagaattttaggctaatacttaacatttgtgagtatagtttccagcagatagtatccatttatttccagaaatactttcagctttaagccttaatgtaatgtgtttcttgtaagagggcaatatctttatatttgttttagcatccattatatgcagaggtatagttttgtcccaaaagggaagaataatccctatttttgtctcaactccacacacctagaccaccctctgggataacataagtttgcccaaaaccatttgaaataaatttaaagcctgtagtttttactactgtaagatcctttctaagcacagactttagcatatttagattaatggtttgatgaccctggattgagccccttttaattgagaagaacataaaaaattcaacagtgttcttagagcctgggggcttcgggaataaagtacccacaaaagcaacatgcagccgcagttttggtcaactgactgactagcattctgcttcctctaccgcctggcttgtcttttgagcaggttctctgtgagcctcaacagaagaagaagcatcatttgtaaaatggggatgatgatgatgatgatgatggtagttgccctgtggggtcgttttgtgggttaaattaaataagacaattctaatcacagtgtgtcgatgataaatgctacgagttagctgccactcttaatggttttggtacatctccctgtcagttttcatgctatcttatttataaaaatgaagtgaatactcacatggtttgattctttctcttctctctctttcttcttcagaattttctccttctttctcctttgtgaggcaatgacgaactatgtcatttaatctgctgtcaattctaattccagtgggctggggtagggggccctagaacatgagcactgccatttaaagagcaccagacttagagtgcctgggtctcagatgggctttgccatggaagacacggaagacatatcacagaaccactttgggcatttatgtatctttaaatggggacattggaagaaagatcttgtaagttccttgttaactctagaaactgtgattcttacgtgttgagcttctttatcttgattacagttttcagtacatgctccctgttctagttagtgttctaataatgaaaattttccttttgttttattttagaaatataccataagtatggattttgtcagaagattggaacggcagtgtggatcacaggctagtgtaaagagattaagagcccatcctgcctatcacagcttcaataagaagtggaacttgcctgtttattttcaaataaggttggtcatctattcaccgcccccgccccgcacccttctaaaacagaattggaatgccagttaaggatgttgcctcagttagcggctccttttctctgatcatcataataagctttgggagacaaaattgaaagtggagaaagagatataagaagtattatggttgccaaagtctggcttgcatgacaaaaagataagttttcttttttggtaattggagagctcagaacacaagagttggaaggagctgactccaagcccagcctcattcccacccaccatgtcctcattcattgtgaaaagagaaagtaggagttatacagcagctctttttttccattttccctatttcatcgtctgcctcaaataatgaacctgtctcacatctgtttttgctcgtctgagatacttttcccctagagggaatggggagaagcagagctttaagtgttctttgcagctggttccatctattagtttatgagaagcctggtcattatttcagcctccctgatcgtctttgtgacatttgtaccctctattcaggaaaatggtgacatttttcttccaggtttcatgatgatatcacctttgtcaataagccattctataaaatacttgggggaaatttaggatgaacccttatcatacactgcattggaaaaacatgataagagtcatttttgcagattctcttgaatgaggtcatggtatgttcttccgtagaatggattttacttgaaatgctctttgaagaatcataggcttttttatttaaattgctggatgctttcattaattatgatgcagtcctttcccctagcgttctgaggaataattacagagagggaaatcaagaattaggtaccctgatgataattgcttgagatgattgagaatgtatgtaatgatctttttataatgaaatcacagttctcagaatgaagtagtaaggtgccctttcacttacaatactgtgttttatgctaaattttccaaggttgcatcatcatgtagttggtctctcagcaggaaattacggatttgttcatctaagatattaatgggatgcactggaaatagttggtatatgataatcaacatcaagccagggcaagaaacctttttgatttgtgagcaggatttaaaatagcaaagcatcattttataaaatgatactgctatgtagaaataatgtttacatttccccatctctttttgtcgtccaggtttggagttagattgctttagttatctaatgctgtcacctcacaaacatactcctctgcttcctgcctccaaactttcctggtccttttcctcagaccctgggacccatgcagcatcacctcactcttccatcccacccctgcacctcctggagctcccatgggctatttcagcccatgctcttggctctgccaggctgggccccttggtgacggcccagcttggcttcagctgcatctcccttccatttcagtttctctcaaagctggtaattggaccttaaactacattgaaactcagccagttccctgaaagtcttttttaccttcaccagatttcagccttaagccttcaaaggagctgattagccttttttaaaaaacctcttttatttaaaattcatgaaattttaaaaaaacacgtttgagttacggaagtgtagaacttgtctttagtacatttgtttttccatctaaaaagtaaattccattaagactttgtagaacttttctattgatttttatcaggtgttgagttgtttgctctgaaggatgacaaaaagttccgcaaacatgattagggtcagagttgcattgtcatcagattcatttcaaggtcatttgaagtaaacctaaagacagtggggtgtgatggttggacatttcctaagaagaaatattactctcagtaatagttttctgctcctggatctgactatatacccacatcccaatcaccttcaggaaaaaggccacctccccaccccagccaccaccacaattcttgtgaacacattttgtatcctctcactcttcctgagaccccactgtgtctacatttcatttgcacctacaggcatattggaaagtagatgaggacttagtatctcataggaagaaattaaatgcagatgtgatcaaaacagccccaaattataatgagtcagtggctgcctggaaactgcaggtgttagctctttaaatgctaaagcctaaatttcagtttgctgttctttttaaaattgaaatctttatagtacattcacatgtatatactgtattacatagtatatgctgaacacagtcttatgatgtggaatctacatagtagtattaaggtgcaagtagccctttcctgttcctgcactcctctcagacatgtgtatccacaagagacgggtgcacttaatgatgtttccaatacttcagagaaaaaaaacaataggcatcactattattatcgccattgttatttttatttaagtattattgtagacctgtgatgttcgtggaggaatatgtctagagaccttccccaggcctatatttaagaatttagaaatgtttgtatttggggttgcccttcttacatggatcctgttgagagtagaatgacattcgatgtgcacatgaaaaccacagcatggcttttcagatttcagcagaggttccctctcacttttggccattttccaagaagaaatatgatctgttgcttcattcctggaagtgactgcacagcagagctgtgtgaggggctggtcccctggctggggagcacacctaggccaagtgactcaggcagttgtaatcatgtatcactgtccctgctcacagacaggcagaacgtctctgtgaagtgcagggatcaaggctctgctgcatttctttggtcctttttcatttctatgcttttcagaattatcataaatatacataaaactttgtgtcccatgtctttggatagtactaaattatacctatttttccttattggaaaatagcatcaagcttccacattaatactgcatactagtccattgaatatatctcaggttccataagcatattccttcttttggccatttaggttgcttccagtttttccctgatataaacagtgctgtgccagctatcaggccttttctgtatcagggctaacttcctatattttgtttagattttgaaaaaaggcaggacttgggggtctgagattgagctctaggtgctggtttgctctcccaggtgcagagcaatcccatctcccttgttcccgtgctcagtgtcactgcctcctcttactgctgttcctgggctagtttccagtgctctcttatcccacttttccatctgtcacttgttccttctgtacctctcaactgcagcttgaaaagactagccttttgtaagcttcactgggcaattagagttcctttccttccatggggcagacgggacagctactggaaaccagccagctacaatggtacaggatagccttagtgtcttcagtgctcagctgtgttgggtagggctgctgctttttgtctcaagctgttctttttactcttcagacagttgcctttagctcagtctgtgaaccgctttgtaaaagcacattatgtactataaaaaataatttaatatcagttggataaattgatattgagcatgcatcagaattcattactagtaaggcaattagcaggtgacaaaagagcatgctagtaaagagatatatgaaattgcaagagttatatagttagaaaacaatgcctgcaaaagcagctagcttaaaaaaactatataacacatttgcctttcacaaagtcataaaaacatgtccatatccattattagaacagaagtctgtgacaggatgagctgaggtgccaggtgagccagctgtcatcagggaaaaaagaacgcacatctaggaagcgctggtacagacagccgtagaacccgaagggcaagtaccatggacgtgggagagggtcacagattagaagagcaccaagcagtgagttctagttttaactggccacttcctgtgatttttctcaagctgccaacacaggtacagaatgcagctttcttagcttggggacgtttaccttcctgtgatggtgttaagatagatgggttggaggaaccaaagttttatggccttgaagtgaatagaggatcataatcaggtgctgctcaccagcaacaacttcttgatggagacttaactggcagtttgtttaatttgagaaacatggggtaagttatgattcagaccagctgcaaataacagagaacccttatataacagtggcttagtcacgatttcttgttcagttaaaaaaaaaaaaaaaaaaaagcctgggagaataggcattccgaggctggacttaccagtgagtgacagaggaagttcctgttacttaggaaaaacagagaatggatagggaaaggcatctgtcagagtcataaacattaattcttcttcttgtttttatctcagatttagagaaatagcgggatccttagaagcagcacttacagatgtcctggaagatgccccaggtaactcccttaaagtgataagtggcatggtatcctaaatgagttcattcagttcaccaagtcatctggattgcagtattctgagcgtacttttactgttttttttttttaatcatacagtaagttggaccttaaaaatcacttagtttgacttcttttttttgctttttttttgagatggagtctcgctgtgttgcccaggctggagtgcaatggcatgatcttggctcactgcagcccccgcctcccaggttcaagctattctcctggcttagcctcgaaagtagctgggattacaggtgtacaccaccacgcctagttaatttttttatttttagcagagacagggtttcaccatgttggccaggctggtctcgaactctgacctcaagtgattcacccccccttggccttccagagtgctgggattacaggcatgagccaccacacccagcctgacttctttttttaataaggtaaaaataaaccaaatagttttggtgtatagagttcttgctttatagagatgaaaaatgaataagaatataggaaacagacctcattttcattcctgaatataacttgtccaggggatatggccccttggtgtgcttatgtgaacagctggttttttttagcaaattggctgtgatctgccttcctcccaggctgaggactggtctgcatggtagagggtcaggtgctcctgcgtctcactgagaatgactcacagctggagcatgcatcctgggcctcctgtgccctggccgcccatcctaggatgttgggcaggtaacagttgtaggtatgtggacttaccagtacatgttgacataccctttcagcctcattaatttttgtatcatatatttattcctagtgaccactgaaatactgtgtgctgatatctaggttcctcaacttaaatttccactctcttttatacagctaagtctactgtcattttgaatcaattttagcctcagagttagttttcatctgtctttgccaaaaatggtcatatgtagttaacttcttctataaaaataagaagtatgttgagatagaggaagactcttgtgaaataggacaaatttgaaactgaagtttaaacctctgcaagtgattgccactccagcccatgtttgtcgatttggtatgaagtacctattaaacgttatttctgaatgctatatgtatttgatgtttatccaaacacctgggagatagtgtcatgtaaaattgtgcgtggcatgaaggatgtggtagggaacttggattgtggccactcgtcatccctgtgcctccaacagctttgctgaccacatggttttcttcagaaggccattttctttacctttgaatcgtacatcggaagtctcacattagactatagcctaaaattgcctgaaattccttaaatgtgtgttgttgttgttttttctctagctgaaagtccgtattgccttttggcttctcatagaacttggagcagccttaggaggtgttggtcagatgagatgttcttgccattactggtgcatcgcctgtggagactcactctgcagattttggcacgatactctgtgtttgtcaatgaggtaagggctggctgtggagctcatccataatcaatactgataaaaattaaagatatgttaggctaactccctaagatttttgtaaataccatgagaggttaattcagaggaccacagtagtctgacttcccaagattgtctccagctctgtgtctgtgtttcatttttactcctgcgagcattgcatttaggggtgtctattatcacaaacttattttgttgaaaagcaccactctggcaagtccatttttttccttctcaaaaccagaatctttgaactgcctccaaatttaaaaaaagaaaaagatgttcattttaatttcaaggtgattatgaaaatgattagaaataaaaatatatgcattttaatacttaatatttggaagtttacaaaatgatattgtcatcaacataaaaaggtattaaaattctttttttgaatatccttttcccttttcaaataatcaaatatattaaatatccacatgctctgatgacttattaataccctacaaaaacccagaaattcttgatccacaagggcgttggtccagtcctgtgctgagcaccagcccggcgggtccttgctgggacctcggattgcagtgctgccctttctctggggacagcgtgagtaacagacactcaggtaaaccagtcatcgcagtgtgaggagtatgcaaaggagatgtgttctaaaaaataaaaaagacaacagggagaaaacagcacactttgagtaaaatctttgtaatttggagtaggaaaggatcccagtcatcctcttgcagtgtattttaatggaaagagtgtcagctttggagctaatgtcaaacgttggctctttaactttttaattctgtggacctggagaaattaagctgagtcttcatctggagaatgggaaaacagcttctatatgtggctgttgtgaggatttatttggactaaagctcctgtcaggtaatgggagtctagtgaaatctagtttgtgtttcccttttgcctttcctccgctcagaagggtcttagtggaccaccctgggctgtcagctgtttctgaagaccactgtatgattcccctgacagagtggggttaggacgattattcaattaggctaagcatgcgttcttgctagccaggaattctccgtttatctctagtagatcactttgccctgaatgttcattatcccattctatcccattcttttcttgatgctagcttacttctctttgatttttttcccttataaacaatgtgacacaaagaacactttgttttttgtatttgaaggtttggattttgatattttacccttgttaattataattacaaatgtattacgctatgttatttgcctaatataattgatttttttaaaacctgtgatgtccccaaaattaattttattgtggtttgggcactttatttttcacgttatttttatcaccagaaattagacaagttccagaaggtaaatgtacctggggccgtagtttgtccttgtttctctcttagtgcttcactccttcctgtagatacaatattgtatacttttattagtaagtttttactaaatgctatgtagacagctagcatttaatggtgagttattgacgcgcacatatgtaatatataaatgctcatgtatcttgctagtgtgaaagtagttaatcagtgaaatcctttttcagctttcactcaggcccatttctaatgaaagtcccaaggagatcaagaaacctttggtaactggtagcaaagaaccttccatcacccaaggaaacactgaagaccaaggaagtggtccttcggaaacaaagcctgtggtttccatttcccgcactcagctcgtgtatgtggttgcagacctggacaagcttcaggagcaggtaagcctgtgtcccagaataattccaggtgcttggtttaatgttttcacagaaggtagtatgtgtaaaaggcaaacaccactgggccttacggggcttaaattgggggacccgtgggtaccccaagagagaacctctcactcacctccctttctaggtgtctctccagcttcccctgacaggtcatgtccatatagggtttctaagggtgtgcacttctcctcctgtgtggagtgcattctgtattgtattcacctccaccctgcttccttttcagtagtgatgggacaagcttgagcagccatgctcccccactttttttttcccattagctcaccttattctggtcaggcatgatctttagtgggctggattttagttactttacattaatttaccccgatattttctgttgatgtttaatcttcagctatactttgaaagtgctaaaatattaaaacttcttcctcttttttctctgtatagatccgtatgtttttgcttgtaacatcaactctgtggggtgaatttagtggttaagtcctctgatacacaattctgctttcctcaagtttagatattttgtggtgcttgaataaatactgttttgaattttaaaatttgtatgttttcagtaagaatatggtctttactgtgagctattttcgtattatggagcgccatagagtagaaaatgtttttgcttattctctgtgcctgttaatagccattaaaccatgtgatttctcatgttgttgaaatctttttatagtaaaagcattaaaactgtttctttcctttgatgaaaattactgaaattcctgattttaagttcaccattcattagcaaattctagagtttgtagatgcaaatagaattgcctcttcctttgatttataaaaagtaactgaatatataaagtgcatatttatttcagcttccagaactcttggaaataatcaagccaaaacttgaaatgattggctttaagaatttttcttctatctcaggtaaaaatgaatcttgactaagcaaatctttgaataagaaatgatttaaaataaaatctcagagactgtagggtatatttaacattttcttctgtagttgtaaatccttggttgtttctctattctgtattataacttacctaaataagatgttttatttaattcatttgatctgatttattatagtacacaatgtaaatgctgtgacagtatttcaaatgaagttcatgtctgggcctgagcatgatgattaaatccagtctttaatctcaacagcagccctggaggactcccagagctctttttcagcctgtgtgccctccttgagtagcaagatcatccaggatttaagtgactcttgcttcggtttcctaaaaagcgccctggaggttcccaggctttaccgaagaaccaataaggtcagcgccatttatgggagagaattttgaggtggggaagtgtgtgttaggaaagccaaagaggaaggaaggaaggaagcggcggattcccagggtagcctgagacagactgagctcatcccattctgagaatggtattgatgaagagagggaggttgggcaggggtggtcaggggctctgggccacaaactgaaatagttagacctttcccatcctatcctaaaagtatttaaggatatactcagtttccttttggtcttgaggaaaagtaggtttttcagaagaaagcattttaataacattttaaagtcctatacgtttttgtctccatatcaggtattccacactttatatcttgttccctctttattgttactggaagcatagttggccccttatccccaggttctgcatccacagagtcaaccaactgtggatcgaaaatatttagggggaaaaaaaactacaacaataaaaaataatacatgccaaatgtggtggctcacaccaaaatcccagcattttgggaagccgaggcaggaggattgcttaaacctaggagtttgagaccagcctgggcaatgtcgtgacatccagtctccacacacaaaaaaagtttttattaaaaaaaatataaattttagtaatctaaagatgatttaaactatactgaaggatgtgcataggttatatgcaaatattatgccattttatatttgctcaataattattgtctgatttgaagctgccacttggaagtgggagagagaaaccaatatgttatttttctttagtaatctaccaactctccctttctattcaataggctgttacagtaatacatttactgagagtttgttatgggtcattcactctgctagacactttgcatagtcttattatcctcctacaaaatgggtgctagtattgtcatttgcagatgaagaaaccagagctaagaaaggttacattcctgaccctgtatccttgcttctcaaacagtggtctagtgatcagcagcattcacatcaccttgtgggtgggagcttgctagaaaagcacaatcccagaactcaacccttccacccactgcccccaacagaattagaacctgagttttacgagatcaccaggtgattggtgtggacgtgaggccacgggaagcagtgccctagtttcggtgccctgagcggtgggtggctgtgccagccagcacctcaacccagtctggctccagacatcaccttcttgtgctggctcttcttattccctcatgttctccaggcagctttctgtggaccccagtgttacttttgggagggatggaagttgtccgtgtctcaaaactagaacgttaatagtatccttttggacttgagttctgggtaacttactgtttcttttctgtttttttcctgtgcatctttatctcctaccatcatcattccaggaggtcccaaccacagcttcctcctatgtggacagtgctctgaagcccttattccagcttcagagcggacacaaggataagctcaaacaagcaataattcagcagtggctagaaggcactctcagtgaaagcactcataagtaagtaaattaaaagcagaccttgtgggccttgcttagaagagtctgcggcagaaacccccaaggcaatcaagcactgcgtatggataaggcagtgagactgcctagcacttcttcactggattagtcagagtgtgtgtcccactgtttgcttcctccctccccacacccttgtggacggcctgtgggctggcttcctctgcctgggcttcagcctcggggccgggccatgtgcacagtgcccccgcatctccaggccctgcctgcgttccctgcaggtgccgttctcccaggtccagccacattcttctgggaggccctttcgttactcagaccctgtcagtccaaagtggctctaatcataacagatactcaaaggacttaggttggtgaaacccttgtaatcaaggaagagaaaacatacatttaaaagtaattacagctgacaaggactcgattcctaaaacctctaaaacacttgattgtctttttctaatgaaatttgcttttcccaaatcaaaaagtgtgttactcaattttgttaccaattttgtttaattattaaatattaattttgcagtaatattttatttacttaagatttaagtggccatttatgggttaatttagaacataacaatgatgtataatacagtttttgtgggcaaatgtatttcagatgccaagtaaccagcttgtagacaaagctttgaaatataactcatttataatttgaaaattatattgcaagtattttgaaggcaatgagctttatttaaaattctgaaatacttttacactctaaaagatgaactgttcctagaactgattggaaatgaacttgttacttgatctggggcatgaactacagatgtccaccctcgatacatgaaagacaaaattggtctatagttttctccatgttcaggattaaaaatttaagcaaaatccacacacacacatatttcttaaattctgagggaatgctatgttagacacttaagaccatatgtgtgtgtgtgtatatatatatacgtatatacatgtatatatatacacatatatatataaaatgatcttaagaaacttaaatacttaccgtggttgaattttcgttggaagtgaatttttatcttaaaaatctctttttttggtccacaaagccagttactctatttggtgttacacacaaatgcctcttttcaccaataaacgtgtcttctattcaaggtactatgaaaccgtgtcagatgtattaaactctgtgaagaagatggaagagagcctgaaaaggctgaaacaagccagaaaaaccactcccgccaaccccgtcggtcccagtggtggcatgagcgacgacgacaaaatcaggctgcagttggccctagatgttgagtacttgggagagcaggtaacccatcagccgccggcagctccagcgagcctgaaaccaaattctgagagccgggcagttacttggtggctcgcgtgatcccagagatgctgtcgcagtggctagggaattgcttcctgtgttaagactaggagtcggggctcccaaattactttgcccctaggcagtatgagacggcaatatgagaattcccgttttgaagtctggtggcgtgctctctggtgctgttgccatctgcttgtttccccagtgcccatgctcacggagctcactacagtgagactttttggtccagtgcctgatacttaattggtgcgaaccccaggcttttgaaatgcttgctggtttagcttaaaataactgaaagcattacccctctatggtgcatgagaaatcctttgagcataacttctctgcttccctgcttggcctttgtagctttcctataaaacacaaattttagaatcatggcacgtagttgaatggtaatgtggatattatcacttaagaggtgatatggataaggtgcaatgaatgtcttttcatttttcactgaggtgaaaatgaaatttcaccataaaatgaaattttatgatactgtgaggacagtatcataaaacctctagatgttcagaaactggccttctaaactgttaaagcgtcgcacatagtagtaggtcctcaagggaggcctttccacagggaaaaaaagtgaaatcataaagtttccacaagaggacacttggtggtgttttggagaactgatacaatgttaatagaaaaagaaaaaaaaaaaagcagtcaaaacaagacacttgattttctagctcactaaggaatttcttttacacatcatgatcatcactgaaaattcaacttttttctgctttgagatgaatttagagatatatcccggtaaaagtcaactgccatgtttctttatttggcaaaaaaacccaaagactttttacaagcaagaaagtatgttatagaaacgtgaagagccaatgagcaaaagaaagggaaggaaggaaggagagtgggatagggaactaaaaggaaagagaggggaaggaaaaggtgctcccgcagtctcggtccccagaacaaaccacaaaatgctgacagagacttggtgtgtatcttcccggatctttctctgtgcgtgtgtgtggtgcgtgtgtgtgtgtgcgtgtatggatgtatacgtgtgtgtgtgttgttattgtcgtttttaaacaaaagtgggaacgtagtgtgccatgtctcggtgaccaaaataatccacggtagttgctttgccaaacaaagtgttttcaactcatctgattctaaaaggtttttggcaatatgttaagaaactaagagcacagaccagtacttttttgaaaattctctacttaaaagttcacttttttatttcctctagtgtggattttcttttctagaatgtttttaggcccacaaaagaggcttttattctgtctgatttgatgaactgagataaattaacatactggcttcttagaatgctaagtgtttgaccccaaaatcctcacattttacaacaagtaaatcctttgctctagaggaaaaaatatcctacaagtcttcagggaactgtcttctggtttagtagaggatgaagattttctttcttttttttccccccccatattcagcttgaattgcagtaacataattcattctcatggcctttgcagatacaaaagttgggactacaagcaagtgacataaaaagcttctcagctctcgcagagcttgttgctgctgccaaggaccaggcaacagcagagcagccttaagcatcttggaagatcccgaggttagattcttaagcaagagaagagttggacttccaggctgaaggggagaaagtgactctgttctcttagcaaccgtctgtagcaaagaagtgcttccagcatcactccagcaacacgcccatgcgtcttctctcagcgtatttgggtcttctttgcccaaaagaacacaaaagcctttttccattgtatggaagatagtttttaagacatttgaaactttctactatagtttacagaacaaattattttatttttattgtaaatcttagtgtggaagagctgatttctaaaatatgattaaagtaaatatatacctatgaatatcaagagtcgtctccctgagcctgtagttggaagtgacgactgtaatggaatgatgtcttgtatagaaatgcccttctctgaaataaagagaactcctgggctttctaaagaggctgcgggaagccatcctccactcccactgtgtgtgagagcagtgcttctgatcctgctgtcaccccgacctctggcaggagccggcgccagtaggaaagacctccttcctaaataaaagaagtgtctcccatgagtgtgtgctcgttttctttgggaattccccaccagggaagcactcctcgtcactcatgccctgtaatgacacacattcccttccaggcggatgctcctcttagcactgatgggaagggtcctggccagcactgaccctttctttcgatgtgtggaagttcctttccttggaggggtaacaccttccttaggagtcggcaggcccttcctggcaagctgatgtgggtagaaggaaagaagactgccctgagaagaagagatggaagcactggggagaggcactccaagactggttggttggttgaactcacataggcagcatggagtgccgtgcagcccccgcctagctgtggcttgggccctcccagcctgatgaggagctggaagcagctatgttgagtccttagtcttgcattcccgtgcatctcagtcccttctttgttcaaaggttagccctggggagaggaagtaaatggtagggaatgagagcaggtcctgtagttagcaggcttgagttttttagcacagaccgggatgaggagggctagagaagtcagaggaaaccccagtggtgaaagcaccaagagccaggtgtgtgtggagccccaggggcttccacgcagcccccagcctgccacaaagaggggcttgcactttctgtttgcaggtaacagacactggacagtggcgccctgtgtagagagcatctgctttgggcttaggactggaggccctgcccctggagggggaagtgtccagttctggagttcactgttgggaaatttggtcagtgacagaaccatgggagagagacagagaagggatttcttctcagggcttgacctccctggtgtgggagccggctcacctggcagggctgtggtagggtggggtaccatcagcagggggccagcggaaggaaagacgggcgtgcagtgggggagagagaatgaactggaacccgtggggataaatggagcccgcatctggctcttgctgcctcctggtctccccatttcagtgatggggtgatgtgcagaggaagctgcacatgcacttggcccagcattcagggaagctgaaggaagagacccagcaggagctggaggagttgcatgcctgcctcccgccccaagccagcaggagagcctgcagctctgagtcaatatgcaagagctgcagtggagcctgggctgcagcagcctgctgcatatcagcatgcagccaccccaccccacctcctgcagctgtttcctgtgaccaaggccaacctcaaaccatcccaggaagggagtcgtggggaacacaggtccagcctcgctaagccgatccagtgcaaagctacctcagtagccacatggaggtaaactacttcctccactccagccttcatcaatagaccccaaatgtttgtccccatctccctgagtgctctgcccttctcatttattttagaacataggaggagagggttatgacttaacagcccatccaactccagcattattattctcattttacagatgaggaaacggacagcttaggtcatcaagataactaataagtagggttgaaacccaagcaagataattccagagcctggtttactaattgttacataattcttcatccctaaaatcagcactacaacaaagttgacagtcaagaattggaacgcaagttgttgatttctttgaccctgtcaagccccaggctggccctggactcagcacactgcctttctcagtgacagccctgatgccataacacctatttctaagaaacacgcctgtaatcccagcactttgggaggccgaggtgggcggatcacctgaggtcaggagttcgagaccagcctggccaacgtggtggaaccccgtctctactaaaaataaaaaattagctggtcatggcagcacgtgcctgtagtcccagctactcaggaggctgaggcgggagaatcacttgaacctgggaggcagaggttgcagtgagccaagatcatgccactgcaccctaccctgggcaacagtgtgagactccgtctcaaagaaaaaaagaaaaaggaaagagacaagaatctttaagtaaagtgaaaggcttcagagcctttgtccatggttcccccagaacatctctcctttctttggtatgtgttttatttgctttgctttggagaaattactattgaataaagcttaaagatgaaataatacttacatactgtaaacctgtcattagtttcaatttttctaatatacagactcaaaagtgggtgtcagccacaggagaagttttttttgttctactataatgctgctggggaggccatgagtaggtcattcggggactcaggctgactggaagtcagccatctccatcctatggcttccaagttcaccctggaggaacctcctgcattcatttctagggctgccgtaacaaattaccacaagtgtggtagctggaaacaacagaagtgcattctctcacagttttgaaaagtctaaactcatggcgtcagccgggccgtgctccccctgaaggctctaggggagattcctcgcctcctccagcgtcctgtggctggaggtgttccttggctacggcagcatcaccccagtctctgcctccgtcttcacgtggccttctccctttctgactgatagagatactgtcatcagattcaggactcacctggttaatccaggatgatcgcatcttgagattccttgcttaattgcatctgcaaggacccttttccaaatgtgttcacattcacaggctccaggggatgggatgtggacatatctttttgaaggccaccattcagcccactccccctccactgcaacctaccagaaagggagaagagtgtgatgggggcgcccagggtgtggctctggccccagtttgggtgagcacaaaatccttccccctcactccagtgtgtggcgctcaggcacgtggggcctggaactgtagttttagctgtgtgtccaggaaggagagaaagaaaaaaaggatttggaacttctgtagatgaactccccaatctctcatctggggtcttttttggtaattcctcgcagctccctagaactgctatatggagttgcccatatgagaaccgcacagtcaccaagctgtgctgccatggcttaatgatcctagtgatggaataaaagcagggtcactcaggaactctgtagtgcaggaggtaagggctgattttcctttgcggggcccttttgaaacaaccatgaagctctctggtactggggtctagatgtcactctaacagcagcaacagcactggtggtgcagtaattggagccagcatggctgagtcattgacaacgtggacacctccatggtgtgttcatgtctcagaactcaaaagcagtgatcaactgcagatgctgaactgttagattcttaagcaagatctgttaggggtccccgtttgaaggcagtgttattttctctgttcatggcatctgaatagatctggtggatctctccctccctatcagcagccaggcagtccagtccgttcgagcagttggtgaaaagcagggctttgccagttggcaatcctcctctctgtgtaagacctcagcctcagcgccctaaaggaaacgctgtctgtcttttgagatgtgcagacattcttggtgctgcccgtgagtctcagtttttaccctgaaaatatcctgctacttttgatcagccactaagcttcgtgttggatggctgtgaacatctgtaaattgttgagtgaaggaagtgttaccttcatttgattgcgaaagtttctccattttccactcaaccctcagctggttttcatgtggagactgaatttcagaacaatcagcattctcatttctccttagctctcactaatcttgaactaaaatgtattattggccgggtgcggtgtggctcacacctgtaatcccagcactttgggaggccaaggtgagcggatcacctcaggtcaggagttttgagaccagcctggccaatatggcgaaaccctgtctctactaaaaatacaaaaattagctgggcatggtggcgggcacttgtattcccagctacttgggaggctgaggcaggaggattgcttgaatgcggtaggtggagattgcggtgagcagagatcgcaccattgcgctctagcctggacaacagagcgaaattcagagtggcattctgactgtttaaatctcttgtgtaatccagcttgatggcatgttgggacctgattgaccctcccatcctgaacaactgaaaatcgatactgtgtgaaacagcgctgctcagtgtcggatgccggcagtgcagggtcctagagagaaggggcaggtgggggtcctgcgatggcccagcgtctagcatggagggtctctggatgcacaggagcatccagagcccagcccattccctgagaggaggcggtgtggagtttggggacactgaagaggctggaactgggggtgcagagtaacggagaggagacaggtctgtggagcgtcgctttgcttttggagctgggtattgaccagcccgcctgtgtaaagaggttgtcaaggccaaggaaagaatccccagaaaggagcaggtagaaaaaagccccagagcaaaacgggcctgggaaaagtgtgtccagagtggaaagacgtggagggtgggggtatggcccctgcggtggagccaaattaacccgatgtaaagggctgctctgaagccacctcacaaaacatagaatcaagcctcgaaggatgacactcactccacgtaactttctgtttttcattttagctgcagggtgtacatatgcaggtttgttacatgaatatattgtgtgatgctgagatttgggcttcagtggaactcgtcacccaaatagtgaacatagtagcgagtagataattttccaacccttgaccttctcttttcctcccctttttagagtctccagtgtctgttgttcctatatttatggcccaatgtgtacctagtgtttagctcccccttataagtgagaacatgtggtgtttggttttctgttcctgcattaatttgtttagggtaatggcctctggctgtatgtatgttgctgcaaatgacatgatttcattctttgttatagctgcatagtattccatggtgtatatctacattttctgtatccagtccaccactgatagacacctaggttgattccatgtctttgctattgtgaatagtgctgtggtaaacatatgagtgcatgtgtctttttggtagaatggtttattttcctctgggtgtatatgcagtaatgggattgctgggtcaatggtaatgctgtttttttgttctttgagaaatctccaaactgctttatacaggggctgaactaatttacaatcccagcaacagtgtgtgtgtttccttttctcctcagcctcaccagcatcttttgttcctttgattttttaatagcaggcattctgactggtgtgagatggtatctcactgtggttttgattttcatctctctgatcattagtgatgttgaacattttttcaaatttgttggccgcttgtgtgtcttcttttgagaggtgtctgttcatgtcctttgcccactttttaatggggttgtttttacttgttgatttgtttaagttccttatggattctagatcctagacctttgttggatgcatagttactaatattttctcccattctttagttcatctgtttcctctgttggtagtttcttttgctgtgcagaagctctttagtttacttagtgccagttttcaatttttgtttctgttgtgttggcttttgaggacttagtcataaactcctctcctggctccagctaacttaacagaagaatgaggttactcaagttcaggggtgtgggccctgagacccttactctcttgaagggatagagtcactgacatgtttgtgggtctatcagagtcactcagaacatctctgatcattgagcaactttaaaaattgtgtggggtaaacatgtccacacaaaaacccacacatgggtgtctgtagcagcttaattcgcaattgccacaacttggaaacaagcaagatgtccttcagtaggtgaataaataaactgtgacacatccagacagtggcatagtatttagcaataaaaaagaaatgagcgatcatgaaaagacatggaggaaacttaaatgcacattactaagtgaaagaggctaatctggaaaggccacatactgaatgattccactatatgacatcctgggtgggaaaggcaaaactatggagaagatgggaataggatcggtggttaccagtggttaggagggaaggaggggtgaataggagggacacagaggattttcaggtcagtgaaactcctgaaaattgtctaaacccatagaatgtacaacaccaagagccaaccctaatgtaaactatggacgttgagtaataatgatgtgtcaatgtaggttcgtgggttgtaagaaatggaccactctgggtgggggatgtcaataatgggggagactggaaggtagtagggggtatatgagaaattgctgtatcttcctctcagttttggtgtgggcttaaaactgctctaaaaaactaaagtctgctagaaaaaaaaatcacacgggatggtattcaaattcaccatccactattcaaaaccttcagtccatgtttcagtagttgaagtttttcagattttaggaaggtaaagtggcccatatagtgtatatcccataacacccccaggggcttctgcaacagcaccttataatcacatgtacatcttcgtgtggcaaatttaggaatattcacactatcaactttttcttctgaggatcttaaacagcctgacgtctgtccccatcaggttttactgccaagtgagtaataaaaatctttccatttttcaaactcactaatttcctcagaggctgttcaaagcatcccctgaccatggtctcatgcccagccgaaatctcagattgacagtgattttagttggtgagtaattgccttgtctaggagataggcacttgcaactccaggaagacttagaatttagtgaaaaaatgtttcagagaaactgacctgtggaattaattttgtgtgtgtgtgtgtgtgtgtgtgtgtgtgtgtgtgtgttaagtaacttgtagaatgttcgtattttgtatccttgtaatagctgagagatctatcctgacctaacttcccatttataagtgcacagaaaacagcgggagaacagcgctggttggcaactttatactcctagcgacttccagaagccgaagccgcctctaagtagaagaaattggtttgtcgactgcctgctgccttttaaaataaagtcacaaacttaaatgctttgtttccagcacgtggctgcgctgtctcaggtctctacgagcaacttccaagcctggacctcctgtaaaactgcagattctgactctgtaggtccaggaggggcgtgagaagccacattctaacaagctcccagggcagctgccgccactgccggtctaagcgccacactgaatagcgagaccttaaggcacttctggtctctgtgcttccagttcttccgagaaacttggcatcttgcagccgtttcggagagtccatgtgtgccagctctacccgctttgagagcagaacaagccaggaagctctgagagtgggactggaaggtaactgaataaaaccggtgacggggagttacgacgaagcaactaagggcactgctgttgccgacagaatccctcaccttgacatcgagctagggagatgtgttcaaaaccaggggaagactctcaggaacatgaggggagaagccgagatttgtaatccccgtggctgacttcactttagttctgatcaatagctaacacattgcgcggcttatttatttcaatatgtatggaagggaggaagatcgaatgccttacacaagtaggtaggacagcatcaccattgctatcagccgacggccgtgggcctactgggtgcctaccgcttccttggctctccccaagattccgaactgtgggcctaatcccatcgaggaggagcaggcagaggcactcaacagatgggggaaaattgcaaatatttatttgtgaagatttatttctctaccttccactcccggggcacaataccagcagcagtctggccctgtgtcaccaggacggaagaagtcccatctgcctggttcctttcccaggtgccacatggggtatggggccttccctgtcaccctcttcccgccccctgtccatcacacagatggccaccactgcttaccaatggaagtgtccagagaaaagcatcacctaaaacttcaaaggactgctaagtactggctcagacctcccatggaaattccatccaaagtccaggaaagcactttcgtttgcacagtctatctgctgaattgtatacatctgtttggctgctaaatgaaagataaaatttttggaggcttattgtggcaagacgtttattactaacacaagggagaaataaccagctatggttccgcattcaaacagaaattcaggtgcttgcatctttcacgtattgttcaaaaatcacaagcatctgtggaaaaaactaaggtattacagacactacacggaggtcatgttcttacattcaagacactaaatacaaaccgaaggcaatgcaaaaatgtatactttaattttaaaacccaatttttgttctcaacttgaaaagggaacacttttttgtttcacaaacaagctggtcggttggaattctttttggaacagtagtcccgcgctaaacactggttcttgcctccccacccccattctctaaaataaacccagcaaactgggaggtgcatttgtgccgctgcaggcttctactgctcactccatgcagcacacttagaccaaggagaaacggctgctttccagctcaaagtcgactcattagaagaaaaggtgggagactgggggtgacacatcgctgatttgtccggggttgttatctgctgctggcctttgcctcaaaggccaggggcagaggccttgccaggcactgtgttctggggccctggcctcatgctgtgctcagcgggttggccacgcggcccaggaagtgcagggcagtggcgctttgatcatacacagcaaacaggaatgggcggttcagggtcacctccaagacctcaggcttgttaagctgttgggtagactctgtgggctctctctcatccgcttcaagctcaaaaaaaatgctgttcagcacctgcaaagcagcagacatcaggatcattctgagggcgcactgggtgacccagggtgctgagggctagagggccggggtgggctcaggacctctgtgctgtgcactgtcctggagggggacattttccagcctgccaggaggatgcacagtgtatgcctgcccctcagtgtaggcaagggtgtgtctgtgtgtagatgaccgttaattggccacaatggccaaactcacatgccggctcctccctaacacaccccttacatcctcccatcttcacattctgccctgatgtcccaggcagaattcctggctcccttggccatggcccaccagtgccagggcttagctaacttagcacagagggctcttcccgctggcccccgtaagaactcccactttctccccagcactgagcacagggcccagaacatcaaggcacatccttggtagctgcagatgtgcatggtgccacatggcagggggacattctgtctgctgctcagcatttccctgaagaaggggctgggcccagggcaccaggtccaggggtgcttgctgtcttcatcccggtttcaactccactataggaaccctggaggaccctgaggcaaggcaaggccaagcaggaccatggaacacacacctagcaggaggag

SEQ ID NO: 1058 - DNA, 71847 bp, Homo sapiens
ataaacaaatcacataaatattcacatctatttcaagcagtcattgggcaatcaaatcagttccttgattttatgaatataaatcataaggttagtaaagaaataatttgagttaattcactttaaaggatctcattaatgtttacatgcacatgtaatagatttatattaaatgttttaacagttaaagctaaacttgaaactggaatctcttactaagaaccagtacttaagtgctctaaattataatgatgtacatgtaaatcctatgtgccctggtttcctttatataataaaacactttagtatgaacttgtttctatcctaaacagcacccaacagaatgaatgttttacacacagcgaattctcaattaattatgtaaaagtcttgtatataaacatataaataagcattctgtaaaatacattgcttttcttatctttgactcgcattatgaactatgtttttcctcccgacaaaaaaaatgcacaaatacgaaagaagttatcagatggaaaatcatacacaaaatagcaaaattataataaatattctttattctaagtctagcaatgacattactttttcccattttagacaaatttctctgaccatttttctcaaaatgatttcttgaataaaaattctgagtcagctaataaatttcaaagataaattttaaaatgtatcaaaagtatagtattaaagcaaaacattaaaagtatcgaaatagtttcaccaggtatgtatctacgtgtatatatacaagtaaacacacatatacaataaacactaatcttcccacattaacggaagtgacaaatgacaatctaaatacaaataaaacagtattcagaatcacaaataaactaaaatgtacaatgtttacgtgaaaaagaagttggctaatgttgagggtttgaattttaaattctcctaaacaaaatctacccatacactacccccaaaaaaatcattcaactaaaaaaaaaaaaaaaaaattccaattgctaatgttcagtttttatagtgttgctatgctatagccaaaacaatcagtgtaaccaattttggatctaggtaaattatttctttaccaatcaagttaaaactgtttttgtgacaaactttatgtatattacatctttaaataccataaaataatcatcatgagggaaccaaaagaaaaataaaaggtctttattaagcaagtttaatctagccaagcctttattaaaggcaaaacgatgttcgaaatatggagcatattcatccacatataaatacatattttcattaacatactgtgctaagggatttggcaaatgcattttaacctatagaatttgtacaaaatttgaattcagaacatcttaaacagctaaaattataccctatttgaattttactattttaagagttaaaaatagcctcactaaaaagaaattcagacaccatggaattctgctgtcttaagcagcaatttaatacataattaggggggaaaaagtaagccatacacatactacaaaaagatctactgtcaaaacaaataaataatgaacaaataagttaatttgaaagcaaacattttattaatcttgaaaataacaaaaagatcctgtcgatcttcaattactggtaagactaccaccaatatagaaaatctgaccaaatatatggttgtatttcagatttttatactagataaattacaaaagccatcttctaatagtacatgaacaatacaaagttctcagtttaccttctataattgctgctataacctttaccacgaggtgaagggccatgtacgaatctacatgtgtttccatagaggcagttgccagtcttcagccagttacggcactgtgtctaagagacagatattactatgtaaatttcatatttatttctggaaaaaaaaaatgctagcgggacaaaattaaaacaaatgctaccaaaattccagctaacctgtgatatattactccccaaataataaaaacttcaggaaaaaaatatggaaaaacccataaaccttatcacccttttcacttctttttataaaacacactttaaaaaatttactgaacaaacattcctacaataaaacaacctgttcacctttatgatacaaataagcatttcaataatagaattctaagagaacccctgtgactatactagtgacaactcacctctgctgtactgccagtgctgggtccaagcctctcaaatacactgggtcttcgggatgtgctatcagatatagtcttggtattttccactgtgaccttccttctaatttttgacattttgtactacttcaaccaaaaaagaaagaggcaaaactgtaaaattcctcagttttaaataactgagcccacagcttacaagtagataaaactataggtaacagtgtaaaattacaggagattttccttgggagattaaaaaaaaaaagcataggagaggtcacaggtaaacagagataatatcttctaaaacatgccttactggtgaatttataacagctgtgagatctgttggctagaattgtacctcttctgcagagtgaacgaatatgatcctactcacacagtgaagttttcatagtacaatcaacctcagaagatacagtacaaaatgtttactttataaaagttacttacaaaaattgcttcaaaatttagtaactcaaagttgttaaccatcaactggttaactgaaaaagagttatgctaaagaaaatggaaaaataaaattgggtgaaaattttcatagcagaaattatgtttcataagtttaagggacaacagcagttatgttccaaaaatcaggttgagaaaaatgaatgatattttagtattttctttgcctgacagaagtcaaaacaatctgatcaagcatatttattttccagtaacacaaaaacaaaacaaaacaaaactcaatgttgatagaaacaactttcaaaacaggacagactgtagaactagaaaaagtcgaggtgtttctataatctatactacactgacataaaattcaaaggtgttaaaagtaattatcagactattttaccattattagtaataacaaaaaaggcaaattgtaaaaatatttttattttattttacgtttaagctctgttagatttgatgtaaacataaaaatattttttaagggccaggcacagtggctcgtgcctgtaatcccagcactttgggaggccgaggcgggcggatcatgaggtcaggagatcgagaccatcctggctaacatggcaaaactccgtctctactaaaaatacaaaaaaaaaaaaaaaattagctgggcatggtggcgggcgcctgtagtcccagctactctggaggctgaggcaggagaatagcatgaacccaggaggcagagcttgcagtgagccgagatcacaccaccgcactccagcctgggcgacaaagcgagactccatctcaaaaaaaacaaaaaaactctctctatatatatatatgtatgtaaataaaacattcaaaaactgaaactatagtaaaaatctaatccaatgacataattgggtaattcaactagatttgcaagtatcagataatgacagtatattatgacattagaaaacaatattaaattctagaccaagatacaatccagagcatacactactgtgggaagagggtagaaactgcctcataaggggaaggaaaaaaaacaccatactatatcccgctttatacaaactaaatattagttgaaatcttatcaatcatcaaaagttactagaatgaaccacagcagctaaaaaagtttcatttagtctctataaagatcacaaatctttaatgtggtttcaaagtaaagacatatcactttaaaggaaattaaatcgtggtagtacctaattgaaacagcaataaaaaattataaacagtgtttggttcaatgaggtacttcaggtcacacttttaaaagaatccaaagactaagaacaacatttgataaataaaagatggtgcatcaaggaaggaaaatatgaaataatatatggtgattttaaattggaaaatctatatttttatcaatataaaatgtaataattcttttgatataatagcaattaatttttagtgattttaaaaacagaattacttcacagtaattataaatttaagaaccagtggagagcatcacataaacaataatttgctgcaacacaaaatcaattaaatattaattgttctccaagtaaggaactacacaccaattctacatactggtgttagcattataagataatctttgatttaatttttcttagactcattctcagctgaaatgtgaacatacggaggagaagctggtaaaatttcctatgtctatttgatttactgagcacgaaaaaactgaaagctaagagaagtggagctgagaaagatctagaaaatgtagagctttgagaaaaacttttttaacaatatatatccaagcatgattcaataataagtaaatgtatcacaatgtataagaagtttgagaaaaacataaagtttcattatatattgctacattaatatacaaatatagagtaatcctcaaccaataattcaatttttaaaacatttcttaataaacaaaattgaataggttccaaaatttccttatttgctagttatgtagaacttagaaaacaggcacaaccatcccaccacactgcctcaagtggactaacactaattttttatttttccctccactgtcactggaaatgagttagttctgcccccaacatctctactacccccaacatgcctccactcccagctcagtctccttcaaaaaattcaatggtaatggtttccagttaggacgacaggctatttattatcgtacttattatacttaaaacattggtcatctatcatctcctttctttttactttttgagggttccaggtattaactctacagtttctttttctggtctgtcctctgttgcctgattcgcactactctcctcccttgacctattgctttgctggtctgagagcttctctccaatcctagactccctaaggcaaactttgaagatttcgccgggcgcggtggctcacgcctgtaatcccagcactttgggaggccgaggcgggcggatcacgaagtcaggagatcgagaccatgctggctaacatggtgaaaccctgtctctactaaaaatacaaaaacaaaattagccgggcgtggtggcaggcgcctgtagtcccagctactcgggaggctgaggcgggagaatggcgtgaacccgggaggcggagcttgcagtgagccgagattgcgccactgcactccagcctgggtgacagagtgagactccgcctcaaaaaaaaaaaaaaaaaaaaaaaaactttgaagatttcaagggttggacttgctatgaaagacaatcaagtgaagactaatgatccacctcctcacctccctcaccctacgcccatattctttccacagagacaaaattgcttttaccagtgacatcaagaactattcaagattcacctacatagtaattatcccaggaatttcacttgcagctactactgtactgagtctcccaatttagcgaagaaatgaaattaagtaaaaatgtggccaagcgcagtgactcacgcctgtaatcccagcactttgggaggccaaggcaggcggatcacgaggtcaagagattgagaccatcctggccaacagatcgagaccatcctggccaacatggtgaaaccccgtctctactaaaaatacaaaaattagctgggtgtggcggtgcacgcctgtaatcccagctactcgggaagctgaggcaggagaatcgcttgaacccgggaggtggaggttgcagtgagccgagatcgcgccactgcactccaacctggcaacagagggagactccgtctcaaaaaaaaaaaaaaaaaagatgtactctactttttctcagactccaagagtaccatactttgtcctaaagtaatacagcatctgagtatgcggtctgggttacagcaaggtcctggactgaacatttaaaacaagaataatgacaacaataatacacacacacatattcttaataaaatgttctttaatgtgatatatatatgtgtgtgtgtaaaacgtctggtgaaaaaagaaaaaagcagaaactgaagatttctaactgaaaaaattcttctgatcatccatgtaaaaacttccacaagtagtcaacaataaaatgttacttaaatattactaatgagacattcatgaatttgaataaacaaaatgcttcatgcttgtaaagaacacaatatataactttaaaaatcccatttatctaaaaatatacacactatctacaatacagcagaaaaacatttcctttttcatatattaaaactaaatgttaccaactaatgtgacaattagaattttcaatcctatttaaaactttgggcccgtaaaggaaaatgaacaccacaacagttaaaatgtagattttcggggcgggaaactttttcaaattatgtatgaacaggctgaacatgacaagtaaatgcttcaaagtatatgagaaaaattagaaaccataagataaaaatgtaaatactaaagtctttcctatcatagagaatagaaatcaaggtcataccaataacttactaatttactcttctatgaaggttttcctccatttttgttttcaaattattatttggtttaagttgccatcacacttccacccacatcatcaagtctttctcaaacacgagcattatcaaagacagagtggcactagtgaaagcctatttcgttattttcctatttctcctctccatttgcagagcaaatgaatatctgaagtctttataatctcttttcaattaaaaaagaaaatggaaaaagaaaaagaaaatccgggacacaaagtttgagtctattaataaagacacaacaaaagagggtcttaaatgggaactgctcccttgccccgagaaacttagaataacactgtactcagaaggttcacattataattatggctgagaaaggagaagcatacaaaagggtctctttttgaataatgactccagaagctcaattaataaaatcttgtcaataaacacatatgcgttctagtatcttcacttcaatccataattaattatcttttccaggtctcatctactggaagcataagtgaaagcataacactttaatccggatgagtagcggcataatattagggaaatttcaaacaattaggcaattaaaactacatgaatgtactaactagtaggataaatccctatactctgaatttctaagattaaaaaggtgatactaaaaataaggtatcttcacatttatacttcatatttttagaaagaaaaattaactttatttgatgcatagtttgagagaattttttaaaaagaactttctaaaacaaactttcagattgcttccgtaaatttaatgctaaaacaattccaaactaaattccaaatacaactgacagaactaagctgactacataggaattagcaaagcaacactgcagtactatgcagaaaaaacaatttgttaaaaagactgtgcacagaaaacatcccatgctggtagctactctaaagtgaagtaaaaagaactgcatcatacaaaaatacaaaaaaaaaagaataaaagactctttctatatcaacagcagttaatgcttcaactactactaacagctggagaaatagctccacctctatatgagatggagttgggagagatgaggaggtgaggaagactatcatccactgaaaaccaactctctaagtaaatttaagttaaacaatgtgtttcctctatgtaaatgccaatgcatattataaatactgatgatattacaattttaataatttgtaaagatgttaagataccatccacttgctggatttttagtatgttaaattcatattacaaatatgaaaatcacataagcttgcaaatctcaaaatatgcaatgttcatttagaatgaccagtaatcaggaagccagtaagaggcatacatttgataaaactgaatcctaccagatgcacagagtgaaagccttagtttcagagtgcaactatttttaaagccgcaattgttacaagcttgcatcaactttgctagtctctagttgaaactgtcatctgttataatctaaatagttcattaagaaaataaaaattatttgaaaatctatagattgtattcacaaaacgctccaatatattgtactaaagccagtaatttcaaatgttacagaactagaccccgctaactggcaccatatacccatagactgaactgcataagtatttattctccaacggtatcgcggacttcgaaaacttgaggtgtaaagatgttttccaaatttttaaaactactttaaaaatccaaaaatcttaagagacttcatactcccataattttcaaagtagttcgaattacctgaaagccccatagtataaccaaataccttaagactacccttcacaaacaacatcttaccaacataattcaagtattatcaactctaaataattttcaaaccacataaattgcgttagcctattacagagagataatgccgccaaacagactctcttctttctattccactttcccccgtttctgacagttgccaaaactacctacctaaggcttgtgaagataaagtagcactcaattcccaggacctaaatcgttatcactgctgagggaaaaaaaaaaaaacaagaccaatcacaagtaagatgtttttctctaacagatctggaatgagtatagaggaagattctaaatttaagcccaaattgctgcacccttccatcgcacacaaatacgaacaccatacaagggttcccgtgcttacatcaaatggtaacgaggggtacagcctattgtctgagtctacttatcgcccttagacaaatgccagaatcataatcagagtgagaaattacgcctgagcacagggggctattgcagagttaagggtgggatgctcaaggaaagctcaaaatcccagtgactcaagcaaagacgggggggggtaacccgggcctccgcattacgggtccgctcaatgccttccccagatacccacaccaattcacagaacgcttacttcctccccaagctcccttcgcaagtgcagtccggaggcaccaccgccgccgccgctccgaggagcgggggaggcgactctgtccccgcgcctggacccaggaggacgacgacgaggagaaagcgatgcgcgcgcggctcccgggaaccggctcttggctagcgaggagcccccgggatggctgagaagcagaaccaacccgcccgccgcctctccagggtcaagcgaaactgggtcgcaggaagaaaaataacgaagagattgtagattaagaaaaggcaacaaaaacactaccaggccgctaggaggaccgcctcaaaatgccgccggaagtcagaggtttgccctgttcctctgtagacccaggcagcttccggccgtcagattagtcgtcagtgcgcagacaccacccttcgtggacacgccctctaggcgtaaggttccatgcgagcggtaagagtgcggcgggacttggaaatcgaatctgtgctctgtgagagatcctaggaaaggaaactgggagcccgggagaactaaaattcccaattaaaagtgaatttaagtgagttttctctttttattacataattccttaccataaacagctgttgtaaatgcgcaaaatgcggcatttgttgacagtacctagagccactcattcattcgttcaacagtgtttattgagcagctgagctggaatgagaggctatgtttgtcgtttttgacacccctcccctttctgggccatcgcctaattaccgtggagcaaacggaatgcatggttgtatttctaaaggcacaagcagaaatttattgaaaatttggagcagaaatctttaatgtacttctgaccacccttccttttgttgagtaggatccaatgatcagcgtgagatgatcattgattaaacttgcttgagatggctagtcaaacgtcgaaacttgcttgagatggctagtcaaacgtcgaaaatcaaagaaaaagtaggtaactagacttttacaattttttttaaagggtaaaaagacatgaaccctagtctgccttaatggcaaagtagcacttattaggttctctgacagaaccaaggaataggaaaatcttttatcaaaactacggataaaacttaaaaataatttgatacaatgatttggtcttgctggaatcagtaaattaaaatacggaagcagaatgataaaatcaggggcattaaacattcctaatgacatgccaagctattttagagacagcggcaaaagcttctctacaggtgggtttgatgtaacgctccggcagcaagaatccgtatgtgcccgtatctcgaagttcaattgtaaacgaatatttgatgcccaaatcatagatccaatcgtccccacctccaggagctaggtctaaaagaagaagaaagaaattgttgaaatacagacgtttcaaattaatttacaaactgggaattgtttgatttaaatgtttatttgtttgtatacctttagatttttttcagtttttaactaatataaacaactttacaatgagtacccttgtttatacataattgcttctttgtctctttagaatattcttccctagaatagatttgctagtctaaggctctgtactttttgcaattacggcatgttcccaaatggacgtcaaaagaactgaattcatttatacttccacaagcagggtatgaatttgcccatttccccttcccataccatcaataggaattatgaattctgataattttatgggcgaaaaataatatccaactgtcttaatttatgttttttgattatcagtgagttgcacatttgtttggcatatttattggctatctttatatttcctatcaattgtccttcctcatttgtctacttggttcattttatcaattgcttataaaaacgacattagtgttattagctttgtttggcatgtagacctttttttctcctttcattcatttctcctttcacaagaattttttctccttactgagatttcaacttggtttatgcagggttttcatatgaaaatatatgctgtacctggaatttactttggtgaaagacatgttaataatccaattaatttttttctaggtaacttgttaggttttccaaccgcattaattgaataatctgactttttttgggggggtgctaaattgagtccaggtttatggcaaagtctgacccaaaattttaatttataattttagcatctatctaatacagtttgggaagcatctcatgaaagctacaattgccagaagacttgttacagtttaatgcatgttaactaaaatgtgtacatattttagtgttcatgataaatacagtttcgaccttttttgagatggagtctcactctgtcacccaggctagagtgcagttgcacaatctcagctcattgccacccccacctcccaggttcaagtaattcttatgcattagccaaccaagtagctggcattacaggcgcctgccaccatgcccagctaatttttgtatttttagtagagacagggtttcaccatgttggccagtctggtctcgaactcctgacctcaagtgatcctcctgcctcagcctcccaaagtgctggtattacaggcatgagccacagcacctggcctctttttgtttttttctaatcattaaaaaaaaaaaaaaaaggaaaaacctggatttggccttcaggctgtagttttctgatgcctggttacaggtttattttatgctcctcttttcccatctcccttcaaacttcaaaagggcaaaatcagtctgtcctcccactgtgtgtagataggagttactcactaaatatctttcagcaaaaattaatcaaaactttttgttaagagtttgtcacaagttttgtgtgtgtaatatatattaaagacaatcaactgtaatgtgttatgagctatactcttgggaacaggctaacactaaaaaacacttgatgcaaatggcatgccctagattagtgtagtgtacaacctgcacaaccttccatggtggccctgggaatcatgcaaaagttttatgaacttttctgcttcactcaactagtatgatgccaattctgtaattcctacttgattgtgataaatatgatttcttaaataggattttggcttctttttagtaactcatttattaatatagctttgttcagcattgtcatagctattatgcttctgttcctaattattacaattcagttgtattacatgtgaccctatttaattcagaaaaattaaatacacaaagaaaaacagatcacacagatttctttagtagctcaaagttctctaagatcataagaagaaatacttacataaggtttctgagccatggccatgtgtatacctggtatttttactaattttctcaatagcacgaactgcttcactggctactagagactggaagcaacaagatatagaatttcagttaatgtgcagctttgaaacatgacaagtagaagtttctaaaaaataatcatacattaattgaatcaaagtatacaggtagaaaatctagattcatctaaaaggcaaataaataaggtaaacaaattaatttaaaatatgtgcactttatggcaatcacaattgggtggctttaaacataaactatttcaatatattgaaataatttatataaataaatatattaatttgcagaaaaaaattatcacatgcctttttgggaactcatttattatggaaaatgaagtataactacatctcaaaggcttagaggtactccatttctgaacaaaattatcaccaaactttaaatccaacctttctaaacacatacaaacacctaatgcatgcatgactcacttcttatccttctcacaacttctattttcttcttgtgtaaaatgtctaatgacttccatagattcatcaaatcaaaaaagattatgcctctggtatggagcaggataataactaagacccccatttgacttcattttgtctgttgatattcattttgtcaaatctattctgaagttctcacttatctggaacttttcggaaattggaactagcatcatggtatacactgtcaccttcttgaaaaactcaagagatttatcagcggatattattttatgccatctcattgttcaaaaaataagttttaatgtaaccccattgtctacataatgaaatacaaatttatctgacagtcacaccccttcagaagccaacctaatctactttctgatgctatcaccctccacttttgcatcctcttatggtgaacaccaacttctttgcttggaaggtccttccttccctgtctgcctatagaaatcctctttcaatgcctgtctaaaatgtagctgatctttgacatcaacagcactttattatttgtagtttttcccccccttaatagattgtaaattcctcaaggacagtaactactttatctcctcacttatctcagcatttccctctgaatgcattagtgaagccatcccttgatattctagttagaagtgagttgtactgtctgtgccacgtatttagtagttactctatgtcgccttagagtacaactatttgtaacatttgctaatggttgagctccctaaccataacacattctcttaaagggcaggattttacctaatgcttctttaaacatccattgacaaggtattttacacgtaatggctctcaacatatatgtgtgctggcagtgatgcaaaaaaaaaaaagcataattagactaattctacttcccaaatcatgataaatttccttttatttcttcaaagataatatttttgaaaggtgctttccttaacagttttcccttgagaagaaaaaagctcaagtatcaagtacatttatgttctaaatgggctattttcagagaatgcaaataatcttatatttgtcatcagcaattgctagctcctgtaatgtgactatattttattctgttaagagagccagaaaaaaaaatgagtcactaagaaacaagctactacctaaaaattagtcccttcccaagaatggggctgttgatgtaacacttccactgtctggagagcatctgggatgaggatttgtcgaagcctagctacaatccttcaagaatccttgcatcttttgccatgaacccaaacatacagtatcttggactaaaaagtgctaagggagtatcaaattgtgtgagtcctctttgaatttcctgtattgtctgttatgttccaaaaaacagactctctcctcaatgctaaaattggaggtactttaataggaccaaaaccctgagggttagggaagtcagggcaggaacaattcctgctgctaataccaaaacaatgagtgctgtgttgagacttaatctgtggtgtgctgttgtaggaagctagtgaccacaaagctgtcgcatgattccatactcatccttgcttataccgcttcacatgcagatcaggtcaagtgtagtagtagttccttcctaaccttcaaggaatttgtctgacattttcttaggaagcccacgtgctgaataaagtgtgtgttgttagggtaaggcacgttctttatattcccttagagaacactgacccagggtgactctcaacaggatcacaccatgatttaaaacatctatcatttgccttctagaggacaaaatttttcccagtttttgattcttcaactaagtattattttatttccaaaatgctaatgagaaaaataattaagtagcacttaccagttcctcatggtctttgcttttacttcgtgtataggaatatggaaacactatatgctgggagtatgaatgcatgctgatgtatgctttaatctggttgatatttcttctcaagaaactagccactgccttcacttctggttctgactcaggataaagtccacagtaggtttccgagcatgaggaactggatgcaccttcctctgtaacgaaattgttaaggtgaaattatgaggggatgcacatagtactgtaatttgtggtttcccagacaacgtattctcctacctatgttgcaacacttttagatgaatggattaggtagggctctgcaaagaacatagttccactaagtgttatgtttcttttgaagtcaaatacttatctgctcacatagctgaccttctaacagtcattcccagcacctgtctcccttgcaaccttgagaaagtggctaagagatcctcagagatgccagccctgtctccagacttatggttatgggagaaaaaataaaccccactttccttaatccactgtaaatttagtttttctgatatttgtagttttaaagctaccatcaatatagcccataaaagaaaagcctcacttcagagctcagaatatgtaaatctgccttcagtgctacttttaacttgctaaagtggtttagtaagtttagtaaataaaatgggatggtgatatttgttgccagaccaacgttcattcattcctttgatagattataatttgcatcacttgagatggtaggctgccttccaacacttctccccctgtccctaattcacaaggtgaagccccagcaagctgcatctgacacaagagattattccttcctgcaaacagttgagggctcaggattgggtctgactcttgtgcttgccaatctgaatcccttcaaagataacttgaaatcaatactaagagtctagtctcagtctagctgctctcttgaacagacagtaaaaatagtaatactaccagctgacacctgtggagcacatgctgtacgtcaggaactctgctaagatttttgccacatctcatgtaattcttacaccagccctatgaagtaaatactgtcattttaggagatgcaatctggatattcttggtggtaaccactcttcagaataagaggctatacagcatattgttaagcacccaattacttgattctaaatcttgactaccatttattagctatatggctttgggtaaatttttaaaaatctatctgtatctcaatttccttatctgcaaaattgaaaaattatacattaaatgctgattgaatgagaattaaatgagctagttcatacaaagtgctttgcacagtgcctggcatgtagtatgcatttcataactgttgctgtttatcatcatcatcatcatcatcatcatcatcatcatcatcatcatgtggactgagacctgaaagaagccagtgtgcatcacagagatgagaaggggagaggaaggattcactgagcctctctagggctccaggcccagttcctttctgtttctgagtccagctgcatctctgcctcaggagtccatggctgaggctactcactatccttacagagcctgcttttcttaattaagctcattctgctttattcctgttattatacaaacacaacattaatgtttgttaaaaaattgtttccctgagaggaaatgtgaacatctaaggtcttcccaagtatttcatttttaaccaataaggtgattggataaaccatttttgatagttcggtcacctttgaatattcctgcccttttatgtgatatataattcttagagaatagagattatatattgggtatggaggtcggggaagacataaccactaaatagagaggtggtgccctaatatgaatcctcagaccagggttgtttaatagaaatataatgcaagtcacatatttactttaaattttcaagttaccactttaagaaaaataaaaagaaggccaggcacggtggctcacacctataatcccagcactttgggaggctgaggcaggcggatcacttgagatcaggagttcgacaccagcgaggccaacatggtgaaaccccgtctctaccaaaaatacaaaaatagccaggcatagtggtgcacgcctgtaatcccagctacttgggaggctgaggcacgaaacttgcttgaacccaggaggcagaggttgcagtgagctgagatcatgacactgcactccagcctggatgacagaacaagaccctgccacacacacacacacacaaaaagaaatatgtgagattaattcaatattgtaatttatttaaccaaatatgtacaaagtatcatttcaagtgtaaccaatataaaaattattcttgaaatattttatgttacttttttcatactaagccttcaaattctggtgtgtatttaacactcagtgtatgtctcaattcagacaagctacattttaagcactggatagccacatgtggttagtggctactatgctggacagtgagcctcagattctcattctatgattgtcattctagagatttcaagcattttagtggaaagagccctgaagaggcaggaaacttgaggtcgagactctgctttaccattaagcagtcatgttaatttgggcaactacttcatcgtctcagcctcaggggcctcatctgtaccaggaaggaacttgggccactggatccctccaagctcaagcattctttgatctatagacatggaaccaagcacactgtgaaatatctataataggcaaattcatagagacagaaagtagataagaaattaccaagggctggggagaaggtagggatgaggagatattgcctactggttacaataagtaaaaatctctctttgggacaattaaaaaattttagtaatagatagtagtaattgtgaatgtacttaatgccactgaactgtacaattaaaaattgttaaaatggcaaattttatattgcatgtattttatcataataaaaaataattttaaaaaacactatagtctcctagaaaaagaaataaagaattttccattcaagccagttgcaaaaactttgtagttgaactcagtgttttagaaaatgtgtggtgctatcttaggaagtttgagaccaaaggttctcataatgtactcctgttatgaactgaattgcatcctcccaaattcctatgttgaagccctaagccccaatgtgactgtatttaaagataaggcctttaaggagacaaagtgaaatgaagtcataggcatggggctctaatccaatgtgactggtgcccttataggaataaagagagacaccagggaggtttgtgcagaaagagaaggccatgtgagggcacagagagaaggcagccatctacaagccaatgagagaatcctcaggaagacctcactctgctggtaccttgattttggactcccaatcctcaactgtgagaaaataaatttctgttgtttaagccacccaacctatggtatttggttatagcagcctgagaagacaaagacacccctacaacctaccctccactctcatctccaacacacacacacacaaaattttaatacagaggagcataaaatgagtaagtaggtttgatatgtcacttcctgttaataagtgaggtgtttttggatcctttatataaagaatcataggggcacattctagttgtagggatgagaaaagattaaattcttctttctcactgtcttgcttacatagtacagaatagatactggaacagttggtaataaggacagttccttacaattactttttatttggtttttttttttttttttttagttaaaaacccatatgcttgctgcttctgtttctgtttttcactcttatgatacataacaatatagcaccatgcccaagaggggactgagacatttcttgatgacaataacagaatatattttgactacttggctatccaaattaaataacactgacttcaccaagaaaaatattaagtaaaatcaagcaccaaaagagcttgaagataaaataaaaacttccaaaagggaactgataacttgggtttatagcccagctctgccacgtacttgcacatacttgctacgtgcccttgaggaagggacttaactgttttcagcccgggtttctccatctatgattcatagataatgaaatctggaagatgaactatgtcaatggctcagcgctgagtaactgtcagctctatttacttagattctttttacatggctgctgttcctgtgagcccctggcatgttattagtgccacagcaaactttgggcctctgggaacacgagtggttttttagggagaaaccactaaatgattccctggaacctaagtcgggatgaactgcttcttcctctgagttcctaccatatctgtagctctcagagcaactaaattcattcatggactcatttagttaatattttatgaggaccctccttgtgccaggcactgcactagataatgggtattggtttctgtctgcatggagtttctaacctagacagggaaaaaaataaggaaataaggtaagtgctttgttgtgaggtttggttttcttttgttttagcaatcagctttcccaggctgaatgttgtgaggttttaataggtattctgggattttgataaaatgtttaaaatcatgaaattttaccttttttaaaggaaataggcaaaattatgtgcataggattgtatagggtccaggtctgggaggaagaagatgtttctgtggatacaatagcttctctcccttatgggccccatggagcccaaaaatatagatgatgcatactccttgtcaggttagtttattttcgtagctgtttctgaaatgtagtactatgaaaaataatgttgagtgggtgggaagaaagagtgaactaacacctacccccctaaaagcaaacttctttgtcttcgggttcagggggtacatgtgcaggttttttccatggatatattgtgtgatgctgaggtttgggattctattgaacccatcacccaaatggtgaacacagtaccacttaggtactttttcaactctttcccctctctctccttccctgccccttttttgagtccccagtgtctattcccatctttatgtctgtgtatactcagtgtttagcttttacttataagtgagaccatacagtatttgattttctgtttctgtgttaatttacttaggacaatgccttccagctgcatccatgttgctgtaaaggacataattttgttcttttttatggctgtgtagtattccatgatgtatatttaccacattttctttatccaatccgccattgacagacacctagattgattccatgtctttgctcttgtgaatagtgctgcaatgaacatatgattgcatgtgtcttttgggtagatcgattcattttcctatgagtatatactcagtgatgagattgctgagtcaaatagtaattctacttttagttctttaaaaaatcttcaaactcctgaaagcagactgttcttgaatgcataactcaacatcatcgaatgccttaactcattcgaattaagaaataataaattcccactgtgctgctttttatactatttttaatatttttatattttctttatattatttattaaagaaattaagaaagtgaatagtgaaaaaaatgtcttcaaacactatagaagtaaacatttacttgtgcaattaaaaatgaggggtccaggccaggcacagtggcccactcctgtgagccactttgggaggccgaggtgggcggatcacttaaggccaggagtttgagaccagcctggccaacatggtgaaatcccatctgtactaaaaaaaatacaaaaattagccaggcacggtggcatatgcctgtagtcccagctacttgggaggctgaggcaggagaatccttgaacctaggaggcagaggctgcagtgagccaagattgtgccactgcactccagcctggtcaacacagcaagactctgtctcaaaaaaaaaagagaggtcctccccccatctcaggtctttgatattctaatgatgaatgtttttgtttattaaaataggatctttaactgtcacttctttattattccaagataatagattttagaattttgaagctagaagggatcttaaaaaactgattcaactttcttattttaaagatagggaaacaggagagaggagaggccaaagtgatttgctgactctggccaacagtcgcagcattacatttacctaagcatttatcatttaaattattccctgattcagacaggccagctctgtatttaatttgaattcatgggcctttccctgtgaacatcaccctttcagtgaagagacattgcaagaaataaagccaacaacctaccacaccagtgtttggaagcaaagttcctattcaggtctgttccgatgcaatgattgttcgcatagaaagaacggttctttctccacattcgattctacataaacaaaatacaaacagacaacctgggtagccacgttcaaggcctgaggaaagacatgcatttgaaagtccatgaagccagaattgcctttctctccttcaatcccataccttgcatggcttcatcacatcactgttgttgcaatattcctttgcacggtccctattgctatccgggtttcaatcacatccactcagactattttagttgaaccaaacataatggtaatatttgatcaattttgactgatacaaataaagatttcctttcattccactaggctgcttattagccttcttgtttagtcttgtttcctttacattaattttatgcacagggtcattctgagctccttcgaagaaaagcaaaataactttgtgtctcaactgaacgctgagtcataagttaaaatgctctctttaggtagaattcaccactcccctttcaaagctagaaaaggtggagatgtgaagacacctttaatctgatgacttcttcgattgtgctgatttgactctggtttttaaatataaagcaaattccctattgggttcttggggtaaactgggaaagtttggtcatgtaaagagttgcacaggccgggcgcggtggctcacgcctgtaatcccagcactttgggaggccgaggcgggcggatcacgaggtcaggagatcgagaccattctggctaacacggtgaaaccccatctctactaaaaatacgaaaaaattagccaggcgtggtggcgggcacctgtagtcccagctactcgggaggctgaggcaagagaatggcatgaacctgggaggcggagcttgcagtgagccgagatcttgccactgcactccagcctgggcgacagagcaagactccgtctcaaaaaaaaaaaaaaaaaaaaaaaagagttgcacatacttcatttaagttctgagtttgggatgatgtagcacccttttctcctactctcaccaaccctccgccaagccttccagcctgttaccactcccaggcctgtggttccgtggcaacaataggccctggggatatcaagttctcaaactgtgggaattaataatagggtaatgatacaaagaacagttgggaagctggaaatctaaagggtgactgaattccactgtgattcaggttaaggtgtaaatatactttattaccagtttacagatatgaccattcattggacaccaaatttgtgttaggcattatgctaggtaattctcatttacttagtttggcatttgcccacctccacctacaaaattttcagttacagtattcctctcaccagagatgactttttcctcaatctcctgtgccatttccatatcttctgcataaattacctcctacatgaaataattcatgtgtaattccatgtttccaatcacaccaactaatcttattcctcttagtatttatatgtgctactcaagtaggtttttctaaatttatatatacctagttatgtttctatgtgcccctctttaaattagaaagcagagtatttcatattgcttgagtaattttacatgaatcacaatgttgagtaaccagaaaatacagacagaagagcatgttaaactacaagatggtaatgcaattagcaaatcctgataatgggaaactcttttctttgacaaataaattgcaaggaaaaaaagaagagagagaaagagcaaaagatggaatgtgagttcatggattaaaatagaattaaaagacatataaaccaatcataatgtaagagccttatttggatccagaatcaaagaaacatactttttaaaaagttaggaggccgggcgaggtggctcatgcctgtaatctcagcacgttgggaggccgaggcaggtgcatcacaagggcaggagtttgagaccagcctggccaatatggtgaaaccctgtctctactaaaaatacaaaaagcttagccaggcatggtggcaggcacccgtagtcccagtggctcaggaggctgaggcagaaaaatctcttgaacccgggaggtggaggttgcagtgagccgagatcgtgccactgcactccagcctgggcgacagagcaagacaccatctcaaaaaaaaaaaaaaaaaaaagttattatacaattgaaaatactggcaatattttatggtattcagaaacagctagtttttaaggtataattatactataattatttttttcagagttcttttttttttagaaatgcatactgaaatatttattgatgaagtgatatggtacctaggatttacttcaaaataaaatgagtaaggtagaagtgggtagagagaatacagatgaaacaagactggtcatgagttaattattgttgaagctctatgatgggtagatagaagtttactacacaattatgtgcacttatatatatatttgacattttccacaataaaagttaaaaaaaattaataataaagccattgtgcctagatccagaattctatgaataattcaacctgtatatcctatatccccaaggagaacatgatttgtcttctttgccttttctcctacctttttccatgagtagtcataaccatccacattaaccactggcataacatagaaatccacaagcctcaggagattggtatattgccctattatcccatagaattgagttatctgcaaattaaaccaagtatatttaattagatgttttaagttcttctaaacttagtgtgtttctttttcttttttttaatttgtcatttggcatgtttagatttgcagatttaactttcagaaagagtgctaattcctcaaaagaactgaacttagggtgctacgaagtggtgataaatgccttacacgtggtccagtattcctagttaatgaaggcagacaatcgaaccataaactttctaaattttccttaaaaaataaaattaattctttattaaagccatagagcccactaagaagatttaaggaaacaaaaacctagatttagtttagctcctttttctgtaattcatgttcatcagagcttaaactacctaccatgttttatccccagatgtgattacatgatattggctacattgtccttagaacttgtggagctcaagttttgctagaattgagtgtgtttcccaaggctttgatcatctagctgtagaattagggtagcttttcctaggaactggctatgaattcctaacggacatcatctcaaacttgttcctctctactttagagtcatccagcttagtggcacatattgcagtgtgatccaatggcatccaaatttggtgactgagaagtttaccccaaaatgacaaaatgtacaggcaggagaactataaagacaaattttagctggtcaaatcgtttcatctaggacaaagcttttggttcaaaatcttaatttgtggcaacattgctatattttaatttaattcacatttaattacattaaatatttaatttagtttataattgtttgttgccttaaagcatactcatgacattgttaagaaatgtctttttcattattgacaaaataaaaacaagccttttataaactttactattttccctttaaacgtttaaaatattatattcatatttccctagaacaatcacaagagtcacattaaaaatctttgccatgaataaatacttatgaaatcggagagaaagaaaagaaaaaagttattttaaaatctactgtaggtcagaaataaaaggttaatgaaaaggaagcaaaatttgtagaatgaaggaagccatgttttgtttttttgtttgtttgttttttattatactttaagttctgggatacatgtgcagaacatgcaggtttgttacatagttatacacgtgccacggtggttagctgcacccatcaacccgtcatctacattaggtatttctcctaatgctctccctcccctagccccccacccccgacaggccccggtgtgtgatgttcccctccctgtgtccatgtgttctcattgttcagctcccacttatgagtgagaacatgtggtgtttggttttctgctcttgtgttagtttgctgagaatgatggtttccagggaagccatgttttaaatagtcgagcaaccagttaaatacatttttatgttacgaatttataaatttatgttagcatcacttttcagtaataatgtagcattcattattagaaaaatattaggagagcctgttccttttaaaataataaagcaaataataaagcatttctcattttcatttctacaacatgggccaaacttttaatagatgcagcatatgaatttctttttctgcttcactttttaaatttccttcctacctttacctctggttggatgggaatctttctacaaaaagttatgctctgagagattaccgatgttaggcccagaacaatgttacctatttctttatctaataggtaggactccagacagaaggagtgagtgagggctgaaatacagtctgtgctgtgtgccaagccacaccttcaagtgtggctatagctacaatcccgaaggaaggggtgcccattttttctttaacagcttattgagatataatttacattccagaaattcaccattttaaagtgtgaaattcagcggtttttggtgtattcatagagttttgcaaccatcactaatatctgatttttggaacatttcatcataaaaaatccccatgcctatgcccattataactcactcccctttccctcctgccatttccccaagcctctgacaatcactaatgaactttctgtctctgtggatttgcccattctggacatttcatataaatggaataatatatgtggcattttgtatctggtttcttttacttagcatagtattttcaagattcatctatgttgtagcatgaatcagtatttcattccttttgattgctgattgatgtttcattgcatgaatatgctgcattttgtttttctgctcataagttgatggaaatttgagttgtttccactttttgactattatgaataatattgctataatcatttgtcaacatatgtgttcacttgtcttgggtatacacctaggagtagaactgctgggtcatatggtaactctatacttaatcttttgaggaacttccacattgtttttcaaagtgactgaagaaattttgcctgacgacaaataaatatttgttgaaggtacgatttaccaacatggcaagtaacataactgaaatcctgtcctactagagttggtctgcaatatacaatgacttcacttatgattttttgactttacaatagcgcaaaagcaatgcatattcagtagaaaccatacccatgccaccattccatttttcagttttagtgcagtatttaataagtgatatggatattcagcaatttattataaattaggctctgtgttagaagattttgccctactgtaggctaacgtaagtgttctgagcacatttaaggaaggttaggctatgatattcagtattcggtagattaggtatattaaatgcattttttacttagaatattttcagttgtgattgtttattgggtatattgagacataaccccaccataaattgagaagcctctgtataaaagaaaaagaagatgagaatagaggagaatggagaagagtgtaagactgagtgatgagagggtgggattgattcccatcagctggcctgtggtcaatgattactcagctcttcctctcactttgcctggggtgcactcaagctttgcctttaatgtggccctaaacaacaacaacaacaacaacaattcctgcctaggaattaaccaatgaccatttgagagataataaattagtacataacgacatataggtcagttaatggggttgctaaaaaaaaatataagacacatgaagggaaaattttaaaacaaaatgtcattttcattaccattacaaatatatcagagagctatccgtctcagtttttactccaatctctatatatgtatgtatagtttgaactgtagccaatgacaataaagtatttatcccaacagtaggtactgtttagatactctctgcaacccaaaattgtatgtcagcctaaacctgcaacattaatttaaatttcaaattccacaaggggatattgagcaccaattatgttgaccaaacaatataccaggttatggggaacaaaaaaattactttagacctggtctctgccttcagaaagctaatagaagtgataagttggaaagggaaaagcagcagttcaatgctattaatataagtatgataataaacaatggcaagatgtacaaggtggctcagaaaaaggatggttaattctgtggagtgtttggggttggaactccagaagagcaggtcaagggagcaagaaattgagggttcggatgaatttgtgatgggaccaattagtgaagaaagtgttcctggaaagggactgataaattaaaatgatatagatctgtgtaggaactagaaatatgctaaggttgaaaaaaaagcagtcatagtaggggtgagaaatgagagaagacaggaaattaagaagttacattgctagatggcttcttctaacattccttgttgctgtccatggccacattctgggtctaaggatcagcaaaacattacttctgagatccagaggatggctacaggagaaatctgctaaagaggagttgagatgaggtttagtagaacagagaacaaggaactgtgaagatacattgttaggtgactctcacacatggactttgaattcactcagaatgatggcaagagttggaggggaataaagaatcatgaaccgggtaccaggaaattatctgaaggtcagtgcacgatagcaataaaataagagtgcaaccagtttgtgtaagtttctgagaagagaaggatcattggtagtatcaggagaagagaatgctgatctactccaccaggcctctcagcacatggtgatgtgaaaaaaagagcagcccctctacttgaaggagccaccagggagcagtgtccttaggtcatgtgtcagctgtggtgaggaggggcagagataattctgtgaaggccctgaggttgtagagctctaactttgtgtgcaattagatgagagttttctagggcagaggtttggcaggaggttagcagtgagaaaagccatttggcagaaaaagtacttggcaagttgtgatggttaacatatattcactgggtcctatgatgtgccagccctgtgccggattttggcttggtgatgcagtcatgcacaaattggtctcagctctgcctttgcggaaagagaaggatctaaatttgcctcccgagagtacatgaatgagaagcttagaaagaaatgactggcttcaagcttctcaaagtgtagtgtagtggatttccactgagactagattataagatttttgaaatccttattgagttgtagaaaagagtgagagacttaaaagctaagattttaatttgcctttgggtggtttagtttttgaatataaaacctaccttcacaattgttgaaaggtaaatattttattttactttccctcctccagtgctttgaagtactaagagagtcagatgatctgaattagttttaggcaggcaagaatggagtttaaatgtcgatttaaaaagcccttattgattatgtttctttgggctacacaaatcaggttcacattgttggagcaaaatactcagctataagatccttgggctatattttgttcatccttgtatttccaggatctgaaacatcataggcaatctataaatatttgtggattaaataatttaatcttacaaagattcagcaagcagtttgggtagagggtaggatgtctaataggagggcagaggtgtcagggtgagaagggcagtcattagggacaacctcaccgatataaattagagtcaatatgaatggaggtttcttcttggcccttctcatgttcagtgatagaatggaaaataaatgttcttactctcctactttggacctttctctattaactgctgctcccttcactacctaaaataaccaaactactcaacttggggaaggttccagatcatgatgtgactgggatatgttaagggtctgatcagttggaatcatcctcatttggccaaggtagtaccaatggtgtttgggaatttccagtagactcagggaggttgcagctcccatccatggagaatggaggatagaagattcacagtgaatgaaggcaaatagggatgttgcatttgtcaaggtcaagcaaagacagaaacagttttatcttgatgtacttaataagtgccaatatcttaatttcctaactcatttattctgttactatgtatctgtgaatgcaaagactgcaaaaatcattatcagaaagacacatattttgagttatttttccagtggctatgattctttgtagaaatcagtgtagagaacatatatgcccattttataggatttgaagcataatttttactgttttcattcatcagggaggttaatagtcgttatatcttttacttttccaacatacagtttgtcttatatatggcttttttgatgcaaaacccttcttcaggaacaaaattccctattatgacatatgagaaaacatattctgtttcacctctgtaatgttgtgctttatgttcaatttccaagggcaaaggtggcaaaagatgtctggataattaaaaccaaaagagaaataaattaattgggccccaacttagataactccttcagtcctttcctctacttagtaaacatattataatcaatgtactatttcttaatcattttccactgtttagctccaggcagaaatgtagaaaagaccaaaaatattttgggtgatttaaatgcttgaagtcatgttcttcaacttactaatgcataaaagtcacctgggaaacttgtgaaaattgtagattcccaagcttcatgatgtgacctaggaaaatgcattttaataaatagcccagttgagtctgacacaggtgatcttgggcaccattttgagaaatagggttaagagaatgtgaatacttacatggcctatgaaccacaagcagaaagcaggagagatccattctctggcatggattccacagtcaatccatatggcatttttggctgcttgttcttttccagaaacctgctcaaagaaaccccaaaagtagcaaaaacagtaacaataagcttcaggataataactttcatttatatagtgcttatatttaatagtttcagcaaatctctgagatatgcattgttctgcatttctttgaaaattctcaagggaaatttaaacactggtgatactaagtgacattagttaaggtagcaaagctggtgtgaattgaaactgaagtttgaagccaggactctttgatttaaaactgtttttatcctccacaattatgcagtcatgtcagagctgcatgtggaagtttcaaagaagagaccagagaactaatgatttgggctgtatcttcatgcttcatttagaggtaaatgggtgtgagttggatggcaatcttccccgggaggtgtggagacacacccagagcaaaaactccctcaagattttcctgagtgcatattttttttttatgtggattatttctttatttcacacaaaaagaagcacacatctaacctctcacgaacttaccagcaaatccagggacagaggcttttttcccagtatggtgggctaacacaagctgctaactctggaataagaatcatcaaccttttctcaataatagcctttgatgtctttagaagaattatcaagaacacctccaaaattaatcataatgtatttgcctttaaaagtcagctacaacacagtttagggtatagagcagtggtccccaacctttttggcactagggaccagtttcatggaagacaatttttccatggatggggcagagttggggtggaatcagtggtggggatggtttggggataaaactgttccacctcagatcatcaggcattagattctcctaaggagcatgcaacctaaatcctttgcatgcgcggttcacagtggggtttgtgctcctatgagaatctaacgctgccactgatctgacaggaagcattgctcaggcagtaatgcttgctcgctggctattcatctccagttgcgtggccgcgttcctaacaggccatggactggtacctgtctgcagcccaggggttgaggaccactggtatagagggaagggagaagactgttgtaaaatcaaacaaatatgtagacttgcaattccaaaataagaaaaagaaagagttagatatttagattgtcatttgaaccactccaggaggttttttcctaacttggagctagcaatatttaacaggatagtaagtaagaaagcccaatggcattggccactaatcgtcaaattgtatagtcaaagagaactacctagcttaatctactcaatgcaaagaaaatcttaagttgtctggattcgttactttacttgacctttctaagtcctgggccaattttcttggcactggttctgacaccgaaaagttggcaaaatcccagagactcacattatctgcacatccttgatcaagtaagagtaggaccaaaccatccagaatgcatgatttttcaacgtgtacaggttccagataagtatgttccaaggactacacacaacatggctgaaagcaaatgtcatgggtggatatgccatgatacatggatccaatctgattgaccaactcagtgaccaaggggacccaacatttcatatgtctgccttgagtctgcactgtaagttcttgtaaacgacagattaaaattgagaagtcctaacccaaagtcttatctttgaatgactgaagaggctcacctatcacaatttagataatattgggatactgtgcataaattatatgttactaaattaaatgtacatttttagtgactacattattttccagagctttaaaaaaaattttttttaagagagagaggtagaaaacagaactatagagttgtttcctagttctgaaaacaattggctgtggctatgttcactgacctttactaaggtcaatttattcaagagagaagacatccaatccaagttaggttaatcaatttctcttgcataatattttgcaactgaaaataaataaccaaatgggtggaaattggagtagaaaccatcataagaaccctactgcaaaggacttcagccttgtccggctgtttgtcccttgctgggatttgttgtcctggtcttactttagtttcaaaagctgtaccaggaagtactaaccagagcaaacaggtaagagaaagaaataaaaggcatctaaattggaagggaaaaatcaaattatccttggttttagatgacacgatcttatatttagaaaaacctagcctccaccaaaaaactgtgttagaactgataaattcagtaaattgcaggttataaaatcagcacacaaaatcagtagcatttatatacaacaatagcagacaacctaaaagaaaaatcaagaaagaaataccatttacaatgaccaaaaaaaaaaacctataataaatctaaccaaagaagtgaaagacctacaattaagaccatagaacactgatgaaagaaactgaagagaacacacaaaaaaatgaaaagatacctcatgctcacgggcttaagaattaatattgttaaaatgtccgtactaccgaatggaatctacagattcaatgcaatccctgtcaatatcaatatactcttcatagaaagagaaaaaaaattctaaaattcatatggagccataagagatcttgaaaatccaaagcaatgctgaacagaatgagcaaagctggagtactaaaacagcatggtactggcataaaaacagacacatggaccaatggattagaatagagaacccagaaataaatccacagatctacagttaactcattttcaacaaaggcaccaagaacatacattgggaaaaggacagtcttgtcaataaatggtattgggaaaaattttattcataaaattcaaactaaatgcctatctctcgccttatatataaaatcaactaaaaacagattagaattaaatgtaatacctaaaactataaaactactagaagaaaacattgggaaaacaattcaggactttggtctcagcaaagattttttgggtaagatctcaaaagcacagtcaacagaagcaaaaatagataaaggggattacatcaaactgaaaatttgcttctgcacagcaaaggaaataacagcgtgaaaagaaaaaaatgggagaaaatatgtgcaagctatccagccaacagggacttaataaccagaatatataaggaacgcaaacaattcaaaaggaaaaaaacaaataatccaattttaaaaatgagaaaggaatctgaacagacatttctcaaaagaagacacacaaatgggcaacaggtatatgaaaaaatcctcaacatcactaatcatcagggaaatgtgaattaaaaccacaatgcaatgtcatctcattccagttaaaatggcttttatccaaaagacaggcaattacgaatgctagagaggatgtggagaaaggggaacccttgtacactgttggtaggaatgtaaattagttcagccactatgaaaaaccatgtggaggttcctcaaaaaactaaaaatggaactaccatataagccagcagtcctattattgggtatgtatccaaaagaaaggaaatcagtatatcaaaaagatacctgcactcccatgtttattacagcaccattcacaatagtcaagatatagaatcaacctaagtgttcttcaacagatgaatgataaagaaaatgtggatgtggataaagaaaatgtggatatgcatgtggaaaatgtggataacaaatggaatattactcaggcattaaaaggaataaaatcctatcatttgcagcaacatgccctgaaataagctatgtagggaaagacaaatactacatgttctcactgatatggggagtggaaaacgttgatctcatagaggtagagagtagaatggtgattaccagaggctgggaaaggaggataaagagagattaattagtgggtacaaaatagatagaaggaataagttctagtgtgtagtagcacagtagggtgacgagaatcaacaatatttcaaaatagctagaagatgaacttaaaatgttcccaacacaaagaaatgataaatgtttgaagtgatggatatcccaaataccctgatttacacattgtatgcatgtatcaaaacatcacatgtgaggagggagggagaaaaaaaatcacatgtaccccagaaacatgtacaattattatgtatcaatttttaaaaattaacatcaaaaagctgcaccactttttttaatttttaattttattttttcaagtccctgttttattttctgttagtgtttgtcccctaacagaaatagtgtttgtccactaacgaaaataaaacaaggacttgaaaaaaataaacaccacttccttcattttatggaaatgttaaatggcttatctaatgtcacataaacagaaacagagttaattctagaactgggattcatctagaattgaagccttaaccccctagagactgtatttggagatagggcctttaaagaggtgattaagttaacatgaggcccttagggtgggtactaatccagactgactggtgtccttgtgggaggagattaggacatacagaccaggacaagactatattattaatgggaaaaataaccaacccctaaatagccaggtattaaagttgaggaacacttgtaatgcaaatattttcagaactcaaaggaaacaaactcaagttttaacaaacacgactggagaattaatccctcccctcacagtgaaagatcaacaactttccccacaacatacctttaaaacatagagtgggtacttctcaaatgaggatccaatgtggatttttgtaagcatatcaggatgcctctcagttataaattctatccaagaatagatctagcaaaatggaaaccagaggttagtcacgaagccaagttcaaagcatttccctgaccaaagcaagcagacaacttcttcagagaaaggaaaacctctgtatgtggaatgcacgaggacctaaagcacttagggcagggtgtttcttctgctgtttagggaaattaataaaattaaagttttgataagtgtcaaggttttgagaaagagtgaaaaagtgctaagatacttataatgaggtaggaaaagttaatctataaactatggcccctgaaagttacttttaaagtcatcacattgagtcactgcccctgtgtatgaaattcttgttctcattcattcaaaagttcacttttatatgagacttttttaaaaatgcacttttcaagatgaagggagcccttagcactgtcttcatgcaggataaatggaagcatcattgtttcccactaaagacctgtgcaagaacagtgagattggcacaatgatgagaggcaaaggtggggaccatctggaggaaaaacaaacaaactcaattatccccccaagaagtagttcgattctggacctctctcttgggtggaagtccagttgtatttgaggttctgtcaagataataggggaaggaaaaagcaaaaaaaaaaaaaaaaaaaagaaaagaaaagaaaagaaaaaaattctgactttaggctagcacccacttcaaagcaaacattgaattattgtctggtttgggattgctgggattgaactgggttatgttttaatttggaccaactttccagggtccattcttaaactctgatgccttctgaaacagaagcaatcaaaccctggctttatctctgggaacttttctagaggtgatttcaaatagcaatcctagctggtaaaaactggagcaccatttatccttgggttctctgagatcacataaccagcatgagtggtaggtgtgagtggttgtccccatgctgagaattaagggctcctgcccacctgccaccaagtaccgaccctgtcagtgtctggggtgtcagaaatgtaactgtcagcaatttcctaattgaatctccatttcctgtgttactcttctaggcataaatacatctgagaaagctaccacaaaaaaataatttatgcattgatacttcagtagatttcctctaacaggagaggctgtataatatgaaggcagtttaaccgacagactttattcatttctcaaactaagctggggtaataatgtaacatcctttgaagaactcttttctctcaccatttcttctaagaagtaatttttggccatttgtttctttctccctacaccggatcatttaagatctcctggtgtgagtcaatgacaaaataacctctgctgcccaccagtccatcttgtaggtagggctgatcaagagaccaccgatcaaagggaaagaagcacttagaggaatattctgagagcaaaatgcttatggttcctatgaacctgttagaaaataataggggcgggggtgcaaagagaagcacaagacattttctataatgtcatagttaaggagtagatgttgtacccctttctccaattcatatgttcaatccctaactcccagtaggttagaaagtgactgtatttggagatagggcctttaaagagatgatcaagtcaacatgaggcccttagagtgggcacgaatccaatctgactggtgtccttatatgaagaggagattaagatatacagagagagaccagggatgcatgtgcacaaacaaaaggtcatatgaggctgggcatggtggctcacacctgtaatcctagaattttgggaggccaaggcgagcagatcacttgagctcaggaattcaagaccagcctgtccaacatggtgaaatcccatctctactaaaaatacaaaaaattagctgagcgtggtggtatgcgcctctagtcccagctactctggaggctgaggcaggagaattgcttgaacccaagaggcgcaggttgcagtgagccaaaatcatgctatcgcactccagcctgggtgacagagagaaactctgtctcaaaaaaaaaaaaaaaaaaaggaaagaaaaggcatatgaggaagaacgctgtgagatggcaactacctacaagctgaggaaagaggcctcagtagaaaccaaacctactgacaccttgatcttctagcctctagaatcatgagaaaacaaatttctgtgatttcagctacacagtctgtggtattttattaccacagccctagaaaactaatagagccatgtgcttattttttcctcctgtgtcattccaactctttcctgaacatatcgtaagaaaacataacttttttgaacaaaataattaaaatatgttttaacaaatatttaaaaatacttctgtttatggcattcccctctccccaccaaacttatcacagcagtgacagtttcaccttttatgaaggtgaaatcccacctatgaagcctctctgcatcaagtttgctcatgcagtcgtgctgatggatgctggagagaggtggtctaagttggatagatgtaggagagattaaaaaagggggggtgcaattttaaggccccctcaatcaaccaggcacacattctagaagcatactgactctggcttaattaactgggaaggaacagatgcttttaaagattatatacataaaattgattctcattacctaagtcttagatgtcttaaaaatatggatatggtccctaatagtttctgggcacttagtcaaagatgacaaaaatagttatattaggcaatatagctgcatactcataaaaaggcatcaaggtatttttactacttggagaatatcatataaaaaagaaagtcctcctgcgaatttattctttcaactaacaaatacagggaatggcttttagtggattatgtgaaagcttgctgaggtctcacctgcacatcaacatcttactcaagttctctctagaaggagtggaacctgtaagtactgatagaaaaaaaatccaatttcttacagattaaaacaaaggcattattattattattagtttaaatagcttccttctaaggaataaaatgcaattagttatagtgtattaaatataagtgaatatattcctttaattcagtgagctaatctggtaattagtaaaattagggtaatggtccaaagagacatgattaattggactggtaattttttggtggcagttttaattaaaagccccaattctttaatttctgttgttccatagcataaagtgttattcccagcagttagagatattcttagctgtagacaaacatcctgcagtttaccaaatatgatgcagtcttctcagggaagatatctaccaaaaaatgaatgaccaccatttaattaacctaagtgtgtttgtgttttattttttaccatcttccaccaattatgattcttgaatattcccctgattgaaatggcaatactggttaaatgaaaatagtagctttgaagagctgtgtgatggcttacttcatttagtgagtgatactgttcatagtacgatgcggaggctcgggggctgactgtgtcgttggaaatctgctgttgaataagatcttccacatctgccagcaagacactaggtgatgaaacagagagtgagctagtttccaagcagagggtggatcttcccacatggcccattgcaggcacagcaggtgagcatgaagaaaaaaaatcactaagaaacttcataagcatttcatcaaggtaaaagtaagacatctcgcattgtggtaaactggttgacaaaccctttcagtagagcctacatgggcactagagaaaaagtagctcctattaggtatactttcaggacctccataaaaaccaccgtttcccaccattaccaacattactcaatggtgattcttcagtgtcttttatatgaatatatggattaatgtacctttgttcaatccagactaacactgtattatgctgttttcagttaaagaggaagaagaagcagaaaagccttttctttctttttttttttttcttattttttcccccattgacctgcatcagatgttctgcagagccaaagaaatagaacaggaaaagggaagtacaggaaaggcatctcattcaagttctcttcagagcaccacatttgttaaccaggcaaatattttagctgaattcaggcattctatcgcctgagatggacaagttgaaagttagctatcatactaataaagggttctttacttttatttaggccaataaataaaagccgcagtgttgacatcagaaaggtctaagttcgactcctaactctgccatgttctttctgatttaccctgaaaaattcctttataagtaaggatattttttcatctatataatggggttgcatctacttcacggggttaaataaagattaatagacacaatgtcaattaatagaaaggttcagcacagttcctggaaaacagtacacacctataatatactctataatatattactaataattaacatagcatattatccagggggcacccattgatacacagaagagagcatggtctcaaggggccaggccaccaggaaggtactggcagttgggcagtggatatggaggggagatattaggagactccataagaagaaggctagactgtgagcagaaattgtacctgatacactttttaagaaaaggaaatcatttctaatccacagggtaggtgctgtttttacccttaatatacaaaacttgggagcagagaggtgaataattcccccagggtcatataggtggtaaggggcagtgccagactaacccgaggtctctgcagagtccaaccacctgttacactttttaaagccagacattcagaaatggtcactgtctttgtgaagaagaattagcagaagctaaatcccctcccgaagctgctttttcaggagatatcaaaaagcctaccaaggcaaatgacagttttgctccctgagtctgggtacagagtcagagaaaaaggaactatgagagcctttaccaatcactgagtctaacctgcattttagataagggacggaggtcatgaggggttgaaccatttatccaagatcacagagctggaccttaggctttatcaccagtccatttggtccagtcagagacttctatgctgccatggttaatacattttatttttccaggaagcaattataccataccctagtcaagtgcatagtaagtgtttataataactactcaatacgtattgaacggtgcctacctgcatggaattccgctcacatttaaatgggctttcacattgtcgacatcagatgcatttacaaaaaaatggacttgttttttcttcacaataaggtcagctgttaccggctgccagagaacaatctacagtttaaggggcaaaattgataaaattaaaaaagagttgttcacatcattctcatctgtagctagagccatgacagttttatctataaggagtatgaaaaggacactccctggtgctggtccccatccacacacatggtaatataaacatttattttgcagtgagttttttaaaattcctttctataactctagttgctaaaaaaaaataaaataaaagggcctggaatatacaagataatccataaatatttgatgagacaatgatgaatgaatgactatattcatggcttaactgtaaaattgcatgtgtacatcagatatttgaaaggaaacaaaattttttctagaaagaaagttgattaaacattgattttatttaataaaaatttcatgttcttgtaattatcatcatgtcatttttcctttttttaaaaaggcttccaataagatttacattttttctctcttaatgtgctttttatttatttatttatttattttttattttttattttttttttgagacggagtctggctgtctcccaggctggagtgcagtggcgcgatcttggctcactgcaagctctgcctcccgagttctcgccattctcctgcctcagcctcccgggtagctgggactacaggcgcccgccaccacgcccggctaattttttgtatttttagtagagacggggtttcaccgtgttagccaggatggtctcgatctcctgacctcgtgatccgcccacctcggccctccaaagtgctgggattacaggcacgagccactacacgtactttttcaaagcactttcacactcatttcctttgatatttataacgctttgatatagactaggcaggtgttattatttgcattgttcaggtgaagaaattaaggttcatacctgacatctaaaatcatacacctagaaatgacagaacaagaactagaattctaaatctcagatgcttcctcttgtagtatttcctctttaccatgatgtggtggtcgtgaatatgcaccatttagctcttcggttgagagaaatacagttggctggtgttttcagtggctgccctggtgacccactagaagctgaggccatgtggtctcagggctgcatccagccagtaaccgagtcctgtggaagtgttaatgcaggcccattcttgccagactgagactgacctagcccagccttctttggacctgccctatagtctgagattctccaaacaaaattcccctttctgcagaggtgtcagagctatgacatggtctgatgatgctctctgccttctccagctcccgcctctatcctccaacagcattcccctcatcgcttgctcctccagtctagtcttaacctctgcttcttggaaaacactaacaaacaaggagccatcaattttgtaccatgatattgttacaggatccctggggtcgcttcaccagcagaaacctctgtggtcagtggcgcctttgcctaagctttgctcaggcccgctgagcccactcggcctggcaggctgcactcatctcgtgctactggcttgggtctcattcgtgccaagggcgagctgagcggtgaggggtgtgtgagtgagcaggtgtggggtccagctactacacacagcgaggcatgctggctgcggcagggtgggcatctttcggctccctgcaaggctgtggctggaccaggtgtccctcaagcagcttcaatggctggcaccggggaaggtggtggcacccagaagtttggagacgtcaggaaccacagagccctaaagagggtgtcatagtcctgcctcggggagttcttaggtctgagctccccaaaaggctgcagctcttctctccttcttgtcacccacaacgtggcaagcaaggggcgtgtttcagctctgtttgtgttagagctctttcacctccaccatttggcaggttcagcgcccgggaacaatgacgtacgtggacaagcggagggtgagcaaggtgaagaggagctttactgagtaatagaacagctcagaggagactcgcggtgggtagctcctctctgcagccagggtgtcctgatgagtgttcgttctcagcagagaggagaccctggagtgggtggctcctctctacagctggtcctccccatgtctctccagaagagtctggctgaatccgggggatttctatgggcttcagatgggaggaagtgagtgctgattggttcatgggtggccataggcgggtgcggaaaaatcaccgtcagttcccactgcggtccacgggactggcagccttcctgggcttgaaggtggggcttcaccagggacccgcccttttctgcctaggatcctgtctgcctcctacggctatttatggcacccaggattttccagctgagggggcctgcaggccagtgccgagaagccctcagccacccccttggcttccctcctgtgctcgtcagtacccaaagtccagagggggctgaggcagcagggggctagcatgtcagtaccgctctgatcatgcacacagccagccaggttgtgacaacacctaggctcagcctcaattttgctccaagattggagtgagcaccaggaactcggagagaccagacagtgggagcaggcacttgcgagcctgtaggggaatgagggtccttctcagaacactgagagtgcagaaatgcctgggtctgcaaccccagctgggcagctgcagctgcgcccaggagggcagggctcctgcctgctcctggcccccaagagcacagggatgtccaggtctgtagctgcagcgggcagctgcagctgcgcctggggagcatgaggctgccgccctgccatcacagaagggggcgggacttttacctcctcctggcttctgctggctccgtggagcacacagccccagccgtgcctcccgcatggcagcagccgctctagatgggccgccactgccattaatattctgtaattcttgtcaattttctacatcttagacattatgtcgagatgggtgcctgggtgagaattttaataaatgtactctgtctttctggtgcatccttggttaagaaccattgtttcatgagtaaggttttatttataaatattttaatttctgttactgtagcctctttgtaagtgcacactttatatcccaaggtactattatgaaattggctggaaagccaatagcacaagtgaagaagtgttgatttggggaaccaacaaaatcatgtgattatgagaagggagagaagactatgagaagaagagttcataccagatacatgtaagccagacaacatacaggaggaaactcaacacccagtgcttatacaaagtgaaaccaatataaacataaattagggagaaattacctcatatgttgtagtaagattctgtagaacttgaacttgcctagaggttctaggaagagcagctagaacttggccactggggaaaaaaataaaagaggattttgatattaaataaagagtaaagatggaatatattatactgtgaggagcttttaggtaattgcaaaagggaaacaaaatttaaaatgttattaggacagaggatcttactacagattcagtgtaataagagaacatatactctcagtctttatgctcctaagcaattgcaaaatcaacagctctcttgactgggggtcagtttacagagtatttacttctttcctttttcttgtgcgtgcatgtgtgttttaattttaaaaattaaatatttgatgcataagggaatatttatgctgatcctagttaattatacaataaaatgaatgcctgtgaacccatcaccccacttaaaaagtccagcttccttgacatcctgaagatccttgtgtgctcctctctgtcctacccccttgccacatcaccagaggtatcctctaccttaaattttgacttttgctcattcccttgtttttctttatagcatggatttttaaacacatgtatgtgtgaattctgaaacaatacccttagatttgcctgattcaactttataaaaatggtatactatatgtattcttctgaatcttgtttttcttttgttcggtattgtattctcaagattatcatctgtgttgaagtagctagccatagttcacacgtgaaagcattttcttacaagtggaattgccatttcatgggatatgcacagttttaatttcataggatagtgtcatatcagtcctcaagttttttgtatcaatttatattgtcagtagcagtggaaaagatttcctgttgttcttcctccttgccaatacctgatgctctctgacttttcaacttttgcaatcaaatttttatgaaatgaaattttcttgtgattttgattttcattttctgacttattaatgaagtacagttgtttatatttgattatcggccattcatatttttgcttatatgttatgtttattcagatcaactgcccatttttttctaatttacttgtatttttgtagtagttaatttgtataatttctttatatattctaaatactaatttcttgtcagttatatgtattgcaaatatcttctagcagtttgtaatttgtcttttctctttcttgatgatgtgcttttttttttttaatcatttccttccaggtttgtgtggtttaagatgtctttctagatatctgggatataaagatattctcatatacttcttctgtccttcttatttaaattttaaattcaattgaaaattatttggttgggtgcagtgtaaagaagaaatagacttctttttttttcttcttagcatcgtttattattatgattttttacatcatctatatttttcccagggatccactatgtcaattttgtcatatatcaagtttccatactgtttggcagagaaaatgttggttcatcaacaccactgcctcttcctgcatagacagaaaaacttcattacccagccttccgtgtggttgtgttgagagccagtgcctgagctttgccaatgggaatgcgtgggagtgttataggtgcctaagagtaggtgtgtcttcatgtgcacgtgccccctctcatcctgcggccagaagcaaagagcctcaaatgtggagttgcataatggaagcagccaagatctccaagttgaaggagagcaccagggagagttctatgaccttcatcaattagtattatgagtgagaaattgctctgatctgaatgtttgtgtccccccaaaattcctatgttgaaatcctaacctccaaggtattaggagatgagggttttgggaggtgattaggtcataaggggagaggcttcatgaatgggattagtgaccttaaaaaagagatcccctcccccttccaccatgtgaatatatagcgggaaggttctgtctatgcggaagatagtccctccccaaacacaagaattagctggtgctttgtcatgaacttcccagcctccagaaccgtgagcaataaatttctgttgtttataagctgcaccacttaaggtattttttgttataactgcccaaacgtactaagacagaattaaccctatattgtattaagtaaagctgtttcaggttttattagtgattatagcataatcaaggattacccttgctaatataatgtgctctatttcttagttctctattatgttctattgatatatttgtctacccttgagccaatactactcatcttagtgatggtagcttcatattacatcctaatatcttagagaacaaactcttgcttcccctctgccctgcccaattcttttttttttacaagcctcttgtcttgatcctttgctttttcacataatttttaaaaatcagcttgttatgtttcatgaaaaaaatgaaattttcattagaattatattggatcaatagattaataatttggaaagaacagatatactcatgattctgagtgtcattattaataaatacagtgaatttgtctatttgtctattctttttttttttttttttggagatggagtctcactctgtcacccaggcaggagtgcaatggagcgatcttggctcagtgcaacctccgcctcccaggttcaagcaattctcctgactcggcctcctgagtagctgggattacaggtgcacaccaccatggctggctaatttttgtattttttagtagagacgtggtttcaccatgttagtcaggctggtctcgaactcctgaccccgtgatccacccgcctcagcctcccaaagtgctgggattacaggtgtgagccactgcacacagcccatttatctattctttaatgcctttccaaaagttttacaattttatccataaagatgttgcactttttttttttctttttgagacggagtctcgctcttttgcccagactggagtgcagtggcgccatctcggctcactgcaacctccacgtccctggttcaagcgattttcctgcctcaagcctcctgagtagctgggattacaggtgcacaccaacacacctggctaattttttgtatttttagtagagactgggtttcactatgttggtcaggctggtctcgaactcctgacctcgtgatcctcctgcctcagcctcccaaagtgctgggattacaggcgtgagccaccgtgcccggctgcacatttttaaattatgttttcttctaacaaatttgccttttcgttagtaaatggtaacttttaacatgccacctctaagctcttttttgctaagatatagaaataaaaatgatttttggtgttgattttctatttagctctcttggtagttttgataattttggtatagatatttggggggatatttctctttgcaagtaatcattacatctgcacacactattaggttggtgcaaaagtaattgcggtttttgccgttacttttaatgtacttaatgtacttttaatacgttctgcttctttaatttcaatgcttatagagccccttttccccttcctttttgtcttgctgtgttgcctgggacttcagtacaacattgaatagaagtggagataaaatgcatgattcctaatttttaagaaaaaccttaaaatattttaccattagaatgcttgttgtagatttttggtagatgtcttttatcagttttaaaaaactccttgctctttgttaagagtttttatgatgaataagtgtggattttaaatgctttctataagatgagcatatgggttttctggcttaatatcttaatgtggtgaattatatcaatagattgtttaaaaagcagacacttggttggttttctcacttttgctttgttgtatttctattttgcaactgttgctaaggttgtgagaattcttggtgattcttacacagccaaggcaatagattaatgtgactcaacatgaatttactttattttcacataccacttagaaaagaaagaatttcttagcaaatgtcctcatttctgcagctctccatccagttttataggtaagtgataaggagagaaaggaagcagtgaggtgagggattgtggactctgttaacggcaatggcattctcaggtttccagtataccactgagtaacctcacaagaactattttatttaaattaaaattaagcatgttggtggcatttgccagctctgagcccccccttttttttaactgaacgagatttttcttttattttcaaacaaatattgcccttgaaatatgacgatagatatattttaaattagaaaaaatgcttcctcttgctttatttaaaactaatcttagactttgcttccagttataccctcctttatgaaataactaaaaacctggacaaaatgtatggaacaacagcactcaagacattagacaacagcaacattatgactaaatgcaacatggtgttctggattagatctcggaacagaaaaagagctttagtgggaaaactggtgaaatccaaaaaagtctggagtttagttaatagtaatataacaatgttgatttctcagtttttactaatacatcatgataatataaaatgttaacattagggtatattgggtgaggggtatacagttgtattacaattggcaacttttctgtaaatctaaaaatattccaaataaatcatcttatttaagaaaaccatgtaccaagagctctcaaagcacaaaagaggttatgataacttctgtttgtcattattagcaaaggcttcatagaagggatgtctgggtgtgtaagaatgtctaagagtgggtaaaggcacaatagcaagagataaagggcatttttggaaaaatggctcttgttcattgttgccaagtataggatacgggtgtttaaagcaagagaagaatgggagctaaacagaaatgagtgtgggaagttatgttcatccttccctagagaaggtcttgaatgcatgctgagaaatttggactttatcttgtaggcaattagaagttagaaaggtaacatttgagctgtgatttatagggataattttatttgttttcctttgtttgtttttgtttgtttgtttgtttttgagatggagtctcgctctgtcacccaggctggagtgcaatggcgtgatcttggctcactgcaacctccaccttctgggttcaagcgattctcctgccttagcctcctgagtagctgggattacaggcgtgcaccaccatgcccggctaatttttgtatttttagtagagatggggtttcaccatgttggtcaggctggtcttgaactcctgacctcagacaatccacccgcctcagcctcccaaaatgctgggattacaggcgtgagccaccgcgcccaccaaggataactttaacaagggtggagggtggctttattttggaaatcctgagtaaaatattctgaattctggaaataagtctatggagagacttgcttattagaagaggggaaaagtagctagactgagaaattttatgtcaatctctggtacaagtttagcataaactattaaaccactgattaaagatacatgttcaaggatgtgtattacggcattattcatagtaacaaaacctaaaaaccatgtgaatgctcagcagtaacagaattgtcgaatgttggtagtgtctccacattctagaatgcttttcagtcattataaaaaatgagtttgatttataacagttaacttgggggctttaaatggcatattaagggagaaaagcaagatatggagaactttatgaaatatgatcctatttttggaaaaaaagttagaaagataaagaaaaattatatgtgttaaaatcaggagaaaattatacataaataaacaacacattgttagctttgatttggagggtgggaaatggcaattgaagccttgggtaagtggcaggggaagaacaaatgagattctttttaaaagaaaggtttctatagtaccaataggagatacaacattgaactagtatacaattatacccagggaggtataactatgtggagaaatgtatgaaaggatgatcacaaacatgttcatattttcaccaggatggtgaaattttagtattttctccctaattttatgcttttctgtattatttactttttaaacccaaaagaactcctattcttgtatttattcaagaaaattaaatttaaagaaaaatctcctttgactgtgaaaaagccactaacaagcttctcagtgatgctggtaaccctctcatctcaccagcacattccttattattttcataaacagaatgttctctgggcccttggagtagcgtagtcacccagtgggttttctagccttacatagcatttttattctagtgtgctctatctcttttttcaccatctgccacattcgctctgacatttctagctcagatggtgcaggccatgctttctccaagcttccaaaaactaccctaacagcatgtttgtaccacctctcaaggaactaactagaatgttaaattctgtagcatgggtgagtgcacctcctttggggtatagtccctttcctttgttaacatgcccagcacttccacagccagcttatgttgtgactaccctaggttattggcttgaaggccaggaggggaggtgggaatagatcctgagggctaactacaggacatgccattacagaactgagctctctgataccaatggagatgttaagatccctgtatagagaagccaggcgggagggcttaaccaccagtaacaagttgggcacagttattacaatgagcagtaaggtcggagtggcagccagaggaccatgacccttagaaaattgtggagtcggttaggagaacacagagttcttaggggcaagatagagaagcagccaacaaaaggattgctcaatctttacaataaaaataaatcaaagctggataatgagagaggctgaggacagctatcctaatcaaaagtcataatccattgcccttttccagatctgagctgttcttagacccagaatttcttgcctgaaggaggaatcaggtccccacaaggaaagaccctgcaactgtataaaaaaagaatctaaaaagatcatgactccttcagtcctttcccaaagagacctatggaaatttcctcaggtaagtctgcaccctggggaaagggtaatactcaaatattttcaggtgtgttggatgcagggtcactatccaagttgattttgaaacttgggtatctggagccctagcctaagactagctcatagcgggtgcaccatgttaatggattcccccatcattatttccctggtcaccaaatgtataattgacatgaacatactaggtagttggcagaacctccacattgtttccttgactgtaagaccagagctatcatagtgggaaaagccaaaaggaaacctctgaaattgcccaacctcccagccaagatatcaaaattaaaaaaaaaaaaattcatccttgaggggaaatgacaaatatcagtaccacccttaaagacctaaaagatgcagggatgatagatcccatcaaatccacatttaatttgccatctggatcccacaaaaaccagatggatcctggaaaacgacagcaaacaatcaaactcaaccaagcaacaatctcaattgcagccatagtgcttgatgtggcatctttgccggggtagagtctcaggcatatggtattcagctattgcgctggatatgtcagtcggaaaaagcatcagaacagttaacatccacttgggacagacaccagtgcatatttacagtcttgcctcagctttaattaactttctcactctccagctgcaagatgtgtacttgatataagcccccagctactgtgctctgaaatctgtccctgtgttagtgctaataccacatttcccactggcttcttgcagctaataactgagtatggtggggatactaagggaggctctttctacaaaactggaaactcttctgatgtgtgactctggctataggacttttttttttttttttttttttgagacagagttttgctcttgtcacccaggctggagtgcaatggagcaatcttggctcactacaattctgcctcgtgggttcaagtgattctcctgcctcagcctctcgagtaactgggattacaggcacgcaccaccacacctggctaatttttgtatttttagtaaaaacggggattcaccatattggtaaggctggtctcgaactcctgacctcaggtaatccacacacctcggcctctcaaagtgctgggattacaggtgtgagccaccgtgcctggccaggactcttggttggttttgccaaaactttcttagaactgcactacgacctgaaatgttccctacctgcttccttcctttcctctctcctccacaggggttaagcttgcattgcagtctcatggctctcccagcctcctccagccctctccccatttcttgcacccaagcattttcctcaacacacctcttgcacagctaatcccatcttggtgtctgcttctcagaggatcataactgacacaagtaggaagaggaagtctgatacatggacagtcaagttgatagtgcatgggtacaagtaaaaaatgaagtgggctgggcacggtggctcacgcttgtaatcccagcactttgggaggccgaggtgggtggatcacctgaggtcaggagttcgagacgagcctggccaatatggtgaaatcccatctctactaaaaatacaaaaaattagctgggcatggtggcgggcacctgtaatgccagctacttgggaggctgaggcaggagaattgcttgaacccaggaggcagaggttgtagtgagctaatatcgcaccactgcactctagcctgggcgacagagggagactccatctcaaaaaagaaaaaaaaaagtgaagtggtgctgcattatggactcactcgggtgaccgaaagagagcagagagggaaatcgtcccaaataggcagagcttcagtgttgcatctcatcatacaccttgggtggaaaaggtgtttccagtgttagaatatgcaggaattcatggagagtggcaagtgacatgactggaaaacccctcaagaacctggaagaagaaatcttgacagattggagacaaagagattggagaaagggggatgtgaatggaactatgagagtgggcagaaagtgtgaagatctttgtatcatttattaatgcctaaccaggagcacccacaacagaatagacattaaacagctgcataaacaaatgactcagccagttgatgtcagtcagcctgtgtcaacagccaccccaatgctggcacaaaaggcactagaacagaatagcctgatggcagagatgaagtgtgcatggctccagcagcacggactcctctcattaaggctgatctagctactgttgctgccccatgtctaacttgccagcaacggagaccaaagttgagccccggaatcagcaccattcctcatagagaccagctagtcactgggtggtaagttgactacatctgtcctcttccactctgggtatgggtttatctcgcctgcctgtagggcctcaggcaagcatcaccatacaagggcttacggagtgtttgaccactgataaaacatctcacataacatcctatcagatcatgggctccactttacaacaagggaattgcagaaatgggtccattaccatggaatccacttagcctctcacataccagaatacctagttgctgctatcctgttactgaaataaaaatggtttgttgaaggatcaattgaggtgctaacttggaaggcaacatcctccagtgcacactttaaatcaatactcatgtggtgctgtgtccctactaggtagtatacatggttccaggaaccaagttggagtgtttccatataccgtcactccaagtaacccactcggagaattagtactttaaatctacaaatatggactctgtacttataaaaattccggtttccagagagcataggaagagttcctttaaactgaaagctgttgttactgtccagtcatttcagtttcctcatgctgattgattatcaggaaggcgaggagttaccatgggttttctagccatgcaggaagggtaattgactccaataatcagaaggacattgagggctgcacttacatactgaatgtggcagggaagaatatgtttggaatccagcttaggcgttctgtaatattcccttgtccaaatttgatgtatacagacaattgcagcagccatggcccaagagggcccagtgattatgactcagatccttgaggattgagggtctgggttgtctcaccaggtaaaccacctagattagaagaggtgctagcaaagggcacctctttggggaaaacagaacgggtaggggagaagaggaatgacaagtattggttatggcctcgagactagctgtagctgtgaaggttgtagtttatttcactaacgttcctcttgtatatttcctttaggaagagggaccaagcaaaaccccagaagagttgatctcaaagcttattttatgaagaaaattgacctgagtgacacaaagggttggactgtagtagatgtcacgttttgctgcctagatctccatccagggatgaactcttatttcctcagcttctttgtctcctcagcttctgggagggttggcagctgatattctcacctgagtccctttctaggacttgcccttgcctgaagagagctgtgctgcccaacatgatgcctcctccaaggtacaatccacacccagtgactaataaacaggggttacaaaggcatgcctgcttgccccagtttgggacaactttaccaggccaacccagcctcaaggctctccacaggaacaggtgaggccatagttgtgattacatcacaggtcagtttctcctctgcccaagccttcttccttcattcctccacagatgctgatcctgagattcctttccagtaaacttcctccatgcaatcttcatctcaggagtctgtttcctggggaaactaacctgcaactgatacaaatgcctattctgtgagataaaacactaaaagtacaatgcgagtggtataaatattctgctacaggaatacaaagtcaggtatcatttttgacttaggtagtcagagaatggagatattctgagttggacttctgagatactaggattcaataggtgaagggaagatgagatggtataagactaacataggcagaattttgctaaacgaattggagatgaaacatcataagtgcaggtgcacaagtagaaaagtaaaatcagagctcaaggaaggagaagtgatccagctgggcagaaatatggggcctatatagagatataccaggaaataaagccaggacgaatggcagggtaggacctgattgttaagggtcttaaatgctggggtcaagattgtggcccttacttaaaagttggttgggcatgattttgggagttgtagcaaaagatgtggcaaactcaaagcttccttttcatgtaaagtatagagaagtggaggttcatatcattaaatcactgtaatttcagtgtgaacttctaacaatttgagctaaccatgagataggacaccttatcaagcaatgagctcttcattatctaaagagatgctgaatttcaagtccatgtagaggaagtcttgtgttgactagagcataatatgtctggggggacttttcttcttttttactgatatttagtaacttggatattgtgctaagtgctttacaggtattcttatttaatcctcacaaggcagtatggtagataatctattatattgaaaataatgggccaggcacagtggctcacgcctgtaatcccagcactttgggaggctgaggtgggtggatcacctgaggtcaggagttcaagaccagcctgaccaacatggtgaaaccctgtctttactaaaaatacaaaaataagcgtggcatagtagctcacacctgtagtcccagctactcagaaggctgaagcacgagaatcacttgaacccacgaggtggaggttacagtgagccaaaatcacaccactggactccagcctgggtaagagagcatgactaggtctcaaaagaaagaaagaaaataatgaacaaaaaatgttgagtgggcagtattaaattaaaaaaaaacctaatgtattaaagaaggagaaaagtataaaaattagtcaacaagcagagaaagaaagaaaatataaaggtaaaaatgtatgttatccaaatgagacctcttaagaagaaaaaataaaggaaattcaaaaaataagttaggaaatagtgagtaaaattatgaagttaaaaattcaccaaaaatttattgatatgtccaagttcagcttgtagtgaacagactcttcttatgcagaatttgagcaaagtgctaacacaacagagttaggtaatgggatgagggtcagtcagatcactctatttttggaaactggtttcatgactgcttccccttacttagtcataaacaggctatataaaaagctgtcagagtggaaagagggagaggatttgtgaatttttttttttagcatgtttttatggttctgtaagtcaccaccctcccaaagggatgaagtttcggggtgcactccccttacctcagcctagtagggggacttccaggagataatgagagagttggatgtttcctcaaatttacagacacaaagactggtgcctggcttctcctgataaagctaaacctgcatgtggctggtctctagttggctagatagtagtagttaaaatgaaaagaaacacttaatgttagatgccatccaatagggccacctaaagggatggaaggttctcaacaacaagagcccagaggtagaagcaagactcttagcggggaaggatggagtcgcaagtgaaaacctagacaaagaagcatctgtcctggtccagaggcttccccaataaagatgtctcacacaactctaagaagttagaactcgagaaaaagactaacaagaaaaagagtaaggtgtgtttgtggaagaggtgaggcagttgttttcctataaataatgttaaattaaactaaatttggtctgaggatgcctcgtaacttgagtcgctacataacaaactgcaacctaacttaggagtattttttttttgtactaacgaggtgagtctcagccaatcacagcagccaagctacagccaatcccatgtggccaactgatcagcctatgcccagtaagacaactgctcacctgtaactactcaagctgcttctggacctcatttccatttgctgtttataagtgctgcctgcccactttgctgagcagaactctctgaacttctttcgtttttgagggttacttgattagaaaattgttctttgttcaattaaattttgctaaatataattcttttaaagattttcttttaacaacaaagatggggatatttgaacaataccttggttggaggtgacattctaatttctaaattgaggctatttgtatttttagcaggacccaaggactgtcacttaaaagcaggctaaaaagccttgaaattttctaactttccatgcgagagcagtgatagataaccccactacgcaaaatgtcatggggcaatgggagacaaaaactaaagctgtgtttcaactgcgtctctgaatgatacgattatagcacttacacaataaccacttgagaaaaaagaacagccttgcaccaaaaatcgaatgagaagtacaagcacagtgaagtaacaggtcactttacaaaaaaaagtaaaggctgaaaggggacgagcaaattgcccaagtctgcatgggtgataagtagcagatctggggctcgaatccagatcctgagcttttaatacctatgcaacacttcctctgttccttcccttctgagaacgtcattatgttcattggggtgtatcccctgctatggtttacaggggagggttcacactttcaccattctgaaagattattttgaatttaaaaagctggcaagatgtctctgaacaatggaacatagcccaaggctgcaattttgttgcacacattacagtgttttaaggccactggtggcctgttctttgagatgaaaacaatacatcagtaggaacaaagtgaaagagagtaaactggtctccaggtacccaaacagtatgtgaagtcaacagaggaacacttcctgtggtctattaataattcagaagccctttatcctcaaccctcctccactctctaattcctaagtcttcttcctagtgtctcttacttcctctttccaaatagtctgggctggcaggctgcatttaggtaatcactgcacaatacaattactgattctgtttacaagattcttgctagtattttatttttaccctttatagtgtttggcttttaaaagcaaatgaatatggagtcatgattttttggctgcctttccctttggcatatgatatttatgcctttaaaacttgttgttgttccagggcatttcactgatgaaatttatcaaaatgaacctacaaatcagccactaagagactgcatgaataaaaactgttagtaggaaaatgattatgacaaaaaaaaaaaaaaaaacaaagaacagctttaagaaaaagccagactgttagtttttttttttttttttagaagggttgatattctgaaccccagcaacaatttatcaaagtctgttgccctgaatgaaattagatttcctttttagcttcaggaataggccattcctggaaaagtggagcacagaaacatttggtaaaaaaatttatttttactcacagaaagagtagtttgcaatgttatttccagtgaagggatgggaaccaggattcagatattcatctgtctacaatactgaggtcctcctacctcctctcctctgcaaagggaccctcgcagtatgcaaaagtattaaatatttttaatgtgatattctttggttaaaatatagtcacattctcattccttttttcaagcataagtatcagtcagatttcagagtataagctgaagcaacaaatagtaacaaagcccatgcatgaagatatgttctcactcatttttttactattttattgttggctacttcttctatttgcgttatatttagtgtcactaagctgctatacacgtactcatttgaagagatgtgctaaagcttttagtgtgttttgctattgattatcctatccaagagtttgggttactctacgatcaagatggcggtctgcagtgagcccacctgcccgccaacctctgcaacaaccagctgaggataattgcactgggctgacgccaaggccatgattagatctgctagtgggtgagaaccatgagactgaacctctaatcccgaacctctcttccaagctactttccaaaccaactgctgcctgcaactccctttgactaaatctgaccttccttcaaactggctctcttcctaatttccagattttatggaggcaatgctgtccagtgcatggagttgaaatgaggctaaagtgggtttgaatccaagctctacatttactgtttgatcttgggccaattatttattcttcctgaggctcagtttcctcctttgtaaaatgtcagtaaagattcctagcatgtaggattttatgcatttaaagagataacatttctaagtgactagttcagtgcctggcacaaacacaggcactaaataagcagaggtttcctccctttcccctaactgtcaatggtactgccactgtgtacagtagccaagttggacatgttgataccaatttttctcttctccccctttcccttaactgaagccaattatcaagttatggaatattagaactagcaagaaccttagaaatcctgaccatatgattcaccgataaaatacagagaaagacataagtcactgatcattgcagcaatcttgacccccacgtcaattaaataacaaaaataatatcattttatgatagaatttgttgctcgacattcgacaatcatgttgaacaaaagaagatcaatcaactataatcagttcagtgatcatgtacaaacacagcttcaggctcacaagtcaagatctattttccaaaccattgtcctatggttatttatgaccgtgaacatttttttggtggtagaatgttccttgtcactggtatattcctttgccctatgtctcttctttctttgtcatttactaacatgaggagagggatctgtctcaaagataattggaggagaaagcgatcatagaaccaaaacaaaggggaaaaaataagataattccaaaggaaacaatatcaatgttttaaagcctaaaaattgactacttaataaattacattacatataccctggaactattttctccatgcattgcatgtgctatagcatgaattcatttgtgttcttctagatagtttatcctaagggaatctactaagcaaaataagaatcagataatagttctttatcacacaactcttcttcctttcatattccatgctaaataatcatgcatgatccaaacctcctatttaacacttcaccctcttcttcctcctatgttccatgtacaaggggaaaataaatgatccatagttaactttttttatgtgaagacaggaagaatatgaatcatacatcaagttagagtataaatagttacgtttataaaagatttaatttcttgaatctccatagtcactggatatgcgtatcatccaaggttctcccaataataaaaccagagccaggaaagaaaaaagaccctgtctttagtgatagcccattgtgctaaagtctacttatttgtcagggcaacttggaaagttctgaaagacctggccttcaaagtttaccattttgtccaccagctcagtgcactgacttgacacgacatgaggcaaacaagtgaggagagtggcccaccacagtctaagattctattgggttacctctgaaacgcgaagacatgctgctcacagaagagaacaatgggtacaaggactgcaaggctgcaaagcttcatcccaacagcaattttctgtacaacaaatttctctgaagagaaaaacccagatcattgattgcataacagccttctttacacactggttaaaatataacggcatgttccctcttgttcctgtgggtcaatcaacttagcttccatttccactcccaaaaagagaaatattattggcttagttaggctgttgcttgataattaaacactcaaaaagagtatgatgagagttgctcttaatttagactatctagaaaatgtgtaactccttggggaaggtagggccaagaataaaagggtagtaatacagtaggatcttgtctggtttattgcagaacaatagctatagaatattgactaatggatatatagcccatgttgagggagatctaccgtgaagtactataaatgtcttcccttgcctctgactttttcaacattttaaatttatgaagatgtaaaaagtgagttcctcaaatctggctaatccaatccaatgttgaagtgcagtttgtaaggatgattacaggatctctgttcaaaaagatgtttccttgaccatatggaatgataggcccacccccaataggaatactatttcatggaagctggttcaagcagtaaagacatcaggttactttgaatctcatttatttaaaggtcaccataatagccatcaattaaatccaggcccatcccctatcatcttgaaagtagcatcaaataacattttgtctagtatgaggccatatcctaccctctgtaagtgagtggagccctcttcccctacattcccattggttaatgcacttgaatgttcttgaagtcagaattggcaaatttgcaaaataaatcagcctgcccacaattaacttctgagaagaaaatgattttttttcttttttcttttctttttttttttttttttttgagacagagtctcactctgtagcccaagctggagtgcagaggcgtgatcttggctcactgcaaccttcacctctggggctcaagcaattctcctgcctcagcctcccaagtagctgggactagaggtgtgccccaccacacccagttaattttttttgtatttttagtagagacagggttgcaccatgttgcactggatggtctcaaactcctgagctcaggagatccacctgcctctgccttccaaagtgctgggaatacaggcgtgagccatcgtgcctggccagaagaaaatgattgagatttcaaacttttccttttgagatttaaaactattgaatgatatttaatgaattaaagtgacctccactgtaaccacttgttgtataagaaagaagaagaaataagaaaatatgtgtgtgtctgctcatatgtggagaaagaaacataagaaggatagattagaaatcaatgagactggttatccacgggaggtgagtggaaacacactggaaaagacagggtagaagagacagggagggacgcttctttgggtgaagtgttttgaatagttctgaactttagaactactctgaattttagaaccatgttcttttcacatatgtacttaaaacaagcaaacaaataaattttaaaaaataatacaaacaaaaacgaacctgtgtttcaaatgaataacataatcacactgaaggagagaaagaaaaactaacccaagtaacttttaccttatctttttaacataaaagttaactttaaaacaaacagtcaaaatagttaaaatatgctaataaattctatcaatttttgtgctacttattttgtatctgtgtttcttctttattttatgtcctgtttcctctctggggaaacagaaacaggatacaaaagaaacagagtgcataaaaaacaataaattttaaattacatttcttattgctgaagcaatcttttaaaagttcctatagcaaaagtctacaggtgataaaatcttttatgctctgtatctttaacaataactttcttttgccttcactttcaagtactagtttagctgaatgtaatattcgagtgtgacggatgcgtcattgttgtttgacatttcctgttgcatggtaggaatctgctgcccaggtaattgttgttcccttgcagtttagctgtcctttctccttgataacttttaagggattatctttatccttggtgcttctcagatccattactctggtctagatgtggatttagtttttattatcttactcaatacacaggatgtacttttgatctgaggatttagacatttcttcagtcttggaaaatcattttattatttcttcagctatcgtatctctgctagtgccctgtaggggctcctgttggagcttcttgatctatctttcatgtcttgtaactgtcctttcatgttttaaaaactcatcatctttgtctctgtatgctgtattctgggtgagtttctcagcactatcttcaaatccactaatttattctttgagtctaatttagactacatagtccagttgaggtgttttaaataattacctcgatgactatataaatcatttacagctggttcttttgcgtgtttactgattttgtttttataccagtattttaaaatatcatttaagatttttttcaattttttagtcgatatgattcctttagatctctcattgagaatcctcaggatacttattttaaagtcagtgttgcactgctttatgaggttaattatgtttgggtgaattcatgttctgagtattgattttgttagctgcctttattggtatttgaattcttctgtgatttggaactctggtctgcaggctcattttgagtaggaagtcttccttcaagtaggaagtctttcatttctttctctcttcccctatgctcacttctctctgcttggcacatgcctccaagaagtccctgcgcttccattccagagccctgtcttacactggtttttggagcacatttcaaagatccagtcagcaaacagtaatgacttgacttaattattggcttagttactcctggtgtagttattctgtctcatactgactagcagctacttataaaccagtcctaggtaaaagtgagcagcatttttttcctttgtattaaggtacatgcagtgaaatgcacagatcgtaagtgtacagttagattttatatatatatatatatatatatatatagaagtgtttgttcagatcatttgcctggttgttagttgggatagtttgtcttattactgatttgtaggagttattcacattttctagacatcagtcctttgtcagatatatgtattgtaaatatatcttcctttgagaaatgtctatcaaattcttttgaccattttggaaaatttagttgtcgttttattattaacttgtgagagttatttatatattcaggatacaactcctttgtcagacatatacattgtcaatattttctgacactttgtggctctcccattttttattgatgtcttttgcagagcaaaagtttttaattttgctgagttcaatttatcaatttttctttagtggttagtgccttctgggtcttgtctaaggagctttgtctaactcaagatcatgcagatattcttgaagctttatagttttgacttttaggtttatgatccatctcaaattaatttttatgtatgttttgagggagggattgatgttctttaattttccatataagtattcaattgttttagcatcatttcctgaaaacacttttctttctcccatgggattgctttgccatctttgggaaaaatccattggctctgtacgtatgagtctacatccataagtttgcagtaatttctttcctcaccacaataataactagagtgtgtctgttttatttcttatctcttttttctccttatgcttcaatttggatattttctattgatctggcttcaagttcacttattcttttcccagcagttccagtttgctgataagtccattgaaagaagtctttatttctgatatatttttcatttctgacacttctatttgaatttttttttagagtttacttttcactgctgcatttcccattttttcatacatgtatgaacaaagattgtctttgagcaatctctgcatctggttcttttgaccattttctcttttgaagatgggtcactttttatgctttttcatatacttgtaattttttattgaatcacagatgttatgtacaaaaggataggatagactaaagtaactagcagataagcccagaataggtcccatatcttcttctctcatgccaccagtgtgaaggattgagccaatctaggctgcagttgagctgggtctaggctttgctgttatttttgttaaattttatttgttatattattatagcaagatcaaattatttcctctagccaggattgatatctgagtgcctggagggtttgtcttagttctcctgccctgcctgcacccatcgtcaggcccagtgctcctgcgccataggaggggtctcagctctcctgctctcctcttccctaccagtagccacaggcagctactgtctcctgttcagcgtaaggctgggttcattgtgggttttctctctgttttcctgccctgacctcaaacgtcagcaggctctgagcttcaaagagggtcagcaggctctgagcttcaaagagttcatctctctctgatctcttgactcttccccagtacagatgaccactgtcttgttctcagcctggggctcagagtcctttgagatttgtgatggttaattgtatgcatcaatttgactgggccatgggatgcccagatattggttaagcattatttctgaatgtgtctgtgagagtgtttctagatgatattagcatttgaatcagttgattataaaacaggcccaaagaaggtagacttcatctaatccactgaaagcctgaataggaaaatgggctgagtaagaaagatttctttctctctgcctggctgactttgagctgggatatcagtcttatgccttcagacttatactcaaactggaacttagaccatctgcttttctgggtctccaacttgtcacctgctgtttctgggcattctcagcttcataaccatgtgagcaaactacttataataaatctctttatatacatatatatacacacacacacacaaacacacatatatttatacatacatatatctcctattggttctctttctctggataacctagactaatacagaattgcttccaattttcctgctctgctctcagactttggcagaccagcatgtctgtgcctcagacaggaccttttctgctctcctgtccctccctcaattttggttcattagtttcctttgcagcatcagctctctgatgagctgcaaaaattatgattttggaggttgtccagcttgttcttactaaggtaggaaccacatttgtctgcaactttctgtatcctaatggaagcaaaagtctggcacaacttttattgcttttttgttttgttttgttttttgagacggagtttcgctcttgttgcgcaggctggagtacaatggcacgatctcggctcaccacaacctcctcctcctgggttcaagtgattctcctgcctcagcctccctaatagctgggattacaagcatgtgccaccctgcctgcctaattttgtgtttttagtagagacaggatttctccatgttggtcaggctggtatcgaactcctgacctcaggtgagtaatcccaaattgctgggattacaggcatgagccactgcgcccagcctattgatctttgattccacaagctgggaagaatgtgcttggtccctggccctgagcagtcagcttacccgtagcaccctagtatgtctccatgacgtacagtggccaccactgcctgtctcatgccatcaacacctgccaccactctgcatttacgttccatttcttgtatctgagattgtctctcatttgctgtctttggggttttgtccttttatatcttttcctccaattttgtgtgactggggagaggtgcagaaagtctcattaaaccataatctctttgagttgtcttgacgtggaaatctccctccctgcatttgtctatggatctcttcattacagtaaataggatatttcttttcttctctatttttatttgtattcctgtagtttgtttttctctgtgtccatcttcaattgcttttactttctagtgctttgtatttctctctcttttcctagtttatttctacctttgcctttttatattaatcttaatataaaataatattaaatcttaatatttaatacattaaattaatcttttatattaatatataatataaaatcaatttgttcaattatactttggaggcaatgaaataattttggtggtgagtggaagaggtggggctagcatttgagctccttctccaaaatgtccctccagagaacaagacaaagggattgcattggtgtaaatctgacaagatttccaatccacttcccaagtcattcacctgtctaagtgatcttcattactcgccttcattttgggtctgagttttgctctctcgttgcttttgctatcctctatctgtctctcctctctcttgctctgctcattctagtggttgtttcttggccccaagcctcacctctggtgcttcactttccaaagagaaagactagacacaatacataagacaagaatatgtacaaggaaaaaaataggaacccttccagtaaaagtcaaactctcaaataactttttactccactctatgctttttatgacttatacacctaaaataaaatgatccacagaagttaaaaatagaagatatgtagaaggagatatcaatgaaacggaaacaaatgctggggtaaagaaataaaaagaaatgagctatcaagccagagaaagacctggaggaaacttaaatgcacgtggctaagtgaaagaagcccatctgaaaaggctacatataatatgattttaattatgtgacattctcaaaaagggattcaggtgggagggagggaggaatcagtaggtggagcacagaggatttttaaagcagtgaaactactctgtatgacatagtaataatgaacacatgtcattatacacttgtcaaaacccgaagaatgtacaacacaagagtgaaccctggccaggcatggtggtgtatgcctgtagtcccagatacttgggagactgagatgggaggatctctggagtccgggagttggagaccagcctgggcaatatagggaggccccatctcaaaaagaaacaaaaaaaaacagtgaaccctagtcaaactatggactttggttaatcataatgtatcaatattggtttagcaagaattataaatgtatcgcactaatacaagatgtgaataataggagaaactatgtgtgtgttggggggtgggtgagtgtagcggagtgaggggacatgtgggaattctatcttccaatcaatttttctgtaaatctaaagctgctgtagaaaagtctattaatgaaacaacacaaacaaaaacatggcactatttaaatcagacaaagcaaaattaagctatgcaatgcaaaaagtgtgacaaagatcaattggaattgacaacagatttaattaatacacaacagtcattaaactttatgagttgaaaaatacctcagcaccataagacagtgaaaaaaaaaagaaaaaaagaaaaagaaatgccattataatataaagcaaaacatgatagaaatatcaagaagaaataaataaaaacacaagagaagactgtagcacactcccatttgtctaggatggcttagataggcaaaataagacattgggaatatatagctcacgtctcaatgggaaacagatgcctctttctgcataaaaatttgaccttcacttatcttccttactctgttcctctaataacttgataaaggtaaaatgtcgactatgtctctaggcaacattacttttggtagaaataactcctactggataaattgcatctggactcaggataaccataaatgattgggacaatcatttgggacatcatatctgattgggacatcatagctttcagttcccctgagtgtgctgactcctgtaactccatatgcctccatagggaccctgaaagctgtgtctatgaagttattacaagatattggctactgtggtgcatggagcttctaggccagggtgattctcacacctgcctgatgtggatcttgttgcttcacacctgaaacatcatttgagaagcccgggaagtggtgtggctgctgcatggctgctccaagaactactcccatgggagaggagctcccaacagtgccttgccatcaagctttgatttctaccttacatacctctgaataaactgttgccaatgaggctgatggaagtcttgtgagtttgaatgccaggttgaacttaagaggattccctggtgagcattgcaagatggtatactcaatgttattaatttgtggggagtttaataaaagtattgtttatattgatgtgggaagggtatagggaaattacaaggtatggtgcagtgtcccaagaatagtaacatggggcactgaaaagatagagaaaggaaaagaatgagtgaccagaacctggtgacagagccacaggggagggctgtctggctggagctgtgacttaccattgaaggactcaggaagttcttttttttctttagacagggtctcgctccgtcatctaggctgtcatgcagtggtgtgatcatgactcactgcaccctcagcacacaccaccatactgggctaatttctgtatttttatagacaggttctcaccaggttgcccagtctgatctcaaaatcctgggctcaagcaatcttcctgccttggcctcccaaagtgctgggattataggcataagccactgcacccagccctcaggcagtttttattaattctgcaggaagggagctgggagaataaaaatcccgacctcattttctttccttcttttgttctcttgcttgagcttcccatggatgaactggaagaattcagaaattgaatgatataaataacaaagttaaattaatagacatgtattgaacttagtttttagagtatgtataattttcccaattttctgtggaattattgcaaaatttgatcacaaactataaggctacaatttaaaaatataacaaattcctaactgtaaaaattttctaggttaaattctttgatcacaaagcaggcaagaaatgaatggtggaacaaactaaaatactagctccatgaatgaaaagacctacatggatatgagagtaattaagaaggagttagcagcgatgggactttgtgattgactggatatagacaatgaggaatatagtgaaggaaagatgatttcctgatttctggcatgggcagctgagtagatggttatgctataaactaagaaaagagagaaggataggaagagatgggcctggaagagtatggagtttgagatgagaagagaaaatggaaactctgaggagcacagaaaattaaggcccaagtgaagaaagatgagcttgcagggaagactgggtgatgacaagcggtgtaggagagaatccgggtactctgttttgctgaaatgagaaagacggacatacagatgcatataaaggcatatagaggcagatatatttatatttgaggaagtctggacattgagtaagttagtgctgataacttctagtttcttagttaagaaagagatgaggttatctatacggagtaaggaggaacgtggtggtgccgttgctactacggtgtaatacgtcactactattactattaattatggtgtaatacctaaaacgtagtggcttgaaataacaataattatcttttatctctcacagtttctctgggtcagaaatttgaggataaggtggtgaatgattctggctcaaggtctcccatattgtt

SEQ ID NO: 1059 - DNA, 107218 bp, Homo sapiens
ctgaagtcaacccatcaggtcagtctgggaaaggctgatatttcaatctaggcacatcgaggcacctatttgtggaattcctaccaatgcagtgtcggtctgagtcatcacctgttaggatcacaaagctctcagcagctaggtgacatgagggacagctatccaagaatttgagacagtcagtacagggtacaaaaattagtctatagatatacatttttatattcttagcttactaatatggactacgaggtttgccaaatttcctatttaatatcctggttgccatttcactttatatacaaagccaaacatattcatttaccaacttacatatatgacatagttttttttattaattaactttgtacctgactgtagataattattttgatcttgatactgaggaaccaaatggagtgcttttagttctcttgttctagaattgtctatacatagcatttgtgtgccccctttcaattggcatatcacctaaaatgaaaaagaacaatcaggtttcatttttgaaacataattccagtaataatgaacctaaataaacttaaatctgagaaaatagctttaatccagaagttacattttaatggaagatagaaaactatagatctgttttcgatttcttactctacactaacatgctctttggagacaccaaagggcaaaaaaaaaaaaaaaaaaaagaaaaacccagaaatgtttcctgagatgcgtccagtgtgtgaacagaaaaaagttcctgtgcctggctttctccacaggtgtctgatttagttggggatcaggtagccatgccccagagcttcctttgtcctgtcctcactccaccattgacatgagcagaagagggtgctgctccgctaagccccagcccattcagccccagtgggcactgaggccctggcggcatgtccctgagtccctgggcacgcacttaaaatcctctctaattttactccaactgtcctttcctgccacacacatgtcattatttaacacatggggttttaaaaacacatctattttatttcctacaagtacagcttagaaaggttagtccaagaactataaagttctaagaagccacactgatctgcttgggcctgagcagcactgtcagaccccccttggatactgaccataaataaatggtcgcaagccgggtgggtctgccagtccatcccatcagtcaagcaaaagcactgagggaactgtgtgcccagccctgcttcaggctgtggcatgtggggatagaaaggcgagagatgctgtggcttctgcctggacacagcttccaattctgctggcagaaccacaactacacagagcagctgtgctttatacacttaagttgcttataatctagataagagaacccaaagaaccataaaggaccaatgttatcaaagtaatacacattggacctactatggtcattggatcaatattccacatcatcctgacatctgatgagaggccagcattcatgttcaattggagttgtatttgtatttggaggataaagttatagctacacacacacacacacacacacacaggaaaggctcagagtgaactctgcagacctgcctctactgcacactcctgggccctatccacatgggagccttggctctgccctctggggaaatgtgctaacatcactctgcagtcttggggagtcggagagttctcatcctgctgacctgcttttagggtcctagaaaaactgctatcagaacccacagccccaaatagaaccaccgatggagaggctaatgttagtgtacaccacagctaaaccaaactcatgacaggctcattttcaagtatttgcttgttaacgtctatgccttacagcaagggcctcatttctaggaataaagaattgctgggggaaaggcaatgatcggttcttggactctgggtgctttgctaagggaatgctgtgggcgacactctccccattcctagtccttgccacgtgagatctggagtcccagatgcaccacttaattatgaagaccaatgtagatgatgtaacatctctgtttcttacccataaagtggggataaaaagaatgcctatcctacagagttgttaggaggattaaataaaggtgcaaaaatatgacataaaccacagctgtgactgattacgtaccctatacaagcgttacctgttatcatgagagattgggacacgaaggaagcaggctctgccctgaagccacaggaccgtgccccacaccaatatgccaaaccatgaggctcagctgcagtccctgaccccagcactgcactaactgatgtgatttgtgcttgctctccttaatgaatacagcaatgtcctcatctttgttcaatttgctaagatggagtagaaatgagaatcttagaggtgagatgtgaaaggctcatgtccctgttttgctaatgagacaaccaaaaatcctgatacaatacatacgtgaaatgaaaaacgagtgaaatgatcagtcgacttagtaatgatggggtccagcatttagtataatgttagtcctacacatcttctttagcataattaccattgggttggaatctttcttaagagaacagcaggaggcatcctctagttcctgggacgatgggaacttgcaacaggattcctgagcaagaagattctgcaaagttgcttcttccggattattacttgtagtagtaccacctgcttccttgatttcaacctagaaaaaagcaataattattttagagaacacatggtggacactggctcttgcagttgcataatttagaaaattgaaatctcagtgataagtagaagttatggtgaaaccctgtctctactaggcatggtggcacactcccagctaccggagaggttgaggcaggagaactgcttgaacctgggaggcggaggttgctgtgagctgagacagtgccattgcattccagcccagccccatcacacattcttccagcatgctcagtagtttgaattagatgttctagtcaattgttttttcctcaaaaagccccaaatccttggtaacgttttaatattatttatgatgtgtttataggaagatttgtaattaggtagtagccctttcctgccttaatagtaggacaacaaacatgaaatggtggagagtagggagtggctgccagctttgtgttcaagctgtcttctgtaacaactgtcaacccgatgacaaaattaccaaagatatggagaaatacagggataatactgaaaatcaatagaatttttaaaagtaagaatcctcgtggttaaaaaaaaattacaatcaggattgtttcaacattgggatgctgctttttacaatctgtaggaatgtgaggaggactgggaaacccacgctttgcatcctcccctcccctcctcctccacctacacttgcccgagctgcctggaccagaggacagtggggctccccaaaggccaggaggcaggccacagagcccttccaaaaagatggtggctctaaggtaacatactgaagacctcaaataaaaatcacagagcaggtatctttcaaaatgcagatagtgactcaaattggagcttgtccagcccaataaaatcagaggcccaaacaaatcatatttcccatgtatgggcaaatcactcagcacagcagactagcatctaggtataaatcttaaaagagataaagtttagctatattttaagtagctttatttagaaattttaaatttcatataaatacacataaaattttcttctacttgctgctttgggggatgtgctatgcacgtcatcccagtttagatttaacttatctccctgtaatcaacaaatactactataataaatatatcatttcctcagacctatgcaactaatatctgaactacttatactaaaattccatttctgacctttcaaaacaaaggtcaacatgtgggaatgaatttctagaagaaggaaattagcaactgatcctgaatatttactgaaaataattccattctgtttaaacgataaacatgtctgtgctgtatctggtccattttattaatgaatcagaaagcagtcaataaaaatttaaaaagcaaagtctctcctttagtttgtcagaccagcaatctcttaaaattggattaaagagaattttactatctttaacatcagagaattctcttgtgtgtgttttgtttgttttttaagacagggtctcactctgtcgctcaggctggagtgcagtggtgcaatctcggctcactgcagccttcgcctcccaggttcaagcaattctcctgcctcagcctcccgagtagctgggattacaggtgtgcgccaccacacccggttaatttttgtattatcttccctgttctgattaatgctttctgactccactctgtgaggaaatgagccgagctaggacctacgggcaggaggcgctggacaccaatccggctgggcagcaaaatgcagttcttaacatttcaagccctctgagaaaggctgtgagaaagacctctgtcctgggaaacggctgggggaactggtgagctctatggctcctctgaggacaaacagaggtcagtggaggccccagcctctgcccatccttttcctgtacactaaggactggcaattaccataacagaaaaccggaagagcagaaatccaagctcctgctgctctggcttatgatacagggtcaggctccagccatctcaatactgactcaagcattgtgtcccacaaacgcttcatctacaacttactaaaatgacctcatggatgagtggtctcgttttctgagctgggtcctttttgaggggtcgagaacacattttcctgggaccctttgtttcctttgaaaactcattagttttggcaagaacaaagcggaaaattatcagcggtcatctacagctagagagggcagtcggctgagagctggcaagcatttctttaggctctgatttacattgcatatgcttgaagagctattactcattagcaaagggaagatctcacatcttgacttcaaggcccggaaaatccaagtattaactctgagtccttgctgtggattccaagcctggtaaagttaaaggaaaaaaaaaatgcaagatgcaaacacgccaaccctccaccacattgcgtttgttttcacagacaatagttaccagcagacagcgggcctctctccttaagccaaggatagcaacagggcccaagggaacctacgtcctagctttccccctttttttgttgtccgccgtctgcatggttaggtcagctttggacgactggtgcagggcagaattccctccaggggaaagggcttggctgggccgatgcatgttggattaggaagacgacaaagagtatacgctctaccgagaatcagtgactccggtgggctgtgtgtggtgtcaccagggaaaatgcttgtagagggaaatcctggggtacactagcagcctcagatgggttggggaagggatggagggggagctgtgcccattccccaggcggttcttactgggatcatgcggacgcccgggtgggaggctccttccaggacccaggcgcccaggggcaacaccgccgggctgcggtgcgcgggtagcagcgaggacaggaagtgcacgttgcaggcgggcggctgcggggcctgcaggagcgcgacgtcctccagcgcgctgagctctgggatcccggggtactccccgaggagctccccgccgtcgctgtcgccccccgcgagcttcgccttgacctggcccttgcagtcggcgcccagcgcggggttgaacgcgtgcaggacgggttccttggggtccgccgggcccaggtacgcttctttgaagacgtggaactcgtcctcctcgtacttcacgggggccttcaggccgatgttctccgaagcgaacggaccctcggggcttaagagctccgtcaccatcgcatcctcggggctgggcagcccgcccggcagagggccctcctccatggcgcagggcggcggggcgggatggcgggggccgcgcacctgcaacacgcggccaggtgagaggcagccagaggagaggacgaggggaggggcggccaggaaaggggacagccaagggaggggcagccaagggaggggcggccaggggaggggaccaggtgaggggcggctaggggagggggcggcctggtgagggagggccaggtgaggggcccggggaagggcgaccaggtgagggggtcaggggaggggcgaccagatgaggggcgattaggtgaggggcggccaggtgaggggcggccaggtgaggagcgaccaggggaggcggtcaggtgagcggcgaccaggggaggggcggccggggagggggtcacgggaggggcgaccaggggaggggcggccaggggagggggccaggtgaggggcggccaggtgaggagcgaccaggggagggagtcaggggaggggcgaccaggtaaggggcggccaggagaggggccggccggggtgggggtcaggtgaggggcgcccaggggagggggccaggtgaggggcggccgaggagggggtcaggtgaggagcagccaggggagggggggccaggtgaggtgcgaccaggtgaggggcggcctcgcccacggcccgccgccctccgcccacccgcaggggcccgacccggcccggcagcccccatccccgcctgcagagccgaggcccagcccggggaccgccccgtcattcctcctcggagggacgcacctggggccgccggggctgccgcagcgtggagcgagcgggatggggcgtgggccgggcctcaggcgcaggcggccgttggcggttggagaagggggaagggtgagggacaggaacctggggggaggggaagaggcgcccgggcagtgggcggggcctgggcgtggggcggagtcgaggtcggggcggggaggtaaaggcggggccagggaggtgtggtgggcgtggtctggggcgggaggagacagagtcgcgaggggcggggcctggactgccgctgttgccagagcgggtcaggggaggcactcccaggttcagccgatccaggctcaggtggggaaactgaggtccccatcaactcgggcagcgctaagtgggactgcctagcttggcttctgaccttgggcttcagttatatttttctggccaggcgtggttgctcacgcctgtagtcccagcactttgggaggccgaggcaggcggattacttgaggtcaggagttcaaaaccagcctgggcaacatggtgaaaccccgtctctactaaaaatacaaaaattagctggccgtggtggcacgcgcctgtaatcccagctacttggaaggctgaggcaggagaatcgcttgagcccgggaggtggaggttgcagtgagccgagatcccgccactgcactccagcctgtgccacagagctagactccgtctcaaaaaaataaataaaataaaataaaacatttttctacactcgagctctcaagacagatcccggcctgggacgctgcgggtggacagagggcaggggcttgcaccgcacgttcccagccttgcacccactcccggtccttggtgacgcagcttacaggtgcaactgatggagttggtcccgaaatagaagtaacaaatacggctgggcgtggtggctcacgtctgtaatcccagcactttgggaggccgaggcgggtggatcacctgaggtcaggagttcgagaccagcctggccaacatatagtgaaactccgtctctactaaaaaatacaaaaactagctgggcgtagtggcgcacgcctgtagtcccagctacatagaaggctgaggcttgaacctgggagatgggggttgcagtgagctgagattgtgtcactgtactccagcctgaccaacagagaaaggctccctctcagaaaaaaaaaaaaaaactcacaaatacaatgaaagtctcaaattttgggtggggaatgagctatttcatctttaaggagtcaatagatatcactgtttaatcaagaggaggtgaaagtttaattcaagtgatggcgaaaactgcaaagggtgtagagggactggtgggagtgggtgctggggagacagcctcaggtactgtctactcaggtactgttttggtaaaaataaagaatgtaaaacatcagctttctaatctcacttttaaaaattaaatacttttctaaatttttaaagggtagtacccaaggcacagcaacaccgtgtactatttagttgtacatttaacattcaaaaatcaagaaaattttgcctggggctgggcgtggtggctcatgcctgtaatcccagcactctgggaggccaaggtggtcagatcacttaaagtcaggagttcaagaccagcctgactaacatggtgaaaccctgtctctactaaaaatacaaaattagctaggcatggtggtgcacacctgcaatcccagctatttgtgaggctgaggcaggagaattgcttgaacctgggaggcggaggttgcagtgagctgagattgcaccattgtactttagcctgggcaaaaagattgaaactccatctcaaaaatcaaacaaacaaaaacaacaacaacaaaaaacactcacagaagcagaaaaaataataaaaataataaatcgaagagcccaagaattatgcatagcttgagtggcccaagcgagagagtaacccacaaggttgcaccgttcattcgtttactaatcagaatcagacgtctactgagtagcatcatgccaggcatacacagccacctgtgggggtcacccacgggttgcaatcaagcctggaggctctgcacctgctgctcctagatgcttgctgccctgctgcactggccgggctggctccgtcgagtctctcaggtctcagctcaacccactctaagtgggtcaacctccctgccagctaccaccccctcccaatgatcctcttagttgcctcagaacacttaaaatccttcaactggttggcttgttctctttttcctctgtgatatggtttggctctgtgtccccacccaaatctcatcttgaattgtaatccctctgtgtcaagggaggggcctggtgggaggtgattggatcaaggaggcggttcccctacgctgttcttgcaataagaagtgagttctcacaagatctgatggcttaaaagtgttcggcaattccccctcactctctctcctctgctgccatgtaacaggtttcttgcttccccttcaccttctgccatgattataagtttcctgaggcctccccagccatgctgaactgtgagtcaattgactgtctttcctttatacttacccagtctcaagaagttctttacagcaatgtaaaaatggactaatgagacagccagaacctggtggggtcactgctgtctccccagtgcctagaacaggcgctgatatggtttggatgtgtgtccccacccaaatctcaggttcagtggtaatccctaatgttggaggtggggcctgatgggaagtgactggatcatgggcgtgcatttctcatgaacagcaccatccctcttgctactgtcctcaccatagagtgcgtgagttcctgtgagatctggttgttcgcaagtgtgtaagagagcacctcctctctctctctcagatctggttgtttgcaaatgtgtaagagagcacctcctctctttctctctctgtctcctttcaccatgtagaatgcctgctccccctttgccttccaccatgagtaaaaagctgtttgaggcctccccagaagcagatgcctccatgcttcctgtatagcctgcagaactgagagccaattaaacctcttataaattacccagtctcagctatttctttacagcaatgtgagaatggcctaatacaggtgctcaagaaaaacagaaaaatggaattcatgcattacttttaacatatttattgagcatcttttatgtgtcaggcactgttctcagcattgaggcaatggaatggatgaataaatgcacagcaagtgaaaatcaacaggcttttctttccagcccagcacatgaacttggtgatgtccatggtctcctccaaggccttgtttccatatgctgagactttccactttgtctcaagtatctgaacttggtccttgacttataatccccttaatataacaaaagagacagaaacaaatcttgtagtagactggggttaatgttttattaatgataacctacattcacactgcatttctaagatttacatccaaagagcatactgtatttacatgcaccggtcagcccaagataacaaattcaaaccatggctgcgttaagacaatggtttgttccaattaaattaaacagataatactcttatcaccccccttggacatgtacaataagacccctctttctcccctcaaggaatataaaattgcattgataactgcactgatgagcaacaattacatttgaaacatttaaaacctgagagagaaacccaaatatgtttaagcactcacgtctacactcaaaatgccctgtgaactctagtgtaacacagattgctcagtggtcaacagtgcatgatctagctggctctgatagggactgacgccggctgctggcttttaacgggaagtgctattcttgcccagggcagagagagctacatccccgctgcctgcttgacggacagtcaggggcttttgttgttggtttgtttttgcttttttttttagacggagtctcgctctgtcgcccaggctggagtgcagtggagcgatctcggctcactgcaagctccgcctcccgggttcacgccattctcctgcctcagcctcctgagtagctgggactacaggcgcccgccaccacgcccggctcattttttgaatttttagtagagacggggtttcaccgtgttagccaggatggtctccatctcctgacctcgtgatccgcccgccttggcctcccaaagtgctgggattacacgcatgagccaccgcgcctggacgcttttttttttttttttgtcttttgttttcattttttcttgctttcaggagaaaaaaaatctttggcccataaaggtgggatttttacatcatgaagtatacatacataaaacatgcatgtgggccgcgcatggtggctcatgcctgtaatcccagcactttgggaggctgaggcaggtggatcacctgaggtcaggagttcgagaccagcctgaccaatatgatgaaaccccgtctctactaaaaatacaaaaattagcagggcatggtgttgggcgtgtaatcccagctacttgggaggctgagacaggagaatcgcttgaacctgcaaggcagatgctgcagtgagccgagattgcaccactgcactccagcctgggcaacaagagtgaaactccatctcaaaaaaaaaaaaaaaaaaaaaggcacgtgttctccggcaagcaccttccatcgactccaacagttcagccatcgctgttgtactatcggggtgcagcactctgaaggagtcaggcccaactagaaccaagtggtcaaaaaaataaatacacaatttaaaacaatggacagctaagcttgtcatgacagacagtgggaatttcattccatgatgcttcatttttgcattaaatactgaagatgactcagtgcataattgctttgtggtccatgagacgctttcgtgaaggcactcctatctgaaggacaggctgggtgaacacctagcactgtcacttgagacatcttggctggtcaccaaggtgagccggcatactgtctccatcaccctctggtgagtctttcccctcaccgggtgggaggagaaggccatcccttggggtcgtggagccactctctcctcaccacggtgggctgccctccccttcctcacttgctagtccccgcttggtggccgatgccctgccctccttgctgtcactttgggaaagagatcctcctgaggcacgtgtcatgttttattcttgagtgaattatctgaccatcacggcccttgctccccttttatgacatgtgcctgttatttcttttgttgcttatgatgacaagaaggcagtcccgggaggggagtctggcacagctgcccttgggaaggaactggtgtttctgagggggagggggctggtggggtgtagcaaatgcttatgtacggttatccatactcagtcaattgtgaagggaacagtatacccacaattccacccaaagactctacaaaataaatctttctctccatctcccttacatttagggcctttcatttttaaggcactgggttgtgaagacttgaagacatacaaggtcagtaaaactgaagaccttgcatcctgcttgcttcaaatgtggagaggcaaacacaggctactggaccagacgggaacggttacccacggtgacaaaagcaggtctccaaagcacagcattttggttagtgcattccagatgtgttagctacaactggggacaccaacttgaataacacatttttcttttaacaaaacaaaagtttaccctgcttggatgatgctaaatgcccttaagcactaggccttcggttgccactgagaaagcacaccatttccattccactgtgtgtgaagccacaaccctactaattccttcattaactcaacaagatttgcatcccttaataaatccaagccgatgcggagacatcaggggagactttatcagatgtcccccaagggagggcaagtctggaagtagtggggttatgcttcacaggggagagatactgttctaggaaaaaaaaacacccacattttctggaaggaaaactgagtttttttaagagcagtgtttcatcccgagctaaggtcaggattaatgcctatttttcatttggtttgcatcagaagagctcgttttccttcccagcagctccagtggaattactttttggaattagaactgagaccaaacaaagtgatgatgtcagtcattgcttctttcaggtgccttccaaagcgatgagaatcctttcatgtaaaaacaaaaaccaaaaacctattaaaacgtggccatccccacatttcaagctttttcatttgcaatctgacccaatgtttcattgaaattcctttctgccagttctctaagatctgaccaacgtcttaaagcttaacttagacattccagagaaatgctgagggtaaagagatgacagctgatgtgtttgtgcgggtgtgttgtcgatctaagccttcccctaatgccaatgcgtttatcccacggaaaacacaatgaccatcctgagcatggtggctcatgcctgtaatcccagcactttggaatcgcttgagcccaggagttcaagaccagcctgggaaacatggtgaaaccacatttctacaaaaaatacaaaaatcagccaggtgtggtggcactcccctatagtcccagctactcaggaggctgaagtaggaggatcccctgagcccaggaggctgaagctgcagtgagccgagatcacaccactgcactctagcctgggtggcagagtgagaccctgtctaaaacaaacaaacaaacaaacaacaaaagaaaaccgcagtgaacaaataaaccccaacttcctctgttaacagcgacagtggcatgggttgccaggctatgtacgacaaggaaagcagaatataaataagggcaatgtgccatgctagggaggaggtcccttgttccatccacagaggaagccgggggtcccctgctctgtatgcagatttcttagtgtgtacccattatttttagttcatcttccaagtgctaaagagtctgaaagttacagcagcactccaacgttaagcttcaaaaccattgctgccaacagaggtaaacatgttaaaccaaattagatacatttccttttttttttttttttttctgagacggagtctcactccatcacccaggctggagtgcagtggcatgatcctggctcactacaacctccacctcccgggttcaagcgattctcctacctcagcctcctgagtagctgggattacaggcgtgtgccaccacaccagctaagttttgtatttttagtagaggcggggtttcaccatgttggccaggatggtttcaaactcctcacctcaagtgattggccagcctcagcctcccaaagtgctgagattataggtgtgagccaccgtgcctggctgagatacatttgtttaaaactaggtaaagagaattttgaaattcacttatggctgggcacagtggctgaagcctgtaatcccaacactgggaggctgaggtaagaggatcgcgtgagcccaggagttcaagacttgcctgggaaatgtggggagaccctgtctgtacaaacaattttttaattaaaaaaatttaggccaggcgcggtggctcatgcctgtaatctcagcactttgggaggtcgaggcaggtggatcatctgaggtcaggagtttgagaccagcctgcccaacatggtgaaaccctgtctctactaaaaatacaaaaaaattagccggggtagtggcgggtgcctgtagtcccagctacttgggaggctgaggcaggagaatcacttgagcccgggaggcagaggttacagtgagccaagatctcgcccctgcactccagcctgggcgacagagtgagactgtgtctccaaaaaaaaaaaaatttttttttaaaagcagtccatttatgtgaaaattcccgaaatcaagtaaaagcaggcagttgaattgactttttctgtcaaattaaagatgtgtttccttaaaaagaataaagcaaaaataccccatcttcagaaaaaggaacttcttttcatacataccgtctcagggcaagagaacttggaagaaatgtggaaattgatgaggttctctcccacaaggatgtacgacacaccatagccgtcatcagcaacctggaggacaagggaatttgaatttgttgctgggaaatgagacaacgtgaaaaagggactttctaatgttctaaatgcaacactggcggggctcggtggcttctccttgtaatcccagcattttgggaggctgaggcaggcgggtcacttgagcccaggggttcgagaccagcccggacaacatggtgaaaccctgtctctacaaaaaaatacacacacacacacaaattagctgggcatggtggcatgcatctgtagtcccagctactcaggaggtggaggtgggaggatcacctgagatgggggagattcaggctgccatgagccatgatcatgcttactgcactccagcctgggtgacagagcgagaccttgtctcaaaaaaataaaaaataagtgcaagactgccaaggacatccatagcaatgatcagcagtaattcctttacggcggtagaaccgcaaggtaacgggggcacccagcacggagatgggcccatcacaccccattacccatcccatcaccacgccccactgcgcctcgcccagccccgccgcactcaccggtccaaagccccctccgctggacacgtactctgggttattctccaagtcaaacagctccacttgctgctgaggggtctggcttgttgataatctccaaggctcagataaaacctattgagtgaaacagggaaatgtttcctaatcccctcctctaccgtccctcaggagtcgctttgggaagacgagaaaagcctggcttggtcttttgattgttccacacaccacaagtctatgtctccaaaggcctcactggcttgggcagcgtatctgcagagagcatgcggggtgggtggggcccccagactggggcagggagtgcagggtgggggtgggggcataccagcaaatagcatctcagacagtgaaggtaacagatatatggagtaagattcggaacggggacagaggtgtcagacttgtaccaactcccacgagccagctgccatattttcagagaattttcaagctggctattaaatacagccactattaaaaattaaatttgccaggcgcaatggttcatgtctgtaatctcagcactttgggaacccgacgcgggtggattgcctgagctcaggagttcgagaccagcctgggcaacacggtgaaaccccgtctctactaaaatacaacaacaaaaaaaattagccaggcatggcagcgtgtgcctgtaatcccagctacttgggaggctgaggcaggagaatagcttgaacccgggaggcggaggtttcagtgagccaagatggcgccactgcactccagcctgggtgacagagcgagactccatctccaaaaaataaaaaataaataaataaataaataaaacttaaattaaatttgagctgggcacagtggtgcacatcagctactcagcaggctaaggacgaagaattgcttgtgtctaggagtttgagcccagcctgggcaacactgtaagaccctgtctcaaaaaacaataataatatatttcataaacttacaataaaataaaggatttttaaaacaaaggtggtacgcgctcacagctcatcactccctagttacttccgtgcgtcttactgtgacgtaagctctcgaggtcttcgggtctattaagtcaggggctacatgtgacagcgaagtttttgaagaaatgcagtactaaacgcgctgctcacattttccattttatgacagctacacccacagacccgtttttttcaaatgcccattctgacattaaaatatgttcatgcaaggctgtagtaatttactaagttttggtctagccaatacaactgacggaagaagtggaagagacttacttccttaaggaaaggggactccacagcgagatatttagacaccacgtaaaggcagaagaggtgacgatcgatcccagagccggtcatggcgaggcgatacatatgctgatgcttctcagacgccaacttgaacaacttcagcctctgttccacctgagtgacaaaaggtgggaaggacatatgttgcatgtctcaagttgagcagttacggatctaagttagccaccgcacccggctaatattttttgttatttttagtagagacggggtttcaacatgttgcccagggtggtttcgaactcctgagctcaggcaatccgcccacctcatcctcccaaagtactgggattacaggcgtgagtcaccgcgcccggtctgacagcctttccagaatgaagtttgtctcggaaaaaagagccctggccagtgtctcctctggggatcagcggaaagcacctgcacgctctggggatcagcagaaagcacctgcacgctggagtcaggcggacccagtggcctgggtctgacctcggccattagtgagcagaatggcccagcagctgctgaattcatctaggcctctgtttctttatctatggaaatgaactgatgacacttctcaggaccactgctaagaaaatttaaaggacaatgtacagaaaacccccaggccccagcctggcacttggggcccagcgtggcaatggctctaataaccaatggaaggtcccgtgcgacagtcacagctcacctaccctgacaccaaccacctgttcagttccaaagcagccacctgctatgcctttcctcattgtgtgtcctggcctaatttaaagactctcaggaagtagaatatgatttggagaagtatcatttgtaacatgcgtctctgtccttgtccctacctttaccttttaatattttaataccttctgtacccttgaaaggggcagaggaaagaagctgaattgagcacccctaaagaagaaggtacaggaatgatgagatcagagaagctggagtgatggcctccagaagccttttagggaagtgtgacaagcacgttgtgtcctcagcctgatggcacattaccgtctgggccgggtccaccatggcccgcacgaagtcgcatgactcagtggtgcaggagcgcacggtctccgtcctcccctctcggaagagccgggtcatggaggcctcgtatgtgaggcaaaacttgcccatgtcctggggaaagagaagtacttcagtgcacggcagggcatgctgatatgtctaaaacgtaaggaaggattgggtaagattggcaaggagacgtggacttcattgtcaacatttttttgagacggggtcttgctgttgcccaggctggcatgcagtagcatgatcacagctcactgcagcttcaacctccccctgctccggtgatccccccacctcagcctcctgagtagctgggactacaggtgcatgctaatttttttaaaattttttttgtagagacagggtttcaccacattgcccaggctggtcttaaactcctggctcaagcgatccacccgccttggcttcccaaagtgctgggattacaggtgtgagccactgtgcccagcctattgtcgaatcatattttcagtctctggccgcttttacatgtgggtagtgacgtggcagcagacaggtgtcactggcttcaggaagggcctggtggaggtgggtcagtttctaggttaaccaggtttctgtttcaagatgcaactgatactatgacaccccccccacccccgagtccaacacacctctgctgcattcccttcaggctaaggtgcagcctgcagcagtgtacagaaggaatgccgtgcacagcaggggatctgtgtttgaaatgatttaaagacacaacgtattgcctggagcaattccactgcgtctggaagatggtgagaatgatctgggagagactgtgctggggtgcaggaagaatgtctagcaggagggcgggaagtgggtggggccggagcctgaagcacagccactgccccattagacaggaagcctcgggtgggctggcagatgcacagggaaggtctcttccaaaagctcctgttttctgggtgaagcagaagaaagcgggcctgctgagggccaggctggagaggaggtgctggcagcgggagaggggtgtgatgtggcattcaggggcatggaaacatggtgcctggcccactgcggtcagcgctcactcgtggggaggggagacgagccagctgttgaatgctttttttccagctaggctggtgccttgggaacagaatcacagcagctggagagctgggctgaacccgggagcctctgcaggctccccaggtaagttcagggggaccagggagtcaaggtaagggatgatcccaaagaaccatggaacccacacccagagaatagaaaagggagggcagggagggacaaggggatggggtcaaggaacgtgggcatctgggcctagagaggacagcacggcaggaggggctgatgcccctgaggctgagccttggtggagatgacgggatagtgcagcaagggcccctgctgggaatagcagatggtggataaggacagagactgagtccaaggcagcacgcggctgtgggaggaacagcatctgcgtgctgccccaagaaggggcccggggccaccaggccagctcaaagaggaccaggttccaagtggggacgagaaggtgataagcagcagtttatggacccaaatgattcctgaccagacacatccctgcacattagtgtgcaccctggcacaggccctggtggccccagggtggcagacccacccatctgcaaaggacaccatgtggcaggctgatactgtcaaatgaacccagaagagggtgccagaggcaaggctgggctgagcacagggcctgctcagcctggggaaggggaagccggacagagcacaggacccactcagctggggaacggggagccggacagagcacaggacccactcagctggggaacggagagtcagacagagcacaggacccgctcagccggggaaggcctggcacctgcacacaggcccagctgaagtcaggctcctcacagtgcagccaagatctctggaggagaggaggcccctgaaaggcagaaggtagcgtccaggaccagggcccctgaaaggcagaaggaagcgtccagaaccagtgaaatgagagtgcatcagccagcagaaaaaggaaactgaaggcgtcgacaagagcagcggctttgcagagggaagcgtctagagaccgtgggagcacgctggacaccagcgctaagcagcacttgcagtgaggacctggctgagcccccaggatccccccaacgtagctggccgccttggggagctctcttccccaacccacagatgccaccaaccctggtggcatgacacgacactcaagattcccttgggagcgggggtcacaggcctggggcctgccatgaggccacggggcctcctgcttcccatgctgatagcaaacgcgcctttcagagcccttcccgcatctcctcactacagagcacttcataggcgctcacaatgaagaagtggggagagggagagaagcagataaaagggaaagcggaaatgtggcattttagttatttaataaaggtaaacttgaactatatgatgcaatgattcatttgaaatcaatgttccaatatcaaactttaattgtgtaagttatgagaacagtcatgccttgtgcccacagtttaaaagacagccatctaaaaaacttcttggcaaatgcattgaatattagtgtgcaagccccactggagctcagacgccatcaaagagccaaaccaggttacaactgcagcacccttgacccactgtgaccagccgccatcaggaggatggcccttcgctgccaccaaaacatctccagtttctaagaagcaggattcaaagacagtctatagatatactgacatatatggcatcacacactagcactgttactatggggctaatgattcaggttggtagggcttccaaagcaggaggcaaataactgctgcagactagaattaataccactgtctagtgtcagcattcaatccatattcaatattcaatactgatttactgatgctcccggcacaggcaatactgttgtaagacagatcatgcctttgccctcaatgagcaaacattctagcaggagacagggatgaacaaaaaaattctatcacatcaagtcaggccactgaatagaaataacacaggaacagggaactagggaacagaacaatgcgggaggggctacctttttttttttttggagacagtctcactctgtcgcccaggctggagtgcagtggtgtgatcttggcttactgcaacctctgcctaccgggttcaagcaattctcatgcctcagcctcctgagtagctgggattagagatgcgtgctgccatacctggataatttttgtatttttagtagagacgcgtttccccatgttggccaggctggtcacaaactcctgacctcaagtgatccacctgtctcagcctcccaaagtgctggggttatgctttataaaatgaaatacacaaggttattgtgcataaccttgaaggaccccttcaaggggtcaatataacacaaggttatattgtgtataaccttgaaggacccctgagaaggggtccccaggctctcctaggctgcccaaggggtccagggcagaaaaaaggttcagaagcttagaagagacccacagggccacagcaaggttctggatttatgtaaaaccacagggaggctctgcagctcccagctgggttgagatcggtctgaatgttaatttttgaatgaataaatctgatgtatacttttaatagatcactttaatggatctgtcatttttattttattttttatttttttgagacagagtctcactctatcgcccatgccggagtgcagtggtgcgatctcagctcactataacctccgcctcccaggttcaagggattctcctgcctcagcctcccaagcagctgggattacaggtacctgccaccacgcccagctaattttttgcattttttggtagaggcagggtttcaccatgatggccaggctggtttcgaacttctgacctcaggtgatccatccgcctcggcctcccaaactgctgggattacaggcgtcaactaccacgcccggcactccagcctgggtgacagagtgacactctatcaaggaggaaaaaaaaaaaaaaagaaaagaaaaaggaaacttcacaacatcacctgctaatattttgcatttatcctttctagactttgcatgtaacaaagcaagagttgggaaacttctgtaaaatgcagaacaggctgtgcgggccaggtgctctctgtggcgactactccgctctcccactggagtgagaacagcacagacaacatgtgaaagccgggcatggccgtgcccagaacgcttcactgatgaacactgagacttcacgtaattttcacatgtcacaaagtattggtcgcctgttgactgcttttcaactactaaatatgtgaagccattcttagctttctaagccatgaaaacaaaaatgaaaacaaaaacattgaagggccaggtttggcctatgagccacagtctgcagatcattgtaagaaacacctgactttcacaaactgttttatgactaaatatttttccgtataatatgccatagatggctgggcgtggtggctcacacctgtaatcccagcactttgggaggccaaggattgcttgagcctaggagtttgagaccagcctgggaaacaaggtgaaaccccatctctacaaaaaacataaaaattagacgggcctggtggtaaatgcctatagtcccagctacctgggagactgaggtgggaggatcgccagcacccagggaggtcgaggatgcagtaagccgtgattgtgctactgcattccagcctgggcaagagtaagaccctgtctcaaaaatatatatacacatatatatgccttagacatcacttaatagctatataatattccgctgtgtgaaaataccctattttaatttagtatcatgaaaggaagattcactctgccgaaaggaaaggattacactgaaagcttcgtgcaagaagctgcctttttcttttgttcccaagcacagagtgacggataaaaggcgaaatgtctccactctgggttcaccgggttttgtgtaacaaatatgtaactgacgattcccctaccgccccttttctcttgcatcatgggaattccgtaacgtggccacgccctcccttccttcccctcctgcctgcttttccttttaaatactgaagccctcaaaaccacctttggaggaaggcacaggcctgtctcccaggcacgcatctttaaccttggcaaaatcaacttctaaataaattgagacctgtctcagacactttctagtttccagtctttttttttttttttttttttttttttgagagggagtctcgcactgtcacccaggctggagtgcagtggtgcgatctcggctcactggaagctccgcctcccgggttcacgccattctcctgcctcagcctcccgagtagctgggagtacaggcgcccgccaccgcgcccggctaattttttgtatttttagtagagacggggtttcatcgtgttagccaggatggtctcgatcttctgacctcatgatccgcccacctcagcctcccaaagtgctgggattacaggcatgacccactgtgcccggcctgccagcattaacttttaagatttcttcttcttctttttttattttttgagacggagttttgttcttattgctcaggttggagtgcagtggcgtggtcttggcggctcactgcaacctccacctcccacgttcaagtgattctcccgcctcagcctctcaagtagctgggattacaggtgtgcaccaccacccagctaatcttgtatttttagcagagatggggttttaccatgttgtccaggctggtctcgaactcctgacctcaagtgatccacctgcctaggcctcccaaagtgctgggtttacaggcacgagccactgcgcctggccagatttcctcacatttttacagtaagcttgctcacacgtgttttttgtgtacctaccctttttcatggatcatgtgcagggtcaaagttattcttccccgatgcatgtttccaactgtgtggtctgtgctgctcccagtcctgccatggggcccctaaatttattaaaactattcccagctgctctatgaacatccctgcctcagtccaccctcaccaacatgaaaaaaagcctttaccaaccccgtaggcaaaaatctagtcttgtttaagttgtacttgttagattcttggtaagattaagcttattacctacactcattgaccgtatttttcctctcttgtgaaccacagtttctggtctgactccttatttctcttggattatttttttccaaaggcaaccacttagccagatttcccagctccatttactcaccagctccccgtcccctactgatgtcaaatgctccctccattacacgttatttcccaggcctgcttttgtacgaggactgcagcattttatttttattaaaaacaatttttttaaagatagggtctcactgtcatccaggctgtagtgcagtggcacgatcacggctcactgcagcctccacctccggggctcaagtgatcctcccaccttagcctccggagtaccttggactacaggcatgcgccaccatgctgggctaatttttttttttttttttttgtattttttgtacagatagagtctccccatattgcccagtctggtctcaaactcctggactcaagtgatccacctgcctcagccacccaaagtgctaggattataggactgagaccactttaatcacaacagtcttctaactcctacactttaagttttaggatttgaaaaagtacatgtccacctccccgtgtcctgcctccgcctgattgcttttcttttcaaaaatgttacaggtgactctcaaatgttagccttttcaagcctcaagatcaactgggcaagctcctctcctgaagcccctgcctgacctctcactgtgttcatattaaatgtgtgaactaagccaggcatggtggctcaggcttgtaatcccagcactttgggaggctgaggcaggcggatcacttgaggtcaggagctcgagaccagcctggccaacgtggtgaaactccgtctctactaaagatacaaaaattagccaggtgtggtggcaggcacctgtagtttcagctactcgaggggctgaggcaggagaatcacttgaacctgggagccgagtgagcagccgaggctgcagtgagccgagatcgtgccactgcactccagcctgggcaacagagtaaggctccgtctcaaaaaaaaaaaaacagtgtgaactgggaacatcccttcctctatggttctgaagttttttttcatccaaaatcatggctttttctccctctccctggggaggagttggggggcgagtgctcctcggccttcttcccagagtccagtctgctttatacacgtatgcctggaaggtggggccccagattctcgtttctattacattctcttattatatttcccacttggccatcatccttgtgcaagaaagctggtggtctttgtgcaactctgcgctgggccggctcactgggtgtgcctcttaatcgtcaaagcctttctgctgttccatctcctgaacagacataaatgttcttcctgcccaattaccctgtcatctgctagaggcatcctcatctttcttgttttaaggggactgcctcccacacttttactttgaagcagtagctagctattaatacacgatgccacttatcctgttaaggaaagagccctattactaagccccttgaccaagagctcttatcaggaatggatgttaaacgtgaaacgtcttcttaggatctgtgaaactcactatctaggctcttctctgacccaacagtatggtttagtgtatgactggatttactgacacaaaaccagcctctcaccgctggtgtacgccactgtgggtgactattcttttcctacagtgctggattctagttgctaagattttatggagggtctctgcacttccattcatgcgggaagctggtctgtgcttcctttttctgcgtttagctgcagcacagtgatgagagccacaggttctcgaacaagcctgcctgcttccgatctcagtcctgctgcgtacgagctggagccctcaggcaagatgcttcacctccgagtgtggagggcagagatgaagagatgccttcctcggggccgtcctgaagtttcgctcgctcctgccaagtacatggcacagtggctggtgccccttgcagctcattcccacacctgggccacgtgggttctggggagcagatggggtggcttcctttgtggagtctctgagctgcaagctctttggagtcacaagggtggctccctgacaacctctcactttggtccctggaccagaggccttttcaggttttctaccttgagtcaacgtcaccaatttgtactgcttgcagaatagtcatttcagcatgtttcaaaatgtactaaactggagcgtggcatttccttactaaactcctaagtcctgcgcttacttgcagggaattcttttaaaaaagaaaaaaatttaaaaagataaaataacatcctttctgtaggtaaggtatcaactgcttgcatgccctcatactgcacgtttacgggcaaaatctgctcatcaattctcaaaatccagctcactgattctgagatgcgatgcctctattccatgtcaccttttaatcacatgatctttagtcaatgatctgtcacagacaggagcttgtcactgtgctcctggtactctgcccagctgcttctggtttacgcatagtgagcatgttacttgggaaagcaaggcttcataactgtgacagtctttacagactgtattagcatgcattttaaatacgattttggcccattcattccagttcatctgatattaacactgcctcttacttctctgtaactgttttcttaactttaggtggagagagcatagactctggagccgctggcccgctttatccctgcctagtgccaccctggcaagcacctggcctctctgcacctgtttcctcacctgtaaaatgggaaaacaagattttctgaggcataatggggacttgtaaatttttaaaaatgggataacaagagtgcctcccaggtgcagagacagtgaagcatgaggtacatgatgcaccaagcaaaattcaacaatggcacaatcgttaccaaggttgggggggcagtgccacacgctgcatatgtgtacagcactcaagttttaatacaaggctgggcacggtggctcacgcctataatcccagcactttgggaggccaaggcgggtggatcacctgaagccaggagctcgagaccagcctgctcaacatggtgaaaccccatctctactaaaaatacaaaaaattagctgggcatgggggcgcacacctgtaatcccagctactcgggaggctgaggcaggagaactgcttgaacccgggaggtggaggttgcagtgagccgagatcatgccattacactccagcctgggtaacaagagtgagattctgtctcaaaaaaaaagttgggaatatctcaagccaatgccacgatgacttgtgctgcccccagaaaccaagggccccctgtctgggatggaatgctccctccaatggacaagaagacccatttatgtccctgctaggggtgcaggctgctcctccaacaggggttgccaggtgcaagccaaaatatggccagtgctcagaaaagggagatggaaatgccatgtgtatacaggggatccagcccatggcacctccaagtggctggagtttctccttttatggaaggagatgtcaaaggccagagacgttaagtaatttgcccaaagacatcacttaatagctatataatattccactgtatgaaaataccaaaatttaatttagtatggtgaaaggaagatttactctgccaaaaggaaaggattaagctgaaagctaagtcatgcaagaagctttttattttgttcccaagcagagagcgacagatgaaacgtggaccatgttcacctgacctgtgtgaagtgcagatttaccgagcgccagacgaatacgtaactgactattcccctacctgcccacactatttccactttagcaaatgctaggattcggggcttattatggggcttaactctccctctgtagagtgatgagatctcactttgtcctcatcccccagactctccctctcccgtgtcagctgggaatctacgcctgctggagggggatttgcgaactttgcccgcgtgcgtggtgaaacacccaacgccacccggcccccggagaccggggtcggggggagctgtgcttctcctatgccgggtttcgggccttccctccccactgggtgaacagtcttgggcaggtgtaggaacccccaaagtgctcacgacaaaaccctaggcggtcagttcttaccttgtagtgcgccagctggagggccagctgcacaaaggcgtctgggctcgtgcgacatttcttgatgattcctttaccaaaggctacgaatgggaaggaatggaaatccacgtcgtttgccagaagatttgcggtgttcagggaggtctctataacctcttgacacttgagagaaagaagaaaaaggttttacggaacgaggggagaaaagtactgacgcacacccagaaggaaattggaggctggtttttagtgcagctataaactcggtactgggaagtacacaaacgttttcctgacccagaagccctagtaagttaggggcatggctccctgaccccggaggagcagctgcaatgttatagcaggtagcgggtctgacatgagcaggccaggagagggcttcctccgacacacactgggaatatcacgcgaccatcagtgatggtcaggtggttgtgaactgtctctctaaaataataataggtcacagccggtgccagggaaaggcagtctctcagtagatagaaatggagctggtgaccagcagcttcccgataagatctcaagcgttgggcgagtgggctgaagcatgcgcactgagaggcaaaatggcggcgtctaactggactatgagcttcctccagcagtgctagacaggcaagggcagaacacctcaagtgagcatgcgcacaactccagtaaacatactgcgcatgctcccttcccaagcgctggagccactgtgcatgcggacagcccacaacaagggaggaattgggagaagtaacacaagaccctggacgcatgccaatgtataaaacctcaagtcaagaggtcaaacctcgcacttaatctcccaagttggccgcttggccctcttccaaatgtactttccttcctttcgttcctaaagtttttaaaataaactttcccgcttttaaacttggtctctcctgccttctgccccacagtcaaattcgttctgagaaggcaagaattgaggttgctgcagacccgtacagatatgttctgacgctaacaggaacatgggtaggggacgggggcaccctggcttccagtgagaccccaaagggtgtttcaaatagtcacacgtcatcttatgatgacgtcatcacacagtggcaatcaagaaacacatttttttactttttattattaatttttatttatttgagatagggtgtccctctgttgcccaggctggagtgcagtggcaccatcgctgctcactgcaccttctgcctccctggttcaagccattctcctgcctcagcctccggagtagctgggactacaggcacttaccactatgcccggctaatttttgtatttttagtagagacggggtttcaccatggtggcaggcacctgtaatcctagctacttgggaggctgaagcaggagaatcgtttgaacctgggaggcagaggttgcagtgagctgagatcgcgccattgcactccagcctgggtgacagtgcgagactacatctcaaaaaaaaaaaaaaaaaagaaaaagaaaatggtatcttggactccagggaatttctccttggattaagtgaactaggatttggtatttgcaaccctaaaattccttcccaaaagggctcctgtgaatgggctgcctctgagcatgtttaagaggtgccaaaatgaattaaactttgagaagtataaatgagcaatttagaggctttcagctctaacctatgtgattttggcttttagtttttgattatgagcattctgtagatgtctagttaagtttaagctggaaatagcgctgacagtcttagccaggagcttcaaacagaagaagaaatatttaccgaggcttccgaggcaacaggagctgtgacagccccgcagacccacggaactccctgagcaaacaactttcagcctcagtggtcttcaactgagctcatgatagggcaggaactacggttggaaaattcatctgtaagacttcaaatgtgtttcccatcccaggtaagtaacaatggttggataatccggacttacttcccccgggatgtcccactgcagcctggtggggtacggaatgttcggattgatgtcgcctttgcagtgcccatcctccgcatagcccagctggaggctgtcaatggacatgacgtactgtcaaaaatagaacaaaattattaaaactaacagtggtacataaaacacattaacctccaacatgaagagagggttgttctttgcagagatgttacaaagtttgaatcacagctgttaaggcttccagtatgctcagcacctaatgaggtggatctgatctccatgtcagatgtgacagagagaggacagacgagggctaagggcttgctcaagtttgtgacgctctcctttcactggcaagtaaacctaagccaatttattcaacggtgtttattgggcacctactatgggttggaaccactgtagcatcagcggcatccaagccctggtgacagcgcagacaagaactgtgttttgtgaacaaaacagacaagaattcttgcccttccttaaaaagtgaaatatacctgtatgacccagcagttccactcctaggtacatactcactgaaatgaaatgaatagatgctcacacaaaaacttgtacagaatgttcagagcagcattattcataatagccaaagagtggaaacaacacaaatgcccatcaactgatgaagagataaacaaagtgtggtcaatccatacaatgagatattatccagccctagaaaggaatgaattccaggtatgtgttacaacgtactgaaccttgaaaacattatgctgagtgaaaagaagcaggcaggcgcggtgcctcacttcagtaatcccagcactttgggaggccaaggtgggaggattgctggaggccaggagttccaaaccagctgggcaacatagtgagatcttatctctacaagaaattttaaaaattagccaggtgtggtggcacatggctgtagtcccagttactgaggaggctgaggtgggaagatcacctgagcccaggaggtcatggtttcaatgagtcatgactgtgccactgcactccagcctgagcgacagagcaagaccctgtctctagaaaagaaagaaaagaaagcgaaagaaaagaaaaaagaagccagacatagaagaccacatattgtatgattctatctatataagatgtccaaaataggcacatacatacacacagaaagattagtggtcatcaggaacctgggggagaaaggaatgagggatttcttttggaggtgataaaaatagtacagaattaggctgggctctgtgactcacgactgtaatcctagcactttgggaggccaaggcgggtagatcactttaggtcaggagttcgagaccaagctggccaacaaggggaaaccccgcctctaccaaaaatacaaaaattaggtgggtgtggcgatgcacgcctgtaatcccagctactcgggaggctaagcagtgactgttgcacaagcacctcgtgaatatactaaaaaccactgaattgtacacttttaaagggtggattttaaggtatgtgacttatatctcaactaaaaaaattaagtttttttaaaagaggaatccctgtgctcaggaagcttacattctagtgagggaggtaaaaacaacaacacaaggtcggggtgactgtcggctggcgaggcggcggggcgggtggaaggtgccgctaatacgtgggggtcacaatccaggctgacctgagccagcgaacgaacagacttgatcaggttccacctgctctgggtcagagctccagaagagcctgacacagaaacatcagaaataaatcaagagcaagaccgggtgtggtggctcatgttagtaatcccagcatgttgggaggctgaggcaggcagattgtttgaagccaggagttcgagaccagcctgggcaatgtggcaaaaccccgtctctacaaaaaatacaaaaatcagctgggcgtggtggcgcacacctgtggtcccagctactcgggaggctgaggtgggaaaattacttgaacccaggagttggaggttgcagtgagctgagattgcaccactgccctccagcctgggtggcagagcaagaccctgtctcaaaaaataaaaaataaaaatagaacaagaacaagaacaaacagactcaagtttgactagatctgtctttaagggactgcactgggcccccatgtgagactaggtcagtccccatctgtgtatggatcacataagcccccagccaggggtccctggagtcaggccatcctgtctgctggacgctaacaactaaacaccactacttctacgtgcccaccctggtctaagataaaatccctttatccttatccagagaactttaaaaaacaagcctgatcttgtaaatatccagtagatttctctacttgataaatgtaccctgtgtgatccagctgcctatggtcccgactctttttcttttgccaaacaacagctcttaggcatataggactcgggaagtccttggcctggggtataacaagcccgggctattatgctgtgcagagatttattaaagcgtgccttcttgctacgtccagagacactgaaggcagcttgatcttcaatgcgctctgtagctaaaaggctctctcagcttttgtcgacatcgccaaagaaccctggtggtggtgaaaagcccttttaatattggctgctttttatcaggtattaatgtcctagggtcatactggtgtcttaaagcctagagcactatgtttttttttttcctttttatcctttttcctacatagaaaacctcccttggctgaaggagtggctggaggttttgccaagactccaaccagaagtaagacaattaaaagaggtagaggaagatgagacaggagcccctaacctagtcttgggagagggtagcagggcagtgccattcctaggggaagtgaggtcagctgagacctaaggaagacctgacggggccaggagccaggggaagccagggggaaaagccttccaggcagagaggagagtgagtgcgaagactttgcaagaaaaaactggcaccagaatttgtttatctcttgggggaaaaatagacagacacaatattataaaaagaaacgtcaaggccaggcgtggtggctcatgccataatcccagcactttgagaggccaaggcgggtggatcacttgaggtcaggtttatatatatataaaaattatccgggcatggtggcatgtgcctataatcccagctactcgggaggctgaggcaggagaatcacttgaaccggggaggcagaggtggcagtgagctgaaatcgcaccactgcacaccagcctgggtgacagaacaagacgccatctcaaaaaaaaaagtcaaaattcaaaacattcacagaagtttaaagaaaaaagaaggtcatacattatgatgtcttcacaagtttactactaatttctttcttttttttttgagatggagtctcactctttcgtccaggctggagtgcagtggcgtgatctcggctcactgcaagctctgcctcccgggttcacgccattctcctgcctcagcctcctgagtagctgggactacaggtgccagccaccacgcccggctaatttttgtatttttagtagagacggggtttcaccgtgttagccaggatggtctcgttctcctgacctcgtgatccgcctgcctcggcctcccaaagggctgggattacaggcgtgagccaccgcgcctggccactactaatttctaatttcagacacacaaacccggctccatgccctatcaagaacagcgaggtgctcagcctgcagctgggccctgtctcccacacacgccgtgactttcaggtcattttattccacttcatttattaggccagcaggaaaatttaaaacactgcaaaaagatggtctttatagtcaatgtgaatctcaaaggggcttgttgctttaaaagaaaaagatctcaagtctcatcacaacaagtgaccacagtattttctgtgtcaagtctacggatgatgatcctagaatttagcaactttaaacaagaacctgaccggtgagttaaggaaacaaaactttcatttaatttctcatgccaaacacggaacaggtcaaacagttcagagtaacgaattattaaaaaaaaaaaaaaaaaaaaaaggctgagtgtggtggctcccatctgtaatcccagcactttgggaggcccaggcaggcagatcccctgtgcccaggagttcaagaccagcctgggcaacatggggaaaccttgtttctacaaaaaatacaaaaattagctgggcatggtggcacacacctgtagtcccagctacttgggaggctggggtgggagaatgtcttgagcctgggcggtcaaggctacagtgagctatgattgtgccactgcactccagtctgggtgacagagtaagaccctgtctcaaaaaaaaaaaaaaaaacaatggtagaggccaatccacaggtgcaggcagggggacaggggtttgtggttttcaaataacctggtaattttaagaattaaaatgatgtcttaggtaaaagacacgctgcatgtttataaacccagattttcacatgcttgcttctatttggcctaaaaaatgcggtaggtaggaaacactaggaaatccagcacataagggatagtttattccaggaaaaaccgagcttcacttctgctgtgaagctgcggcctgagagtcaactgccatttcactcttttgttccctaaggagatggcaggagatgcactgctgttcaagggacctaagttatgggaaaggaagacagggatgcctttaatctagtgatttaacttcatgtgcattactagtacaagtgaaaaattcatattctataatcacgcaaatattacaaaactaaattgactgtggggtttggattatcttttttgttttttctttttgagacagagtctcgctctgtcgcccaggccggagtgcagtggcacgatctcggctcactgcaacctctgtctcccgggttcaatcgatttcttctgcctcagcctcccaagtagctggggctacaggcatgcaccaccatgcccggctaatttttgtatttttagtagagacggggtttcaccatgttggccaggctggtcttgaactcctgacctcaggtgatctgcccgcctcggcctcccaaagtgctgggattacaggtgtgcgccactgcgcctggccaggtttggattttcaaaagcaacttccacattcaagtgaaaagtgtgaaaactcacctcccaaaggtgggccacgatcggcgcatctgcccaggagtgttcagcgttgaggcccatcttcccgtttttgaagacaacaaacgtgaacgacttgtcaaaccacctacgtgaaacacacatgtgtggaacttaagtgtttaaagaggcaacaatgaggagacattgcacctctctgcttcatcctggatggactaattcactttgcacctgtccctctaacagtgagcagacactcagtctctgtggagtgagggtgaaagtacaaacaggacactgaatcactcatttcttccctgtcccagacacaaagatgagcgcttatatcctggcagcctgaagtcaggacctgttgttatcgcaaggcaactggggagaggtgggaggctcttcccgtgggcacatgaccccttcatcagccaatccttggctccaccctgcagggggcggggctggccaacactttacagataagaaaaagaggacttgagatagccacatgccaacaccctggcctaaccctgtgcctagccctgtttgccactctcccctgcctgagtccagggacctggcagccctgcatctcatgagcatctccaaacaaaggtggtcatgcacagaggagggaagaatctcagatttgcagctcaggctgtgtatgtgtgatagttttggcagagggaagaaaactgaaggttggccaggcgcagtggctcacatctgtaatctcagcactttgagaggctgaggtgggtggatcacttgagatcaggagttcataaccagcctggccaacatggtgaaatcctgtctctactaaaaatacaaaaattagccaggcgtggtggcacacgcctgtaatcccagctacttgggaggctgaaggaggagaatcgcttgaacctgggaggtggaggttgcagtgagccgagatcaagccactgcactccagcctgggtgacagagcaagactccatttcaaaaaataaaataaaataaaactgaaggttatatttttatgccaccttctttcttagcattatagatacttaggggtgagtgtcaggcacacagggtatttcttccaagctcatgggcaaactcctgtctctcagaaggtaaggacggtacctgtcgtaacatcggccgtgtagtagagatttggcgtagctgtccattgacgtatccgggtcttcacttctgtatccttcttcagtttcatctaacgtcacaaagaacgctgctttctccacagcatcaagagactgcttatttttcccacgtccaaaataggcctgacgacacctggcccagggaactctgcagtgaagatgaaatacgattaaaggcagcccgacctgcagcgatggagcgtgatgtttgaaatgacacaatcaaacctttgcagtttttcagaatttctcgaaggaaaactccatgttgatgatgttccccatctgagactgtttgctggaaggactctcacctgctcctggtctccagaccacagcatggggagcggtgggtattttttgttcaataaatgctgactaaatgaacggccagattgcaggctggccccgtgggcaaagccgccaggaagcagcagacccagatcaccctgttccacgctccctgacacaccctccctcccctctacaggaaccaccctaggtaagttccggcagcccaggtcacagtaagtgcgtaagagtgcgtccctcatgccaggctctgctccaaaccttttctgtgtaccaacttactgatcttctcaatgctactgtacctatttttcagatgagaaaactgaagcacggaaagattaggtcacagctattttgaggcagagtcggaacccaggccatcagcccccaggtgcattccacagatgcccatgtgacccctccacaaggaggtctccgtgcccgtcttatttgaatacacagaactggtgtgatgcccacttccttcttggaagacccaccagctgggcttcctcgagtgctcccgggtccctctcactccagctcctccaggaccctctgccactgcccacccttccagatcggggccatctggctctctccccaccttcttctctctaggagtgcttggctatggcggcccgcagggcgaataagcctagaaacacgctaggcctcagtgcaccccgctcggggaacaaaggtgacgctgacggtggccggcacgtacggagcccttcctgtgaatgactcccatgggtaagatgctgatctggccctatccagagggggcatcgggaccgaggcgcctacagacccacagggagcccaggccccgcggcgccggctcaggctccccacgtctcctccgctggggattccaggctctgagaggagggcatcggatgagcgcatcttcacccgagatgcatctcctgccgccgctctttccagccttgtcaacaccacagcagataccgaacaacgccggcttgcccgcacacatcctcctccatcccgctcctgctcccaggcctggccctctttcaggccctcactacttgggccaccgaaaagcatccctgtgtccagggcccctcctccctgcccaaccagaagaatctcccacattaacctactcatgcacccccggccccaccccaccctacaccacctgaagcggcacccagttgcagaatcaagctcaaatatgattgggtgcctgggaccctccccagcttggcaccgtggcccagctgcccagcccactccacggctcctgcctgctctgctaccccggggcatgcggctccaccccctggacacccactgtcctcctggtctgctcccaccctctgcaagacacagcccacctgcggcccctccacgcagcacagaacctctcctgatctttgcagaaggggccccaacacctgcccctcccgccttactcccagcgatagcgtagcagttgtcacactgctggaacgcagcagctctcagctggggacaacagtgtccccctgatgctgggcaatgtctgcgacacttctggttgtcacacaggttgctgctggcagtcggtgggcagaggccagggctgctgctcagcatccaacgctacacagggcagtgccccccacaaagaggtacccggccctgagtgtgcacagctctgaggtgagaaaccctcctatacaatacacaccacacctgcgagaaaaccaagctcgggctgattcgctttcttttttatgttttgagacacagtctcactctgtcacccaggctggagtgcagtgccttgatcatggcttactgcaacctcaacttcctgggctcaagcaatcctcctgccttagcctcctgaatagcttggactacaggcacgcaccaccaagcctggctaattttttggtagagatggggtctcactctgttgcccaggcacatctcaaacccctaggctcaagtgaccctcctgccttggtctcctaaagcaatggaattataggcgtgagccactgcgcccggcctgattctttttcactgaggcaaggaaatgtaaccctaacacaggggccttggtttccatttgttctgtttcctaaattaataaatatgcccacagccccgtaagaaaggctaatcctggccaggcatatggttcatgcctgtaatcccagaactttgggaggccaaggtgggtggatcacttgaggtcaggagtttgagaccagcctggccaacatggtgaaaccctgtctctactaggcatggtggcgcactcccagctactggagaggttgaggcaggagaactgcttgaacctgggaggcggaggttgctgtgagctgagacagtgccattgcattccagcctgggtgacagagcgagacttcgtctcaaaaaaaaaaagcctaattctaatcctcacttctccctgtcctggactctggagtgtttccacacacatttgcctgacacacacacaggggtggccagggaccccccaccatgtccccattgctcttgagacctgccaagccgggagaccccagagaaaaacagagccgaggtggggagtcccgtgccaggattcccacaggccctggtggggatgggccccagtgaggaagagcgcctccaccaccccccaaaacaggacaagggacctaggctgcgcacctgtctcctgcggtgagggctgccagcctggcctccccgggctgaggctccgaggtattgtccaggatcctctgcatctgctgctccatctcccggggcttcagcagccgcccatcatggtagagccagaccttgaagtagcgtcctcgatggtacacgacgatgtgcttgctgtctctcatgtgctggatggtgtctgagccggccgcaggttggagacacaaaaccaagagtcccaagttcagcacgtgctgagacgaccgtaccctgactctgcaaagggcatgggagtccctgctctgcgtctctccaggcagcctcaggaacctattcctcaagacgttttaaatgattaaggacagcttggagttaaagctctggatcggagaggcctgacttctgagctcagcttagtcactcattagattatgacctcaaacaaattacccgaggccaggcgcagtgggaggctgggagtggtggctcacgcctgtaatcccagcacattgggtgaggtgagaggatcgtttgaggtcaggagttcgagaccagcctggtcaacatggtgaaatcttgcctctactaaaaatacaaaaattagccaggtgtggtgacatgcacctctagtcccagctactcgggaggctgaggcaggagaatcgcttgaaaccaggaggtggaggttgcagtgagccgagatcaccccactgcactccagcctgggtaacagagtgatactccatctcaggaaaaaaaaaaaaaaaaagcatgcttagcaaaatggaatattatcattaaaaaaaaaaaaacaaattacccaaccctccctaagcctctcctcagtaaaatggaggtcatatgttccccatatgcactgtgcaagaattaagagacgatatccgtaaagcccatgtaaataggcattcgatccgtatagtaactttttattaattaatgacaatagggcaacttagaaaatatgctgagaaacattccgataattgtttctgagaacccgagaaatgttctgagaaagaaagtggaaaattacgaaaccaagccattccgtaaaaactactaaaacagagtaatttaagctcctcagtaagcttaaacatcacagaaatgtgatgaagtacgttcactccacgaatatttatcaagtcctcttaagcactgctcagtggggatgcacagtgacagctgatcaaggcagatcgtctagtgaggaagacaaataaatgcatgattaaaaataggacaagctaccaggagcagtggctcaccctgtattcccagcacttcaggaggccaaggagggaggattgcttgagcccaggagtttgggatcagcctgggcaacatggcaaaaccctatctctacaaaaaatacaaaaattagctgggtgtggtggtgtgcacctgtagtcccagttattctggagctgagatgggaggatcacttgagcctggggagcagaggctgcagtgaactgaaattgcaccactgcactccagcctgggtgacagagcaagatcctatctcaaacaaacaaacaaaaacaaaataggacaagtgtcacaaaaggctagaaagtgtaggactaggaccaacctagcctggagatgtgagaaagcccttccacccccactaaggaagtgatgtttaagaagaacccggccagatgaagaacagaattaatcaatattatgcccgatctcatgttttttttgagacggagtctcgctcttattgcccaggctggagtgcagtggcgcgatctcggctcactgcaacctccgcctcccgggttcaagcttctcctgcctcagcttcctaagtaggtggcattacaggcacctgccaccacacctggctaatttttgtacttttagtagagatggggtttcaccgtgttggccaggctggtctcaaactcctgacctcaggtgatccacccgcctcggcctcccaaagtgctgggattacaggcatgagacactgcacctggcctcctgctctgatttttaaaatgtttaccaaaccaaggatgcaggagacctgctttggtttgctgaagggttcctaccagaaacttggaccaaacggcatttgaagccttcgctttaaagtcacaaacaagacaagaatgcacaccatgactatgtatattccacattacactcaggatgctggccgggcaataaaataagaaacaagtaaaagataaaggattgaaagggaaatatcaaaggtgtcatttgcagctatgattagcatgtggaaaatccaagaaaacctatcagctgtttaagccaataagaatacagctgggtagtggctgggtgcagtgactcacacctgtaaacccagcactttgggaggccgaggaaggcggatcacgaggtcaggagatcaagaccatcctagctaatatggtgaaaccccatctctactaaaaatacaaaaaattagccgggcatggtggcatgtgcctgtagtcccagctactcaggatgctgaggcaggagaagcttgaacccgggaggcagaggttgcagtaagctgagatcctgccactgcactccagcctgggcgacagcaagactctgtctcaaaaaaaaaaaaaaaagaatacagctgggtagaaacacagtttataaaaacctttcatgttcctataccccagggcacaggctgaactgtgtccccccattcatatattgaaatcctaacccccagcacctcagaatgtggcctcatttggagatggggtctttaatgaggtcattagggtgggccctaatcctatgtgactgtgtccttttaagaagaggagtttagggttgggtgcggtggctcacgtctataatcccagcactttgggaggccgaggtgggcagatcgcctgaggtcaggagttcgaggccagcctggcctacatggtgaaaactcgtctctactaaaaaattacaaaaattagccaggcgtggtggcggacacctgtagtcccagctacttgggagtctggagcaggagaatcacttgaacccaggaggtggaggttgcagtgagccgagattgtgcactgcattccagcctgggtgacagaatgagactcagtctcaaaaaaaaaaaaaaaaaaaagggagactttaggacacgcacagagggatgaccacgtaaggacacagggaagagatggttatccaaggagaggggcctacagaaggaaccacctctgccaacaccttgatgttggagttccagcctgcagaattgtgagaaaatcgctgtcttgcttaagccgtgcagtctgtggtatttgttatggtggcctgggcaaacttacacgctgcataaccaacaccttgaaaatattcttgaaaaggaacaaaacaataaaagtgcttagaaacagctcgaacaaatgatgtgctgcaaggacttcatggagaaaagtatgacattttattaaaatcgcctaaaaaacaaaaaaggggccaggcacagtggctcatgcctgtaatcccagcactttgggaggccgaggcgggcggatcacttgaggccaagagtttgagatcagcctggccaacatggcaaaaccccgtctctattaaaaatacaaaagtaagctgggtgtggtggtgcatgcctgtaatcccagctactagggaggctgaggcaggacaatcgcttgaaactggaaggtgcggtttgcagtgagccaagattgcaccactgcactccagcctcggcaacagagtgagactcagtttcaaaaaaacaaaaacaaacaaacaaacaaaagtaaaaaaaaaaaaaaaaaaaaaaaagcagaatgtctggaatatataaatactttctacaaatcaataaggaaaagatacacatccatttttaaaaaatatacaaaatataagaacaatattctcaacagaagaaacccaaatgtccagttaacattttaaaagttgctaacccttttggcaaaaatgaagggaaaagggtattttatagattgctggggacgtgaaagttggtaaaatcactttgagggtaatttgtccatgccagtaagactggaaatgtcaaccagggcagccggcaagccaattctaggtgcctgctctacagactgtttgaccaatgcatgcaggggagaaacatacacagaattcactgagcgtcacttagaaaggaaaacaggaaagaaagaaaagcgttcacatactggaattgttttgatactataacgaagtacatcataaatgtcaataatgattgtactggagtggtaagattagggctgtatcttctgctaaaagattttctaaattttggtagtaattccattttatagcaatatatattattaaatagaaaaatgccagaacttaagacccttaagataagtctatacctctttccctttttttattttggggaatttgaatggtctaattagtgaggattgtgactgatgggatcctccggtggggatgtctgagaaagtgggtggggctttgcccgatgatcaccaacgaatggcattgcacgtgctcatatacatttacctttctttattttttttttttgacagggtcttgctctgtcacccaggctggagtgcagtggtgcgatctcagcttactgcaagctcctcctcccaggttcaagtgattctcctgcctcagcctcctgagtagcagggattacagacatctgctatcacgcctggttaatttttgtgggtttcttttagtagaggtggggtttcaccatgttggccaggatggtctcgaactcctgacctcaagtgatccacccgcctcggcctcccaaagtgctgggattacaggcgtgagccaccactcccaggctttgtatttacatttctttcattcccagtgatgttgaatgcttttctataactccttaaacatttctccttccaggggtgcccatcatttcctttccaattaggatcttcatggttttctggcagatttataagaactctttacatattaaccctgttctctgttgtgagcacttaccctcaatttgttatctaccttttaaaacagtttgaagtatttttgaaatatagaaaactaaaatctttacatgacaatatttggatttttccgttgttgtaatgagttgagctgtttctacccaaaagatatgtccatgttctagccctggtacctgtgaaaaccttatttcttaatcggaagtagggtcttttttttctttttttgagacagggtctcattctgtcacccaggctaagtgcagtggtgtgatcacagctcagctcactacagtctccacctcccaggctcaagtgatcctccctcctcagcctcctgagtagctgggaccacaggtacacaccactatgtccgactaatttttgtattttttgtagagatggggttttgccatgttgcccaggctgctctcaaactcctgggctcaggtgatccacccacctcagcctcccaatgtgctgggattacaggcatgagccaccacatctggcctggaaatagggtctttgctgatataattcaatattaagatgaggtcatactggactagggtggaccccaaatccaatgactgttgtccttgtaagagagacacacacacacagaggtgagagccaaggtgacatggaggcagagatcagagtgatatgcctacaagccaaggagcacctggacccccccagaagctggaagaggcataaaggcctcccccagagcctttgaaaagagcacggccctgctgacaccttgatctcggactctggcctccagagctgtggcagaagaaacttcttttgtcttaagacatccagtttgtggtcatttattccagcagccccaggaaactgactcaggtatcatgctcagaatggctgtccaggtacactaagtaactaggttttatcccagcatttcccttgtttattgatttattttatttttatttcatatacatatttttttgagatggagtctcactctgtcactcaagctggagtgcagtggcatgatcttggctcactgcaacctccacctcccaggttcaagcaatcctcctacctctgcctcctgagtagccgggattacaggtatgcaccaccacacctggctaatttttgtattttcagtagagatggggtttcaccatgttggccaggctggtgtcgaactcctgacctcaggtgatccacctgccttggcctcccaaagtgctgggattacaggaatgagcctttgtgcctggcctcccttgtttatttttttaaacacatacatatttacctcctggaatcactgtcagtgtaggccgcatgtctcaaacttaaatgatcttaaggatgtccccataccacggtgctgactgacagcaggtgacagcctccccaggacaccctgacccacttccctttggggacactgcctgccctggtcagtgaaggggcaactgcccctccaatcagggagacactgtgagaggatggagagaaccaacttcactttcctccacctcgttgcccaactgccccaggactgctgttggccaacacatctgtttttcacatgttgagctacagtacaatggacgacagtgtgtggcaggaagagaggaggggtttagccagaaacactgtgaaatccgtgaacacacatggagtgggttcttttttgtttttttgagatgaagtttcactcttgttgcccgggctggagtgcagtggcacaatctcagttcactgcaacctccacctcccatgttcaagtgattcgtctgccttagcctcccaagtagctgggattacgggtgcccaccaccatacctggctaattttgtatttttagtagagatggggttttgtagaccagtagtaggctggtcttgaactcctgacctcaggtgatctgcccacttcggcctcccaaaatgctgggattacaggcgtgagccaccgcgcctggccagaatgggtttttagagaacctctgaaggcaggatcagaggaaaggggagaatctgcttaggaaagcccactcagaggccagcttttgtgcaaggatacagcaaaggctccccaatgaccaccacagtgcacactactgactagggcttggtctggaatattgactagggcttggtctggaaggaccgggctgcaacaagacactcaaaactgcaggtcaggccaggcatggtggctcacatctgtaattccagcactttggaaggccgaggtgggacgatcacgaggtcaggagatgagaccatcctggctaacacggtgaaactccgtctctactaaaaatataaaaaattagccgggcgtggtggcagacacctatagtcccagctactcgggaggctgaggcaggagaatggcgtgaactcgggaggtggaggttgcagtgagccgagatcgcgccactgcactccagcctgggcaacagagcgagactccctctaaaaaaaaataaataaataaaattgcaggtcagctctggccctttccagccagcttcccaagcagccccgaggcccgcccgtcatacaggcctgccatgatggtcttgggctctagctcaccaagtgtctctgggtagttccccatccacaggcacctggggaaatggaggccatggacagcacagcctgggcctgggcctggcctggatgttccccacggtgcctgttctccctccctgtcattctcaaggacgtcctggtttggacggtggcttacgtggccaccctgcccaggtcaggcagctgataaaggagtggctggaacacaaatccacctttccgagcacgacccagtgtgcgttccatcacaaacgctgactgtgagccggagtaaaatgcccctgaggaatccagactcaggaaaaaaacactcagctgtgtgtgactcacgcctgtaatcccagcacttcgggaggccgaagcgggcggatcacttgagtccaggagtttgagatcagcctgggcaacacggcaaaacctcatctctataaaaaatgcaaaaattagccaggcatgatgcatgtgcctgtggtctcagctactggggaggctaagatgggaggattccttgagctcaggaggtggaggctgaagtgagccgtgatcatgtcactgcactccagcctgggtggcagagagagacctcatgtcaaaataaataaataaataaataaatcaaacactctatgagacagttggcagtcttcaaccaaagagaaattaaaatctggaaataagtcaacaacagtgtccaggcctaagacagacaaaggaaattcagcagaaggaatgttcaccagcctacaatctcaggaagggtcagcaaaaatcaatttggcccctttgacacttcctaattctgagcatagggatggaaagtgccgattctccagggggccctgaagaagcttgactcacctgtctcctctcctgggatccgggaagtattaaacatccgctcccactgagcggagcagagtggaatcgtggatcccaaaagacgaatctgtaacaaaaatatatttcaaaccaacaacgaaaatcccacagaagaaaagcagcaagttggccgggtgcggtggctcacgcctgtaatcccaacactttgggaggctgaggcgggcggatcacgaggtcagtagatggagaccatcctggctaacacagtgaaaccccgtctctactaaaaatacaaaaaaattagccgggcatggtgtcgggtgcctgtagtcccagctacttgggaggttgaggcaggagaatggcatgaacccgggaggcagagcctgcagtgagctgagatcgtgccactacactccagcctcggcaacagagcgagactctgtctcaaaaaaaaaaaaaaaaagaaaacaaaagcagcaagcagcaagcaagttaagaccacatggaaatgctgaatgtgttttctgtgcgaattgcttcgtttgacttcctcttttccagtggctcactggaatgattcgttgggggactcattaaaccatgccagggtgcaacttcctgcacagttaaatcctaaataacacattctaattgattattgataactgacacttacaaccaaagaaatattccaggaagaaaagtcttgtttcttatgagcaactaagcagctagtattagttcaaaaacatcaagggcttctccaaagggcagattacagaattaaagtacaacagatgtatattcatttaggagacacaaggagaattacatctcagaataattaggctgggtgaaagaaactagaattccgaaaaaaagagtgcatactgttatgattccacttacacaaagctttaaaaattgcaaactaatctagagtgacagatagtagaccagggggtccaggaccaggtgggagggagagatgacaaagggcagaggggttttcgggttgactgatgtattcaccatcctgactgcagtgatgatggtttctcagatgcatcaatatatacacatcagaagttagcaaactctacactttattttttaatttttttttttgagatggagtttggctcttataacccaggctagagtgcaatggtgttatcttggctcgctgcaacctccacctcctgggttcaagtgattctcctgcatcggcctcccgagtagctgggattacaggcgcgtgccagcacgcccagctaatttttctatttttagtagagacagggtttcactatgttggccaggctggtcttgaactgctaacctcagatgatccgcctgctttggcctcccaaagtgccaagattacaggcgtgagaccctgtgcccggccacaaactgtatattttaaacatgtgcaatatgtcaattatacctctgtaaagctgtttgaaaataatttttttaaagcaatttgtttgcctactggtttgatttcctcccggtccagtttgcgcctgtaaagcaggatggcatggatggcgttgccggctcttgctgcctgaatgtgagttggaaggatatacagcagatcctgaaaagcgacaaaggtggagagaatttgcatagggaaagataagcaaatttaaataatcacagcacatcctgcacactgtcacaatatttctagagatgcatcaatatacatacatattcggttacatctgcaatgctacaaaataaatggtaatttgattttctccactttgactttgtaaatgttttatgagaacataagtcctctaaaacttctgcgctattaaagataactatttgcaccaaataccctcacgtaacacagagaaaggaaagcaaaaattagtcggggagcaattagacaatcaggaagttttctggatgagacacaatgaaaggttaaaatagttgtttatatagagctgtgcctgcagctttctaaattttgagaccctgttccaaatgtctgcattttccacaattggaagaaaaggccaaggaacacaggtctaacctacattttggaagagtctatgtacacaccatgtccccattgatgtagaaagtgcctctgtttgtgggaaataaacaaaggtctcctggcgggaagggcatcagataaatagctcacttccaaatagagcaggaaaagaagttctatggactacactaacggtttttctttcagtttgagattatttcagatgggaaaaaaaaagttaagagaaaaagaaaggacaattttgaaacgaagaaaaacagaaagaaaaagcaaatgataggccaggtgctcatgtctgtaatccagcactttgggagaccgaggcgcacggatcacctgaagtcaggagtttgagactagcctggccaacatggtgaaaccccgtttctactaaaaatacaaaaattagccgggcgttgtggcaggtgcctgtaatcccagctactcgggaggctgaggcaggagaattgctggaacccaggaggcagaggctgcagtgagatgaattgcaccagtgcactccagcctcagcgacagagcaagactctatctcaaaaaaaaaaagaaaagaaaaagtaaatgattaaaaaataaacgagggaaaaaaataaaaggaagtgaaggaatggaaggaaaaggaaagagaagagttctatttgccagttattaaagcagtggtcaagaacacaaactgagaggccttctaaccatccatgctttgaaagacaaagcccaggaaaccagaaactaccgtcgatgcacacccctctggcgtctcagaaaacagtagggtgaagcgcagcgcactggtggcaggatcttggccaacccactgtccctgagctctaggggttctgcagggatcttaaggccgctgtggcaccaagttccagtgctaagccataaaaacagcaggacaggccgggcacggtggctcacacctgtaatcccagcacttagggaggctgaggcaagtggatcacctgaggtcaggagttcgagaccagcctggataacatggtcaaaccccgtctctactaaaatacaaaaattagctgggcgtggtggtgggcacctgtaatcccagctactttggaggctgaggcaggagaatcacttgaacctgggaggcggaggctgcagtgagccgagatcgtgccattgcactccagcctgggggacaagagcaaagctccatctcaaaacaaaacaaaacaaaaaaacagcaggacaggtacagcacagtgaggaattcctgtttgccagaaacttatttttgcaacccaaatccccctgcagtagcagagcaccctgggctactaggctaacactgaagggtactcatagggttctccggcctggaagcaggacagagaggagcatgagccaatccccagagttttcccaggccgtccacaggcctgtgaagacgccacctctgtggacagacccgccgccccaccgtcctcgtcagacagcagcccgggcgggtggactcaccatggcataatagttgctgttcaccatgagcggccctcgtcctcggaggtagatgtactcctcccaccagtcgctcacctagtgggcgcaaacaccagacaaacccgcaggctcagcaggggccaggcaggctccctggcagcagcccagagccgcggggaagggcaggcagtgcttttggcagacatttcggcgtctaacaggggccattccagaacagggaacgcagtcctaactagatggaatgcgacaccgtgggaaatgaaaagtgttctttttaagttgagacaggcagaaagaaggtacatcaccttcattttgtagatggttcaaaagggaaataaaaagccgaagtgggaggattgcttgagaccaggagttcgagaccaggctaggcaacatagcaaggctctagccctacattaaaaataaaaataataaataaaataaaaatttaaaaatgtttaagagaccaaatggaaagtaaatcataaatgtctgactgctaacatgttttaaaaaccaaaactatgggctggccatggtggctcacacctgtaatctcagcactttgggaggttgagacaggaagatcgcttgatgccaggagtttgaagccagcctgggcaacatagcaaggttccatctctccaaaaaattttaagaaattagccaggtgtggtggctcacgcctgtagtctcagctacttgggaggctaagacaggagggttacttgagcccaggggttccaggcaacagtgagctatgatcgtgccactgcattcccacctgggcaacagagcaagaccctttctcaaataaaagaaaacagaaacaaaggccaggagcggtggctcacgcctgtcatcccagcactttgggagactgaggcgggctgatcacttgaggttaggagttccggacctgcctggccaacatgatgaaaccccgtctgtactaaaaatgcaaaaattagccgggtgtggtggcgggtgcctgtaatcccagctactcaggaggctgaggcaggagaattgcttgaacctgggaggcagagcttgcagtgagccgagatcgctccactgcactccagcctgggtgacgagcgagactttgtctcagaaactaaagaaaataaaagaaaacaaagaaaaaaccaatgttatgcaaaattgctccacagactgcttcccaggtctgcctgaagaagccaccgtcccagtccgtggcactaacctggtgttccgcaggtgttgtctctattccctggcacatgtgtcctgaggccacccagaggcagtgccccccaaccacctcacagctgctgtcccttcacagcctgctggacccagggatcgcttcctttcagctttgtgctgaaacacacgtacctacagaacagtgcccatgcaagggcctcgtgtgcggagagctgtgcagagagctgacgtttaccagtccagcacaccggtgcagccagcgaatatgcccggccccctgaggctagagagacccctccaggcactgcccatccacccaccatgccacgtctagcgccacctgctggttctgtcagggtcgctttggacaccttctcttccgtgttagttgttcctcaaagctagactccctcccttgctttgtctgccggaggcctgctcttgccctcccagtacgtggaagcccagccagctccccgcacacagggtgccagctaagacgcttcgttggaggagatgctcctgggaccaccgagccacactcaaccccagggaggggcgatcagcaccgccctatcccacaccatccctgcatccaccagcgagctcgggaaggatgcccttggaatcaagataaaccaaagaggaggatgggagcaggtctctggggcagcatggcactgctgcaggagaaacagctcacgggaggactctccggggaagagggagagggagaagcctcctgcgtgcaaaacacagcatcgtgctggtgtacctgcactcagggtaaaactgtcactgtaggctgggtgtggtggctcatgcctatgatcccagcactttgggaggccgaggtgggaggatcacttgagcccaggagtttgagaccagcctggtcaacatagtgagactctgtctctacaaaaaaatccaaaaaccaagaaactgtcactgtaactacacgtcagtcctaacacacacacactccactctgcacagaggtaaaactatagctggaacttcctagggtgtgattttggctaatccaaactgtcatttcagccctgttatccctgcccctcaaaattagcgtcttcatacggaaaaatttcatcaagaaaaactgtgtatacagacttacgtaatttgtagcccaccaggattttaacttcaaataccactgtaatcttggtccaagaccgacagcaaaatcttgagcaagtgctgtcatccgtttgaagtcttcttccttcataagaggcctcaccgactgtagatactgggattattgggggaaaaaaaaatcacccaagttaaaacatattaatcaaagcctatgtttgcctcacttgtgccttaggaaaagttctaacacattgaaaaggttttaggctgggcatggtggctcatgcttgtaatcccagcactttgggaggtcaaggccagtggattgcttgagctcaggagttcaagaccagcctaaacaacatggtgaaaccccatctctacaaaaaaaaacaagacaaaaattagctggacatggtggtgcatgtctgtggtcccagctacctggggggctgaggttgggaggatcgcttgagcccagaaggttgcggctgcagtgagccatgatcatgccactgcaacccagcctgggcaacagagtgagaccctatctcaaaaaaaaaaaagaaaaagtttagactcttcccccaagttggtcttggcagtccttagacaggtaaactcccttcaatgctaaatggtgtcatagggtaatgataatttaacaattaaactttttcttcctttattagctttaaaagtgtcccaaatcctgcatcaccagaaaatcaccattaaatttttagaatttaaaataaattctagagttgacaagaaaagttaacaaggaaatttcaagaatgtctcttatctattatttggcccttaataaaagatctgttctgacctaagtaagttttgatgacctgcgatggtgaccatgagatggggcagagtcatgctgagagctgggtgctggggctgggcaggtgctcaggcagcaggatgggaacgaggggctggaataggtcacggaaccaggctaaggccagtgccccaggttcagggtttccagcccccaccccgcctcgtccttttacatgtgctactttggttgaacaaatgctcagaggtggaaacacagagagcaattgtttaaaaagacactcaaaagcttctgctacacacctaagcaagctcttacagaaagtaacagtggtcaggtgtggtagctcacacctgtaatcccagcactttgagaggctgaggtatgaagagtgcttgagcccaagcaatcttgaccagttcaagaccaccctgggcaacagagtgagaccccccatctctgcaaaaaaaaaaaaaaaaaatacaaaaattagctgggtgcggtggcatgtgcctgtgatcccagctacttggaaggttgaggtgtgaggatcacttgggcccaggagttcaaagctgcagtgagccatgatcacaccactgcattccagcctgggtgagatgctgtttcccccagcaacaaaaagtaaaactgttgctaaccccacaatttgtcatgacatattttaatccgacaagttgtttgtctgctgtaaaaaacaaagcttggtgcaacagtaatctctctatagtccctccctgtacattgaaaagtaagaccccactcccttaaaagggccagctgtagctgggcacggtggcttatgcctgtaaccccagcactttgggaggctgaatcaggaggactgcttgagcccaggagttcaagaccagcctgggcaacatggcaagaccctgtctctacaagaaagtatttgcaggcatagtggtgcacacctgtggccccaactacttgggaggctaaggcaggaggatcactcgggcccaggaattcaaggttgcagtgagctaggacggtgccactgcattccagcctgggcaagagagtgagactctgtctccaaaaaaaagggggagggggcaggtgtcaagcatcttgaggcttattcaaagtaaaatgcccgtgaatgagacagaaaatcatgccctgaatgagctgaagtggaaccccgagctacgcaacacagacagaggtcactgaaggtcaagcatctcttgctcaccccatcctgccagtggaacaggggccgtcatcagccctgatttgcaagcgtgggcacagaagaggagagatggggtgggccaggtatggtagcttgtgcctgtaatcccagtactttgggaggccaaggtgggcagatcacttgaggtcaggagctcgagaccagcctggccaacatagtaaaatcctgtctctactaaaaatacaaaaattagccgggtgtggtggtgcacatctgtaatcccagctactcaggaggctgaggcaagataattgtttgaacttgggagatagaggctgcagtgagctgagatcatgccactgcaccctagcctgggtgacagagcaagactctgtctgaaaaaaaaaaaaaagagcagagatgggaagaccttaccaaggccaacagggactcagtaaccaagcctggattcaaacccttaacccgagaagtttttgcttattattatagttttaaaattggagtcccaggatgtggaaaaactaaagcacccatgcactgctggttagaatgcaaaatggtgcagctgcgtgagagtctcatggttcctcaatgagttaccacggaattcccatgagccagcaattccactcctggatacgtccccaacagcggatgaacaggtggataaactgtggtccttccatacaatggaacactattcagccacaaaaagggatgaagttcatccatcctacaacacgggtgaactctaaagacatgctagtcacaaaaggccacgtgattccatttatgcgaaatgtccagaagaggcaaatccatacagacagacaggagattagtggttctgaggggctgggagagggaggtagaaggatggggagtgactgcttagtggctatgagcttttgggggatgaaatgtcctggaacgagacagcagtgagggctgcgcaacattataaatgtacttagtgcccctgaactgtacacttgaaaatggttaacagtacaattcatgttgtgtacattttaccataatttttttaaaaacaaagaaatggagctgctccctctccttttgttcaattaaagaaaaaaaaagaccgaagcaggtagatcacttgagctcaggggttcaacacgagcctggacaagacagtgaaactccgtctctggaaaaaaaaaaaaaaaatagggccaggcgtggtggctcacacctgtaatcccagtactttcggaggccgaggcaggcagatcacgaggtcaggcgatggagaccatcctggctacagtgaaaccccgtctccactaaaaatacaaaaaaaaaatattagccaggcgtggtggcaggggcctgtagtcttagctactcaggaggctgaggcaggagaatggtgtgaacccaggaggtggagcttgcagtgagccaagatcacgccactgcactccagcctgggtgacagagcgagattctgtctcaaaaaaaaaaaaatattgccatatgtagtggcatgcacctgtagtcccagctactcaggaggctgaagtgggaggatcatttgagcccaggaagttgaggctgtggtgagccaagatcgcgccactgcactctagcctgaacaacagggtgagaccctgtctcaaaaaaaaaaaaaaaaaaaaaaaagaaaatgaaaaagaaatgagtagctttgaggatgaaatgacaggctttctaggtagtgccttgcccctgggggcctggctttgaagtgcggctgctgtgtcaagaagcaccctgtcctcagaccggctagaagctgactatcaccccaccctcagctggtgaccctcaccaatcagatcaaaaacattcgccacccagcaacagatgaacggataaataaaatatggtctagccatgcaatggaatactattcagccataagaaggagggaaattctgacacaggctgctatgtgtatgaactttgaagacattttgctgagtgaaagaagccagtcacaaaaggacaaatatgatatgatgccacttatatgaggtccctcagattggcaaatccagaggcagaaagtagaagagaagttactaggtggggggagggaagaatggggaatgactgcaatcatttaatacaatgttgtatttagtaattatgtaaagtagcaaaaactggcctggtgcagtggctcatgcctgtaatcccagaactttgggaggctgaggcgggtggatcacttgaggtcaggagttcgagaccagcctggccaacatggtgaaaccctgtctctactaaaaatacaaaaattagccgggcgtggtggcaggtgcctgtaatcccagctactcgggaggctggggcaggagaatcacttgaacctgggaggcggaggttgcagtgagctgagattgcaccactgcattctagcctgggtgacagagggagagtccatcacaaaaaataaaataaaataaaataaaataaaataaaataaaataaaataaagctttaaaaaattcacaagcagtttctctatgaaacctgacactttttaaaaaacacctaagatgcagcagtgatgcattggagaaaaaaaaaaaaaagagttcctatgagaaccctaccaggcacaccgctgaaggctacttgagccaaatggcggtgacctagttcatcataattaagacctaagccttaatccacagatggctggcatttcagtgtgaggcctaagccacacctaccctgttcacagtgtctttgacagccgggaccggcaggcgaggcagcgatgtctggaagctgtacaacatgggttttcggcctgaaaagatcttgaccataccctgaagagagagaattatattttcagactactgccatactactctgaaggcacctgttctcgtctgatctcgtgaagctaagcagggtcagtcctggttagtacttggatgggagaatgaccatttcaaagacaaggctatgttaaagatccgaagccacttttcccgtgcgcacaatgtgccaaccacttactgattttctgtgtcgatttatttttcatctggtccatcttttacccgccccatacttacaggttctagcaaataagcatataaccctgccctccatgccaataaaagcctgggcaacatggcaaaaccccacctctacaaaaaattagccaggcatggtggcatgtgcctgttgtctcagctacttgggaggctgaggtgaaaggattgattgagcctgggagggtgatgctgcagtgagccatgatcataccactgcactccagcctgggcaacatagtgagaccctatgtcaaaaagcaaaacaaaaacaaacaaaccaaaaaaccaggtagaatcaaagccaagcctgacagaggccgtgagatgtcgctgccagcgtcgtgactggccaggaccctgaccgtgcttctgcacctagggtgagtctcaccccacctccttccgcaaggcccttagtttcgggatgggctccaggctctaggaacagtgaggagggtcaacgtgcctggccctgagccaagccgaggggaagcagtttctttccttcagtcattgccaagtctcccaaaggacacatctgtggcccttggttttaggctggatgatcaagcctgtataataaccagtcacctcaatggcaaccaaaacaaaggcagtccttgggcccaggcggggagtcttggtactgcagggcattgggactcagctgaacctcagctgtgaacccactggagggagtgccctttagcctgctttgccaagtgtgggagccacccctgagtctcttctaggtgttaaattctgcttctctagaaatcagaaattttatatccaaatggtagaaaattgatttgagagaaaaaattggtttggctgggtgtggtggctcacgcctgttgatcccagcactttgggaggccgaggagggtggatcgtttgagcccaggagctcgagaccacctggccaacatggcgaaaccctgtctctattaaaaatacaaaaaattagctgggcgtggtggtgtgtgcctgtggtcccagctactgtggaggctgaggtgagagaatcgcttgagcccgggaggcggaggttgtaatgagccgagattgcaccactgcactccagcctgggtgacagagcaagatgctgtctcaaaaaaaaaaaaaaatttgtttggcaaagagtggagtcccggtgtgtggtgggcactgcagtgactcccatgcttctctcacaagcaggctcccccagaggttgggacagcagcccagtccaggcaggcaccactgtgggggccatcccgaggcgaccaagcagaagggcaccggggccaaggtcggggcagacaagaaaccaaagcagacccacggcttcgtatacaccggcagacccacggatcagccccattcgagaaagattctgcagaaaatgtttccatgatgacctggtccattacaaccatttaggccacttggcaagacaggggtgaataaagcagatgtttctttacacacatctggccccagaaacccaggttgggcttgaggtgccgagcaaagcccaaggcccagggccatgactacaatgggcagatggtacacggggcacacacccgcctgcagggggtcacaggggccccagccccccagacggaggcctcgaaagtccagagacgatgcccatcttggagggttgattttcagaaaaactaagcccataaatttttttttttttttttttgagacagggtctggctctgtcccctaggagtgcagtgacacaaccacagctcactgcagccttgacctcctgggctcaagcattcctcccacctcagcctctcaagtagctaggattacaggcatgcaccaccacgcctggctaatttgcctggctaatttttgtatttttagtagagacgtctttttgccatgttccccaggctggtctcaaactcctgagctcaggtggttcactgggcttggcctcccaaagtgctgggattacagccatgagtagccatgcccagcccccataaaaacatttaaattgagaccgggtgtgatggctcatgcctgtaatcccaacactttgggaggtcaaggtgggccgatcacttgagctcaaaagtttgagaccagcctggccaacaaaaccccgtctctattaaaaatataaaaattagtcagccatggtggtgtacacctatagttccagctactcaggatgctcaggtgggaaaatcacttgagcctaggaagtcgaggctgcagtgagccgtgatggtgccactatactccagcctgggcaatggaacaagaccctgtctcaaaaagaaaaaaaaaaaaaaaaaagctgggtacagtggttcacacctgtaatcccagcactttgagaggccaaggcaggatcacctgatgtcaggagttcaagaccagcctgaccaacatggtaaaaccccgtctctactaaaaatacaaaactagccaggcatggtggtgcatgcctgtaatcccagaaacttgggaggctgaggcaaaagaattgcttgaacctggaagggcagagtttgcagtgagctgagatcacaccactgcactccagtctgggcaacaagagtgaaactccatctcaaaaaaaactaaaatgaaaaaatataaatataaataaaaaagaaaaacatttaaatcatgaaatttggacaagcatccacatatatggcaaagccattaccttaaataagggacccttgggctgagggccaaagcaagctggaggaacattccagaagctaagtctgagtcacgggagcctgtctgaggggtcagctaaggtaaccatttaatgcctgacaacaagtgagtcaagaacactacaaagaaccggatggacagcacttttatttgatgaatgacctgaactacaaaccgagcagacctcaatataaaatgctgcaggtctcactaatgtcacaaaagagaagcactctttggcccctgcttttgtgtcatggtgactcaaacctctccagccattcaaggttgaggcccaagtcaccaaccaagcatagagggagaaaaggtcgcaggggtgtccttccgcaggggtgtccttcttcccaaagcccaaactgtccaccccctccacagccagagggacacgcaattaccatccagatcttggtggcacgactcatcttgccgtgctcagtgaacatccacccgtggtaggagagcagcactttcagggagtagcgcatggtgacgatgagggccacccacaggccggtgccaaacagcacgccgctgaccacgttcttcgtctggctggacatgcagttgctgtggagacagacccagacaagggaggctgtgcgtgaggccacacggtgccaccaacaccaccggtgacgccacagacaccacgtgctgcagggtccagcagcctgccccaggtacagccgggaaagtcagagggagagcacttgcaggaactgagctcttaaaacactcacgggcactctcctcctcaccccaaaaccaatcacgccgaaagtagctggcagacccaggcgcccggggcgggcctgtttgctctcttcccagaggtcccttcagcccgatctgctcgggtggcctcgaaaccaaccagggctaatttgtgtcttctggaaaaagatacagcttcctccaggacctcaggaccaacggcagaggggatgctgtgaggccaggacctggccaccgtgagagccatgccctgccgacctgtgcgtccccggcaggtgcgcaggagattctgggccactttcttcagctcttgatgaatttttttctctcaaacttacttttagatgtaatcgtaatctcaaattatttgttacaactgttacctccagtatttatatcaaaagagcttgtttttgacttaggtgtatttaacacaaataaagaaacggactgtgtaaaacggtcatgtaaatattcaacttaaatacaggaaatgtttttgtttgtgaaggaaggtagtatatattatggtaaagatgggactttaaaaatgagatgaaattcagcttttttttttttttcgagacaagagtctcgctctgctgcccaggctggagtgcaatggtgtgaccttggttcactgcaacctccgcctcccaggtttaaatgattctcccatctcagcctcctgagtagctgggattacaggtgcgcaccaccacatccaactaatttttgtattttttgtagagatggggtcttgccatgttgcccaggctggtttcaaactcctgtcaggtgatccacccgcctcggcctcccaaagtgctgggattataggtgtgtgccactgtgcctggccagaaatgcagctattttgtggtttgttttagttttggttgttttgggaactgcaaaatattttttaaatgaaaactatttaagcatgcttcaaatgattaaaacaccaatatatataacctaaaggtgtccctaatatttgaaaagcactaatttggccaggtgcagtggctcaagtctataatcccagcactttgggaggctgagatgggtggatcacttgggtccaggagttcgagaccagcctggacaacatggcaaaaccccatcaatacaaaaataaaatttaaaaaagaaaataaaataagaaataaaaaataataaaaataaaaaataataaatatttcttcaaaataagaaataaaaaaagaaaaccactaatttaacactgcataatatttaagtggacaaaaacaaattatcttcaaggttatatactctttgctccaaaatgtatatctttctataacccgtgaaatctagcactggagtttcactgtagtctcttctttaaacctatacactcttttctggtcatctaacctataaacaaacttgggtttagggatttaagaagctatcttttagataatctacattttagattactgaaagaaaaagacctatatacttacttgatttgcaaaaataaaaatattttagcataaacaaataaatgacacattcaagatttttaaaagtatagacatagaggcactcagataaaaaacgttagcaaaaagctttctttgaaaggacatgctccttacaaggctgtcggggacaaactcagagacaaacctcacatgacacggatgactccacttttttattctttcttttttttaagagatagggtctcactatgttgctcaggctgatcttgaactcctgggctcaagcaatcctcctgcctcggcctcccaaagtgctggaattacaggccaccgcacccagcctgactccacttttgaaggcagcagcccagagatactgcagatcccctccaggacaggaaatggcccatgaggctggaagacgttggcccttaacccggcctttctaaatttaggccagggatggcccagtttaccaaaataggtttaagaggtacaaagaaacaaatcttacaaagacccagattattaagggctttaaacagtcaacacttctatatataatccagttttaagagagcgcctacactagagagtaaattaaagaactggcctgggtgcagtggctcacgcctgtaatcccagcactttgggaggacaaggcgggtggatcacttgaggtcaggagttcaagaccagcctggccaacacggcgaaaccccatctctatcaaaaatacaaaaattggttgggcatggtggcatgtgcctgcagtcccaggtactcaagaggctgaggcaggagaatcacttgaacctgggaagcggagcttgcagtgtgccgagatcgcaccactgcactccagcctgggtgacagagtgagactctatctcaaaaagaaaaaaaagaagatattcattagccccatgagagaatgaaaagtacgtaggaacagctccagacacaaggctcggaggcagctacccaccgcaggcctgtgggtcctgggacctcaaggaagagagcagccaggcctgccctgagcacccaggtctgccagctgctttctgagtgacagcaatgacagcagtacccaggcagacaaggaacctggcaggcgtcccagccaggcatgcttctgctaaaatgactgggaacttttattatgtttcttgcagactcttatagaggcctgagccagcgttcctgagctacctcaaggttgcaagcaactcagctggacgctcgatgactctggagggtccaggggcttcctggagaaggaacaggatgtggaggggtcctctgcagacccttcgcaaaaagaggttcaggaatcagggcacttgctcaagctgtcatcaggagactcagaccattaatctgcttaatcttttatttctagtcatcagaatcaaggctgggcatggtggctcacacctgtaatcccaggactttgggaggccgaggcgagtggaccacctgaggtcaatagttcgagatcagcctggccaacatggtgaaacctcatctctacaaaacatacaaaaattagccaggcatggtggcggacacctgtaatcccagctactcaggaggctgaggcaggagaattgcttgaacccgggaggcggaggttgcagtgagccgagatcgcaccatcgcactccagcctgggcaacggagcaaaaactccatttccaaaaaaaaatcaaattcagccgttaactgtgagtgagttttcgtttacgtctctttttctgccggtttattttcttatttctttctgattaaacaatatttatatgcaaacaacctggaaggcgtgactataaagatccagagcttcgttttttagcttagcccagacccggcattgtgccttccacctgcaattcctggccccaaaacaaagcccaattatgaggagttggtggctattattgacctcaggtgatcgacccacctcggtctcccaaagtcctgggattacaggtgtgaaccaccgtgtccaaatggcaaaaatgccattggtgtaaacaagcagcacagaaatcgaatcaaacgtctggcacggggcagcagggacacttccgagacactgtggagctttcagacccgaaagtaaaatgtgtgtccaagcccaagggtcacggctgcacgaggaagctgagttgccctgcgttccactgtctggacgttcaaatggtggtaaagcagcggtgttcactcgcatttgtctcacagaagcttctggggcagggggtggggggacctcagtgctacactgaagaaagcacagatttcagagctgcgcagagctgggtttgaactctagcttccccgctccctcttcctgtgacttgggcagacacctgcacctgtctgaatgctttctcactggtaaaagggaccctaatgagaggtcactgcagtgcaggctctgaccttcctagatgggagtctgggccatctccagaactggatggaataacagacatcacaggtgtgcaataaacatgtgctatcaacaggcggcaggtggttagaaaaaaaaaataaaatgaacatgtgctgaatgttacctaaggtgtctctgggcttatctcttggtagcaagaaataagccccaggaaaatccaaaaccctagaggtaggagggacgggggggtccctggagatttctaaaccattctgacagagttaagtgggtgaggtccctgcagaggaccccacagcagtcagttcaagggtcacagaactctggaatgaacagactccaagtgcaaagaaatgactacatggggaatcagccctttgagcagaaattccatttcagagccctattggccaggctaagggcactgtcattattgaccaaaccctcgggccctgacaccttccaaggggtgccccagggccactaccactcttctcaccctggtctacagaggaaaggccgcaggggaccgcaaactcctagggggaccttaacagcacccaggagacaggaagaaagctgacgtgagaacagcatcaggagcttcatatggaatccagaacagtgacaatcatcacatttgaagagacataaaaacagcaataaaatcggtaacttcccagacaattggagatttcacaggattacttacgccgtttccagagtccgattgatttttgcaattattcctaacgaggggtcgatcttggcgtacatcgttgtcatcacgcccaccaccacgataagccaactggaggggcttgccgggtacacgccagtgatgatgccgttctaaagacagacacccgggccgtgagcggtgtcctcccacaacccacagggcaatgacgcttcatggcccctggcagcagggctgctgggacagcaggcagtgagaagagggtgtggacagcgtgcgtgcactgagaaaccacaccccactagctgggactctccccagagtttacagcctgcagtgattccagtttcctcccttccactacttccgagccaaaacccaccctgaaagcttccccaagagtcgacgccccgggccatgataatcagcccaggcactagtttagctggtgaaggacgtcactgagccaccatgacgtcctgtccccagcctgctactgtctagaatgccccgagaccccggttccaaaactgctcctcttgccgcccctgtgtcagaagggctgcttaaccctgaagatttcatgggagacctcaccccatgtcgagaatttgctgtaaaatactccagccaaaaaaaaaaaaggattatatcaaacaaaattggcaaaattgttgaaacaaggaagggaatggtggggatctttaatcagtcctcttcactcttgtgtatgtttgacaactccaattaaaaaaaattcttcctaaaccatcctaataagatattgatttcaccaagataatggattaaaaatgaccaaagcaggccaggtgcggtggctcacacctgtaaccccagcactttgggaggctgaggcaggccgatcacttgaggtaaggagtttgaaaccagcctgaccaacatggtgaaatcctgtttctactaaaaatacaaaaaattagccaggtgtggtggtgggcgcctatagtcccagctactcaggaggctgaagcagaagaatcactgagcccaggaggcggaggttgcagtgagccaaggttgtgccattgcactccaacctgggcaacagagtgaggctctgtccaaaaaaaaaaaaaaaaaaaaaaattagccgggcattgtggtgtgcacctatggtcccaactacttgggtggatgagacaggaggattgcctgagcccagtgaggctacagtgagccgtgatcgcaccactgcactccaccctgagcaacagagcaagaccctgtctcaaaaaaaaaaaagaggggaggggaggggagagggagaacaacattcccactgggttgaatatgatggccaagcctctgcatccaagtttctattttcccagattccaaggtgaaaaagagcagctctcggcgagccgagctagtgcctcagtgaaatctcggatgtcaccttggtgggttatttatctgggcccaagaacccacaggctgagccccagggacacccgtgcagctgtactggctcccaggggcttgcccgccatgctgtccctgctgccacctgctcttgagcttaggcctttctcagtggcccacttcagtgccgccctcggagaaggagcaccgggaagtgcacaaactgaactgagttaccgctggggctggcaggggggtcagcggggggggatttccacttttgacttgatgaactttcacctagtttgcatgttttcaaacatgcacttgttccttctatgatgtttaaaataaattaaaatacatggaaaaacaagacacttacttaaaaaagaacaaagttctacttctttagataaacagaattgagaacatgtggactcaactgtatttgaacttgtggagagtttctttttttttgtttgttttttttgagacagagtctcgctctctcacccaggctggagtgcagtggcgcgatctcggctcactgcaagctccgcctcccgggttcgtgccattctcctgcctcagcctcccgagtagctgggactgcaggcgcccgccaccacgcccggctaattttttgtattttttagtagagacgggggtttcaccatgttagccaggatggtctcgatctcctgacctcgtgatccacccgcctcggcctcccaaagtgctgggattacaggtgtgagccactgcacccggaccttatgcagagagtttctaatgtgtgaatgttttataaacaaagtagttattacatccacttgctgaagtttggaaaaaatatttttttgtttttttgagacaaagtctcgctctgttgcccaggctggagtgtggtggctcaatcatggctcactgcagtctctgcctcccaggttcaagtgatcctcccacctcagcctcctgagtagctgggactacaggtgcatgccaacatacctgcctaatttttctattttttgtagagatggggttttgtcgtgtcacccaggctggtcttaaactcctgagctcaagcaatccgcccacctcagcttcccaaagtgcagggattataggtgtgagccactgcacctggcctggaaaaatcctatttgaacaaggtgtaaaggattctgactcagagcagaagatgtgaattctagtctttactctgcctcctattaagtaggtcgctggccctttaagcctcgatttcccagcctgctttaacgcatgccaagtccctccacctgcctaatggaactgctccaagcatccagtgagctaaagtctatgtgacggtgtccccaagccttaagtaccatggaaacaggtaagtgatatgcagtcgccagtctgaaacacgtagacctcaatagcagccagagccccgttcttagatattaaaaggcatactgtgtagatttcaacaaatctcagaaaaccttgaatctgatgaacttctttttccaggaatgaagtccagagagatagatttgtctaagagcttcatggctcagccgcaggtcaatcccgtccggagtgaccgtgaactgaaaggccacagcttggtgagcttctgccatcttcagagagtacctggaaggagaaggagaaaatgtaacacagtggaacgtgtgaccagacactaaaaaaccctcatacagaagtgccattccttctgaacttaagttcttcctcgccacttaacagatttaatacttttcatcaacagaccaattccatcaccacagctggcacccccttgcctgtccaccgctacaaagacagtcgccacctctgcttagagccccaagatgatcatcaggagtcaggcccgtggtaccccaaccctggccctggacattccctggaaccacgcctccaagccagcatccaggcccgtggtacctcaactctggccctggacgtcccccagaaccacgcctccaagccagcatccaggcccgtggtaccccaaccctggccctggacgtcccccggaaccatgcctccaagccagcatccaggcccgtggtaccccaaccctggccctggacattcccgggaaccacgcctccaagccagcatccaggcccgtggtaccccaaccctggccctggacgtcccccggaaccacgcctccaagccagcatccaggccacacctactgacgtaaagcccacggcgcttcagcaactcgcacagcacagacaaatctcaatcttgcagccaggcccttggaggctggcattagaagaggcccagagtgtccacgcaggagtccacgaaggagcccacgacagccctagactctgaacttcgagcgcagatcaatcccaaatgcctctgcctctggtgtctgtgtggctgctctttcgagaaactgttctagggtttcggagagacccacgaagactccatgagtcatatgcgcagacacctcaagaatgggtgtccacagacggagcgggccttcttccttggaggcagcggctgaaacggaacgtgccttggcggccccacgggctaaacggatcccggggcgctgcagtccagacccaagcacagcccctggggagagcatcccctggccggctgcagaaaactgcttccggatctgctacattcttcctgtacccttcatcctggctccggccgccttccttcaggctccttggcacagccgctcagcacaacacagcccacccccatcccctcctggaccccccggggtggtggctcctgcccttctcacggtgcctcctccacctcctcccaagctgcctgccacaaagtactaaatggataaaagagaagctaagaggaaaaaactttcaaggaccataataaaaatccaaaaactcgtgtgtgtgtgtgtgtgtgtgtgtggtgtgtgtgtgtatacgtgtgtgtggtatgtgtgtgtggtgtgtgtggtgtatgtgtgtggtgtgtgcgtgtgtggtgtgtgtgtgtggtgtacatgtgtatatgtgtgtgtggtgtgtgtgggtgtgtgtgtggtgtgtgtgtgggtgtgtgtgtggggtgagtgtgtgtggtgtgtatggtgtgtgtgtggtgtgggggggtgcgtgggtgtgtgtgtggtatgtgtggggggtgggtgtgtgtgtgggtgtgtggtgatgtgtggttgtgtggggggtgggtgtgtgtgggtgcgtgtgtgtggttgtgtgtgtgtggtgtgtgtgtgtgggtgtgtggtgatgtgtggttgtgtgggggtgtgtgtgtctgtgtgtgtgtgtgtggtgtgtgtgtgtgggtgtgtgtgcgtgttctcaccacaggatgattttcctgttttcgcccactgatgccctctgaaggtgagatcaaaatcagtggctatcacagtttcaaagatcccctgttacagaaatcagcctgactcagtcctccaccagccaaaacacagaaccatccgctggcaggccctagaaaggcacccgacttcagacatctgtccatattacaaatatttgttgactgcctccaacgtgccagccgaggagaagagctgcacaccagcagaaaaggtccctctgccctcccacagcttagaccgggctaacaagcaacgcaggagcagtgctctggtgcaggaaggggagaagccgaggggacctctcaggagacagggaagccaggagaaggagcaaccatgggaagagcaggcaagagctggaggcaggaagggcaggaggatggggtcaagggcaggaagctggggtcaagggcaggaggctgggggtcaagggcaggtgtctggggtcaagggcaggtggctggggtcaagggcagggtggctgggggtcaaggacaggctgttgggggggggtcagtggcgggacagctaaggtcaagagcaggccagcggggtcaagggcagggtgtcgggtcaaaagcaggtgtctggggtcaaaggcagggtagctggggtcaagggtagggtgtctggggtcaagcacaggtggctggggtcgacagggtgtctgggttcaaggacagggggcctagtttggagaggaaggcagaggcagccggtgggaggtggcagggttttgtgctagcaatggagaagcatccaagggcccagagaaaggggaacctgccactgtttcttttctaaagaccactctggctgctgtatggagtatggatggggatggggaagcaggaccagttaagaagctgaggctgtcttccaggaaggtgcatgggcctggcccactctgtcagtgacagggacagtgacagtgtggacaatgacccacacaagacagtctgcagaggcaccttgagctgcacttgctggtgaaatgggccctcgggctcctgtcttgagccacccactcagtgaagccaggtactgacaagggacagtctcagggagggaaggaggcaggctggggcagaagctgagaattcatgcctggacctgccacatgtgaaatgtcaccaggacatccgggtggagatgccccacatcgccagagcaagggaggagctgggcaagacgacacacccgggaggtatcagcacagaacctgccagctctgcctcaatgactcggaaagagtaatttggcaaaactaccttccaccagctataacttcagcttagagcaatttgcaaagcaatcgacaatatgtatgggccaggcacgatggctcatacctgtaatcccagcactttgggaggctgacgtgggaggatcgcttgagtccaggaactcaagaccagcctgggcaacatggcgaaaccccgtctctgaaaaaaataaaaaattagccaggtgtggtggcatgggcctgtagtcccagctacttgggaagctgaggcaggaggatcccttgagctcaggaggtagaggctacagtgagccatgatcacgccattatactccagccagggcgacagagtgagaccctatctcaacaacaacaacaacaaaacaacagtatttacatattatttagtaggcacgcagccaactcccacggcctggccagttttaaaggaatggatcccatttttgaaagcagcaagatcaccaagcagatgtttgccatgggttgaagagggcatcaaagcaagcagctctgaaccatttctcaaaaagctatctaagcagctgtaagactcccgtggagtctcaaggttaactttttttttgagacggagtctcactctgtcgcccaggctggagtgcagcggcgccatctcagctcactgcaacttccacctcccgggttcaagcgattctcatgcttcagcctcccgagtagctgggcttacaagtgcctgccaccacgcctggctaattttttctatttttagtggagacagggtttcaccatgttggccaggctgttcccgaactgctgagctcaaatgatccgcccacctcggcctcccaaagtgccgggattactgctatgagccaccacgccccgcctcaaggttaactcttagcccccttccccatcaaagccttcgcagtaaccatgaggaaggcatcccagaagaggactctgcaaagcatgcaccgtggcaaataaagtgacgtgactggctacctctgcacgattgataagatctcctgggcttcatacagaacacaaaggcattattcatggcagtggattaaatatagcgtctgtagccaagtccctccaaagttatgtatccaacacttgctcagaaatctaacctctgataggaagagtcagactggaggtaattatagtgtcctttctaggagtgaaacgccctcgcagagcgatctgagtttaatgaaggacttgtttatttggactggttcagggtaaccctaagagttctaaatgcccctaaggtgcacaatttgtttttctacttctgcaggagctgagatgggctgtcctgacctagcctctccctctttgagccatgagcagaaatgagtgaatccaacaagggccagaggagctccctgtgcaaatgtaatgagcgcaaatcccaccctgggttctggcctggatcagtggccttatgcttaaaaacactgatatagccgcacctacagcagtcccctctcagctacagtttgcacgtttgtttgtttgtttgtttgtttgtttgtttgagacagggtctcgctgtattgcccaggctggagtgcagtggcacgatcatggctcactgcagcctctactccccaagctcaggtgatcctcccacctcagcctcctgagtagctgggactaataggcatgcaccaccatgctcagctaatttatgtatttttttgtagagacagcgtttcaccaccttgcccagactggtctcgaactcctggactcaagtgatccacccatctcagcctcccaaagtaccgggattacaggtgtgagccaccatgtctagtgattttgctttttgaagtctcagttatccatggtcaaccaccatctgaaaatattaaatggaaaactccaggcttggtgcggtggctcatgcctgtaatcccagcactttgggaggcccaggtgggtggatcacttgaggtcaggggttcgagaccagcctggccaacatggcgaaaccctgtctttactaaaaatacaaaaattagctgggcatggtggtgcatgcctgtaatcccagctacttgggaagctgaggcaggagaattgcctgaactgggaggcagaggtttcagtgagctgagattgcaccactgcacttcagcctggggtacagagtgagactccatctcaaaaaagaaaaaaaatcatagttttcgattgtgcagcattctgagcagtatgatgaaaactcccaccgtcccactccctccttccagggacgtgaatcacccctttgcccaggctacccatgctgtcaacactccctgcctacagggagttactacacagtagtactacacaggaaaacacctcgtatacacatctgtcccccggaatctgagggggactagttgcaggacccccatgcttaccaaaacccatgaatgtgcagtcccttatagaaaatagtgtagtatttgcaaataacctacacacatcctcctgtatatatatttttttgagacacagtctcgctctgtcccccaggtgggagttcagtggtgcaatctcgggttcaagtgattctcctgccttaacctctagagtagctgggactacaggcatgtgccaccatgtctggctaatttttgtatttttattttatttatttatttttgagacggagttttgctcttgttgcccaggttggagtgcaatggcacagtctcggctcactgcaccctctgcctcctgggttcaagtgattctcctgcctcagcctcctgagtagctgggattacaggcccccaccaccacgactggctaatttttgtatttttagtagagacagggtttcagtacgttggccaggctggccttgaactcctgacctcaggtgatccacccgcctcagcctcccaaagtgctgggattacaggcgtgagccaccgcgcccggcctacatttttgtattttgagtagagacctggtttccccacgttggccaggctggtctcaaactcctgactttaggtgatccacccacctcggcctcccaaagtgctgggattaacaggtgtgagccaccgcgcccaaccctcctgtatactttaagtcatctctagattacttacaataatgaataccttataaatgctatgtaaacagttgttatgctgtatttttattttgtattattttttgttattatttaggttttttctttttccccaaatgttttcaatccttggttggttaaatccacagaagcagagcctgaggatacaaagctgaccgtataggtttggttctgtccgcaaattcaggcacccaccaggggtcttggaatgtatccccccaaggataaggggggaccactgcaagtgtaagactgcctcctgtggccaatagggagtgcagatctaaaccataggaaaacaccacttcacactcaggaggatggctagtatcacaaagatggatgatagcaagtgttggtgaggatgtggagaaatcagaattctcatgcatggctggtcaaatggtgcagccacgttggcaaacagtctgtccgttcctcaaaagcttaaatacagagttactggcctggcaccgtggctcacacctgcaatcccagcattttgggaggccaaagcagaaagactgctttaggccaggagttccagaccagcctgcgcaacatggcaagcccctgtctctgtataataaacaaaaataaaaaaaaaaataaaaattgggccaggtgcagtggctcacccctgtaatcccagcacttcgcaaggccaagacaggaggattgctttggctcaggagttcgagaccagcctggggaacatggcaagacctcatctctattaaaaatcaaagaaattacccaggcatggtagtgcattgctgtaaccctagcaacttgggaggctgaggcaggaggatcgcttgagcccaggaagtggaggctgcaatgagctgtgattgcaccactgcactccagcctgggcaacaggggagatcctgtcttaaaaaaaaaaaagaaaattgtagaaaaatagacttaccatacgacccagcaattccatttctacatatatacccaagagaactgaaaacatgtccatacaaaagtctgcacacgaacactcacaacatcattcatgatagccaaaaagtggcaatacattctgctgatgaatggataaatataatgtggtccatccatactgtggaatagtattcagcaatgaaaaggaatggacctccgacacctgctgcaacatggatggaccctgaagacgtgatgctgagtgaaagaagccatacagaaggtcatatattgctgattctatttattctaaatgtctggaacaagcaaatctacagagacagaaagtacactagtggttgccgggggcttggagcagatgggaagatagggaggtcatgggtaaggagttgggggtatcttcttagggtgatgaaaacattccaaaattgattgtggtgatagttgcacaactctgtgaatatactaaaaaccactgaaagcctgggcaacatggcgaaaccctgtctctgcaaaaactacaaaaattagatgggtgcggtgatgtgtgcctgtagtcccagctactaaggaggctgaggtgggaggatcacttgagcctggaagttcgaagctgcagtgagccgtgactgcaccactgcattccagcctgggcaacagagcaagaccctgtctcaaaaaaaacccaaactcaccgaagtgtacattttagatgggtgaattttatggtatatgaatctctcaataaagctgttaccaaaaaatactgtctgaagaagtgttatctatttaatgtctatgcacctaaccattctctcctcaaatatatgatggtgggggtggatatgttattattttcttccatatcctgtccaccataatgctctggtcacattaaggactcattcagcagccataaaaaagaatgaaattggccgggcacggtggttcacgcctgtaatcccagcactttgggaggccgaggcgggaggatcaactgaggtcaggagttcgagaacagcctgaccgacatggagaaaccccatctctcctaaaaaatacaaaattagccgggcatggtggtgcatgcctgtaatcccagctactcgggaggccaaggcaggagaatcacttgaacccaggaggcagaggttgcagtgagctgagatcatgccattgcactccagcctgggcaacaagaacaaaactctgtctcaaaagaaagaaagaaagaaagaaagaaatcatgtcccttgcagtaatatggatgcaactggaggcctttatcctaagtgaactcactcagaaacagaaaaccaaataccgcatgttctcacctataagtggcagctaaacaatgggtacccatagacataaagatggaagtgacaggccgggtgcggtggctcacgcctgtaatcccagcactttgggaggccgaggtgggcagatcacctgaggtcaggagtttgagaccagcctggacaacatggtgaaaccccatctctactaaaaataccaaaaattagccaggcgcggtggcagacgcctgtaatcccagctacttgggaggctgaagcaggagaatcgcttgaacctgggaggcggaggttgcagtgagctgagatcgggccactgcactccagcctgggggacaagagcaaagctccatctcaaaaaaaaaaaaaaaaaagagaaaaaagatggaaataacagacattggggattccaaaagggaagggaggcagcagggcaagggctgaaaaattacctatcaggtacaatgttcactctcttccctttcatggagggcactctgggtacaccagaaacccaaccccaccagtatgcaaaatgcctgtgtaacaaacaggcacgtgtacccccaaatctaaaattaaattaaatttaaaaaaagactcattcaaaacaactgttacctcatggcattaaggaatttctgtgaattatcttttaggtattacaagatattgtggttatgttttttaagagacagagtctcgctctgctgcccaggctggagtgcagtggcacaatcacagctcactgcagctctgggttcaagcaatcctcctgcctcagcctcctgagtagttgagaccgtgggtgtgagccatggcactcaggcagtggttatttttaaaaagggttcccatcttttattgatacatcctaacatattgctacatgcaattgtatctttttttttttttttttttgagactgttgagtcttgctctgtcgcctaggctggaatgcagtagcacgatctaggctcacgttaacctttgcctcccgggttcaagcaattctcctgcctcagcctccccagtagctgagactacagacacccgacactgcacccagctgatttttgtattttcaatatagcccagattacaccgtgttggccaggctggtcttgaactcctgacctcaggtgatctgcccaactcggcctcccaaagtgctgtgagccactgtgcccagcctaattttatcttttatcatatctgggacttgcttcaaaatcacttggggtgggaaaaatggagggacgggtaggaaggagccatgtgtgagaacgggtgaagggcagggctgtgcaagcccggtaggtaagtgtctcttctacgcacatttgagatctcctgatgttttagaatgtgttgaatgaaatgaaacattcatctgctgcaattggagctcaaaaatctcatgtttggagagctcctcagatactccaagtgccccaggtgcccacctcccaggaagggaagcacacacttctcaccccatagcccacccaatacaacagggctggcagcagagaaacggcgtaacccatccggagccagggaagataaaaccaggaggagcaaaggtttccggggccagagcatgtggaaagttggccatgcccaagcccccttaccccgtccccactacccacaatctggaaatacctgaacagtcaccacctgcttgcccaacccaacaggatttttatgaccctggtgtaaaaaggatgagaaaggaaaagcagggcctccccccagtgcccgcctccccgagtgcccgcctccctccagtgcctgccccccacctcacccagccagcctcttccaggtgcttcctcttcaggcaggaggccacactcctggcccacgcagggacttcacctctccccagaagagggcacacctgctccctgcctttcacccagctgggagtggatgcagagtggcagcttctcccacctctgagtcaccggaaacaaagccgggggactgcagaagacacgggcaccatggcttcacagaggccaacccaccccagtgagtgccacccagctcctgggccagcctcactcactccagacacagggcagagggttcctaatgtctctaaaaccgaggaactcataagaatggtaaccagataaagccattcgcaccacacccgccttccctccctggccctggagagtagagggccccagaccagagtctgagagtggtcagcacgtttcctgccttgatgtacccccgcactgaaagccaacctgaggccgggcactgtggctcaggcctgtaatcccagcactttgggaggccaaggtgggaggatcactgtaggtcaggagttcgagaccagcctggccaacatggtgaaaccctgtcactactaaaaatacaaaaattagccggatctggtggtgcacgcctgtattcccagctaactgggaggctgaggcaggagaattgcttgaacccgggaggcagaggttgcagtgagccgagaccaggccactgcactcctaggtgagagagtgagactccgtctcaaaaaaaaaaaggtcaggcgcggtggctcacgcctgtaatcccagcactttgggaggccgaggggggcagatcatgaggtcaggaggtagagaccatcgtcgctaacacggtgaaaccccatctctactaaaaatacaaaaaaaaaattagccgggcgtggtggcgggcgcctgtagtcccagctactcgggaggctgagggaggagaatggcgtgaacccgggagccggagcttgcagtgagctgagatcaggctactgcactactgggtgagagagtgagactccctgtcaaaaaaaaaaaaagaaaaccaacctggccctcagcgtgactttctgtaacatactttacttagcacaaacgggattcctcaaagtaaatcgggtctgcggcctcaccacactggcataaacaggactgggactacaggtggctaacctcaccttcctggaaacagacagcagccaggtgaggcaggtgagcagctgagactgggatgggcagacgacaagcccagggccaagggcgcaaagctcttccaaggacctggtgcttagggaggaggagtgggggtgaggtggggtgtccaggtggaagaacgccagtcactaataaattcctggacctcagataagcctcacaaaaactttgggaggccaaggcgggcagatcgcttgagcccaggagtttgagaccagcctgagcaatgtggaaaatctcatctctactaaaaatacaaaaataaaccaggcgcggtggtgagcacctgtagtcccagctacttgggaggctgaagggcgaggctcacacaagcccgggaggttgaggctacagtgagccatgatcacaccactgcactccagcctgggcgacagaacgagatcttgtctcaaaacatacacatacacaagctccagtgaactttactatattatacagcaagactgttttctgtcttaaatgctttaaatcataagataaccgcaaacacacaggcaagcagagaataacacctgtgtaccctcctggaatcaacaaatttaacattttgctgtattgatttagaatgtcccccctaccccaccccacccccaccagtttgtttgtttatttttgtttttgtagagatgggatctcactatgttgcccaggctggtcttgaactcctggactcaagcagtccttcctctttggcctcccaagctgctgagattacaggtgcccagccctgcaaaaatttctaagatgcaatagatacaacctcctctccctgtccccagaatgcggggctcatctttccctacgtatttgagtatctacaagtgcatacagtgccaccatacacgtgcgaggcacacacaaatgctgcctactctgtgcgcggtcctgcaacttgcttctcgtccacattgagttccaagctgccccatgcccacctacacagccctggccctgctgtcctgcacccccctgctggcaggaaccagtctgctcttgtgtccctgctggggctcagggaacttctctgttcactttttcactgttgcaaacaaagaagcagacagtggccttgtccatgttgcagcatcgtattttaatgggagtagaaaaagagcatagtgttcgtgggcacccctggcctctggggcagacttccttatgcctgccctgccctgcctgctctaccaaagttccagctccttcttgatgtggtcatcctgccctctttgcccttgctgaagtcccaccagctgctcgacaccccatctccctgtgtctcccaagtcagctttcccaaggcgtctgagtgccctgcccacctcgccatcgctgccacatcggccccagccaggggcttcttggagaggggggcatactccaccactttgcagcctgtgttccttccgcttctgtgtgtccagaatgggccacctgtccgctacagccaggcctgggtcagggccccccacctcccacctgcgtgggagtccctcaccaggctcactgcgtcttcccctccccagcacctttcatcgagggcaggaggccagggcacccatgtgttacaactccccttcccggaagccttccctggggtcttgggcacaccctgccagactgggcactgtggctgggagccccagcacgctgggagaagggcccttaggccagctggcagccaggcctgcgtctggatccaggccaccaacactgggcagcctctttgctcaccccttcagccttcctgaggctgtagtgaggagggtggcaggggcatggcatggcctgaggcttgggcaagcgtccgcctcctctggctggtgggggctctgccacatcccactcacggtgtacaactaaaccgttagtctctgtgggccagccccacttcccgttccttcttcctcctgggggaggccaccaggcacgcaagctggccccggtccatctgctgctgccttgggcccctctggcttctgaactagtaggtggctccccctgcaccctgggagtcagccagccccccaggactttagcttcaacctgagcacactgcacctgaccttccaagcacgtcttcacccagccaaaacttcaccagctgacaatgaatctcaccacctgtccacgtgcccgcatcctccccagggtttctcttactgagaacgccggcacctgccctgcctgggaagaagcagggatggactaggggtgttcactccagtccccagaacctgctgatgtgaaggtccccgggccgcgtgtcccaccagcaacacgtctgctctacagcccagccttcctttctccaagccacccccatacagagacttcccagagagacctgcccaacggctctttaatccacgtcaccccaggggccggcctatctgcagcccctctccttctgtgattttcttccatgcccaggtatcggagacatatcacagccctggtgggaaaaggtggtgtcccgggggacaaagtttacacagcgtgaccattgggatccaagctgcacagcagggcgtgcacctgtgccccaagttcaaggatggctagaggagagaacgcttttactggaaaggcagaaaagaggaggaagaaaagttaaaaggaagaaatgagaaaatacagaaaaatacagatggatgaaaagggaacttaacctctcccctgtcactcactcgttcccacaaatcatcgcggagccctcggacgggaatcccgaactagccctgggaatggactcgtggaggaggcagctctgggtaagtaaaacaggaggacccttgggtgctgttcctgagctaagacccctccttgctgtgtgcccctgggccagctatggagtaaatcggaggtggcggcaacaccccggcggcctccaccacaccaaaaacaacacatcgtctggcattgtcatggggccgcggatgtgtctattttcactgaaagtacagaaatcacttctgagaagctggcatggtggctggggcctggcctgtacctctgccccaagtggacacgagccctgaaaggctgagtgggaggccaggtgcagtggctcacacctgaaatcccagcactttgggagggcaagatgggaagattgcttgagtccaggagttcaagaccagcctggccaacgtggcaaaactccttctctgccaaaaatacaaaaaattagctggatgtggtggcgcacaccggtggtcctagccattctgggggctgaggtgggaagatttcttgtgtctgggaggtcgaggctgcagcaagcccggactgtgccactgcactccagcctgggcaacagagtgagaccctgtctcaaaaaaaataaaagaaaggctgagtggggttgggggattgggggtggagatcgcccacctggagcccacctgctgggagctcacacagacctccttgcccggagcacacggggtgcccaccaactcccaggtggagcatgggagccaggccacatgccatcctggaggctatgatgggactcatcactgaggtctgtgccatagcacttaagcaccttatgctaatctgctctcggaaccacacagagatgcagaataagaggccccagccaaggctgcaaccccttcatcacaattgtcacaaatccgctgtcccgtctccagctcacctattccatggttgttcctaccaccttccaagctcagctctccctgtcacctgcccctccgccaggcccaccagccttgacctatgccactaactggctcgcagctgggaagtcttcagctctttttccatttctgttttctcctttcttcatacttagcttaaagctcccagcactttagggggcagcccacgaatccaaactccccaagaaattctacaagagacatttagcaatgtcacctgcaccagctggcaaatgaccttcacttgtgagttatgtgtccagtcttccaaatacacttctcaaggacatgaatccttgtgtcatccgaattgaatcctgaagactatggacagttctccaacgctgaatgctacatcaacaatcgtgggggggaaggtgataacacatcttcaattttgcttacgattaacttcattttaacaactttgctcaatatcccccaaatccttggccaataaactgctctggtactttgttttttgaaagtgttcactttgttccctttctccataatcaattccttttaaccaaaacctttcacctctttcgaagtcattggcctatgaatcctaacactggccatgtaatcaagaagacactcaacacaggtccctatgccctttgagcaaacctccccactcctgcacccccagtcctgcagagctgagacaggcaggtggctgaggaaagcaggtgaaaggtcagcttgatgcaccgtgcattgccaggtttcaaaacacgcccaaggaaaatggagatatgggacttgcctctgtaatataaaacaaacaataaaacttgatacgtgacaacggacttccaagaaaatggtctttatagcaactgaaatatgtaaataatttctgagtggggcagaagtctttcaacacagccttgcaatcaacacgtatggagatactaatagataggtgtgtgggaaggtaggtaggtaagacataaagattcctttttgtgcttttaataatgaagttacagcacattccttttttttttttttgagacgaagttttgctccatcacccaggctggagtgcaatgacatgatctcggctcacagcaacctctgcctcctgggttcaagtgattctcctgcctcagccttcccaggagctggaattacaggcacgcaccaccacgcctggctaattttgtatttttagtagagatgggtttttaccatgttgaccaggctggtctcgaactcctgaccccaagcgatccgtctgccttggcctcctaaagtgctgggattacaggcatgagccactgtgcccgacccagaacattctttttaccaaaccctttggcatatgctagacaatgtgacccatatatatttttatattgatgtatttgactagcattagatcatttaattcccactagcaccctaggaaatgggtactagggctatctccatgtactaatgagaaaaccagggcttagatgtcaagaaacttgcccagtgtcacagccagcaaatagcagggctggaaatcaaacccaggcccaggccaggtgcggtggctcacgcctctaatcccagcactttggcaggccaaggcggacagatcacctgagctcaagagttcgagaccagcctgaccaatatggtgaaaccctgtctctactaaaaatacaaaaaattagctgggcttggtggcatgcacccgtagtcccagatactagggaaactgagacaggagaatttcttgaacctggcaggtggaggttgcagtgagccaagattgcaccactgcactccagcctgggtgacagagcgagactctgtctcaaaaacaaacaaacaaacaaacaaacaaacaaaaacccaggtccaactccaaaacttatactcttaactcccaaagtaaagtggtaggtactacacaaaaagttctacttaggattcctaaagttacaacacagatataaaattaggtcactgttgtaaccaaaatgatgagattgcagccagcaataaaactccagtaagtataaacaccatcagtgccaactgtaaaattattcacatgctgcagtcttcccactagcattgcacagtgcccatgcacacaggagcaggctctgctttctattcaaacctagctaacagctgcccatctcctccagcggtaaacaactatgttggaaatcctctgagaaaatgttacccatgggaagcgacagcttagctcagcaggaataccaggcagggcctctaggaacagagaaagtgtgaggctggatgacatgggcctcatccctggaaaaactggagaaggcgctgtaggcagggtcagaagcagtgtctctggcgaagggcagggcagttatctcatcatctacaacacattcttggatgcccgggtgaccaatgcctgggaagattctgcttcgctagaaagctagtgccagcctccgggactggctccagctcggggaaaccaccttcacaacatgcatgatgtccaaggtggcaaaaatctggcctggcctcctcactgctgcccaaagaacttcaagggaagtaccaggaaggctctggaaggacagcagcagcccagggggttccctagaactagcacacatgtgcagtaaagttcatggctcttctgaactgagatgcaggcaaaaattagcaataatgggaaggaagaaaagcagcagctcctcttctccaggcaagtgtgggtgtgcgctctctgcactgtatgagccacatcgttattcaattgcagatatgcacatctgtaatggtgcccttgtacttttccagtaaatgtgtatacacacaaacagaagttgtttcccaaacttggctgggcgtgttggctcacgcctgtaatcccagcactttgggaggccaaggtgggcggatcacctgaggccaggagttcaaaaccagcctggccaacatggtgaaaccccatctctactaaaaatacaaaacattagctgggtgtggtggtgggcacctgtagcaggagaattgcttgaacctggttggtggaggttgcagtgagccaaggtcccaccaccgcactccagcctgggcaacaagagcgaaactccatctcaaaaaagaaaaaaaaaaagaaattgtttcccaaacctgatggaagcaccttagaagtgagaatgtaagactcaccttatgtttttcggagggtttcatgtacaagaaaggtgaaggattttcattattattttttttttataagacagggtcttgttctgttgccgagcgtgaccttgaactcctggctcaagagatcatcttgcctcagcctaagctgggactacaggtgtgctccactacacccagcctggagctttcattatgaaaggttgcgtcttgaattcatgactgatcattcaatattcacattatttaaattggccacacagtggatttcctgtactgaagtttatcataatggactattcacatttatggggtcaatataatgggtcgtcaggttataaaaggaattctgggctgggcacggtggctcatgcctataatcccagcactttgggaggctgaggcgtgtggatcacctgaggtcaggagttcaagaccagcctggccaacgtggcaaaacctcatctctagtaaaaatacaaaaattagccaggtgtggtggtgggcacttgtaatccagctattcgggaggctgaggcaggagaatcgcttgaacccgggaggcagaggttgcagtgagccgagatcatgccactgcaccccagcctgggtgacagagggagacttcgtctcaaaaaataaaaataataaaataaaaggaattctggactgggtatggtggctcatgcctgtaatcccaatactttggcaggcgaaggcaggaagttcgcttgagcccaggtatttgagaccaatctgggcaatgtagcaagaccccatctctacaaaaaatacaaaaattagccaaggtgtgggtagtgcatgcctgtggtcccagctacttgcgagtatcactcgagcccaggagtttgaggttatagtgagctatgatcacgccactgcactctagcctggatgacagagcgagaccctgtcttaccaagtactgtaaaaattaagccaattctgggtggatcacttgaggtcaggagtttgagaccagcctggccaacatgatgaaaccctgtctctactaacaaacaaaaactacctgggcatggtggtgcatgcctgtaatctcagctactcgggaggctgaggcaggagaattgcttgaactggggaggcggaggttgcagtgagccatgattgcgccactgcactccagcccgggcgatagggcgagactccatctcaaaaaaaaaaaaattaagccaattcaaatttagaccttatagtgcaccacgtcaataagtaatggttagataaatacagacaaatatgatcttagaaaaaaaatttggaaaagccacaaagattcacaattttataaagaagatagccaacgtattgacagacccagttatctgacctagctattcagaagcccaccagaagtttaacagctgctacttctttcccactgtgcctgccctgcctctagccagcatcggcactcgggcaggagctcagactgcaaggaggagacctgcacctgcccaaaggacatcctaaacctcctcttcgtaccagtatattgttcccacaaatgtccctaagacaacaggagcggtgtcccctgtatctcccatgcatattcttcacctttgcacagaatataacaacttgaacttctaattcaaactgaacttgaactgaacttctaatgtggggactgcaaaatacattggtgtccctaaatgccgcctgcagccaggacattgtttgctagagcctgtatttactttacacactcaaaactctcttcacatctgacctctgattggatcctcacaaaactcgtgtgacatggaatgacaggttcagacccaccaccttacagatgaggaaatggaaacccagaaaccctagaggcggattcagtgccacacccagtctgcatggggtagggagtgggggcctccaaaacccaggccctctggctgcccagtggtctgggaagcagcctgggaaagggaaagaaaacacacagatctgggttcaaatcccagctctaccaattactcagacctgtgaccttgagcaagtatttgcctcacataaagtatgcaggatgcccttacctcctccggcaaactgcaggaggacgtggcagccagctctgacacctgttaggtctttactgcaggaacacgttctttgtccctttccaactgtagccctgtggtgccaatgcaaaccctctaggaatgtggatttctcttcctacctgttgcacccccaccccatgccaaatctcaatgccagcatttgataccttctgacttcgatgtataccttttagcaatctgtggttgtattttgtgcaaactgtactggacatcacattgagccactgtgtgtatttgaagaagtataaagaaaccaggaagcccggcgtggtggctcatgcctggaatcccaacgctttgcaaggccaaggtgaaagggtcacttaaggccaggagttcaagaccagcctgggcaacatagtgaggcctgtctctacaaaaaaatataaaaaattagctaggtgtggtggcatatgcctgtggtcctagctatgtaagaggctgaagaaggaggatcccttgagcccaaatgggagattacgttgagctatgatggcaccacggcactgcactccagcttgggcaccaaggcaagatcctgcctcggaaaaaaaaactcctggcgcagtggctcatgcctgtaatccccgcactttgggagggtgagtcaggcagatcacctgaggtcaggaattcaagaccagcctggccaacatggtgaaactcatctctactaaaaatacaaaaattaggcaggcatggtggcatgcccctgtagtcccagctgcttgggaggctgaggcaggagaatcacttgaacccagaaggcagaggctgcagtgagccgagatcataccgctacactccagcctgggcaacagagtgagatttcctcaaaagaaagaaaagaaaagaaaataagaaaagaaaagagagaaagaaagaaaaatgaaacaaaatctccaagaaaagaaagggaaggaaggaaggaaggaaggaaggaatgaaggaaataaagaaaaaggaaagcaaacctccatgtattaaatctttttcagggcaccagaggagatgacagttggcaaatcagggataaatgcttttataaatgaagaatcattttataaaaagtcaaatttcagtgatagcatatgacagttttgtctcttctcttctcttttcttttcttttttgagacggagtcttgctctgtcaaccaggctggagtgcagtggtgtgatctcagctcactgcaacctccaactcctgggttcaagcgattcccctgcctcagcctcccgagtagctgggattacaggcgtgcatcaccatgcccagctacctttttgtattttagtaaagacgaggtttcactgtgttggccaggctggtctcgatctcctgacctcatgttccgcccatcgtggcctccagaagtgctgggattacaggcgtgagccactgcgcttagctgacagtttctccagggcatcagaacacagcgttaggaaagctgtctgtggtgactcaatgtgacctgatgaccacaggaccccctgagtgagccagggctggtgggcgaagcagacatcactgcagagagctagcagcttgctgtggggagagaatagggacgtggtctcgggtccagatgtcctcagccacagtagcagcatgaaggaaggtgcattgaggggggacccaaatgctcctctgctccctgcctccctcacaggaacttcccataacacaaacaggaataacagtgcccctcgtcaggcggttatggcaatccagagtggaaaaagggtgcttcgggcagggcgagggggcttatgcctgtaatcccagtgctttgggaggctgaggtgggaggatcgcttgaggccaagagtgcactatgattgcgccacggcactccagcctggacaacagagcaagaccttgtcactaaagaaaaaaaaagaaaggatgtctcaaatgttctgtcattccttcaacacatatctgaatgtctgctctgggccactgaaataatgaggaaggtgaatgtaagggtgagttaggaagaagtagcagcacttagccccggctgcatgtgggggcttagggaacaggaagaatgcaggctggctctccggctcctgggctgggtaccacaaaccacccgcatcaggagtatgaagccttcctttcttaacataaaggacttggtgtccaatgcctaacctatatccctcaggaagcagagcggtacccaccctactgcccaaccctccaaggtgacggtgaccctcctgcacaccctggagagggcacgcctcactcagcagcatgatttctttcactgttaacttccaaagacgttcctggaccgaagaacaatcctcaccaaaaaaaaggcaaaggcagacacttctgaggccgtcaagatacccaaatagggtagctggcctcagcccagggcctgctggagatccaaccttcacctgacatttggatggggtaaaagttgaaatttacacaaggtaacaaatatttgaagctagcaagcagaaaaaagtccttacttgtgttaagcaatcaatttgtttaaaaaacatatcctgtacatgtcgtcaaagaaactggtaatagtggtggcatctggagaggggaaccaagtgagaaggactctactctgtatctgcacctttttaaaaaaaaaaaaaaaaaaacagagacagggtctggctgtcaccgaggctggagcgcagtggtgcaatcatagctcactgcagtctccacctcctgggctgaagccatcctcccacctcagcctcctgagtagctgggaccacagatgcactccaccaggccctactaattgtttgtagagacaggggtctggctctgttgcccaggttggtctcgaattcctggcctcaaagcaatcctcccaccttggcctcccaaagcattgagattacaggcgtgagccacggggccgggcccatctgtgcctctttaactttgcatcgtatgcttatatcgcttatttgtaaaaacaaaacaaaacaaaagtcttcacaagaaaagctcaagactggcagaagacaagtgaggcctctttaaagtgtgttggagagattctcgagagattctctccaacacactttaaacaaacaatctcgaacagccattttaattcttaaagcaccaattcttccggaattcaagttcaggcttccaccagcaacagaattctggcctgccaataataaccatgcagagtgactaaacattttttccaacaaaggaaaaaatgcaaacgatcaaagtgcagaagcagcccttggcccgcgcaggctccggtttccgcctcccgccgccgctgccaccgcccctgcgcctttagatttcgggcagcaagtttaattgctcgcttggaaagcgtcctcggaagggcaccgccagcaactgcggcttcgcgccccgccccttcccccaagccccgggcggcgtcacgtgacggctgagaaaagtaggggaaaggtcagcagcagccccgcccccaggctggcgcgtcccaggcgctcggatcctgttccacccgccgtgcccacagagaccttccggagcgagttggcgcgcgtccctgtggccaccccagcgacagcgggagaaatgcaacgcacctctccgtgggaaggtcgagccctgcggtgcccagctgtggggacagctcggtgctcagtgcttctgatgacagatgctgcatccaacgagccagaaacgcaggcaccgcgctcaagagcccagggcgcgtctaaaaggggctcactgtgaagcctcagtgaaaactgacggtgtttttatgaatgagcactcggggccagggttgggtaagggcaggccctcgttccagggctccccggaggcccaacttgaccgctcggtgaccactggtccggggccggggccaaacgcagcagccgcagcagtatcggaagggacccagtttaattctcttcccctccagggtaggcggcttgtttttagtaccaactcgaaacgttattttggcctgtgcatgatgccaacttctgccactttgaaacaaagtgtgtgcactcccaaacctggccctttttattgtttgattccaactgttaagatagggttcaagtgcaaggtctaggctagcaatgcttcacaggaaggaaaccagtaatttacatgcgaaaagcagtccacaggctcttggtattgaggcaaaaccaatccaaagaaccagctgcgaatgctgatagtccccagaccaactgacagctggatgttcgctggcctcagcggtgtgcattctcagcgacacttatgtcctcaatttattgctacgttcactcggtcagagtcgccttaaagaatttggaaaggcccgggggtgggggtgcttcctggcataaatagaagaccagtgctcagccattttttattcacttggtttgtggcttagaatgaaataaacatgcttgcatatctggaatgaccagaaaccggacacctgtggaagaaaatggtgtaacaaaatacaacgttgcaaaaggtaaaaccgattttcattttattcggtaacttacaaagttaccagcttcctactaaaatctgcccttaaatattttataacacacggagccgagaggaaccgaaagcctgtgccgagttgggaatattaactttgttatgtatttaacctggtaggtagttgggatttttaactctctgagttgttttctttttttaaagtaagatcggccctcatctttgagttctgcggctttaacgaaagccaagggcggatttacattataaagacgctgacccatggcctctcctgacaaaccgaaagaagccggctgttggctggccgcggcggtggctccgagaaggggctgccccgcgtggccctgaccgcaccgtcgggctcgcaggccaagttcgccagggcacggccacgtgacacccccaccctcccgcggccccgccgctcccagcccggcacgaccttgggcacatgctccgcgcccacccgcccttgacccagcgctgcacgggagaggctgcggggcgctcccaagcaggcactgggcccggcaccctcatcctgctcacggcagcgctcggaccgcgcctggagtccctgcgccaagggcgtgtcccgacggctgcaccgcgagggcgggcatggggagggggaccggggagacggacgctgggatggggtcagcggcgccctgccgaatcccgagggccgagcacccctccctcagccgcactgcacctgcccgtaggtgaccaacccacgggcggacccccagacccaatcctctccagagccagggtgggatgggcagggacaggagccggaggccctactggccccgggcgaaggcatcctggaaagcatccagagcgtccagcatccctcccgcggccacccgcaggctgaccgacccctgggcagaccctcagactcaatccagtccagggcggattaaggagtgggagacaagggagccggtggccccgctggccccgggccggaggcgtccagccaagtccggagggccgagcatccctcccgcggccgcacgggacccgcctgcggatggaccgacccccggtggaccctcagacccaatcccctggggaacatggggagccccggcctctttctgggttcaggatctccacaaccccgccgtccggggggaataccggggttcctctcggcgccccggttccggcggcgtcccccacccggtccggttcccggcagccccgcgccccgcccgtccccggcccccgcagcccgcagggccgccccgccaccctccccaccgcgggcgaccgggcctcaccgagtcagctacggaggtgcggcagcggcagcggcagcggcggcggcggcggcggcggtggagtgaacgagcggcgagcgggagccggggaaggagggccgcgggcgaggccgagcgcacccgacgccggcagcagcggattggctgaggcgggtccggctgcggcgcctgcaggcgggtgactcccggcgcgcggagggcgggcccggggcctcggcggggcggggcgtccgcggggctaggaggggagggaaactgaggctcgagcgggtgctcgcgtcctcgacctctgccggaatggggtctaggacgagattcctcaccctccgagcctcagtttcctcatccgtaaaacgagccatctcgtggaggccgtgcgcataaaatcgcttagctccgtgcctggctgatcctcgcgacttatctatcggcattgccccgtgtaatgctccaggcaccccctgatggtattcacccctgactctttcatgcagacaagggtcgcgggccaggaaataagttaccccacatcaccgagctgagaagcaaccgatccacagggagtggtggggcgcgcctgtaatcccagctactcgggaggcgggaagtcgcttgaagccaggagttcgaggccagcctgggcaacgtagcgagaccccgtctctaaaaaaaaaagcgcggggaagtgatagatcggacattgggtccagatctgattccacagcccatgccccaaatcagaccttataccacgagtggcagtcatcgcgatccagaggcagcgtggctcctcctcatctagctaggataaaaatgcctcacttggggggctttggtgagatttactaaaataattcttccagcgtcaagaacataataggtgctgggagaggagtagctggaggccagggcagagcgaccgagagacccttgtgctggagctcgggagaggggccgggagcgggaactgaacatccaccggtcccaggagtctagggcgagcgcagctgcaggggacccagggggttgagggggagggagaggggccccaagcgtaacaggagggccaagggggtcttcctgaccgggagccacccctcccctatctttgcccgcaatgcttccaggcgcgagctggcggctctgcatacagcaggtgctccataaatgcaccgatgttatgaacaaagactcttttaaacctcttttatgaaccctgctctttttaagttcgaccacttcttctagttatgaaaaaatccatgtttgcaaccatccttctttctgtatcatttagttgttaccgcagaagaatttagaagagaaaatgaaagttctcctttgatcccgccccccaccaccgctgcagttaactctccctgcggttcccgggctcgctgttttaaaggaaggctaggatgcaagctgtctgtaaggctgttttgttttcacttggcttacgtcgtagacaggtctctgctgggggacggagatgaccaccggccttcccaaggctgcataagatttcctttgactatgctgtgatccatttacgcggcccccattggacaattagggcctcctccccgccccccaccccaccattgcaggtataaataaaagctgcgttggccgtcgatgtacctcctggagctcctgattatcctgtaggatagatccctggaggggaagcaaccaggcacgtgcgacattttggtgacacaggccaagctaccatgccgaaaagtttaccaacttccactgccacccgcgcgtgcaagcggggccctgtctccgattatggattattttaatctttgccaatcctaaaaggaggggtgggggagggaagaatctctcatctctccttttaatttgcatttctttgaggttagaagttgggggtttgtccccctgcttgcgcttgtctggaccaccagtgagcccaggcactcgacccccgcagatttcaccgccccaagaggccagtgggctgggccagggcacacgttcctgacgcgcggctgcaccccacgagcccgggcggctctcgcgcgtgaggctctccttgcacgtgggccttcgcggtttgcactacggaagctggactgtcattctcaccgcaaatgcccttccctcctttccctggaacctcagccaccgacaggtccccgctccaaggtcatttcctccctcgctcagcgccccggtgcgcgcccagctgggattggccccgcgccctgtctgttcccagggctcttcggccttgaccgtgcgcccttccctgcgcgccgcctaggtgccacctgcaggccgggcggggcagggacagggacccagtctgtggggacgccgaggcgccacgctcacctgtgccatggtggccgggctctcggcagctgcaacgagcccgcgccggcctgcaactgcagccgcactggggaggccttattcccctcccgccgaccacgctgcagctctcctgcccgggtctgcggctcccgcggctgcgtagctgagtctattaataaagaagcagagaacgaggcctcccggggagctccgggcctgagcctcagttccctggggccaaaaacgtctccatgtctgcctctgaaactagagtaatctttctcaagccttgttttttacagattctgccccagtttgaatactgtagcaattgcctaccatagctacaagaaaaattttctttttaatgcaggtaatgtttttatttaccgctaagatttctctttttactcaaaaaatacttttttatggaaaaatccaaacctttttattcattcgttcattcattcattcatttttgaaacaggatctctctctgttgcccatgctgcagggcagtagcaaaatgacagctcactgcagtgttgacatcctaggctcaagcaatcctcctaccccagcttcctgagtagctgggaccacaggcaagtcccgccatgcctggctaatattttgaaaaatccaaacctttgaaaaaaattaaccagaatagtataataaaggcctatacaaccaaaactcaacatcaaccattatggagctagggccaaggtgtatgcctgtgttcctacccactcctgcccagtcctactgtttattttaaagcaaattcagaaatcctaccgttatgtccacaaattcctttttttttttttgacatggagtcttgctctgtcccccaggttggagtgcagtggcgcaatctcacctcactgcaacctctgcctccagggctcaagcgattctcatacctcagcctcccgagtagctgagattacagacgtgcatcaccatgctcggtaatttttgtatttttagtagagacagggtttcaccatgttgggccaggctagtctccaactcctgatctctggtgatccatctgcctcagcctcccaaagtgctgggattacgggtgtgagccactgcgcccagccctcaaattctcgagtacaaacctctaaaagataaatattcttaactaaaaaatatgaccatactatcattgtcccacctaaaatagatgaacaattgttacagaaaatggtaaaccctgttgcctgccaagagcacagctgagtccccactcgatctcgccagcctcatttcttgctggcagctcccagcagattctgatccagaagtgtgtacgacttttttggaactcagctctggtatccccataggaaacagtgttgaaatctcagtgtggtgtgcttccctctcctctccgaagcctgtagtccctctgaccttgcaccttgggcctctaggtgttgagtaaatatggtcagttccactttgctgagcctgcatcaccagggtttcatgaggacagaacagggtgatgcagacgaaagcacctgcacgcagcaagaggacgtgcacggaaaggactcagagcaacaagtgcactgttttcttaatggaacacgtctgctctgaacacgggatcagaacacattcttttgttgttgtttgtttgagatagagtctctcttcgtcacccagtctggagtgcaatggcgtgatctcggctcactgcaacgtctgcctcccaggttcaagcgattctcctgcctctgcctcccgagtagctgggattacaggcacgtgccaccacggctgatttttgtatttttactagagacagggtttcaccaggttggccaggctgatctcaaactcctgacctcaagtgatctgcccgcctcagcctttcaaagtgctgggattacaaacatgagccactgcacccagcccagaacacgttctatcccactgctcctggacgctttgctgcccatctgtgcctcagtttcctcacttaaaagaggaccagctgggtgcagaggctcacgcctgtaaacctagcacttcggggctgaggcgggtggatcacctgaggtcaggagttggagaccagcctgaccaacgtggtgaaaccccatctctacaaaaaatacaataattagctgggcgtggtggcaggtgcctataatcccagctactctggaggctgaggcaggagaatcgcttgaacctgggaggcagaggtcgcagtgagccgagatcgcgtcactgcactccagcctgggcaacaagattgaaactcagtctaaaaacaaaaaaacaaaacaacaacaaaaaagaggaccttgacccagggcactaatgagcaaacctttcaccactctccgtcgtcccttcagagccggactccgctctgtttcttctgcacctctcagtccctggcacctggttggcccattgaggcacaaggaaggtcggcagggggttgccttgtggggaggcagcacagtgaagaagcaagaatggaggtcaggagagggtgcagcaggccacagggcacagagctgagtctggctggctgcatgggtgcctcactgctcatctggcctcagtttcctcacttcaaaaaaagaggatggccaggtgcggtggctcacaccttaatcctagcactttgagaggctgaggcgggtggacctcttgaggtcaggagttcgagaccagcctggccaacatggtgaaaccccatctctactaaaaatacaaaaaaaaaaaatttgccaggcatagtggttggcgcctgtaatcccagctacttgggaggctgaggtgggagaatcacttgaacccaaaaggcagaggttgcagtgagccaagattgtaccactgcactccagcctgggcaacagagtgagaatccatctcaaaaaaaagagaggacattgaccctgggcactaataagcaaccttttcatcactcttttctttctaatattattctgattagttcatttatttggagaagcagtcatattctggtgttgggagtgtgaactccagaaccactcagcctgggttcaaatcctgtctctgccacttactagccgagtgatcttaaacctccctgcacctcagtttcctcatctgtaacatgggaaagaaatggaagctgccttggagagttgtaatgaagatgagtaactgccgggagtgcttagagcattccctggtacacagtaggtgccacataagctttagctgtgattattattcccccgcatcctgtcatgagtccatgttttaaaagctgttgccctcccagatcagagaatgctggaaaaaaaggaaaaaatgtctaaacgaataaacaaaaacactgttgcctataaacagtacgtttaatgggggaataaataatttccctgagcatacagcagaaatatgcaaaactgccacctggagcctacaaccagcataaaatttgctcattcctttaaaagatgcttatcaataagcacagtggctgccaggacaccgtgtactgccagccaagaaccaaaaagctgggcattttgatctatacaggttaatttcagatagatgaggggcctctttaaggccatttgaagtggtcagaatagttcaaaggtcactattactccctcctcagtttccccagtcatctctgaggcccccatctacctagcctacttagagagtatgcgttcaggccaggacctgagcttcttcatgggatcagagcagcgtgctgggcccagtgcaggcaatgccttaatggatgctatcgaagttggtatctcgacttgcccaacaccagggccagggcagtcttgctcctgaccgctgtgctggcagcccagacactgggacttcatgcacagggaggaggtgaccctcctgtagctcattttagcagacacctgagtttttaaatgagagcattggcaaaaggtcttctatgttaaggacataaatcctcccctttggaggtggaggtagaggtagaaggagaacgagagaggcaggtaataacttgagtctttatagtttttaaatttggaagagccgggcacagtggctcacgcctgtaaacccagcactttggcaggctaaggtgggtggatcacctgagttcaggagttcgagactagcctggccaacatggtgaaatcctgtctctactaaaaatacaaaaattagccaggcataatggcagacgcctatagttccagctacttcggaggctgaggcaggagaattgcttgaacctgggaggcagaggttgcagtgagctgagattgtgccattgcacttcagcctgggcgacaagaacaaaattccgtctcaaaaaaaaaatttgaaacggggagtcactgacccttggaaaacctgatgatggctacaaatgctatccctggaaacacacacatgcacacatgcacacacacgcacacatgcatgcacgcacacacgcgcacgcacacacgcacacgcacacacgcgcacacacatgcacacacatacagtaaatcactccagtcgtgacccttccaagacgtgtctatagcctcctgccccacacaggttaagaaaaaatatccaaaacttggaaatgaggcaaaagcatgtctgaatgtgatttcagtgtcacacttgatcattgcctaaccgtcccattcaaggattcgcttattttctagggaacagtaacttggacaaggccccagagtctgtgaagttacatgtgagctggtagatttttgcccaacagaaattcaaaggatttccagttgatagaaaaaagaattccccaaggttatgattttattgcctgcaggacattaaccagttttgtagcaatcttatggcagctttgttttctttcccttttattcttaagatggagtttcactctgtcacccagaatggagtgcagtggtgtgatctgggctcactacaacctccacctcctgggttcaagcatttttcctgcctcagcctcctgagtagctgggactacaggtgcccgcctgctcagtggctctgtctccagcctggctctcctttgagctcccaccctgccactctggcatcacctttctgatccccttaaatcctcactagagcccacccttaccccccatccctactgccacccccagagaaatgacttcattcacttgttccctggggccaagttacccaccgggagaagtcaagtctcggttgccagcaaagcaggaccacaaagaaaagaaaaattagggtgtgtgggtgtgtgtgtgtatgtgttttctatgtcaaagcagcaaatagggcacggtggctgaagcctataatcccagcactttgggaggttgatgtgggtggatcacttgaggtcaggagttcaaggccagcctggccaacatgatgaaaccccatctctaccaaaattacaaaaaaaaaaaaaaaatagctgggtgtggtggcacacacctgtagtcctagctacctgggaggctgaggcaggagaatcgcttgaacctgggaggcagaggttgcagtgagccgagatcatgccactgcactccagcctgggcaagagtgagaatctgtctcaaaaaaaaaaaaaaaaaaaagaaaaaagaaaaaaagaaagaaaaaagaaaagagaaaaaagaaaaaaaaagaaagcagcaaatacctatcagaacctcggtggacctcttttttttttgaggcggagtctcgctctgtcacccaggctggagtgcagtggcgcaatctcggctcactgcaagctccgcctcccgggttcacgccattctcctgcctcagcctcccgagtagctgggactacaggctcccgccgtcatgcccagctaattttttttgtatttttagtagagacggagtttcaccgtgttagccaggatggtctcgatctcctgacctcgtgatctgcccgcctcggcctcccaaagtgctgggattacaggcgtgagccaccgcacctggccaatggactttcttatgcttatttaacagtttagcacacatctttatgagacaaagcagcaaatgtaagaaaccgcgtttactcatttctgtttgcagcgtcatttcacaaagaccctgattctgacttgcagctctccagaaggatgctttgaagacaaaacaggacagagtccatggcccccatgcctcttgcctgagttactatatttcttaaacgataagtgaccctacttcttgccttttcctgcacataagatgacgtcagctgggcgcagtggctcaggcctgtaatcccagcaatttgggaggccgaggccagccgatcatctgaggtcggaagttggagaccagcctggccaacatggagaaaccctatctctactaaaaatacaaagttagccgggcgtggtggcgaacgcctgtaatccctgctactcgggaggctgaggcaggagaattgcttgaacccgggaggcggaggttgcagtgagtcgagatcacgccattgcactccagcctgggcaataagaccgaaactctgtctcaaaagaaataaaaataaataacatttaacaaggttagtgattatgcctctgtaatctataaccaaatatagccaaacccaacttctgatgtgattctgcgtcaatgtaacttctgagaaagcttgatgtgattttgcacacagggaacctccaccacaggtatataaggtgtgacctgaaacaccgtggcggagcaatatgatggaactgcttctgggctagaggcctcagtcaatagtcctcagcaagatctctgaataaactaaagcttcaaaagcttgattttttttttctttagtcgacacctttcaaattacatatgaagaggttgccataatccttttagcagttaggacctggaacgattttttgttgtttgttttttgagacagggtctccctttgtcacccaggctggagtgcagtggtgcagtggcacaatctcagttccctgcagcctcgacttcctgggctcaagtgatcctcctgcctcagcctccccagtagctgggactataggtgaatgccacacctggctaagttttatatttttagtagagacaggatttcaccatgttgcccagtctgtaggtcctggaaagaggaaagatctaaatctggccctggtcttacccatattcactcattggatcatgcattcatgcattctgcaaatatgtattgagcccccatacttgtgccagcactattctagacactgggactctcagggagtgaacagagcattttaaccaagctacaaattctagtgagagaggtggtcaagaaacagattcatgtgaaaagtgcaaaggaggccagatgcggtggcttaagcctgtaatcccaatactttgggagacagaggtgggtggaccacgaggtcaggagttcgagaccagcctggccaacatggcgaaacccctgtctctactaaaaatacaaaaattagccaggcatgatggcaggtgcctgtaatcccaactactcgggaccctgaagcaggagaatcgcttgaacctgggaggcggagggtgcagtgagctgagatcgtgccattgcactccagcctgggcgacaagagcaagactccatctaaaaataaaaataaaaataaaaaataaaaaaataaaaagcaaaggagaaaaa

SEQ ID NO: 1060 - DNA, 55755 bp, Homo sapiens
tatacaattttttttttcgagacggtgtctctctctgttgcccaggctggagtgtaatggcgcgatctcggctcaccgcaacctccccctctgggttcaagtgattctcctgcctgagcctcctgagtagctgggactccaggcgtgccaccacgcccagctaatttttgtatttctagtagacacggggtttcaccatgttggccaggaaactcctgacctcgtgatccgcccgcctcggcccccaaggtgttgggattataggcgtgaagcaccgtgcccggccgctaatttttttttctatttttagtggagacggggtttcgccatgttggtcaggctggtctcaaatgatcctccggcctcagccgcccaacttgctgggattacaggaagttgtgtgtccggaaccactgtgtccggccccagtttcacttttcttaatcagacaattcagctggaagagtttactaaagaggcaaacttcatagaagaacctatttacgttaaacgtttaaatttatcctgacaaatcctgaattcgccgtccgtactcaccccatctcaagaacctctgttgacaagtaagtgggtatacatttttaccgcaaatgttttaccactaagaccttaagaaacttaaaagtagggggaagctgacagacaaagagattaaaaagtaaaatatacgcacacacacacagatatatacacactaatatatattacattacgtctgaggggcgggcgccggagaccagaagagctgcacgaggctgcacgcgctgtgcccgacgcgcatgcgctttccttcaacggtcacccgctggggcgcgacagtggctttttgacccctggtcgaggtcacctttcccgccaagcgcagcgcaaggcgcactgggagcctcagacacgggaagcctcagcgccacgtctcaggcagtggaaaagccagacagaagggggaaggttaagtaactgcatgtgcagttactgaatttctgattgtttttctgacttttgattttctttcttttttttttttttttttttttgagacggagttttgctcttgtcgtccaggctgaagtgcagtggcatgatcttggctcactgcaacctctgcctccagggttcaagcaattctcctgcctcagcctcccaagtagctgggattacaggcgtccgccaccatgcccagctaatttttgtatttttagtagagacggggttttgccatgttggccaagctggtctcaaactcccgacctcaggtgacctgcctccctcggcctcccaaagtgctgggattacaggcgtgagccaccacacccggctgacttttgattttctcattggaactaccacaaattgcattcccaccttccaatctcctgtatcttcaggaaaccatttgctttagcagtcttctacttagccacttccactgtgttatgtcattggggacaatggatagctttgaatgtaatttgtctcatttagaaacaaaataaaatcagagtgggtaggtattaatagttggagattattcagtagtacaagcttcttagtttacagattattatatatccaaatacatttcttaccagtgtaaacattcaattacaggcataccttggagatattgcaagttcagttccagaccctccaataaagcaaacaacataataaagcaaattacacaattttttagttttccatgtgtataaaagttatgttggctagatgtggtggctcatgccaataatcccagcactttgggaggctgaggcggaacaattgcttgaggccagaaattggggatcagcttgggcaacaaagtgagaccctgtctctacaaaaaataaaaaaaattaggcagaggttgtggcacacacctgtagtctcagctactcaggaggcttaggcaggaggatcccttgagcccaggagtttgcagtggcagtgagccctgtttgagccactgcactcctgcctaggcggcagtgagacttgtttcaaaaaaaaaaaattatggttacactattaatatcttaatatatatatataaatttttttttttgagacggagtcttgctctgtctgtcgcccaggctggagtgcagtggtgcgatctcggctcactgcaagctccacctcctgggttcacaccattctcctgcctcagcctcccaagtagctgggactacaggcgcccgccaccacacccggctaatttttttgtatttttagtagagacagggtttcaccgtgttagccaggatggtcttgatctcctgacctcgtgatctgcccgccttggcctcccaaagtgctgggattacaggcatgagccactgcgcccagcccttaatatatttattgtacatatcttatgctttctgtagtctgttaagtgtgcaggagcataatgtctagaaacacaatgcacatactttaattttaaaatactttattcctaaaaaatgctaatgatcatctgaacaatcatctttttgccggtggagggccttgccttgatgttaatggctgctgactgatcagggaggtgtttgctgcatgttggggtgtctgtggcaatttcttaaattaggacaacaatgacattcaccacatcgattgactcttccttttataaaagatttctctgtagcatgtgatgctgttttacagcattttacccacagtagaaattccttcagaattggagtcagtcctttcaaaccctgctgctactttgtcaactaagtttatgtaacattctaaatcctttgttaccatttcaatcttgttctcagcatcttcaccaggagtagattccatcgattccatctcaataaatcactttcctcaatcatccataagaagcaattccagcactttgggaggctgaggcgggtggatcacgaagtcaggagtttgagactagcctggccaatatggtgaaaccctgtctctactaaaaatacaaaaattagccaggcatgatagcacgcctgtaatcccagctactagggaggctgaggtgggagaatcgcttgaacccaggaggctgaggttacagtgagctgaaatcacgccactgtactccagcctggacaacagagcaagacactaacttaaaaaaaaaaaaaaagaagcaattcctcagcagttcaaattttgtcatgagattgtagcaattcagtcccatcttctcatcttcaggttctacttccaattctggtactcttgctatttccacatctgcagttgcttcctccatggcagtctcgaacttctcaaagtcatccatgaggattggaataacttcttctaaactgctgctaatgttgatattttgacctcctcctatgaatcacaaatattcttaatggcatcgagaatagtgacgcctttccagaaggttttcaattttctttgcctacatccatcagaggaatcactatggcagctacagcccttacaaaatgtgtttcttaacttataaggcttgaaagtcaaaattacttcttgatccatgggctgcagaatggtctttttgttagcagacacgaaaacaacattaatctccatgttcacctccattagagctcttgagtgaccaagtgcattgacaatgagcagtaatatgttgaaaggaatctttttttctaagcagcagtaggtctcaaccatgtgcttaaaatatccagtgaactatgttgtaagcagatgtggtgtcatccaggctttgttgttccatttatagatcacaggcagagtagatttagtataattcttaacggccctagaatttgcagaatgttaagggagcactggcttcaaatgtaagtcaccagctgcattatcctcgtatgagaaattcatcctgtcctttaaagctttgaaggcattaatttctcttctctagctatgaaagttttcagtggaatcttcttccacaaagctgtttcacctacgtggaaaatgtgctgtttagtatagccacctgcatcagttatcttagctagatcttctggataacttgctgcagcttccacatcagcccttgatgctccaccttgcacttttttttttttttttttttttttttgagacggagtctcactctgtcgcccaggctggagtgcagtggcacgatctcagcacttttgtgttatggagaatggcttcatccttgaaacctcatgaaccaacatctgctagcttcagacttttcttctgcagcttctgcagcttctgcatctctgtcagcctttctagaattgaggagttagggccttgctctggattagacttcggtttaagagcatgttgtggctggctcaatcttctatccagaccactcaaactttctgcatatcaccaataaagctgcttcactttcttatcattcatgtgttcactggagtagcacttgtaatttcctccaagaactttccctttacattcacaacttggtgaactatttggcacaagaggcctttcagcctatcttggcttttggcatgccttcctcactaagcttaatcattttcagcgtttaagtgagaggcatgcaactctttctttcacttgaacacatagacaacattgtagggttatgaattgacctaatttaaatattgctgtgtcttagaaaatagggaggcccaaggagagggagagagatggggacacagccagtaaatggagcagttagaacacacacatttattgattatatttgccattttacatgggtgcggcttttgacatcctatgacaattatcatagtaacatcaaagatcactgatcacagatcaccatagtagataataataataatgaaaaagtttaaaatattgcaagaattaccaaaatgtgacacaaagacatgaagtaagcatatgctgttgggaaacggcactgacagacttacttgattctgggttgctacaaacctgcaatttgtaaaaaaaatgcaatatctgcaaagcacaataaagcaaagcacaataaaacaagataagcctgtactcataaactttgacatatcttcattacaaaggagaaaacagccactagatatgaaaagatttgcccaaagtcattcaactaggagagaaatgaagactagaaccttgttattagggttaaaaatagtgaaaatcttggtctaataattattttgaattataattaagtcactgttttgtgtgtttttttttgttgttgttgttgttgttgttttttgagacggagtctcactcttttgcccaagctggagtgcagtggcataatcttggctcactgcaacctccacctcctgggttcaagggattctcctgcctcagcctccccagtagctgggatcacaggcacgcaccaccacatccaactaatttttgtatttttagtagagatggggtttcaccatgttggccagactggtcttgaactcctgacctcaggtgatttgcccaccttggactcccaaaatgctgggattacaggcatgagccactgtgcccagccacttttttttctttagaggcaaggtctctttcagtctcccaggctggagtgcagtgatgcaatcatacctcactgcagcctcaaactcctggctcaagcaatcctccctcctcagcctctgtaacaactaggaccgcaggtgtgtgccacaactctcggctactttttaatttttttgtagagtcagggtcttgctatgttgtgtagactgatcttgaactactggcctcaagtaatactcctgccttagcctcccaaagtgtttcaggcatgaactactatgccaggcctattttcattttttttcattttttttgagacagagtcttgctctgtcacccagactggaatgcagtggcgtgatctcgactcactgcaacctccccttcctgggttcaagcaattctcctgcctcagcctctgaagtaactggggttacaggcgtccaccaccacgccaggctaatttttgtatttttagtaaaggtggcattttgccatgttggccaggctagcctcgaactcctgacctcaggtgatcggcttgccttggcctcccaaagtgctgggattacaggcatgagccaccacgcccggccccctttattacatgttctgatttatagtctttctggtaacttagagtatgcatacttgaagcatcatcaagattctcatctagaagagaagagtcaaaaaataataatttgattcaaagaaatagtaagtcttatgcctgtaatcccagtactttgggagaccaaagtgggaggatcacttgaggccaagagttggagaccagcctgggcaacataatgagactcccatctctacacacacacacacacacacacacacacacacacacacacacacacacaaataagccagaaatggtggcttgcacctctagtcccagctactggaggggtggggaaggtgtgtgaggtgagaaaatagcttaagttcaggagttcaaggctgcagtgagcagtgatggcatcactgcactccagcctgagtgacagagtgagaccctgtctcaaaaaaaaaaaaaaaaagataagaaaggaaaaaagaaaagagaaaggaaatactaagtatctgtcacatttatgttatatgttttaatggcattgtctcatggatgcctagttctggaatatttaaatcttcttgtttctttttttaatataatttttcaaattttttggctaatcttctctgtatcattcaaatttgagtatatgtgctgccaaagcaagcaccgtttctttacttttattatacagtttaaaattctgtcaacttttactctgtgatggctcccagatttgctttattttttatttttttgctgttttcagaaatgatgtatttagtttagggctttatcaccacacatatagactactagaatatcttttagattgtctctttttttttcttgagacagagtttcgttcttgttgcccaggctggagtgcaatggcatgatctcggctcactgcaacctccacctcctgagttcaagcaattctcctgtctcagcctctcaagtagctgggattacaggcacccaccaccatgcccagctaatttttgtatttttagtagaggcggggtttcactgtgttggccaggctggtctccaactcctgacctcaagtgatctgcctgcctcggcctcccaaagtgctgggattacaggcgtaagccaccacgcccggcctaggttgtctcattttaaaattttatttattttattatttgccaatttatttattttgaaacaaggtcacccaggctggagtgcaatggcgctatcatggctcactgcagcctcaatctcctgggctcaagtgatcctcccacctcagcctttcccctggtagctgggactataggcacataccaccacacctggctaacttttttattttttgtagagatggagatctttttatgtgctcataacaagaggcaggaggatcacttgcgcccaggagtttgagaccagcctcttgaacttctggctcaagcgatcctcccacctcagcctcccacagtgctgggattacaggtgtgagccactgcacctggcttttaaaaaaattttcttcaagtcatcttgcatactactgtctagaaattgttccagaataaattctaaatgtttttgttttaaatttatatttttagataattttttatctctataagtttgaaattacttattgttaataatttccctttatattgggcatacagtgaagtttttaaaaagtatttcattattctacttgcttagttcaggcattctttttttttttttttttaatttatttttttattgataattcttgggtgtttctcacagagggggatttggcagggtcatgggacaatagtggagggaaggtcagcagataaacaagtgaacaaaggactctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaactatccgatttctcaatcttttccccacctttcccgcctttctattccacaaagccgccattgtcatcctggcccgttctcaatgagctgttgggaacacctcccagacggggtggtggccgggcagaggggctcctcacttcccagtaggggcggccgggcagaggcgcccctcacctcccggacggggtggctggctgggcaggggggctgaccccccccacctccctcccggacggggcggctggccgggcggggggccgacccccccacctccctcccggacggggcggctggccgggcagaggggctcctcacttcccagtaggggcggccgggcagaggcgcccctcacctcccagacggggcggctggccgggcggagggctcacccccccacctccctcccggacggggcggctggccaggcggggggctgacccccccacctccctcccggatggggcggctggccgggtgggggggctgacccccacatctccctcccggacggggtggctggccgggctgaggggctcctcacttcccagtaggggcggccgggcagaggcgcccctcacctcccggacggggcggctggccgggcggggggctgacccccccacctgcctcccggacagggcggctggccgggcggggggctgaccccccccacctccctcccggatggggcggctggccgggcggggggctgacacccccccccacctccctcccggacggggtggctgccgggcggagacgctcctcacttcccagatcgggtggctgccgggcggagaggctcctcacttctcagacggggcagctgccgggcggaggggctcctcacttctcagacggggtggttgccaggcagagggtctcctcacttctcagacggggcggccgggcagagacgctcctcacctcccagacagggtctcggccgggcagaggcgctcctcacatcccagatggggcggcggggcagaggcgctccccacatctcagacgatgggcggccgggcagagacgctcctcacttcctagatgtgatggcggctgggaagaggcctcctcacttcctagatgggatggcggccgggcggagacgctcctcactttccagactgggcagccaggcagaggggctcctcacatcccagacgatgggcggccaggcagagacactcctcacttcccagacagggtggcagccgggcagaggctgcaatctcagcactttgggaggccaaggcaggcggctgggaggtgtaggttgtagtgagccgagatcacgccactgcactccagcctgggcaccattgagcactgagtgaacgagactccgtctgcaatccccgcaccttgggaggccgaggttggcggatcactcgtggttaggggctggagacccgcccggccaacacagcgaaaccccgtctccaccaaaaccagtcaggcgtggtggcgcgaggctgcaatcgcaggcactggtcaggctgaggcaggagaatcaggcagggaggttgcagtgagccgagatggcagcagtacagtccagcttcggctccgcatgagagggagaccgtggggagagggggagggggagggggagggggagggagagcagttcaggcattctttacttgagagccacaactctcaaagtctccttggatagaattcagggaatttatgaatttgtatgggtaaaaaattccatttttatttttactaatgtaggggagaacatatgtttccttctatccatcctaggtttagggctgagatctctataacaaaagagagattagcaagagaaaagcatgcacatttatttaatataagttttacacgacacgaggggctccataaggaaataaaggcccaaagaaacagttgaacttgaatgttttttatagtaggtttgatgaagagcagccagtgatgtagaaatgtcatagggcaaagtgtgaacaagctaaatgtaataaactgggggaaactgagaggcctgtttgtttagattcctctttgtgtccctgtgcttttggaggtaaggatgctccttttctctgggtgccaggagagcacctcttacatgacagtcttatgatctacttcaggggaaggtcagaaaatccttcccaggttttatggctgcttctggggagaacagcaggcagaaggtcagagtcaccttcctgcttctgcaatttcctcaaatgccttcagcttaaaatattcaatatgtcaaagtgctgtattttgtgtagggtgtcctgaaccccgtcactaacctctaactgaaagttaggattttcttcaattctgaacatagttcataaaccacggtaatattagcaatacttcatcatcaaaagaaaaacccagatattttcatatcacattagttttttgcatctattttcattatgcttatcactatttcaaatttaggatagctattaactcttatttaatgcatttataaagaagcatgcatattaatatataacaaacttatcttttaacattttaataactgtatttcgatataattagattcctttgtaatcctatatattttatgcatttaaaaacatgattttaagaaggcattcataggctttaacagatagctaaagactaagaacccatgtttttattctactttcaatacttgaaaagttgtggataaaacaaaaattatgttaaaaactgaaaagtaggctgggctcagtggctcacgcctgtaatcttagcactttgggaggctggggtgggtggatcacctgaggtcaggagtttgagaccagcctggctaatgtggcaaaaccctgtctttactaaaaatacaaaaattagctgggcgtggtggtgcacgcctataattccagctactcgggaggctgaggcaggagaatcgcttgaactcgggaggcagaagttgcagtgaactgagatggtgccactgcactccagcctgggcaacagagtgagactccgtctcaaaaaacaaaacaaaactgaaaagtaatcaactaaatacttttaaactataatattctatacacttttgatgatagccatgtattatggtattatttatgtttttatatttagcaattcttgttccttaaaatgtgctttatggagaaggagccagagttagtgaaatacgtttaggttaatttaggatatattaatgacattatcccacacattgttcatgtcatagacatgaacttaaaaaatttaaagttcctgctgcctgcttagatgcatctactaatctagagcagttgtaaggaagatccatctgaattagataaaaatatgagcagtggagtattggttattttattctggttggctcagttatttgccaaataaaggccctggtcaaattgttgatgactacgtaaaaataatttggactaatacattaaattgttgatcattaaaataattcttccaaagtgcttgtcttttatgcatttctttactttaacataatataaaaatatgtgttgaatcctctttttttaagacagggtcttgctctgtcacccaggctggagtgcagtggtgcaattacaagctcactgcattctcaacctcctgggctcttgtgatcctcctgtcttagacatctgcatagcagggaccacaggcacacaccaccactcctggatagtttcttttttatttttgtggagacaaggtctcactatgttgtccaggctggtcttgaactcctgggctcaagacgatcctcctacttcagcctcccaaagtgttgggattacaggcatgagccactacacgtggcgttttgaatcctcttctgtacaaagatacaatctgagtccttaggacatttatagcctaatattttcttccatcaaagttgctaaaccccatcaccagaataccacaattaatattctcaggatagattattaatagttgcctaggaataagaatggtatgtggcaatgatagaaatttgaaatggcagatttattaagtatttttaagccatcaagttacaaaaggctattaggggtcttaaaaagacaaagagtatacaataaaacaataagcaattacagattgttttaggttgaacaatttttgtacagttatatctatagtacattactaatttacttagcaaactttatcctgagatttgcaaatttaaaaaaatgaagaatcaaactatattttcttttctgtttttttgaaacagagtctccactctgtcatccaggctggagtacagtggtgtgatctcagctcaacatagcctcaacctcttgggttcaaggaatctcgtgcctcagcctcccaagtagctgggattacaggcatgcaccaccgtgctcggctaattttttgtatttttagtagagatggggtttcaccatgttagccaggctgctctttaactcctggcctcaagttgatatgcctgccttggcctcccaagtactgggattacaggcgtgagccaccgtgcccggcctcaaactatattttctaattagtacagtaaatacacattaatcatgacacaattatttcttctggatacagcaggaaaaattaagttaagagaaagtgcttcatatttcttgatttgttataaaaaggagagatcctctagatttctgggtaagagggaaagctagcaatcccacaatgatttcctttatttcttgccatccgaatatatccttcttcaccaaagttgtggccccagctttagaaaaagaaataatacaaaattacaaatgcgtacaatcaaaccatgttatcaactttttatctcattgtttttctcctataagtgattacatatgaaaggccgtaaaacaaaattagaatgaaataaggtaataatttctccagggatttcaggtaactcaaaataatggtttggaaagctttagtgctatattgatgaatagacttaatacctaaggaaaactatagtaagatccatcccagtcctttaatcctcctactttgcaaatatgccttctctaaagaaagagtattagtatcctttataagcctttatctctaaattttttgataacagtatcatgtgtaatgattttctatcaaacttaaattcctctagagaatgtcaattaagaaatatttttgagtgactactatgaaaaaggtatagggcagggaattctaaagcaaacaacaaaaatgcagctctgaaagagctttttgatctagaagtggagctgactttctcataattaaagctattgaaaaatgagccaggcatggtggctcacacttgtaatccaagtgctttgagaggctgaagtgggaggattgtttgaggccagagtttgagagcagcctgggcaaaatagcaagtccctgattctacaaaaaaaatttttttttaattagccaggcatggtggcatgcacctgtattccttacctactctgcagcagaggctacttgttagagatgttgcagagaaaaatcatgggtcggattagggttcgagtagatcagtgtttcactttttgatttaatggacttagaggagttcaaaaagtttttacagatagatatacagttatcaattttaaaattagcatgtatggacatcttttttttttttttggaggtgaagtttcgctcttgttgcccagactggagtgcaatggtgcaatctcagctcaccgcagcctccatctcctgggttcaagtgattctcctgcctcagcctcccaagtagctaggactgcaggcatgtgccaccacgacggctaattttgtatttttagtagagatggggtttctccatgttggtcaggctggtctccaactcctgacctcaagtgatctacccgcctcaggctcccaaagagttgggattacaggtgtgagccaccacgcccggctgtatggtcatcttttttaaaaagcatactattggtcgggcacggtggctcaagcctgtaatcccagcactttgggaggcagagacgggcagatcatttgaggtcaggagttcgagaccagcctgatcaacatggtgaaaccccgtctctactaaaaatacaaaaactagctgggcatggtagcatgagcctgtagtcccagctactcgagaggctgaggtaggagaatcgcttgaacctgggaggcaaggcagaggttgcagtaagccgagattgcgcctgtgcactccagcctgggcaacagagtgagactgtctcaaaaaaagaaaataaataaaaaccatactacttactgtcaccattatgttgtaaaagaaaatacattttaacaccaaaagcaaaaaatccaaagacataatctctattttaaggatagtcttttgagtaaataaatttatattaatgaaaaagtcaccaaaatattcttatttttcttactttaccaagactgatgaaaaaacttagaaaatccttgtaagaggaatgatttctgaagctctttatcattctgagattttatagtggtaggtatataaatatcatacaaggcaaaattcattaagtgctctaggatacaaataaaagtgtgaaattgagaaaatgcctagtgtgtctggagagcagtaagaaatttagttgaaaggaaaactggatatctttagtagaatagtggaaaaagaggatagaaagctggtttggggccatgttgtgaacagcttagaacagcaggtggaggaacatgtacttcaattacaaaggcaaagggaagctgttagaaattttggctcagggactcaaagtttgtgtttttgcatgcagtggagaacctaagaaatgctggtttattgttggaagacaaatgacaccatttaaaaggactgtgctttaagaggccttaaatattctatgtatcagccctcattggacattttgcaggtcctatttttttctctctgtaccatttaacacacttgtctactcccaccttactggtctcttggcttcaagacactactatgttctgattttcttatctctctctggtcagtccttctcaaacattttcatgagctcctttctttacttcctttcacttaattgccactccactgcttagaaattgtcaatggctctccatgcctttacaataaaattcaaactccatcgtcacctctaataaaccactggctgtagtgggtttttttgtttgtttgtttgtttttgacagagtctcaccgtgttgccctggttggagtgtggtggtgcaatcacagctcactgcagcttcgacctcctgtgctcaagcaatcctcctgcctcagccttacaagtagctaggaccacatgtgcataccaccatgcttggccaatttttttttttttttttttgtgatggagtcttgctctgtggcccaggctggagtgtagtggcacaatctcggctcactgcaagctccgcctcccgggttcacgccattctcctgcctcagcctcctcagtagctggaattacaggcgcccaccaccacgcctggctaatttttttgtattttttagtagagatggggttttaccgtgttagccaggatggtctcgatctcctgaccttgtgatctgcccgcctcagcctcccaaagtgctgggattacaggcgtgagccactgcgcctggcccaattttttattttagtaaagaagaggtctcactatgttgcccaggctgtagcaatgctcttttaatatccagtttgataagcaaaagcaataacaagaatccggccaggctattattaatattaatagacaccacttatttagcacttactctgccaaacagattaacataaattatctaatttaatcatcatcctgtgaggtgaatattatcttcttttactaaagaaaaaaacagaagggcagagtggtaaagtagcttgccaaaagtcacatagatagtaaattgtgaagccagaggtcaaatctaggattattttattccaaagcccactctaacttttatctatgcctatccctacagttatctctgtgagtgaagtcatatggggaatgaaattcagaccagtacatctaggatctcatgtaatttatatcctactatggtcactgcattaaataataggtaaaataaatcattttaggtgaactgaatttggacctgagttctagtatgaaaattgaattgagggtctagttactagcagtatgaattcagtcagtgagaccaaggaatcccagaccccattcaacatctaaacaatttacttttctcagttttaccgaccaagatcaattgcccccagttttgcaaaagatcccagacctctttttgactgagtcctgctaacttcccttaaacaatgaaactgataaaaaaaaaaaatcttaagctaaataaagtatctgaggacaaagtcttgccttcagaattatacaagatctgctccaaatgttcatttcggtacttaccaagttgtatatttttattaattctatagctctttcactcaaactgttcaactttaggtgagtttgttaactaaatgcctatctcataagagtactttaaaaattaaatgagagaatgtatttaaagtactcacacaatatttggtatatagccaatgcttactaagtgaaggtagctatttttattattatccaggtatgagtacatcagattggactcaagtagagtccatctacttttttttttttgagacggagtttcactcttgttgcccaggctggagtgcaatggcacaacctcgcctcactgcaacctccacctcccaggttcaagtgattctcctgcctcagcctcctgagtagctgggattacaggcgtgcgccatcatgcccggataattttgtatttttagtagagatggagtgtctccatgttggccaggctggtctcgaactcccaacctcaggtgatcctcccacctcggcctcccaaagtgctgggattacaggcgtgagccactgagccgggctgagtccgtctacttttaaaaaaatgtatagcgttcttctagggtgatcaccagtcccagtttgcctgggactgtcctgtttttaaaaagaaagtcctatgtcccagaaagcctcgtagcccttagcaaagtgggaaagttgatcaccctaccttctccttgcatattataaggctactaacttattattccttctaaaatcaatgccagtttcctttgtaatagactgaagtcctgggcttcttaggctgtgccagacactcttctaggcattaggattacagagacaaagtctttctaaagcctaggttctagaggagaaacatatgataaacgaagaaatacttgatgatatatatgattagtacaataaagaaaaataaagcaggataagggatacagagtgttaagagacagggctcaattttaggtggaatggtcgggaaaagcttcgctgagtggatgtttgcgcaaagatgcaagtgaggcaaagacctggataaagggctagaaataagcatgatgtgtcaagaaatagccaaaaggctaatgtgctgggagctgagtgagagaggggagagtagttggagaggtagttggagaggcaggctaaggccagataatgtcatgctttacaggtcatgggttttattctgagtgggaaggaaagccattagagggtttggggtagaagggtaacataatctactttatgctttaaaaagataattctggttactgtgtagaggattgattccaagcaaacaagagggaagcagctaccagttatgagattattgcaatagaccaggagatggatggtggcttgaactctaatggtaacagcagaggtattgagaagtgcaagcaaatcttgttttattgtgctttgctttattgtgcattgcaaattttgcatattttacaaattgaaggtttgtggcaaccctgcatggagcaagtctatcggcacaatgtttccaacagcctgtgctcactttgtgtccctgtgtcacattttggcatttctcataatatttcaactgttttcattattagcaaatctgttatggtgatctgtgatcagtgattttttttttttttttgagataggatctcactctgtcatccaggttgttgtgcagtggcacaatcgcagctcactgcagcctcagcctccaggtctcacgctcctgcctcagcctcccaagtagctgggaccacaaatatgcaccagcatgccagggtaattaaaaaaaaaaactatctgtagagacagagtcttgctatgttgcccaagctgggatcagtgatctttaatattactattgtaattgtcttggggtgccatgagccacgtgcatataagatggtgaacttaactgataagtggtgtgtgttctgactgctccactaactgacacttcccccatctctctctctctcctctggcctcccttttccctgagacacaatgatattgaaattaggccaattaataaccttacaatgggccaggtgcggtggctcacgcttgtaatcctagcactttgggaggccaaggcaggtggatcacctgaggacaagagttcgagaccagcctggccaacatggcgaaaccccgtctgtactaaaaatacaaaattagcagggtgtggtggtgcgtgcctgtaatcccagttactccggaggctgaggcaggagaattgcttagaacctgggaggcagaggtttcagtgagccaagattgcaccactgtactccagcctgggcaacagagggagactgtctcaaaaaacaaaaacaaaaaacaaccttacagtggcttctaagtgttcaagtgaaaggaagagttatacatctctcattttacatcaaagctagaaatgattatgctttgtgaaagccaaggtaggctgaaagctagacttcttgaaccagttagccatgttgtgaatgcaaagggaaagctcttggaggaaattaaaatgctactccagtgaacacatgaatgaaagcaaaacaacaggccaggtgcagtggctcatgcctgtaattccagcactttgggaagctcaggcgggtagatgacttgagctcaggagttcaagaccagcctgggcaacaagctaaaaatacagaaattacccgtgcctggtggcacatgcctgtagtctcagctacttggagggaggcggaggttgcagtgagctgagattgtgccactgcactccagcctgggtgacaaagtgagacctgtctcaacaacaacaacaacaacaacaacaacaacaaaaagaaagaaagaagaaaaaagtaaagaaaaaaagtgaaacagccttattgctgatatgatttgagtggcctagataaaagagcaaactagccacaacatgcccttaagcgaaaacctaatccagagcaaggccctaactctcttccattgtaagaaggctgatgaaactaaaattaaagaagttaaataacctgccgaagttcttctatgcctccagtgcaacctatgccacctcgattttagcatttatcacattgagttgcaatggactacacatgcacctgcctgtttccttcactccattagactatgagtaccttgagggacggtagaagagctgcatttttcatttccaatcgctagttcctagcttggcacatggtaggtactcaatacatgtttgttgaatcagtgtccaaatgaagatgcaaaaatgaacaagagactatcctaccttgaagaagtttacattttagtgaatggggcatggtttgcacaaatagctataacacaagggatatgtgtaaaatactataatagaattcataaagcattgccaaagcttaggaattagagaaacaattctaagtgaatggggtatgaaggagatagtatttgaggcaggatttaaaaaatgaataggatttgtaatgacttttttttcattttaaaattaatacctttcttttttttccttccttttttgagacagagtctcgctctgtcaccccggctggagtgtggagcgcagtggtgtgatcttggctcactgcaagctccgcctcccaggttcatgccatcctcctgcctcagcctcccgagtagctgggactacaggcatgcgccaccacgcctggctaattttttttgtatttttagtagagacagggtttcaccgtgttagccaggatggtcttgatctcctgacctagtgatccacctgccttggcctcccaaagtgctgggattacaggcatgagccactgtgcccggcctccttcctttttttttcgagatagggtctcattctgtcactgaagctagagttgagtgatgtgatcatggctcactcacagcggcctcaacttcctgggctcaagtgatattcccacctcagtctcccaagtagctgggaccacaagtgtgtgtcaccatgcctggcttatttttgtatagagatggggtctcactatgttccccatgctggtcttgaacccctgggctcaagcgatcctcccagttcagcctcccaaagtgctgggattacaagcatgagccactaagcctggttggacatactatgtttaacttaaatttttttttgacatagggtcctgctctgtcacctaggccagagggcagtggtgtgatcatggctcactgtagcctcaaactcctcagctcaaaaaatcctcctacctcagcctcttgagtagttgatattacaggcacatgccaccatgcccagctaattttttaaatttgtttatagagactgggtctccctatgtttctggtcttaaactcctggcctcaagtgatcctcctgccttggcctcccaaagctctagagttataagcatgagcttaccacattcagctaatatttatactacatataaattttgtatttatgtgtatcttttttcatttaaatatatatcccaagtattttattaggttattaataatagtctgaataaatctaatgcatggagttgattatgtcatagtttatttaatcatatacctattgttaggcatttttggctacttactagtttttactattaaataataatgctacaattcacataagttgtgtatgaaagttttcccatatttaggattattttcttcatatagattccaagaaataaaagtaatgggacactggctgtgcgcagtggcttgcgcctgtaatcctggcactttgggaggccaagacaggcagatcacccaagatcaggagttggtagaccagcctggccaacatggtgaaaccccatctctactaaaaatacaaaaattagccaggtgttttggtgggcacctgtaatctcagctacttgggagactgaggcaggagaatcacttgaacctgggagacggaggttgcagtgagccgagattgtgccactgcactccagcttgggagacagagcgagactctgtctcaaaaaaaaaagggggggggaagaatatgaacatttaaaaagttctttatcatattgtcaaattgcttccaagaaagagaataggcagggtagggtggctcatgcctgtaatcccagcacttggggagaccgaggtgggcagatcacgaggtcaagagatcgagatcatcctggccaacatggtgaaactccatccaacatggtgaaactccatctctactaaaaatacaaaaattggctgggcatggtggcacatgcctgtagtcccatctactcgggaggctgaggcagaagaattgcttgaaccttaaaggcagaggttgcggtgagctgagatcatgccactgcactctagcctggtgacagagtgagactccatctcaaaaaaaaaaagaataaatacagcttactttcccatcaaactgtataagaatgcccatttcaccaagacaggtgggatttctatagacagcattggacttcacaggcatttcagaaagatacagcatatataaagaaacagaggtagggatgtatctgtaaacttagggaatgatgaataagtagttcactgtggccagagtatgactgtgggtatatgaaaatatagtggaagaaatgtctaaggttatgttaaaagctagataatggagtacctggaatgcctggccaggagtttggacttcatttttagacaatggtgaactattcagaatttttgagcaggagttgacatgatctatattttaaaaagataccgctatagctgggtagaatggaatctgaattacagcagggccattgggaatggcaaagagaaaatacatataaaatatgattcacaggccaaatggatagggctgggtgggttgaggggggaaaaggaaaaggccaagatgatgcttaggctttaataatctgaagatggtaatatattacccaaaataaggaatagttttcccttgagcttgtttgaaaatccttttcagggatgagggaagaaaggaagagaagaacattgtaaacttattgagtatgagagtgtgtatatgttggtagtagggtgatgtaggtggggagtttggatttttcaaggagagctgccaaattggaagttggacaaggaagtgtgtcacttaggaggtcattttcagagattatgaactggggatcatctacataatggcaatagttgaaactgaaggagcaggtgagtttgctttgatatagatgagtttgctttgatatagcaaactcatgtaacaggcaggtggataaaataacgtaagatatgaggctaaagttgatgtagcaaaatgaatcaagatagtgagaaatgtgccattgcatatgttttttgggtcattgagagcaactttccaacctctaacacactttcctcctccaatacatgaacaattccatacatctggaaacttgattcaaatagtgtcttctctgtggaggtttaggctgttaggcatttcctcttcaacagtcccatagccatttagacatgtatcattataccacgatgtgtttgttgtatcgtttaaaaatacatctaggctgggtgcggtggtggctcacgcctgtaatcccaacactttgggaggctgggagatatatatatatatatatatatatttataaatatatttatatttatatatagagagatttatatgtatgtatacataatatattatatatgtatattatgtatacataatatattatatatgtatattatgtatacataatatattatatatgtatattatgtatacataatatattatatattatatgtatattatgtatacataatatattatatattatatgtatattatgtatacataatatattatatattatatgtatattatgtatacataatatattatatattatatgtatattatgtatacataatatattatatattatatgtatattatgtatacataatatattatatattatatgtatattatgtatacataatatattatatattatatgtatattatgtatacataatatattatatattatatgtatattatgtatacataatatattatatattatatgtatattatgtatacataatatattatatattatatgtatattatgtatacataatatattatatattatatgtatattatgtatacataatatttatatattatatgtatattatgtatacataatatattatatattatatgtatattatgtatacataatatgtacacataatatttatatattatatgtatattatgtatacataatatttatatattatatgtatattatgtatacataatatttatatattatatgtatattatgtatacataatatttatatattatatgtatattatgtatacataatatttatatattatatgtatattatgtatacataatatattatatattatatgtatattatgtatacataatatattatatattatatgtatattatgtatacataatatattatatattatatgtatattatgtatacataatatttatatattatatgtatattatgtatacataatatattatatattatatgtatattatgtatacataatatattatatattatatgtatattatgtatacataatatattatatattatatatgtatattatgtatacataatatattatatattatatatgtatattatgtattatattatatattatgtatattatagattatgtatgcatacataatatgtattgtatattatgtatgcatacataatatgtattgtatattatgtatgtatatataatatatattatatatattttttcatgttagattgtgagtgcctttaggacaggatggtttcttactattttttgtatctccagggcctagataatgccagtcacattgtagatgcctagtaagtgcttgttgaatgaatgagtgaagagaagcagatttgaatttcaacactaaaagatatagatgatcttcaagagcaacttcagtagagaagggaatttagaacacctgccgtagggagttccttagagagtcaataagatatgagggaaatagtttcattttaaaaagctatcactggtctacacccaagctgatcagtgctgtgaataggttatcagtgaaccaagatattgatcccctcagctactttccccatgggccatacgaatatcatcatcttctatgtgtgccacagtgggaaaagggtaggaaagcaccttttgtttgatttgtagactatgtacttcaagtaaagatttaaggggtgttatgggttgcattgtgtccccacaaaattcatgttggaatcctaacctccagtacctcagaatgtgaacttatttagagatagggttgatgtagacataattaattaaattaagatgaggtcattagggtgggtcctaatccaacatgaatgatgctcatgaaaagggaaaattggccaggcgcagtggctcacacctgtaatcccagtgctctgggagaccaaagcaggaggatcacttgatcccaggagtttgagaccagcctgggaaacatagagagatcctgtctctacaaatagaaattaaaattggtctggtgtggtggtgcatgccagtagtgccagctactttggtggctgatgtgggaggattgcttgagcccaggagtttgaggttgcggtgaacattgatcaccccactgcactccagcctgggtgacagagtgagaccctgtctcaaaaaggggaagaaagtaaaattatgaatagagacagaaatgcatacagggagaatgtcatgtgaaaatgaaggcagaggtcagggtgattgtcctaaaggctgaggaaagtcaaagatcaccagcaaactttcagaagctaggggagaggcatcaaacttttttttttaattaaaagaacatatttaattgacagattgtataaactcaaggtatacagtgtgatgacttgatgtatgtgcacattgtgcaatgattgacataatcaaatgaaataacacatccatctccacccgtgctgtacctttgattcccagaatctgttcatcttatacctgaaagtttacactctttgatcagcatctcctcattacccagcctccagtccctggcagctatcattctactgtctgtttctgtaagtttgacttttttagatcccacatataagtaagatcatacagtttttttttcctgtgtccacgaatattttcttcctcacagcgtgagaaggaagtaacaccttgatcttagacttccagcctccagaactgggagacataaatttctgtcatttaagctgctcagttcgtggcactttgtcatggtagccatagcaaactaacacaaagagaaactccaggtatgccccaaagtctcaactcttcatatttcctccattttttccctctagaagttatgttccttttgtttatgagtgatatagatgtcagttcaatacatatattgaggggcctttaggtgccacccacttagtctgtgctgcggatatgaagaccagacataatctctccccaaaggcacgtacagaacactggagtgacagacaggtaaatatacaatttaaatataatgcctaaaatcctgtgatccagtatgcataggacattttggcagcatagaaaaaagacatgttcctcagcccaaggattcaggaaagacttttctggaatagattgtgcctgagctacttctgaagaaaaggagaagtaaaccaaaagagaagacaggatgttctaggcagagggaacacaaaccaagatatgaaggaaggtattacagataaagtggaatgtatgggaactacaactgtggatagtgcagtataaccagagtgaaaataggaggcaacaaatgccaggaggtgaggctggcaaggcagggagcacagcctataggatttgtcttctgtcagggaacattaattttacaccgaatgaaactcagtagaagagttataagcccagactcgttcatattttagacaaataagtttggcagcagtatgaaagatggatttgagggtaaaggggaagaaaatagagagtaaaggagaccagttagaagggtacagcaatagtccacactagagatgcctgaactagagccgtaatagaagaaacagagaaggaacagaatcaaggacatagataaggtaaaattggtttgactaattggttgcttggttggacttggggaggtctcagatgaatccatcatatcttattgggtgattgtgttgtgtggccctttactgatatgggaaattctgaaggaggaacagtatgggggagagagtactgaattatttggatgtattgagtttggaaagactaagatatatgtaagtgagtgtgtccagataagtctgaagttctgggaagatgtcagaactagagctagagattcaaaagctattggcatataaaggttatagctagagtcctaagagtggaattatagcacccaagaaaaaataaaataagaagaggaatgggcagatgatagagccctggggaaaactaacatttttgggctaaatagaggagaggaataggttcatgagagaggctgagaaggaataatcacagaagtagtacagaagataaaccaggaaaacaaagtgatgaaggcagaatggtaagtgaaaagatgggggcactgagtaatttagaatgtcactttgtaagaagctataaagttcatcattgtcaatatcgtgatcataatgatcatcatcaaaatcatgagagtatttgctgaaactccctcaaattcctgattccaattaaatataaagtgtaaatatattacctgtttttcacaagccagtattctttcccattaagatcaccatagccaaccacaagtacaccatgattcacattctgagtacaggatggttcatagtagacacctgagaatcaaatatgggtgggaaaaaagagtgaatactataggataataaagggcattttaaaacggtattactttttattagcctgctttggatacatagcaaggttaatttaaaaagttaaggacatgtccaggcatggtggctcatgcctgtaatcccagaagtttgggaggccaaggcgggcgggtcacaaggtcaagagatcgagaccatcctggccaacatggtgacaccccatctctactaaaaatacaaaaattagctgggcatggtggcacgcacctgtagtcccagctactcaggaggctgaggcaggagaattgcttgaacccaggaggcagaggttgcagtgagctgagatcgtgccacctcactccagcctggcaacagagcaagactccatcttaaaaaaaaaaaaaaaagtcaaggacatatactgtcatgcataaactagggctcataattatttgccaccaatgctgtatttgtcagtgttcttgccaagcttagcatcactccagtcatagttcccccagaaaccttctttgataagcacaccacctttttctaagtttttttcttttttgtttttttctaagtatttttaaacttgcatacaatcagttattttaattctctgtgtatacaggcatatctcattttattgtgctttgctttattgtgctttgcagatattagcttttttttttttttaaggaacagtgttttgctctgttgtctaggctgtaatacaggtggtatgatcatagctaattgtaacctcaatctcctaggctccagtcatcctcctgatttggcctcccaaagcgctggaattataggcatgagccactgcacccagctagatattgcattttttacaaattgaaggtttgtggcaactctacattcagcaagtctattggtaccattttcccaaaagcatgtgctcacattgtgtccttgtaccacattttggtaattctcacaatatttcaaactttctcatcattattatatctgttatggtcatctgtgatcaatgatctttgatgttacttcataattttgagggtgagctacaaaccacacctatataagatagcagacttaacccacaaatgttgtgtgtgttctgactgatccacggactggccacacccccatctctctcctcaggcctccctgttccctgagacacaatgatattgaaattatgccacatgataaccctatgatagcttctaagtgttcaagtaaaaagaaaagttgcatatctctcactttaagtcaaaagctagatgtgattaagcttagcgggaaaggcatgttgaaagccaagacaggccagaacctagcctaggccacttgtaccgaacagtcaggcatgctgtgaatgtaaaggaaaagtgcttgaaggaaattaaaaatgctgctctgctgaacacacaaatgacaagaaagtgaaacagccttattgctgatacagagaaaatgtgagtggtctagatacaagagtaagccagcccagcatgcctttacgccaaaacctaatccagaacaagaccctaactctcttctattgtaagaaggctgagagaggcgaggaagctacagaagaaaagtttgaagccagcagatgttggttcatgaggtttaaaattgcctcgcctcaccccgccccgcctcaccccgccccgccccgccccgccccaccttgccctgccctgccctgccctgcccctctttcttccttctttctctttctttcttccttgttttttagagacaggttttcactctgttgcccaggttggagtgcagtggtatgatcatagctcactgtaacctcaaattcctgggttcaaggagtcctcctgcctcaccctcccaagtagctgagactacaagtgagtgtcaccatatccggctaatttttatttttatttttcgtagagataagggtctcgcgatgttgctcaggctggtgtcaaactcccaggctcaagcaatcctcccacctcagcctccaaagctagaattacaggcatgaaccaccgtgctcagccaatatcctttctttctttctttaaattctaattattgtttattttattttttaccacttctgtagaggaagaaagaaggatgacgcgcatctacaccaacagacactgggcctttattggccacagcttctttcaggacatcttctctgccataaggaagttcagtgtactttgaacatgtggcagcacgatattttgagtcatattgacatttctgatcctgcaaaaagaagtataaatatgatgaagtatacttcaactcctgtataaatcacctgtatcctaagcctggattttaaatgtctcccttcctttctttaactttttcatgtgtctaaggctccttcctttgcaaatcttccaaatcctaacagtcccgggtttcagcaataatggaggaaatacagaactattctattctttcaaattgtgaacatcctcatacatgcaaaacttgccaggacaatggcccctcagactttcaggtggactgtagggaaatattacatagagataataaactctagatgagagctttaaaatctttttgatgcctgcaagatgatctgcagctaaaatgatggtatataaagaccatataatatgggaaacacaagtatttcaagtgggaaaaggaaagttacaaattcatgtttgttgtatatacaactattttgtatttatttatattatttatttttttgagataggctctcactccattgtccaggctggagtgcagtagcataatcatggctcactgcagcctccaactcctgggccaagtgattctcccacctcagcttcctgagtagctggaactgctactcaggtgtgcaccaccatgcctggctaatttttttgatttttagtagaggtgaggtctcactatgttgcacaggctggtctcaaactcttgagctcaagcaatcctcccacctcgacctcccaaagtgctgacattacaggtgtgagccaccacacttggccaactatgttttttaagtgcttaacaagaaaataacttgaaagaaataaaccaaaacaatagtggttaaggtagaaggtttttgagtgatatttttatatttttaaaatcttctgtaacatggacacaatccttaggttatcgttatatcaaaatgtataatgaatttctgaggaagaggagagtgttatttagcttctcagtgggtggaagaatgatgtggttaatgatctgagaataaggttgagcatgggaggctgcagaagaaaaagtttaaatacagagaaataattttaaggatagtttgcttaaaatctgtttaattttgggatggagtcttgctccgttgccgaggctggagtacagtggcgtgatctcggctcactgcacctccacctcctgagttcaagcgattctcctgcttcagcctcccgagtagctgggaccacaggcatgcaccaccatgcctggctaatttttgtatttttggtagagacagggtttcaccacgttggccaggctggtctcaaactcctgacctcaggtgatccacccacctcggccttccaaagtgctgagattataggtatgagccactacgcccagtcattaaaatctgtttttaagcatgaatgctacttccttatttgtactactgatatattaagaagagtacttcatcagaaacagaactcttgagaatttaagaattcctcttcagggttctctctcacacacaatactgcttctcaagcaattggcatggtggcaagcccagcacagtcagtcagtggataacatgagatcatggggcagcacaaaaagtttgcttaagacgcaccatggctttgtagggataggaagcgtctgagtcgatgcccttgttatcaatgatgtactggaaagccgttgtcatgaagccaccattgcagcctttgtttccatatttttcagttgagcaatccaccaggttctgggcactgagagacaccagctttcctgttttcagcttcagctgtgcttccagggcccccacagcactgaaagcccagcaagcaccacaagaaccctaaaacagatacaaggtcacaaacgcaaatcacagaaaatcattcggaatgacttccataacccaaactggacaacgctcagctacatcagttctgtccctagttcccagaaagagctcccccactacagtttccttctgtctttaacaatgggaatgaagactaaatttaactcaattgttatctaggcaaggtccaaccttgatagagatttgcaatcagccaagctcagaacataatggccatattcaaatatacttagaaacaatactcactgagcatgtaccaaattgcacctattttcacccataagtaagggagatagttgcctacagtaatgagattttgagagagctaggatgatttccttgacctaaaataccctttctcctgtcatatgatgcctgaaacataagaagtttaatcctaggttggcatttttcaaacctttgttatcttcagaatttttttgattaaaaaatattttacaaggaggcataaacaaacaaaaaaaggcaaagctgctttagttttaaaaggggcagagtgtccagagccccatcataattgttctctttctctctccttccctcctcccaccttgctctccaccaaaaggaagcaaactgacattgcttttgattgaagcaaaattgttcattaaaatgcaagcacccagagaaaggagctcattaacttactcagagttaacatctaaatatgtggtttattgggtcttctaaaagctgttattttagagaacctcgggtaagaaatccaaaactaattgaaagaaaaatatgtaggtggaaaagaataagagattagcagtaccatttacttctttttgtttgtttgttttgagacagggtttccttctgtcactcagactgaagtgcagtggtgtgatcatggctcactgtagcctcaacctcccaggctcaagcgatcctcccatctcagcccctcaagtagctgggactacaggagcgcaccatgcctggctaatttttatttttattttttgtagagtcagggcctcactatattgcctaggttggtttctaactcctgggctcaagcgatccttctgcctctgcctcccaaagtgctggaatcacagatgtgagccactgtgcctggccaccatttacttcctaataaatttttactttcttcattgatcacaacctggggtagctgctcagaatgctttgattcctctcacttaccctgacctctatggtgatacatgtgttttacctctaactaatttaggatttttgcaatttttttaaaacaagcaaactaaaggaaaatacaacagcataggaacaataattttacaaggcacatatttcatattctaacgatgcaagactagccatgaattaacttgagtggctcaatttatagaacactctatctctagttctttcttctccttcaactttgaaactcacaagtgaaatggagaaacttcctgatcaccagggctctctcacacaacactgcttctcaagcaattggcttattggagagtccagtgcagtcaatgcatagcgtgagcaataaaagtctgtgttaaacacctatttgcttagttcagtgtttgtctaagtaggtggctctatgatcacttagaaaagcactgtgggggctgaacacgagggctcatgcctataatcccaggactttgggaggtggaggtaggaggatcacttgagctcaggagcttgagatcagcttgggcaacatggcaaaacccatctctgctaaaaatacaaagaaaaaaaaagtggtggtgtgtgcctgtagtcaccgtgtaggctgagatgggaggatcacttgagcccaagaggcagaggttgcagtgagcccagatcgcaccactgcagtccagcctgggcaacagagggagaccctgtctcaaacaaaacaaaacaaaacaaaacaaaaaccactgtggagaatccagttgtccctcagtatccacaagggattggttccaggacctctgagcataccaaagtcaagaattttcaagttccttatataaattactgagtattcgcatataacctacacatcctcctatacacttttttttttttttttttttaagacagggtctcactctatcgcccaggctggagtgcagtggcaagatctcagctcactgcaacctctgcctcccaggttcaagtgattctcctgcctcaccctcccgagtagctgggattacaggcgcccaccaccacgccaggctaatttttgtattttcagtagagacgggacttcaccatgttggccaagctggtctcgaactcctgacctcaagtgatctgcctcccttgacctggaaaagtgctgggattacaggcatgagccactacgcccggccctcccttatactttacctttttttttttttttgagatggagtctcgctctttagctcaggctggagtgccatggtgtgatctcagctcactgcaacctctgcctcccaggttcaagtgattctcctgcctcactctcctgagtaactgggattataggcatgtgccaccaggcccagttaatttttgtatttttagtagagacggggtttcatcatgttggccaggctgatctggaactcctggcctcaggtgatgcgcctgcctcagcctcccaaagtaatggtattataggcgtgagtgcctggcctattttttattttcatttttttctggatatttttgatccacggttggtggaatctgcagatgtggaagctgtggatatggagggccaactgtataaataaaatataatatgtgatccttgcccttaaggaacttataatttagttgggaagacaagaataacaaaaataactagaaagtaacacgtgggactgtaagattcactgtcaaattctgtagctagactaagcatttaaagagctctacctagggttcagaggcttgggatggtaatactcacttgatatttcacttcagtaacacaccctttctctctccagtccacagaatcaggcaatatccgattagggtttgacttatatgtgatatttctctgccactggctgggaactctcagggaactcatcaaagacatcacttcttcactggtctacaaagcaaatatacagtcaggcattgtttaatgactggaatatgttctgagaaatgcatcgttaggtgattttgtcattgtgaaaacaccatagtgtgtacttacacaaacctagagcgtattggctcctacatacctaggctgtatggtagggcccattgctcctaaactacaaacctgcacggcatggtactgtactgaaggttgtaggcaattgtagaacaatatgaagtacttgtgtatctaaatatatctaaacatagaaaaggtagagtgaaaatacagtataaaaagtaaaaatgggagctgggcatggtggctcacgcctgcaatcccagcactttgggaggccgagccgggcaaatcacctgaggtcaggagttcaagaccagcctggccaacatggtgaaaccccatctctactaaaaatacaaaaattagctgggcatggtggtgcatgcctgtaatcccagctatttgggaggctgaggcaggagaatcacttgagcctgggaggcggaggttgcagtgagctgagatcgcgccagtgcactccagcctgggcgacagagtgagactccatctcaaagaaaaaaaaaaaaagtaaaaatggtacttctatataggtcatttactatgaaaggcctggagttgctctgggtgagtcagtgagtgagtggagagtgaatgtgaaggcccaggacattactgtagactttataaacacggtgcactttggctacactaaatttgttaaaacatttttctttcttcaataataaattaaccttagtttaatgcaacttttttacttaataaacttttaattttttaaatgttttgtcttctatggtaaccccttaaaatacaaacacattgtacagctgtacgaaaatattttcttctttatcaccttcttctataagctttttctatttttaattttttaaaagtttttacacttttttgttaaaaactaaaatacaaacacacacacacattagcctaggcctatacaaggtcaggatcatcagtatcactgcatttcgtctccacctcttgtcccactggaaggtcttcaggggcaacaacacgtatggagctgtcatctcctctgataacaatgttttctactggatgcctcctgaaggacctgcctgaggctgttttacagttaactttttaaaagtataagtaggagtacactctaaaataacaattaaaagtatagtatagtaaatacataaaccagtaacatagtcatttattattattaagcattttgtactgtgcaaaattttatgtgctatactttcataccactggcagagcagtaggtttgtttacagcagcatcaccacagacaagtgagtagtgtgttgtgctacattgttatggtggctacaacatcactagctaggcaagaggaacttttcagctccatcataatcttaaaggaccaccatggtatatgtggtccatcagtggccaaaatgcatatgacacatgactatatatctctttcacttacatccttctttcttttctttctttcttttttttttttttttttctcttttgagacggagtttcactctttttgcccaggctggagtgcaatggcatgacctcggctcactgcaatctctgcctcccgggttcaagcaattctcttgcctcagcctcccaaatagctgagattacaggcatgtgccaccacgcccagctaattttgtatttttagtagagacaggatttctctatgttggtcaggctagtctcaaactcccgacctcaggtgatctgcccaccttggcctcccaaagtgctgggattacaggtgtgagccactgtgcccagcctatcctactttctaatatcctaataactgtaactgtgaatatatttaaaaactgccatggaataaaaaaactgagaaaaaacagtaatagttgtgaccaacacaggttccattaggatctggtggggcgaattatctgggtttgtttagtttcacacttggcactagcatcccagctaggcaccctcatggggaaggagaaaaagagaatggtaaaaactagaagttacagggaggcagatttttgtttcaaagcaaggcagaattttataaaagggctgtctaaaaagtggactaaactggtttcccatgtgagaaataattacaaaggagattcctgcatttaagaaggaattcagtctacctagggcgttcccttcttcactttggcaacagtggtaaagttttgcaggacagaacagaatctgaaaaccaataggggattatttgtgatattaaatacccacattctcccattaagaaagcagatgggtcatactaaattgtcaatctagacttaaataagtatggcaacttgctataaaaacctgtcaatagtctttaggtaatactttctagaatttattaaaaaaaaaacaatggtagtctctgagtttaaaatttcctctaaagaagtgatttgttaaagaaagaaagcagtcaaaatagaactaagtaagaaatttctgtacacgttcttacgtccttcaattctactgttttccaactttgtactatacattcctttgttattgttgtttaccttcaaattgcttttggggagacagaaaggaaatgatatttacccagacgtgaaagtgggatttcttgtaatgtacctaccatgtctcccaggtggttcatgcccagatcgtatgagtgcattcccattgaatgctccaggttgtgaagcatcacaaactttagattcttttcccagatgagacgtcgtactgcttcttcattctaaaacataatgaagaagaacatagtcatactgcatcctggacaaataagtgtttgatgatgaaaatggcaattttttttttttttgagatggagtctcactctgtcacccaagctggagtccaatggcacgatctcagcttacttcaacctccgattctcaggttcaagtgattctcctgcttcaaccttccgagtatctgggattacaggcatgtgccaccacgcctagctaatttttgtatttttagtagagacggggtttcgtcatgttggccaggctggtctcaaactgttgacctcaggggatctgcctgcctcagcctcccaaagtactgggattacaggtgtgagccactgcacccgcccaaaaatagcatttttgaagcattctaccaaatgtggatctgcccgagagcatgcaaatacataaatatatccaatataactgctaacttcacatattaatcttaattcttgctcttaactgctttgatggtttaatattattttatgataaacatgaatttccttctctttttaacatttattattattattattattattttgacagagtcttgctctgtcactcggctggatggagtgcagtgaagtggcctgattactgctcaccatagccttgacctcctgggacccagcaatcttcacacctcagcctcctgcatagctgggatgactggtgtgtgccactgcagccagtttttctgtttgtttgtttgtttgttttggtagagactgggtctccctatgttgcaggctcatattgaattcctgggctcaagcaatcctcccctatcagcctcccaaagtcctgcgattattggtgtaagccaccgcgcccagcattttttttttttttttttagacagggtcttgctcttttgcccaggctggagtgcagtggtatgatcatagctcactacagcctcaaactcttgggctcaaactatcctcccatctcagctgcccgagtagctaggactgcaagcctgcaccaccacaaccagcttatttttatttttattttattattattttttttttttgtagagacagggtctccctatgttgcctaggctggtctcaaattcctggccttaaaggatccttcccccttggcctcccaaagtgctgggattacaggcatgaaccatacacccagccatgatttgctctttctttttgatgttttacaacttcgttacatgtatctgggtgtaggtttctttatttaccttcggctgtgtgcttttgattggaggactcaggaccttttctcatatctggaaaattctcaatcagtgtctccacatatattgcttctccaccattccacctaattctcttcttcagaaactcctatccgaagtattttggagcctcaaactctctttcatctctcttacttgcgttttcatatatttttctttttatttctaggtgctgcattctgggtgaattcctcagtactatctttcagattactgattctatccagctctttccagtctggaaatccttttgatttttatcgcaatgacaatattttttattttcaagatttctaatttatttcttgtccattagtgtgcatattattcctttatatatagtcttttgaaaattcatttttgattctattattttaattttattcagagtgaatttacatgctgaccgacgattttcttgtccttcaggagattcatttacatagaatacaatgatgtagaaggcaaggtggatggtgcctcctacagtagctgaagccagagtttccaataagctggaaccccagggagcagtcagcaacaactgtgttctgcctcatttcattgagcgggtgagcccagtcccagaggcactgggtagcaagtctggatgcaggtttctttcccttggagcaaggttttactgttaccccagtaatggacataatgggcatgcatgatgggcttacttccaaaccacaagatgagaagcaatggtataaaggcaaacaaatctaactaagtgcaagaaaggaaaaaaaaaaaaagaagtgcactttgagatcaattataaaggtaggatacgaatcaaaagtcaggttcattcatcctgagggactggaattattaaacagagggatagcattcatttaaccagatagtggtgctaattgcacatctaagtccagtcaatcttgaaatgaggaacctgttcataaagggtgtgggtgagggtgaaattcatcaccaccaacgaaaccgtatgatcatttaaatagatgcaggaaaagcatttgacagaattcaacatcctttcataacaaacattctcaacaaattacatatagaaggaatgttcctcaacacaaataggccatatatggcaagactacagctaacaccatactcaattgggtgaaaatttaaaggccattctgctaagatcagaaaaagacaagggtacccactctcaccatttctagtcaatatagtgctgaaaatcctagccagagcaattaggcaagaaaaataaatacaagatctccaaataagagaaggaagaagtgaaattgcgtttgtttgttgataacatgatcatatagaaagtcttggccaggtgtggtggctcatgcctgtactttgggaggttgaggtgggaggattgtgtgaatctaggagttcaacaccagcctggacaacatggcaagaccccttctctacaaaaaacaaaaatagaaattagccaggtgtggtggcatgtgcctacagtcccagttacttggaaggctgaggcaagagaatcacttgagctggagtttgaggctgcagtaagctatgatcacaccacttcactccaacctgggtgacagagcaagatctcatctcaaaaaaaaaaaaaaagaaggttgggcaaggcggcttatgcttgtaatcccagcactctgggaggccaagatgggttgatcatgaggtcagaagttcgagaccagcctgaccaacatggtgaaaccccatctctactaaaaacacaaaaattagctaggtgtggtggcgtgtgccggtaatcccagctactcaggaggctgaggcaggagaattgcttgaacctgggaggcggaggttgcagtgagccgagattgcgccactgcactccagcctgggcgacagagcatgaatccgcctcaaaaaaaaaaaaaaaaaaagagagaagaaagactccatcaaaaaactattagaactgatacatgaattcagtaaagttgtaagacacaaagtcaacatacaaaagtcagtagtatttttatacactaacaactatttgaaaaagaaattaggaaaacaattctatttacaacagcatttaaaacatatttaggagttaatttaaccaaggagttgaaaagttatatgctgaaaactgtaaaacattgataaaagaaactgaagacaaaataggccgggcgtggtggctcacacctgtaatcccagcactatgggaggccgaagcaggcagatcacctgaggtcgggagtttgagaccagcctgaccaacatggaaaaaccccgactctactaaaaatacaaaattacccgggcgtggtggcacatgcctgtaatcccagctactcaggaggctgaggcaggagaattgcttgaaccccagaagcagaggttgtggtgagcagaggtcacgccactgcaccccagcctgggcaacaagagcaaaattccatctcaaaaaaacaagaaaaaaagaaaaaagaaagaaagaaatttaagataaaataaataaatgggaagatattccatgcttatggattggaagaattaatattgctaaaatgttcatactatccaaagcaaactagaaattcagtgcaatttctatcaaaattctaatgttattcttcacagaaatagaaaaaacaatcctcaaattcatgcggaactacaaaagtccttaaatagtcaaagtaatctttagcaagaggaacaaagctggaggcattacaaaatgcctggtttcaaaatatattacaaaactatagtaatttaaacagcatagtactggcatagaaacagacacatttaccaatggaataggatatagagcccagaaataacctgcaactttatggtcaatcaattttcagcaaaggtgccaagaacacacaatggggaaaggatagtctgtttaataaatagtattgggaaaactggctatccaaatgcagaaaaatgaaattgaacccttatgtcaccccatatacaataatcaactcaaaatgaattaaagcacaaacataaggcctgaaactatatacaaccactataagaaaatataggggaaaactccacaacattggtccgggcaacggttttttgaatatgacccctaaagaacaggcaacaatagcaaaaatagacgaacgggactccatcaaactaaaaagctttcgtacaataaaggaaacaattaacagagtgaaaagataactcatagattgggagaaaatatttgcaaatcatacatttgataaggggctaatatcccaaatatagaaggaactcaaagtaactatcaagaaaacaaccctgtttaaaaatgggcagaagacctgaatagacatttctcaaaacaagacacatacaaatggccaacagatatatgaaaaaatgcttaacatcaccagtcatcagggaaatgtaaagtaaaaccacaatgagatatcacctcacatctgttagaatggctattatcaaaacgatgaaagataagtgttggtgaggatgtggagaaaagggaaccctcatacacttttagtaggaatgtaaattagtacagccatttgggaaaacagtatggaggttcctcaaaaaactaaaaatataattaccatatcatccagcaatctcacttctgggtatatgtcccaaggaagcgcaatcagtatgtcaatgagatagctgcacttccatgttcattgtagcattattcacaatagccaagatacggaatcaaccttataaagtgtccattaaaagacgaatggataaaaaagtgtggtacatattgtattccatacataatggaatactatttagccttaaaaaaaaaaaaaggaaattctgtcattttcaacaacatggatgggtctagagaacgttatgctaagtgaaataagccaggcacagaaagacaagtactgcataatctcatttacatgtggaatctaaaacagttgaactcataaaagtagagagtagaatggtggttagcagaggctgggcggagggtagacagggaaaggggagatgttaggcaaagagtacagagtttcatttgacaagaagactacattctagcaatctattgcatagcatggtgactacagataataataataatgtattttatatgtcaaaattactgaaagggtagattttaaatgttcttatcacaatgaaaggataagtatgtgaggtgctgaataggttaattagcctaatttaatcattctgcaatgtatatttgtatcataacatcacattgtactccataaatagacacaattattatttaattataaataaataaaaataaaacttagagtgtatgacctaagagtgtcatttttatacaaaataatatgtcaaataaataaatatatgatgctagcttacaaacagaaatattacatagttacaggacttagttatttaaagcagtagggttaaggtcttaacatcagcaagtgtgctttgaaataaaaacaaaagtacaaaatgggaagtgatagtcaagaaacaatatctggccacactatgtgggtattaacgccttttcgctcctcagccatcccaaatgtggcccttcctcaggagcttgtgctgatttgcccttggcctgagaccttcactctattatgtattttgcttgctccctggcttccatcaattctctgctcaaatggcacccttatccgtgaggccttccctaaccctcctgtcatatagatagacttcttaccaccaccaccacccagggcccttcctactctccatgccttctgttatttttatctacaacacttatcaccatctagcatactacatatctgcttgtttattttcttatttcctgtctctctcactataatataagctccataacaggaattttgttttgattcctgctgtatggtaccaagaacagtatctggcaagaaacaagtacataatatttatttatttatttttgagatggagtctcactctgtcacccaggctggaatgcaatggcacaatcttggctcactgcaacctccgccttcccggctcaagtgattctcttgcctcagcctcccgagtagctgggattacaggcgcccaccaccacatccagctaatttttgtatttttagtagagatggggtttcgccatgttggctaggctggtctcgaactcctgacctcaggtgatccgctcaccttggccttccaaagggctaggattacaggcgcgagccaccacacccagcttaaatatttactgaaaacactgcctgtaagaacacaattttaagaggtagaaaacagtactcctttaaaagcatatcgctcgagtggcaatccaatctaccttttccttgtattgtttgccataggttttcttccagagatgccagtggtgatccagggtaggatctttatgcaactgtgccactgcagaggagcacaccaagagcacacaaaccagccgtttcattctgtgtaaggaaaggtaacataggaagtgttgctattagctgcatatgttgtgaccacatgttttcataagagaaaataacaatgcaaagtctatcaaagggacagactattataaacagaattatacaggaaaattcctgggatatatagtcacagggaacagctgcagatttatgtcagaaatactacttccaatgcttagtagcactttaaaaagtgatttccaggaatttcccaatatctggtaaaccaaacacatctagagggttagaaaacagggactttccaggatttgccaacaaatctaatcaaaggaaatctctttctctctctctcaaaaaaaaaaaaaaatcatccttaagagagacaaacctctgaaaaatcagtttatctcctgaatttttgaatacatgggctcttcttaactgacctgtttaaatatccacagtctttacagatagttaaaagacaattctcatctattgctttcacatctttaggtaggtaattttcctttttacgtttttttttttttaatgatcagacatctgtttcaaatgaggcaattaactactctttaaaatgccacttctgtatttaattcaagagacatcaacagaaattcagcgactagctccctcaaactggattctactttcttttccatttctttttaattgaaaacatctggaattttaaacatgtaagcctttaaattatattccaaagaaagccatgtttcagtctcaacttagatgcttagatgctcaagcagacattaactttttaaaaatagagaagaggcaaattgaacgacacgattttttagtttacttcctgaaaccaaagatttaaaacctagcaggcagaacaagttacaaacacagagtgtttgaagaccaaatgggagaaaaagaacaaagagtacatacgtgatagaaccagcagttgctcccacagtaagagtccttgaattagtgggctctcttctaagatttcaaagcaacaaggagatttcagttcaattgacttgaaaagaaattggaacttgtcacatgaggtactcaaaatgaggaagtgaactttcatttcagtttcatttaaaatctagctagtacagtcacctctagtcatttccctatggtcttggggacaaagtggatacagtaagccatcaagaagagcccttgtctgagcccagtggctcatgcctataatcccagcactttgggaggctgaggcgggaggatcacttgaggccaggagttcaagaccagcctaggcaatatagtgagaccctgtctctgcaaaaaaattttttttaattagctgggcatggtggtgcatgcttgtagtcccagctgagggggagggtgaggtgggagaattgcttgagtctaggaggacaaggctgcagtgagccatgattatgccactgtgtttcagcctggatgacatatcaagaccctatctcaaaaaaaaaattaaattgaattttaaaaacaccaacttttacatggaaaacatttagttataaagagatttagataaagctccccaaatcccagctccttgtatgatttcctaggaaaacctgtcttactgcttttaacacaactcattcatgatctgatattgtctggttctcactcagccattccttcgttcatcaaactcaaaatgtctttattaatatatactatatgtatagtttagtaatatgcgtgtgtgtgtgtgtgtgtgtgtgtatgtgttagtatattcatggaaaaaaggatacactcaaatatatccaattgagaatgattacctgggtggggtgggagcaagacgaactatcatcttttaaatttgcattttcctaattactaatgaggttgaggatcttttcacacatttattgaccgtttgaattttctgtgaatttcctgttcatcttttttgctcatttttctattgtattgttgcattttcttagtgatttgtgggaggtgtgtgtgtgtgtgtgtgttgtgtgttttccgagacggagtcgtgctttgtctcccatgctggagtgcattggtgcgatcttggctcactgcaacatccacctcccaggttcaagcgattctctgcctcagactcccaagtagctgggattacaggcacctgccagcatgtccagctaatttttgtatttttagtagagacagggtttcaccatcttggccaggctggtcttgaactcttcacctcgtgatccacccgcctcagcctcccaaagtgctgggattacaggtgtgagccaccgtgcccggccaaggtgtatgtgttttaaaaatatattctggcttctaatctttgacagttatatacccttaaaaacatcctcccttagtcttccacttgtcttttattttattttttcttcctttgcataagcctatgaaattccacttgtcctttagtcttgtttatagtgagtttttctatatgaaatttttttatgttgaggtagaacattttattcagcttttccgtataatcaatctatactgtttttgtataagaaaattttcctcatccaaatgtaataaagatacactcatcttatttttatactttcagagagtgttttatttatcttttctatggctactgcttttaggtgtttaattcacctggaatttagttttgtgtatggtatgacgtagggagcttattttctttgttttccaattttgattctacctctattgtacaccaaattctcatacatagataggtcagtttctgagctcatgaagctgttctttttatcttttgctacttcagtatcacacagttttaattaaaacagctttgtaatatgtctccacgtatggtaaggcaagtcatctaggccaccctatctttgttcttctttttaaacattgtctttgtattttgtacttgttaactcttctttatatgaattttttgaatcagtttatcaagttccctgaaaaactctgttggagttttttgcttttttcttttggagacagggtttcattctgtcacccaggctggagtgcagtgatgcaatcatggctcactgcagccttgacctcctgggctcaagtgatcctcccgcctcagcctctggagtggctgggactacaggtgcacaccaccatgcctggctgattttgttttttgttttttgtagataaggggtttcaccatgttgcccaggctggcctcaaactcctgggctcaagcaatctgcccaccttggcctcctgaagtgctgggattacaggcatgagcccccacatctggctattagagtttttatttgaatatatgcataaatttagggagaagtaacatcattataatgttgattcatctcagctgtagtagacatgtttgtgtttgtagccatacagttttttttaaaaagatactgcttatggaaaatttaaaacacatgtaaaagtaaaaatagtagtaaaatgagctgccgtgaaaccattgtcttgtttcaacaatgatcagtacatggccaatcttattttatttatattcccactctcactacctgaattatattaaataaattctagacattctgtcatttcatacgtaaatgtccctgtgtgtgtctttaaaagacagagactattaaacaaatataataccacaataccatcatcacatctaaaataaatgaacaataattttcttttttttttttttctgagacagagtctcactcacttgcccaggctggagtgcagtggtgtgatcccagctcactgcaatctctgcctgccgagttcaagcgattctcctgcctcagcctcccaagtggctgggattacaggcatgtgccatcacacccagctaatttttgtatttttagtagagatggggtttcaccacattggccaggcttgtctcgaactcctgaccataggtaatctgcccacctcagcctccctaagtactgggtttacaggtgtgagccactttattgtcataagaaattaagacaataatttcttaatgtcatcagacatcctatcaatgttcacattttctggactgtcttatacattttttaatagtttgtttgaattgagatttaaataagctccatatattgtgaaaccattgagttatgtttatatcattatgaattcatggatttaaacatatttgatgtgtttcaatccattccagttttatccttattgatactcatattgtctcatttttggtctgtaggaatttattcaaactggctctttggtgcagacagagtttgtatatttggcataatattagtactctttaaaagcttcctttctttctaatatgacaggctattgcaggtttgtcttgaacaattcctgccccagacctggaatcagccatttctccaaggagctctggttccttttagtggaaacaatgtttaaataccataatctaggaactagcagtgtttgggatagcagattgaccattgttgctaagccttttcagtagctagagctaagaaatatcttttttaaaaaaattaaataaatcacaagctgacactgatacttcaaattcaaattcaagactatagggtttactcaccccatcaatcttatatctgcacttcttttcaaacatgcttaaaaaatctgggttctctaaaatatcaactcaagtacttgtttaatttatcctgtaaaattgcagaataacaacaacaagcctacgccaataagattgttaatgaaaacaaattagaggttttaaagtggagggggacaggtttttctccattaagccaaatgtcgctaacgatgtaagtcaattactgtgttttgaagtcacctggaatagttccctgtatggttatgctccacctccatacacaggtttatttgtttcatttcacttcttccttttagggcttgctttttacacttatgtaatttcattttataattatgtaaaacatttatgtggatccaaagtgaaatcatcacaatgaggtatattcaaagaactctagcctctacttttgtctgttttacacgatttccttttttccttaattggtaatcatttaaaaaatttatggtttatcttcctatttttagaaatatgcaaatatgcctatatattaatattctttcatcttaagtgaacactaacatattacacatatttttctctatcttgtttttttcacttagcattttttttgttttagtcaatcacttaacattttattaagaaaaattattcaggcgaaagacattagcaggtgtcctttcagtgatgtgctgggtattatttagtggacctttacaggaattgtttgattctttttagagttaagttgtaaaaaactgataactatgcaaatgatccctatacatggcaatgcaaataaattttgtattgtagatttcactgaatagagaaatagagaatgtagatctctgtcagtcgaattcttttttttttttttttgagacacggccttacttcatcgcccacgctggagtgcagtggtgcgatctcagctcactctaacctccgcctcccggatttaagcgattctcctgcctcagcctccccagtagctgagattacaaatgcacaccaccacacccagctaatttttgcatttttagtagatacagggtttcaccgtgttggccaggccggtctcgaactcctgacctcaggtgatccacccacctcggcttcccagagtgctgggattacaggcatgagccaccatgcccggcctcaaattcttatttgaactgactttaatcttactgatcccttattaattaatgagttaaacttcgatgcgttcgttgtatatttgctctcagctttttagaaactatactttagcaattaaattctgataactccacagtagtatatacagtgttcatttatttttatggccacctagcatcttttgaacaatattcccatgtttggagaatttcccacgttataaattttgcttctccaagttgaagccaaagctccattttcaaggatccagtgcagttaaggcacagacatgagacctagcctttgccagtcaggcacacctgtatagaacatcattttgcaagtgggtaagtgaggaaccagaagtatgtaaaatcctccttttggtgagaatggcagtagagatgtctcccagcagcagcagcaccagcaggagcaggagcagcagcagatattctaatatctggtccccagtgtcacctgttcaaactgtagtgtttatgtcaaatattgtgtctgctcagtggcatcataggttgagcagtcctctctgtggttttggtgatgtttgtggttacacaataaacaaacctcaccgactttctggcctttcataggttctttgagtttccggcactttttttttttttttttgagatggagtttcactcttgttgtccaggatggagtgcaatggcatgatctcggctcactgcaacctccgcctcccgggttcaagcgattctcctgcctcagcctcccaagtagctgggattacaggcatgcgccaccacgccaggctaattttgtatttttagtagagacagggtttcgccacgttggccaggctggtttcaaacccctgacctcagatgatccgcccgccttggcctcccaaagtgctgagattacaggcgcaagccactgcgcctggctgcttcctgcacattttaaataaactgtagtacccggatagatgaacctagtattgacatccacagccgtgttgagtttggaaaaacaagggtggagtgtcagaagctagaatggggaaggtgcttttctcaggctgcgaatacaggaaactcaagaagaaagctattgtggagctctcaataatttcaggttgccttctctatccttctttacacatctgatctcatacctgatgttttttgcttttagccttgatacctctatatgtatttctatccatagaaatagacagttcaatttccttaatgagaaattagcataggaacaaatttctttccatcaagattaaatggtagacaactgcttttacaagggaccatgtatttttccagtcattgtttctctgtctgacgaggtctataaatctacactcagtacagagcataaacgtggtgattaggcaacagcacaccttctgtctccattcctgggtattgcctacatggaattgtgtatgaaattatgtctctacctgtttccggtaatcctctaccaagtgggaaaaaattttggggttaattgtgttttctagtggtactctaaaccggattcaggacggcagcggccatctaaatgtcttcctttgtttatttctaaatccataaattaattccagatttaccaagaaactaaattgagttgatcccaaaatgaaacagggctctcagggacatactcacttcttcccagcctgcctttggactcagtaagtaagcagagactgtgtttatttgtctgatatacatgacccctggttaatatgtaggtcgtagaagaaaccaaaattttacttatggaaggcagggagaatagagatgaattaccttttgtgagaaaaagaacaagtgacatattaactgctattgtattttctgttgtcaggacgtgggctgagtaaaaagcttaaaagcttttgcatatgtcttggttctgccatctattggttataaggcctggaacaagtgatttaacatgcccatggctcactttccctatgcataagtacggaaatgctgacttagtggcaactaaacagtggaagacaccagcaatagaatgtaattataatatcgctccatgagatggtaagattttacagttccaactaattattcctgagtccgttccttttgcagaacaagtttctaataaagtactcaggattaagatagatggttatgagcaagtgctaccatttaggatattcatttgaaatactaatgctcctggcattttttttttttttttttttttttgagacagagtctcgctctgtcacccaggctggagtgcagtggcgtgatctcagatcactgcaagctctgcctcctgggttcatgccattctcctgcctcagcctcccaagtagctgggactacaggcgcctgccacacgcctggctaattttttgtatttttagtagagacagggtttcaccatgttagccaggatggtctcgatctcctgacctcgtgatccgcccgcctcggcctcccaaagtgctgggattacaggcgtgagccaccgcgcccagccgcgctcctggcattttttatttttatttatttattttttttttttgagacagagccttgctctgtcgcctaggctggagtgcagtggcatgatcttggctcacagcaaactcttcctcctgggttcaagtgattctcagcttcctgagtagctgggattacaggcatgccaccatgcctggctagtttttgtatttttagtagagacggggtttcgccatgttggccaggctggtctcaaactcctgacctcgggtgatccacccacctcagcctcctaaagtgctgggattacaggcatgagccaccatgcctggccaagaaaaacatctttaatacaaaaacacagaaaggttgacaataataggaagctaaaagctagatcacacaaacgcaagcaacagcaaaatgtgggtataattattcaaatatcagtcagagtagactttaaagcaagaagcattatgaggctaaagagggaactttcataatgataaagaaataaatgataaagggacccgccaggaagagattataatcttaaatctgtatgctcctcaaaacatggcctcagagtcccataaagcaaagattgccagagctaaaaggaaaaatagataaaatctgcaatcataatgggaggctttgagatacctctttcaatagcttgtagaataagcaaatggaataaattaatagcgatatagaagattcgaataatgcgattaatgaacttgtcctaattaagatatctagagcctgtcctcaacaacagaatcctttttttttttttttctttttttttcacccaggctggagagcagaggcaggatcacggctcacggcagctttgaactgctgggcccaagtgatcctcccagctcagcctcccatgtagctgggaccccagccccaagccactgcactggcctcagaatatttattttgaagggcacatagaatatttaacaaaattgactctgtatgtgctgggccataaaatattcaagtcatttagagtatgttctctgaccacagtgagattaagctaggcccaataacaaaaatgtaattagaaaacctcccatttaagtgatatacttcttaataaccatggttattaagaagaagaaatcataatggcaattagaaaatattttgaactgagcaataatttttaaaaatgacatataaaaatgtgtgagatccagctaaaccagtgcttagaaagaaatttataactttttaatgcatatattagaaaagaagaggccggcgcggtggctcacgcctgtaatcctagcactttgggaggctgaggtgagcggatcacgaggtcaggagattaagaccatcctggctaacatggtgaaaccccgtctctactaaaaatacaaaaaaattagccgggcatggtagcgggtgcctgtagtcccagctactcgggaggctgaggcaggagaatggcgtgagcctgggaggcggagcttgcagtgagccgggatcgcaccactgcactccagcctgggcgcgagcgagactccgtctcaaaaaaaaaaaagaaaaagaaaagaagaatggctaagaatcagtggtctaagctgccacctcaagaagcaaagggaagaacatcagagatgttttgatgttctctatttcccgccctttttttttgtttgagatggagtctggctctgtcgcccaggctggagtgcagtggtgcaatcttggctcactgcaacctacatctcctgggttcaagtgattcttctgccttagcctcccaagtagctgagactacaggcgttcatcaccacacccagttaattttgtattttaagtagagatgggggggggagttctccatgttcatcaggctggtctcgaactcctgacctcagttaatccactcgccttggcctcccaaagtgctgggattacaggcgtgagccaccgcgcttggccatcttttggactaaataaagactgttgagctactctggcagtactctttttagaaaagcacttgcagcaaaattgtgctttcaataaatgatattaaattgtgcattttatctttgaactctcaaactctgttattctttttcaaaataggaagtttctagcaaatatggaaaagaggaaatacccaaatcgatatgttttaatgaattaaatacagatattatgcatcttctgtgccaggcattgtacagggcactgaagatctttcctgcccattattttatttgatcctcccaacaacatatgaggtggtagtggtagcaatagtatccctattctatagtttaggaaactgggacttagaaagccttgtctaaaaccattgtggaaataagtggtggaactgaaacttgaagtccacaccaacatccttgatgcctgggctagatattgtatttcataccaggctggagcagcggtgtctcagagctggcttgtattgacactcgttcacgaaagctgcttatacccacttcatcctcactccatctttagtagcattgcattggtagcttaaaataagcaaactctacaaatcaggtctcccttattttattttattttattttattttatttatttttttgagacagagtcttagtctatcacccaggctgaagtgcagtggcgtgatcttagctcactgcagcctccaccttccaagttcaagtgattctcctgcttcagccgcccaccaccatgcctggctaattttttt
